United States Patent 8,952,217 (PROCESS FOR DECREASING VERBASCOSE IN A PLANT BY EXPRESSION OF A CHLOROPLAST-TARGETED FIMD PROTEIN) - sequence listing, part 3

SEQ ID NO: 3405 - DNA, 1560 bp, Leifsonia xyli
  CDS (1)..(1560)
atgatcgccacatccagcggtacaaccagccgcgagaagttcgacgcactgaccggcgcacaccgggtgatccccgtcgtgcgcgaactgttcgcagacggggagacgccggtcggcatctaccgcaagctcgccgccggccggccgggcaccttcctgctggaatccgccgagcagggcggtatctggtcgcaattctcgttcgtcggagccgcctcgttcggcgttctgacccagcaaggggaggaggtccgctggctcgactacggactctccgccgagcgcgcgctcggccccgacgcggctggccccgatgcgtctggccgtccactcgacgctctcgcggcgctgcaccggcgctggcagtcgccgcgcatccccggcctgcccccgctgaccggggggctcgtgggcttcatcggctgggaggcgatccgccagatcgagcggctgcccgaccagccgccagcggactacgatatcccgggccaggccctcgctttcgcggccgacctcgtggcgatcgaccatcgctccggcacagtgctgctgatcgcgaacgtgctggccgatggtgtcgacgacgccgacgcgctctgggcggatgcgcagtcccggctcgatcggatgcagggcgagctggcgcagccggcggaggcgtggctcgccgaggtggatctcgctgtgcctgtgcatccccctgtctctcgcacggccaagccagacttcctcgcggcggtcgaggccgccaaggagaggatcgtcgccggggacatcttccaggtcgtcatctcgcagcgcttcgaggtggcctgcgaggccggcgcactcgatgtctaccgtgtgctccgggcgctcaaccccagcccgtacatgtacctgctggcgctggagcggcccgatggcggcgtctacgagatcgtcggatcgtccccggaggcgctggtcaaggtgcgggagggacgcgcgttcacgcaccccatcgccggttcccgcccgcgcggggccacgccggaggaggatctcgacctcgaggcttcgctcctcgccgacgacaaggagcgcgccgagcacctcatgctcgtcgatctggcccgtaacgacctgttgaaggtctgcgcggccggcagcgtcgaggtgacggagttcatgcgcgtcgagcggttcagccacatcatgcacattgtctcctccgtcgagggcgatctcctgccggacgccagtgcgctcgacgtcttccgtgccaccttcccggcggggacgctctccggcgcgcccaagccgatggcgctgtggatcatcgacgagctggagcccgcgcagcgcggcgtttacgggggagtggtcggctacttcgacttcgccgccgacgccgatctcgcgatcgcgatccgcacggcgacgatcatggacggtgtggcgcgtgtgcaggccggcggcgggctggtcgccgactccgttcccgagtcggagttcgaggagtcgcagaacaaagcggcggcgccgttgcgggcggtggccgtcgccaatgcactgagacgggtgcagggtgcggactga

SEQ ID NO: 3406 - protein, 519 aa, Leifsonia xyli
MIATSSGTTSREKFDALTGAHRVIPVVRELFADGETPVGIYRKLAAGRPGTFLLESAEQGGIWSQFSFVGAASFGVLTQQGEEVRWLDYGLSAERALGPDAAGPDASGRPLDALAALHRRWQSPRIPGLPPLTGGLVGFIGWEAIRQIERLPDQPPADYDIPGQALAFAADLVAIDHRSGTVLLIANVLADGVDDADALWADAQSRLDRMQGELAQPAEAWLAEVDLAVPVHPPVSRTAKPDFLAAVEAAKERIVAGDIFQVVISQRFEVACEAGALDVYRVLRALNPSPYMYLLALERPDGGVYEIVGSSPEALVKVREGRAFTHPIAGSRPRGATPEEDLDLEASLLADDKERAEHLMLVDLARNDLLKVCAAGSVEVTEFMRVERFSHIMHIVSSVEGDLLPDASALDVFRATFPAGTLSGAPKPMALWIIDELEPAQRGVYGGVVGYFDFAADADLAIAIRTATIMDGVARVQAGGGLVADSVPESEFEESQNKAAAPLRAVAVANALRRVQGAD

SEQ ID NO: 3407 - DNA, 1545 bp, Debaryomyces hansenii CBS767
  CDS (1)..(1545)
atgttttctaaaattcaaccatcgcttgaagcattgacttcaattgttcaatcacatcaagatgatgaaaataagcctaatttgtatccaatttacaaatatgttacagcagatgatttgactgttcataaagcatatttgaaattagcaaaattgaacgacccaaagagatcaccatcatttttatttgagtcggcagttaacggtgataccgttgatagatactcgtttattggtctcaatccaaggaaagtgataagaactggtgaagacgaaagattattccctaaagagcattgtaatgttgatccaattaccatattagaaaaggaacttgcaaagtataatcaaattcaattaccgggattgccaaaatttagtggtggtgcagttggttacatttcatatgattgtattaaatacttcgaacctaagactcgtaagcccttagaagatgtattacagttaccagaagctgtgttaatgttatgtgatttaattgttgcattcgaccgtgtttatgatagatttcagatcatcaataatgtggcggttactgattcaaatgatttacaagcaagcttcaataaagctgccgaagcgattgataatgtggaaaagattttaagatccgaatctacaccagaagaaataaacccaaaacaacctccaatcaaggctaatcaaacgttcacatcaaacataggtcaagaaggttacgagggccatgtttcgaccttgaagaagcacatcttaaaaggtgacatcatccaggcggttccatctcaaagggttgctagacctacgtcattacatccattcaacatatatcgtcatttaagaactgtgaacccatcaccatatttgttctacatagatcttattgattttgagattatcggtgcatccccagagcttcttgtgaaagcggatgaaaagggtaaggttgtgactcatccaattgccggaactgtgaagagaggtaaaactaacgaagaagatgaagcaaatgccgaaattttaagatcgagtttgaaggacagggcggaacacatcatgttggtggatttggcccgtaacgacataaatagaatctgtacgccggaaagcaacaaagtagaccgtctcttgacaattgaaagattctctcacgttatgcatttggtatctgaagtgagcggtaccttgagatcggataaaacgaggtttgatgccttcagatctattttccctgctggaacagtaagtggtgcaccaaaggttaaagccatggagttaattggtacactcgagaaagagaagagaggtgtttatgcgggtgctgttggtcactggggttatgatggtaagaccatggacacttgtatcgccttgagaaccatggtttacaagaatggcattgcatatttgcaagctggtgggggaattgttttcgacagtgatgaatatgatgaatacgtggaaactatgaataagatgaaggccaacaatcagaccattattgatgccgaaaaggtttggattgaaaaagttggacaagaatag

SEQ ID NO: 3408 - protein, 514 aa, Debaryomyces hansenii CBS767
MFSKIQPSLEALTSIVQSHQDDENKPNLYPIYKYVTADDLTVHKAYLKLAKLNDPKRSPSFLFESAVNGDTVDRYSFIGLNPRKVIRTGEDERLFPKEHCNVDPITILEKELAKYNQIQLPGLPKFSGGAVGYISYDCIKYFEPKTRKPLEDVLQLPEAVLMLCDLIVAFDRVYDRFQIINNVAVTDSNDLQASFNKAAEAIDNVEKILRSESTPEEINPKQPPIKANQTFTSNIGQEGYEGHVSTLKKHILKGDIIQAVPSQRVARPTSLHPFNIYRHLRTVNPSPYLFYIDLIDFEIIGASPELLVKADEKGKVVTHPIAGTVKRGKTNEEDEANAEILRSSLKDRAEHIMLVDLARNDINRICTPESNKVDRLLTIERFSHVMHLVSEVSGTLRSDKTRFDAFRSIFPAGTVSGAPKVKAMELIGTLEKEKRGVYAGAVGHWGYDGKTMDTCIALRTMVYKNGIAYLQAGGGIVFDSDEYDEYVETMNKMKANNQTIIDAEKVWIEKVGQE

SEQ ID NO: 3409 - DNA, 1524 bp, Yarrowia lipolytica CLIB99
  CDS (1)..(1524)
atgatccaactcagacccactctagaggctcttcagaccatcgtggccgacaaccgagccgccgccaccaaggagactcttcccgacaacctctatcccgttttcgcctatgtggatgctgaggccctgactcctcatactgcctacctcaagttggctcgtctggatgaccccaaccgaagtccctcgttcctgttcgagtctgccctcggtggtaagcatctgtcccgatactctttcattggatctaatccccggaagatgatcaagactggtgctccccatggacctgacgttgatccgctcaacctgctggagtctgaactcgaccagtaccgacagttccagacccccggcgtccccactctttgtggaggagccatcggatacatttcgtacgactgcatcaagtacttcgagccccgaaccaagcgagatctcaaggacgtcctggaggtccccgaaagtgccctcatgctctacgacaccattgtggcctttgaccacgtctaccagcgactccaggttatcaccaatgtcaaggttgaggccgacaccgatctcaccaaggcctacgaggacgccaagaaggaggtgcagcgaatcgcagacctgctgacttcccctgaggttccccagcccccccagggacccgtgacccttggaaagactttcacttccaacattggccagaagggttacgaacagcacgtgaccactcttaaggagcgaatcaagaagggagacatcatccaggccgtgccctcacagcgagtagctcggcccaccgacctgcatcccttcaacgtctacagacacctgcgaaccgtcaacccctctccctacctgttctacattgactatcttgatttccagcttgttggtgcttctcctgagctgctcgtcaagattgagaacggccgaattgtgtctcatcccattgctggaacggttaagcggggagctactcctgccgaggataaccagctggctcaggagcttctcaactctgagaaggaccgagctgagcacgtcatgctggtcgatttggcccgaaacgatgtcaaccgagtatgtgatcctcgatccacttccgtcgatcggcttttgggtgtcgaaaccttctcgcacgtccagcatctcgtttcccaggtgtctggtgttctgcgacccgaccagacccgattcgacgccttccgatccattttccctgccggaaccgtttctggtgcccccaaggtcaaggccatggagctggttggagagcttgagaaggaaaagcgaggtgtctacgccggtgccgttggatctttcggctacaacggagaggccatggacacttgcattgctcttcgaactatgcttctcaaggacggtgttgcgtacctgcaggccggaggaggcattgtcttcgattctgacgagtacgacgaatatgtcgagactatcaacaagatgatggcaaacaaccggtgtattgtcgaggccgaggagatctgggctggacagcagaagggtgagtag

SEQ ID NO: 3410 - protein, 507 aa, Yarrowia lipolytica CLIB99
MIQLRPTLEALQTIVADNRAAATKETLPDNLYPVFAYVDAEALTPHTAYLKLARLDDPNRSPSFLFESALGGKHLSRYSFIGSNPRKMIKTGAPHGPDVDPLNLLESELDQYRQFQTPGVPTLCGGAIGYISYDCIKYFEPRTKRDLKDVLEVPESALMLYDTIVAFDHVYQRLQVITNVKVEADTDLTKAYEDAKKEVQRIADLLTSPEVPQPPQGPVTLGKTFTSNIGQKGYEQHVTTLKERIKKGDIIQAVPSQRVARPTDLHPFNVYRHLRTVNPSPYLFYIDYLDFQLVGASPELLVKIENGRIVSHPIAGTVKRGATPAEDNQLAQELLNSEKDRAEHVMLVDLARNDVNRVCDPRSTSVDRLLGVETFSHVQHLVSQVSGVLRPDQTRFDAFRSIFPAGTVSGAPKVKAMELVGELEKEKRGVYAGAVGSFGYNGEAMDTCIALRTMLLKDGVAYLQAGGGIVFDSDEYDEYVETINKMMANNRCIVEAEEIWAGQQKGE

SEQ ID NO: 3411 - DNA, 1527 bp, Kluyveromyces lactis NRRL Y
  CDS (1)..(1527)
atggcttctgatcatattactattcagccatcaattgaggtgattaaagaatgcatcgctgctaatgatgattccatcaatatgtacccagtataccacttcatgccagcaatggaccttacacctcatgtggcgtatttgaaaatgagtgagttgaacaataaggagaggtcaccatcttttctatttgaatccgcaaacggtaaccaattgagtcgatactcgttttttggtcatagtccacgtaagattatcaagactggtcctactgaaggtcaagcgtgtgacccattgaatattctacaagacgaattggctcagtatcgattggctgaaaatgttccaggcttacccaagctttctggtggtgctattggttatgtttcttacgactgtgttcagtattttgaaccaaagacgaagagaccattgaaagatgtgctacaagtaccagaatctgctttgatgctatacgataccattgttgcatttgatcatgttttccaaaggttccagatcataactaatatcaatgtgaagacggtctcatctttggaacaaggttacgaagatgcatctgagattatcaaacgcattatcgccatcttgaaggatgaatctagtccgataccattacctgaacaaccatcaatcaaattgaaccagactttcacatcaaacattggtcaagaaggatacgaacagcacgtgagagatttgaaagaacatatcaagaagggtgatatcatccaatgtgttccatctcaacgtgtcgctagaccaacttcacttcacccattcaatatctacaaacacttgcgtactgtgaatccctcgccatacttattctatatcgattatttggatttccaaatcattggtgcttcacctgaattgttatgccaagttgatgccaaaaacgaagttatcactcatcccattgctggtacagtcagaaggggtcagactccagaagaagatgacagattagcggaagagttgagaaattctactaaggacagagcagaacatgtgatgttagttgatctagcccgtaatgatgtgaacagggtctgtgatccaaccaccacttccgtggatgagttactttcagtgcaaaagttctctcacgtccaacatcttgtctctcaagtcagtggtacactaaggaaggatcaaaacagatttgatgctctaaggtctattttccctgcaggaacagtttctggtgctcctaaggtcaaggccatggaattgatcggagaactggaaggtgaaaaacggggtgtttacgctggtgccgttggacactggtcatatgacggaaaatccatggacacatgcattgccttgagaacaatggtttataaagacggtatagcctatttgcaagctggtggtggtatcatatttgattctgacccatatgatgagtacgtagaaacaatgaacaaaatgaaagctaaccacaatactattctacaagcagagcaaatttgggctgagaaagttggcactcaagactag

SEQ ID NO: 3412 - protein, 508 aa, Kluyveromyces lactis NRRL Y
MASDHITIQPSIEVIKECIAANDDSINMYPVYHFMPAMDLTPHVAYLKMSELNNKERSPSFLFESANGNQLSRYSFFGHSPRKIIKTGPTEGQACDPLNILQDELAQYRLAENVPGLPKLSGGAIGYVSYDCVQYFEPKTKRPLKDVLQVPESALMLYDTIVAFDHVFQRFQIITNINVKTVSSLEQGYEDASEIIKRIIAILKDESSPIPLPEQPSIKLNQTFTSNIGQEGYEQHVRDLKEHIKKGDIIQCVPSQRVARPTSLHPFNIYKHLRTVNPSPYLFYIDYLDFQIIGASPELLCQVDAKNEVITHPIAGTVRRGQTPEEDDRLAEELRNSTKDRAEHVMLVDLARNDVNRVCDPTTTSVDELLSVQKFSHVQHLVSQVSGTLRKDQNRFDALRSIFPAGTVSGAPKVKAMELIGELEGEKRGVYAGAVGHWSYDGKSMDTCIALRTMVYKDGIAYLQAGGGIIFDSDPYDEYVETMNKMKANHNTILQAEQIWAEKVGTQD

SEQ ID NO: 3413 - DNA, 1455 bp, Erwinia carotovora
  CDS (1)..(1455)
atgactgccgccaatacgactcacgtcactcatacaagagattctgcaaacgattcggccaccgcgacaggctccgccgttctctatcacgcgctgccttactacccgaacgtattgctcgatcgctttgcgcccttttctcaacagccgtgggctatgttgctgcattcggggtttgccgatcatccgcacaatcgcttcgatgtcatggtcgctgacccgcgagtcacgctatgcacgcgggggggcaagacggaaatcacaagtgacggcgtaacgaatacagtagagagcgatccatttactctgctgcagcaacagttggatgcattggcgctacccaccgaaacccaccttgatttcccttttcaggggggcgcacttggcctgttcggctacgatttggggcgtcagattgaaacgttgcccacacaggcagaacaggatatcgacctgccagacatggcgattggattatacgactgggcgctgattgccgatcatcaccggcaaacactaacgctgatcgtacatcattctcttcaggcgcgacttgactggttagccaacccgcccgttaacacgacgaaagtcggtttcaacctcaccagcgactggcaaccgaatatgtcacgcgacgcatacggtgaaaaattctgcaaaatacaggactatcttctggcgggcgattgctatcaggtcaatctggcgcagcgtttttctgccgcttatgcgggcgatgaatggcaggcgtttgtacaactgtccgcaggaaataaagcgcccttttctgccttcctgcgcctgccggaaaatacggtaatcagcgtgtcgccggaacgctttctctggctggaaaacaatcacattcaaacgcgcccgattaaagggacattaccgcgcctcgcagacccggatgctgataaacagcaggcagtacggctcgcaagttccgagaaagatcgctctgaaaacctgatgattgtcgatctactgcgcaacgatattggccgcgtcgcggttccgggcagcgttcgtgtacctgagttgttcgtcgtcgaaccttttcccgcggtacatcatctagtcagtacgattgaagcacagctaccggaagattgccctgccaccacactgctacgcgcctgtttccccggaggatcgattaccggcgcaccaaaaatccgtgctatgcagattattgaagaactagagcctcagcgccgcaatgcttactgcggcagcctcggttacattagcctgtgtggaaccatggacactaacatcaccatcaggacgttattaaccgaacacggcagaatttactgctgggcgggtggcggcatcgtcgccgatagccaggaacaggctgaatatcaggaaacgtttgataaagtgggccgcattctccccctactggaggattcccaaataactcaggtaccgagtaaatga

SEQ ID NO: 3414 - protein, 484 aa, Erwinia carotovora
MTAANTTHVTHTRDSANDSATATGSAVLYHALPYYPNVLLDRFAPFSQQPWAMLLHSGFADHPHNRFDVMVADPRVTLCTRGGKTEITSDGVTNTVESDPFTLLQQQLDALALPTETHLDFPFQGGALGLFGYDLGRQIETLPTQAEQDIDLPDMAIGLYDWALIADHHRQTLTLIVHHSLQARLDWLANPPVNTTKVGFNLTSDWQPNMSRDAYGEKFCKIQDYLLAGDCYQVNLAQRFSAAYAGDEWQAFVQLSAGNKAPFSAFLRLPENTVISVSPERFLWLENNHIQTRPIKGTLPRLADPDADKQQAVRLASSEKDRSENLMIVDLLRNDIGRVAVPGSVRVPELFVVEPFPAVHHLVSTIEAQLPEDCPATTLLRACFPGGSITGAPKIRAMQIIEELEPQRRNAYCGSLGYISLCGTMDTNITIRTLLTEHGRIYCWAGGGIVADSQEQAEYQETFDKVGRILPLLEDSQITQVPSK

SEQ ID NO: 3415 - DNA, 1563 bp, Erwinia carotovora
  CDS (1)..(1563)
atgcaaacaacacaacctaaactggaactgctgcgtattgaggccgtttaccgtaacgaccccagcgccatcttccatcagctctgcggtgccagaccggcaacgttgctgttagagtcggctgaaatcgacagcaaggaaaacctgaaaagcctgttgatcgtagatagcgcactacgcatcaccgcactgggtcagcacgtttccattcaggcactcacggcaaacggcgccagccttctgccgcttctggatgccgcgctgccagtggagattatcaatcagccgcgtccgaacggtcgtgaactcacgttcccactggcagacgccatgcaggacgaagatgctcgcctgcgttcgctgtccgtgtttgacgccttacgtcagattctgacgctggtcgcctgcccgatagatgagcgtgaagctatgtttctcggcggcctgttcgcctacgatctggtcgccgggtttgaagaattacctgcgctgaaccagcagcagcgttgcccggatttttgcttctatctggcagaaacgctgctggtgcttgaccaccaaaaacgtgtgaccgctctgcaagccagcctgtttacaccgaaccatagcgaaaagcagcgtctgcaacagcgtctggaacagctgcaacttcagctcactcagcccgcgcccgcgctgccgcgtcagtccatcgaagacatgacgctgagctgcaaccagagcgatgaggctttcggggaagtcgtcagccagatgcaggaagctatccgcatcggtgaaattttccaggtcgtgccgtcacgtcgtttctctctgccgtgtccttcaccgctggccgcctaccaaacgctgaaggatagcaatcccagcccttacatgttttacatgcaggatcaagacttcacgttgttcggtgcctcgccggaaagctcgctgaaatacgatgcagacagccgtcaaatcgaaatctatccgattgccggtactcgcccgcgcggtcgccgtgccgatggctcgctggatcgcgatctcgatagccgtattgaactggaaatgcgtaccgaccataaagagctggctgagcatttgatgctggtagatttagcccgtaacgatctggcgcgcatctgtcagccgggtagccgttacgttgctgacttgaccaaagtggaccgctattcctttgtcatgcatctggtctcccgcgttgtggggacattgcgtgaagatttagatgtgctgcacgcctaccgcgcctgcatgaatatgggcacgctaagcggcgcgccgaaagttcgggccatgcagctgattgccgaaagtgagaaaacccgacgcggcagctacggcggcgcggtgggctacttcaccgctcacggcgacctggacacctgcatcgtcattcgctccgcctatgtcgaagacggtattgccactgttcaggccggtgcgggcgtggtgctggattctaaccctcaagccgaagccgacgaaacacgcaataaagcccgggccgtactgcgagccattgccagcgcgcaccatgcaaaggagattttctga

SEQ ID NO: 3416 - protein, 520 aa, Erwinia carotovora
MQTTQPKLELLRIEAVYRNDPSAIFHQLCGARPATLLLESAEIDSKENLKSLLIVDSALRITALGQHVSIQALTANGASLLPLLDAALPVEIINQPRPNGRELTFPLADAMQDEDARLRSLSVFDALRQILTLVACPIDEREAMFLGGLFAYDLVAGFEELPALNQQQRCPDFCFYLAETLLVLDHQKRVTALQASLFTPNHSEKQRLQQRLEQLQLQLTQPAPALPRQSIEDMTLSCNQSDEAFGEVVSQMQEAIRIGEIFQVVPSRRFSLPCPSPLAAYQTLKDSNPSPYMFYMQDQDFTLFGASPESSLKYDADSRQIEIYPIAGTRPRGRRADGSLDRDLDSRIELEMRTDHKELAEHLMLVDLARNDLARICQPGSRYVADLTKVDRYSFVMHLVSRVVGTLREDLDVLHAYRACMNMGTLSGAPKVRAMQLIAESEKTRRGSYGGAVGYFTAHGDLDTCIVIRSAYVEDGIATVQAGAGVVLDSNPQAEADETRNKARAVLRAIASAHHAKEIF

SEQ ID NO: 3417 - DNA, 1311 bp, Acinetobacter sp
  CDS (1)..(1311)
atgctccttcaacagtctgaagtgactggattagtttttttgaataataaggatcagccgattatcggatttaatcctgctacattttgtatttttcaagatcatcaacttcattactacaaaagagatgaatcaaatcaatatatcgaggatcaagataataccgagctgactgaatttatcatttttcagaattctgaatattctacaaaaagtataaatagtaaatttcagggtggttatattggattcattggctatgattatgctgcatcacaatatgtaaataccgatttctgtgtacaacctgcgctttatgtaggcaaatatctgagttacctgactcaagaaaatgacgaatggtatttttatagtcaatctccaaatgctgaaactgaatatttacaactacttagtattttcacccaacaaatttctgagaataactcaagcttctatatatcaacaccatttcaatcccgatggacaaaatcgacatatttaaaggcttttgaaaaaattcaggattacatcaaatcaggggattgttatcaaattaatttgacacaagaatttcaaacgcactgcaaaggaaatttactttcaaaagccgatcaactttgggatttaaccaatgctccttacgcaggttatttgcagataggtgattttgaattactcagttgttcgcctgagttatttatcgaatttaatgagtatcgacaaatcaagacacgtcctattaaaggaactatgccgcgttttgataatgccgagttagatcaaatgtctaaacaaaaattacaagcatcagaaaaagatcaggcagaaaatgtcatgattgtcgatctgttacgtaatgatctaagtgtctatgcagaagttggctcagtaaaaacaacaaaactttttgaaattgaaagcttcaatcaggttcatcatatggtcagtgaaatcacggccacgctcaaagctgatgttaatccttttgaggtcttactcactgctttaccaggtggttcgattactggtgctcccaagattcgagccatgcagattatagatgagcttgaaggcgagccacgtggggcttattgcggttctttaggttactttaattttgatggtacaggttgctggaatattttaattcgtagtctgcaacggtatcaagatcaactttctttatgggcaggtggtggcattaccatcgcatcaaactctgaggctgaatatcaggaatgttttgataaagtctctgccatgctgaatctaatcaatacatggcaaagcatgcaaagcacggcttaa

SEQ ID NO: 3418 - protein, 436 aa, Acinetobacter sp
MLLQQSEVTGLVFLNNKDQPIIGFNPATFCIFQDHQLHYYKRDESNQYIEDQDNTELTEFIIFQNSEYSTKSINSKFQGGYIGFIGYDYAASQYVNTDFCVQPALYVGKYLSYLTQENDEWYFYSQSPNAETEYLQLLSIFTQQISENNSSFYISTPFQSRWTKSTYLKAFEKIQDYIKSGDCYQINLTQEFQTHCKGNLLSKADQLWDLTNAPYAGYLQIGDFELLSCSPELFIEFNEYRQIKTRPIKGTMPRFDNAELDQMSKQKLQASEKDQAENVMIVDLLRNDLSVYAEVGSVKTTKLFEIESFNQVHHMVSEITATLKADVNPFEVLLTALPGGSITGAPKIRAMQIIDELEGEPRGAYCGSLGYFNFDGTGCWNILIRSLQRYQDQLSLWAGGGITIASNSEAEYQECFDKVSAMLNLINTWQSMQSTA

SEQ ID NO: 3419 - DNA, 1521 bp, Candida glabrata CBS138
  CDS (1)..(1521)
atgcagattcaaccagacttacctactcttaagggtctctatgagcagaacaatgccctggatgaagggattaacatgtatccggtgtatgcgtttctgcctgcacttgatcttactccacacgtcgcttatttgaagctggcacaattgaacaacaaggatagaactgagtcgttcttgctggaaagtgccaaaaccactgatgaattggaccgttactctttcattggtgtgtcaccaagaaagattataaagactggacctacggaaggcattgagactgatcctctagatgtattggaagaagagatgtcccagttcaagctggccacaaacgtgccaggtttaccgaaactaagtggtggtgccatcggttacatatcctacgactgtataaggtattttgagccaaaaacgaaaagagacttgaaggatgtgctacaattgccagaggcctatttgatgatgtgtgacactattatagcctttgatcacgtattccaaagattccaaatcatgcataacatcaacactaaaaagcaatctctagaggaaggttacagtcacgcagtagaaatcatcaatgacattataaagagaatgactgatgattcaaagccaataccttaccctgaacaaccaccaatcaaaatggacaggtccttccagtctaatatcggtcaagaaggttacgaaaaccacgtcggcaacttgatagaacacataaaaaagggtgacatcattcaagcggttccttctcagcgagttgcaaggccaacagacctacatccattcaacatttacaggcatctacgtacagttaacccatcgccatatctcttttacatcgactgtctggatttccaaattatcggtgcttccccagaacttctatgtaaatccgatagcaagaataaagtaatcacacatccaattgctggtactatcaagagaggtgctacaactgaggaagatgatgaattaggtaaccaactgcgtaactctttgaaagatagagccgaacatgttatgctggtggatcttgctcgtaatgacatcaaccgtgtttgtgatccaaagacaacgaacgtcgacaagttactgacaattcaaaaattttcacatgtgcaacatttggtatctcaagtcagtggtactttaagaccggacaagactagattcgatgctttcagatctattttcccagccggtactgttagtggtgcacctaaagttaaagccatggaattaatctcagaactagaaggtgaaagacgtggtgtttacgctggtgccgttggtaactggtcttatgatggtaaaactatggatacctgtattgctcttagaacaatggtttacaaaaatggaacggcttacctgcaagcaggtggtggtattgtgtttgattccgacaagtacgatgaatatatagaaaccatgaacaaaatgatggctaatcacaataccattgttcaagctgagaagatttgggctgaaaaggttggaacgactaactaa

SEQ ID NO: 3420 - protein, 506 aa, Candida glabrata CBS138
MQIQPDLPTLKGLYEQNNALDEGINMYPVYAFLPALDLTPHVAYLKLAQLNNKDRTESFLLESAKTTDELDRYSFIGVSPRKIIKTGPTEGIETDPLDVLEEEMSQFKLATNVPGLPKLSGGAIGYISYDCIRYFEPKTKRDLKDVLQLPEAYLMMCDTIIAFDHVFQRFQIMHNINTKKQSLEEGYSHAVEIINDIIKRMTDDSKPIPYPEQPPIKMDRSFQSNIGQEGYENHVGNLIEHIKKGDIIQAVPSQRVARPTDLHPFNIYRHLRTVNPSPYLFYIDCLDFQIIGASPELLCKSDSKNKVITHPIAGTIKRGATTEEDDELGNQLRNSLKDRAEHVMLVDLARNDINRVCDPKTTNVDKLLTIQKFSHVQHLVSQVSGTLRPDKTRFDAFRSIFPAGTVSGAPKVKAMELISELEGERRGVYAGAVGNWSYDGKTMDTCIALRTMVYKNGTAYLQAGGGIVFDSDKYDEYIETMNKMMANHNTIVQAEKIWAEKVGTTN

SEQ ID NO: 3421 - DNA, 1407 bp, Staphylococcus aureus
  CDS (1)..(1407)
atggatatattttataaaaaaataaaagcaaatgtaacgccagaagttttagcacaacttcattccaagaagatcattttggaaagtacaaatcaacaacaaactaaaggtcgctattcagttgttatttttgatatttatggcactttaactttagataatgatgtattatcagtaagcactttaaaagaatcgtatcaaatcagtgaaagaccgtaccattatttaacgactaaaataaatgaagactaccataatattcaagatgagcaacttaagtcattaccgtttatatctggatatgttgggacgtgtagctttgatttagtaagacatgaatttcctaaattgcaatcaatacaattagaagatcacaagcagcacgatgtaaggttatatatggttgaacaagtttatgtatttgaccattacaaagatgagttatatatcatcgcgacgaatcaattttcaaattcaacaaaatcagatcttgagaatcgagttaataagtctatcgaagacttaactaaaatccaaccattcatgcctacacaagattttgattttaaaactaaagaaattcaatcaaacatttctgaagaaagatttatcgaaatgattcagtatttcaaagagaaaataacagaaggggatatgtttcaagttgtgccatcaagaatttacaaatatgcgcatcatgctagtcagcatttaaatcaactttcgtttcaactgtatcaaaatttaaaacgacaaaacccaagtccatatatgtattatcttaatatcgatcaaccatatattgtcggtagttctcccgaaagtttcgtaagtgtcaaagatcaaattgtaacaactaatcctattgcaggtacgattcaacgtggtgagacgacacaaatagataatgagaatatgaaacaactacttaatgatccaaaagaatgcagcgaacatcgtatgctagttgatttagggcgtaatgatattcatagagtaagtaaaatcggtacctcaaaaattactaaattaatggttattgaaaaatatgaacatgttatgcatatcgtaagtgaagtcacaggtaaaataaatcaaaatttatcgccaatgacagttattgcgaatttattaccaacaggtaccgtttcaggtgcaccaaaattacgtgcaattgaaagaatatatgaacaatatccacataaacggggcgtttatagtggtggtgttggatacataaattgtaatcataacttagattttgcattagcaattcgaacgatgatgatagatgagcagtatatcaacgtagaagctggttgtggcgttgtatatgattctattcctgaaaaagaactgaatgaaacgaaattgaaagctaaaagcttattggaggtgagcccatga

SEQ ID NO: 3422 - protein, 468 aa, Staphylococcus aureus
MDIFYKKIKANVTPEVLAQLHSKKIILESTNQQQTKGRYSVVIFDIYGTLTLDNDVLSVSTLKESYQISERPYHYLTTKINEDYHNIQDEQLKSLPFISGYVGTCSFDLVRHEFPKLQSIQLEDHKQHDVRLYMVEQVYVFDHYKDELYIIATNQFSNSTKSDLENRVNKSIEDLTKIQPFMPTQDFDFKTKEIQSNISEERFIEMIQYFKEKITEGDMFQVVPSRIYKYAHHASQHLNQLSFQLYQNLKRQNPSPYMYYLNIDQPYIVGSSPESFVSVKDQIVTTNPIAGTIQRGETTQIDNENMKQLLNDPKECSEHRMLVDLGRNDIHRVSKIGTSKITKLMVIEKYEHVMHIVSEVTGKINQNLSPMTVIANLLPTGTVSGAPKLRAIERIYEQYPHKRGVYSGGVGYINCNHNLDFALAIRTMMIDEQYINVEAGCGVVYDSIPEKELNETKLKAKSLLEVSP

SEQ ID NO: 3423 - DNA, 1407 bp, Staphylococcus aureus
  CDS (1)..(1407)
atggatgtattctataaaaaaataaaagcaaatgtaacacctgaagttttagcacaacttcattccaagaagatcattttggaaagtacaaatcaacaacaaactaagggtcgctattctatagtgatatttgatatctacggtactttaactttagataacgatgtattatcagtaagcactttaaaagagtcgtatcaaatcactgaaagaccgtatcattatttaacgactaaaataaatgaagactaccataatattcaagatgagcaacttaagccaataccgtttatatctggatatgttgggacgtgtagctttgatttagtaagacatgaatttcctaaattgcaatcaatacaattagaggatcacaagcaacacgatgtacggttatatatggttgaacaagtttatgtatttgaccattacaaagatgagttatatatcatcgcgacgaatcaattttcaaattcaacgaaatcagatcttgagaatcgagttaataagtctatcgaagacttaactaaaatccaaccattcatgcctacacaagattttgattttaaaactaaagaaattcaatcaaatatttctgaagaaagatttatcgaaatgattcagtatttcaaagagaaaataacagaaggggatatgttccaagttgtgccatcaagaatttacaaatatgcgcatcatgctaatcagcatttaaatcaacttacgtttcaactgtatcaaaatttaaaacgacaaaacccaagtccatatatgtattatcttaatatcgatcaaccctacattgtcggtagttctcccgaaagtttcgtaagtgtcaaagatcaaattgtaacaactaatcctattgcaggtacgattcaacgtggtgagacgacacaaatagataatgagaatatgaaacaactacttaatgatcctaaagaatgcagtgaacatcgtatgcttgttgatttagggcgtaatgatattcatagagtaagtaaaataggtacctcaaaaattactaaattaatggttattgaaaaatatgaacatgttatgcatatcgtaagtgaagtcacaggtgaaataaatcaaaatttatcgccaatgacagttattgcgaatttattaccaacaggtaccgtttcaggtgcaccaaaattacgtgcaatcgaaagaatttacgaacaatatccacataaacgtggcgtttatagtggtggtgttggatacataaattgtaatcataacttagattttgcattagcaattcgaacgatgatgatagatgagcagtatatcaacgtagaagctggttgtggggttgtatatgattctattcctgaaaaagaactaaatgaaacgaaattgaaagccaaaagtttattggaggtaagcccatga

SEQ ID NO: 3424 - protein, 468 aa, Staphylococcus aureus
MDVFYKKIKANVTPEVLAQLHSKKIILESTNQQQTKGRYSIVIFDIYGTLTLDNDVLSVSTLKESYQITERPYHYLTTKINEDYHNIQDEQLKPIPFISGYVGTCSFDLVRHEFPKLQSIQLEDHKQHDVRLYMVEQVYVFDHYKDELYIIATNQFSNSTKSDLENRVNKSIEDLTKIQPFMPTQDFDFKTKEIQSNISEERFIEMIQYFKEKITEGDMFQVVPSRIYKYAHHANQHLNQLTFQLYQNLKRQNPSPYMYYLNIDQPYIVGSSPESFVSVKDQIVTTNPIAGTIQRGETTQIDNENMKQLLNDPKECSEHRMLVDLGRNDIHRVSKIGTSKITKLMVIEKYEHVMHIVSEVTGEINQNLSPMTVIANLLPTGTVSGAPKLRAIERIYEQYPHKRGVYSGGVGYINCNHNLDFALAIRTMMIDEQYINVEAGCGVVYDSIPEKELNETKLKAKSLLEVSP

SEQ ID NO: 3425 - DNA, 1428 bp, Bacillus thuringiensis
  CDS (1)..(1428)
atgaaaggcatgatgacaaaagaggaatttataaaacagaaagaacaaagaaaaacatttttagtaatcgctgaagaagaaggagatagcattacgccaatttctttatatagacgtatgaaaggtaaaaagaaatttttattagaaagctcacagcttcatcaagataaaggacgctattcttacttaggttgtaatccatatggtgaagtgaaaagcgctggtacggaagtggaacgaaccatttacggcagagcagaaaagttgcaaagtaacgtactacaagtgttagaagaaataatcgcgcccgctcaagtagatagtccttttccattttgcggaggagcagttggatacattggctatgacgtcattcggcaatatgaaaacattggagcagatttacatgatccattgaatattccagaagtacaccttttactgtaccgtgagtttatcgtgtatgaccacttacgccaaaagttgtcgtttgtatatgtatgcagggaagatgattcagcagattatgaagaagtatacgaaaggctgcgagtatacaaagaggaagtgctacagggagaagaagcggaagtagctgaaataagatcaacattatcattcacttcttctataacggaaagagaattttgcgtgatggtagaaacggcgaaagaacacatcggggccggggatatatttcaagttgtattatctcagcgtttgcaaagcgaatgtattggagatccattcgcgttatatcgaaaacttcgaattgccaatccatcaccatatatgttttatatcgattttcaagattatgttgtactcggttcttcgccagaaagtttgttatcagtaagagaagataaagtgatgacgaatccaattgccggtacgagaccgagagggaaaacaaagcaggaggatacggaaattgaaaaagaactgttagaaaatgagaaagagcgagcggagcatatgatgcttgtagatcttgggcgaaatgatattggtagagtgagtgaaatcggctcagttacgatagataaatatatgaaagtagaaaagtattctcacgttatgcacattgtatctgaagtttacggaacattgcgaaaacggatgaacggatttgatgcattagcgtactgtttaccagcggggacggtatcaggtgctccgaaaattagagcgatggaaattataaatgagctagagaatgaaaaaagaaatgtgtacgccggtgcagttggatacgttagtttttcagggaatcttgatatggcgctcgccattcgaacaatggttgtaaaggatgaaaaagcatacgttcaggcaggagcgggtattgtttacgattcagatccagtagctgaatatgaagaaacattaaataaagcgagagcgctattggaggtaatgaaatga

SEQ ID NO: 3426 - protein, 475 aa, Bacillus thuringiensis
MKGMMTKEEFIKQKEQRKTFLVIAEEEGDSITPISLYRRMKGKKKFLLESSQLHQDKGRYSYLGCNPYGEVKSAGTEVERTIYGRAEKLQSNVLQVLEEIIAPAQVDSPFPFCGGAVGYIGYDVIRQYENIGADLHDPLNIPEVHLLLYREFIVYDHLRQKLSFVYVCREDDSADYEEVYERLRVYKEEVLQGEEAEVAEIRSTLSFTSSITEREFCVMVETAKEHIGAGDIFQVVLSQRLQSECIGDPFALYRKLRIANPSPYMFYIDFQDYVVLGSSPESLLSVREDKVMTNPIAGTRPRGKTKQEDTEIEKELLENEKERAEHMMLVDLGRNDIGRVSEIGSVTIDKYMKVEKYSHVMHIVSEVYGTLRKRMNGFDALAYCLPAGTVSGAPKIRAMEIINELENEKRNVYAGAVGYVSFSGNLDMALAIRTMVVKDEKAYVQAGAGIVYDSDPVAEYEETLNKARALLEVMK

SEQ ID NO: 3427 - DNA, 1443 bp, Bacillus thuringiensis
  CDS (46)..(1443)
gtggttaatataagagggtgggataaaagaagacggggtgttgatatgcaacgaagaaaatctttagcgctttctattccatatcagttagatttctttaagcaatataaatttctttctaaggataaaccgcaacacattttgttagagagtggacgtggcggtcgttataacatcgtgggattaaacccagtagcggtaatccgagggaagggtgaagcgttacatataagtgaaagtggtaaggaaacaataaagcaaggaaacccattggatttaatgcaggaatatatggagcgatggaaaacggattataatccggaatacccgccttttcaaggtggtgcaattggttactttagttatgattgcatccgttatattgaaaaacttccttctcttgcggaggatgatattaatatacctgatatattctttttattatttgatgatgtgtttgtgtatgatcaaaaagaaaaagtattatggattattacacattatgtagataagcatgaagaggcaaaagagcgattaaatgaatggaagattctttgggcgacagaagcgccggaagtgactataccgtttgcgtgccctgaaaagaaaaatgaagcagttgcttttactgaagaaagctttatgaaggcggttgaatgtattcaagaatatattggggctggtgatgtgttccaagtaaacttgtcgacaagacaagaaagaacgttacaaacacacccactagaaatatatacaagtcttcgtgaaattaatccatctccatatatgggttacttggagctcggggattttcaaattgtaagtggatcgccagagttgctaattaagaaacagggaactgaagtaagtacaagaccaattgctggaacgagatctagaggggcaaatgaacaagaggatgaagaattggcaagggaattaattgagaatgaaaaagaaagagcagagcacgtcatgcttgtggatttagaacgaaatgatttaggacgtgtttgtaaatatggcactgtagaagtagacgagtttatggtaattgagaaatactcacatgttatgcatattgtttctaatgtgcgtggtgaggtggaagaagataaagatgctttcgatttagtgaaggctgtattccctggaggaacaattacgggtgctccgaaaatacgtacgatggaaattattgaagaattagaacctgttcgccgagggatttatacaggttcaatcggttggattggttattctggagatacagaattgaatattgtaattaggacacttcttgctaaagacggaaaagcgcatgtacaagcaggggcgggaattgtcattgattcaaatccggaaaatgaatataaagagtcgttaaaaaaggcgattgctttatggcgtgcaaaagaacgtagcgaagaaacggttaggtag

SEQ ID NO: 3428 - protein, 465 aa, Bacillus thuringiensis
MQRRKSLALSIPYQLDFFKQYKFLSKDKPQHILLESGRGGRYNIVGLNPVAVIRGKGEALHISESGKETIKQGNPLDLMQEYMERWKTDYNPEYPPFQGGAIGYFSYDCIRYIEKLPSLAEDDINIPDIFFLLFDDVFVYDQKEKVLWIITHYVDKHEEAKERLNEWKILWATEAPEVTIPFACPEKKNEAVAFTEESFMKAVECIQEYIGAGDVFQVNLSTRQERTLQTHPLEIYTSLREINPSPYMGYLELGDFQIVSGSPELLIKKQGTEVSTRPIAGTRSRGANEQEDEELARELIENEKERAEHVMLVDLERNDLGRVCKYGTVEVDEFMVIEKYSHVMHIVSNVRGEVEEDKDAFDLVKAVFPGGTITGAPKIRTMEIIEELEPVRRGIYTGSIGWIGYSGDTELNIVIRTLLAKDGKAHVQAGAGIVIDSNPENEYKESLKKAIALWRAKERSEETVR

SEQ ID NO: 3429 - DNA, 2061 bp, Streptomyces venezuelae
  CDS (1)..(2061)
atgcgcacgcttctgatcgacaactacgactcgttcacccacaacctgttccagtacatcggcgaggccaccgggcaaccccccgtcgtcgtgcccaacgacgccgactggtcgcggctgcccgtcgaggacttcgacgcgatcgtcgtgtccccgggccccggcagccccgaccgggaacgggacttcggaatcagccgccgggcgatcaccgacagcggcctgcccgtcctcggcgtctgcctcggccaccagggcatcgcccagctcttcggcggaaccgtcggcctcgccccggaacccatgcacggccgggtctccgaggtgcggcacaccggcgaggacgtcttccggggcctcccctcgccgttcaccgccgtgcgctaccactccctggccgccaccgacctccccgacgagctcgaacccctcgcctggagcgacgacggggtcgtcatgggcctgcggcaccgcgagaagccgctgtggggcgtccagttccacccggagtccatcggcagcgacttcggccgggagatcatggccaacttccgcgacctcgccctcgcccaccaccgggcacggcgccacggggccgactccccgtacgaactccacgtgcgccgcgtcgacgtgctgccggacgccgaagaggtacgccgcggctgcctgcccggcgagggcaccacgttctggctggacagcagctccgtcctcgaaggcgcctcgcgcttctccttcctcggcgacgaccgcggcccgctcgccgagtacctcacctaccgcgtcgccgacggcgtcgtctccgtccgcggctccgacggcaccacgacccggacgcggcgccccttcttcaactacctggaggagcagctcgaacgccgacgggtccccgtcgcccccgaactgcccttcgagttcaacctcggctacgtcggctacctcggctacgagctgaaggcggagaccaccggcgaccccgcgcaccggtccccgcaccccgacgccgcgttcctcttcgccgaccgcgccatcgccctcgaccaccaggaaggctgctgctacctgctggccctcgaccgccggggccacgacgacggcgcccgcgcctggctgcgggagacggccgagaccctcaccggcctggccgtccgcgccccggccgagccgacccccgccatggtcttcgggatccccgaggcggcggccggcttcggccccctggcccgcgcgcgccacgacaaggacgcctacctcaagcgcatcgacgagtgcctcaaggagatccgcaacggcgagtcgtacgagatctgcctgaccaacatggtcaccgcgccgaccgaggcgacggccctgccgctctactccgcgctgcgcgccatcagccccgtcccgtacggcgccctgctcgagttccccgaactgtcggtgctgagcgcctcgcccgagcggttcctcacgatcggcgccgacggcggcgtcgagtccaagcccatcaaggggacccgcccccggggcggcaccgcggaggaggacgagcggctccgcgccgacctggccggccgggagaaggaccgggccgagaacctgatgatcgtcgacctggtccgcaacgacctcaacagcgtctgcgcgatcggctccgtccacgtgccccggctcttcgaggtggagacctacgcgcccgtgcaccagctggtgtcgaccatccggggacggctgcggcccggcaccagcaccgccgcctgcgtacgcgccgccttccccggcggctccatgaccggcgcgcccaagaagcgcaccatggagatcatcgaccgcctggaggaaggcccccggggcgtctactccggggcgctcggatggttcgccctcagcggcgccgccgacctcagcatcgtcatccgcaccatcgtgctggccgacggccaggcggagttcggcgtcggcggggcgatcgtgtccctctccgaccaggaggaggagttcaccgagaccgtggtaaaggcccgcgccatggtcaccgccctcgacggcagcgccgtggcgggcgcccgatga

SEQ ID NO: 3430 - protein, 686 aa, Streptomyces venezuelae
MRTLLIDNYDSFTHNLFQYIGEATGQPPVVVPNDADWSRLPVEDFDAIVVSPGPGSPDRERDFGISRRAITDSGLPVLGVCLGHQGIAQLFGGTVGLAPEPMHGRVSEVRHTGEDVFRGLPSPFTAVRYHSLAATDLPDELEPLAWSDDGVVMGLRHREKPLWGVQFHPESIGSDFGREIMANFRDLALAHHRARRHGADSPYELHVRRVDVLPDAEEVRRGCLPGEGTTFWLDSSSVLEGASRFSFLGDDRGPLAEYLTYRVADGVVSVRGSDGTTTRTRRPFFNYLEEQLERRRVPVAPELPFEFNLGYVGYLGYELKAETTGDPAHRSPHPDAAFLFADRAIALDHQEGCCYLLALDRRGHDDGARAWLRETAETLTGLAVRAPAEPTPAMVFGIPEAAAGFGPLARARHDKDAYLKRIDECLKEIRNGESYEICLTNMVTAPTEATALPLYSALRAISPVPYGALLEFPELSVLSASPERFLTIGADGGVESKPIKGTRPRGGTAEEDERLRADLAGREKDRAENLMIVDLVRNDLNSVCAIGSVHVPRLFEVETYAPVHQLVSTIRGRLRPGTSTAACVRAAFPGGSMTGAPKKRTMEIIDRLEEGPRGVYSGALGWFALSGAADLSIVIRTIVLADGQAEFGVGGAIVSLSDQEEEFTETVVKARAMVTALDGSAVAGAR

SEQ ID NO: 3431 - DNA, 1593 bp, Photobacterium profundum
  CDS (1)..(1593)
atgaatactaccccattaggtgcaggtgaattagaaatccttagccttgatgtaccttatgtagcagatccaacggagttatattactccgtatgtggtaatcgcccacataacctattgttggagtcggcagaagtcgactctaagcaagatcttcaaagtttaatgttagttgatgctgcggtacgcattgtatgccgaggtaaagaagtacgtcttgaagcattaaccgataatggcttatgcgtacttcaaactatcgaaaacgttgtgatcaccgacattactgtcgagcgtgaagcgcgctgtttggtcttacacttcccagccggtgaacgcacactcgatgaagacagccgtttacgtcaaacgtcgtcttttgatgcgctccgcatgattcaacatgccttcgacacatcggctcatccgcgtgaagcattatttttaggcggtttgttcgcttacgacttagtcgcaggctttgagcctctacctgatgtaacacaagacaataactgccctgattaccttttctatattgctgaaacgttactggttatcgaccaccagcgccgcaaaggtaaacttcaagccaccttgtttggtggtgagcaatataccgctagctactttgaactaagccgccgtttacagcatattaaagaagcctgcctagatcctaaacctgttccagcagcaaagcttcttgagcgttgtgagccagaagccagtatcagtgatgaagacttctgccaaacggtgaaagacttgaagcaatacgtcattgcaggtgatgtattccaagtggtgccttctcgtcaattcacattgccttgcccttcaccgcttgttgcttataaagaacttaaaatcggtaatccaagcccgtacatgttcttcttacaagattcagaattcaccttatttggcgcctcgccagaaagtgcactgaaatactgtacagaaagcaaccaagtcgagatttaccctatcgctggcacacgccatcgcggaaagaatgtcgatggttcgattaatctggatttagatgcacgtattgaacttgagttacgcagcgacttgaaagaaaacgcagaacacatgatgctagttgatttagcgcgtaacgatgttgctcgtatcagtgaaccgggtagccgttatgtggccgacctactgaaagtagaccgctatagtcacgtgatgcatttagtgtctcgtgttgtagggcaactacgcagtgaccttgatgcattacatgcttaccaagcgtgtatgaatatgggcactttaacaggcgcaccaaagattcgtgccatgcagctcattcgtgatgtagagcaacgtcgtcgtggtagctatggtggcgcagtgggttacttaacgggtcatggtgatatggacacctgtattgtgatccgttcagcttatgtcgaaaacgggattgcaagtgttcaagctggtgctggcgttgtgtacgactcgatcccccaagctgaagctgacgaaacacgtggtaaagcacaagcggttattgccgcgattcgcaaagcgcacagcttaaacgaaacaaacaacctaagcagtcaataa

SEQ ID NO: 3432 - protein, 530 aa, Photobacterium profundum
MNTTPLGAGELEILSLDVPYVADPTELYYSVCGNRPHNLLLESAEVDSKQDLQSLMLVDAAVRIVCRGKEVRLEALTDNGLCVLQTIENVVITDITVEREARCLVLHFPAGERTLDEDSRLRQTSSFDALRMIQHAFDTSAHPREALFLGGLFAYDLVAGFEPLPDVTQDNNCPDYLFYIAETLLVIDHQRRKGKLQATLFGGEQYTASYFELSRRLQHIKEACLDPKPVPAAKLLERCEPEASISDEDFCQTVKDLKQYVIAGDVFQVVPSRQFTLPCPSPLVAYKELKIGNPSPYMFFLQDSEFTLFGASPESALKYCTESNQVEIYPIAGTRHRGKNVDGSINLDLDARIELELRSDLKENAEHMMLVDLARNDVARISEPGSRYVADLLKVDRYSHVMHLVSRVVGQLRSDLDALHAYQACMNMGTLTGAPKIRAMQLIRDVEQRRRGSYGGAVGYLTGHGDMDTCIVIRSAYVENGIASVQAGAGVVYDSIPQAEADETRGKAQAVIAAIRKAHSLNETNNLSSQ

SEQ ID NO: 3433 - DNA, 1404 bp, Photobacterium profundum
  CDS (1)..(1404)
atgatttgtaaatcacaccccaaactaagcattgagcaacttgattacagcccagaaatgactcttgagtggttttcaccattatcaagtctgccgtgggcgatgatattacgttctgctgccaataatcacccagataatcgctttgatattctagttgctgatcctttagccactttagagacacaaggtgaaataacctgtattaaatttttaaatggtgatgaaaaaactagcactgacgatccattttatctgcttgagcatattcaacgagatctattaccctcacttaaccctatgactgatgtgccatttatcggcggtgctctgggttattttgcgtatgacctaggtcgacgggttgaaaaaattgcctcgttggctgaacacgatatttctgcacccgatatggcagtgggtatttatgattgggcattgattgctgatcaccaagagcagacgctctttttagtctctccttctggtagtcaacgtttagaatggctaaaacagcacaaagaaaacagtttaacgcagcacaaaaaagacgcattacaacaagctgaacacttttcattaacaactgattggtctgcaaacatgacaattagcagttactgcaataaatttgatcaagtccaagagtatttactctctggtgattgttatcaaattaaccttgcacagcgttttcaggcttcttatcgcggtgatgaatggcaagcttacttgcgtttagagaaaacgaatggtgcgcctttctctggttttatccgcactgaacacggtactgtcttgtctgtgtcaccagaacgttttctacaacataaccaaggttacgttgaaacgaagccgatcaaaggtacgcgcccacgatcagacaatgcagaacaagaccgagcctatgccgacgatttacgtcatgctgaaaaagatcgctcagaaaatttaatgattgttgatttgctacgcaatgatattggacgagtggcaaaacccggtagtgtcaaagtactcagcatttttgaaatcgaaagtttccccgcagttcatcacttggttagcacggtaacaggcgaactagaccaacagtactcggcaacggatttattacgtgcttgtttccccggaggctcaattacaggcgcccctaaagtgcgggctatgtctataattgaagaattagaaccgcatcgtcgtagtatttactgtggcagcattggctatatcagccgctgtggtcgcatggacactagtattacaatacgaacgttagtcactcaagaacagaaaatatacgcttgggcaggtggtggagtggttgcagatagcaaatctgacagtgaatatcaggaaacactggacaaactaagtagaattctgccagtcttgaggcagtag

SEQ ID NO: 3434 - protein, 467 aa, Photobacterium profundum
MICKSHPKLSIEQLDYSPEMTLEWFSPLSSLPWAMILRSAANNHPDNRFDILVADPLATLETQGEITCIKFLNGDEKTSTDDPFYLLEHIQRDLLPSLNPMTDVPFIGGALGYFAYDLGRRVEKIASLAEHDISAPDMAVGIYDWALIADHQEQTLFLVSPSGSQRLEWLKQHKENSLTQHKKDALQQAEHFSLTTDWSANMTISSYCNKFDQVQEYLLSGDCYQINLAQRFQASYRGDEWQAYLRLEKTNGAPFSGFIRTEHGTVLSVSPERFLQHNQGYVETKPIKGTRPRSDNAEQDRAYADDLRHAEKDRSENLMIVDLLRNDIGRVAKPGSVKVLSIFEIESFPAVHHLVSTVTGELDQQYSATDLLRACFPGGSITGAPKVRAMSIIEELEPHRRSIYCGSIGYISRCGRMDTSITIRTLVTQEQKIYAWAGGGVVADSKSDSEYQETLDKLSRILPVLRQ

SEQ ID NO: 3435 - DNA, 1404 bp, Photobacterium profundum
  CDS (1)..(1404)
atggctaataaaaacatgcaaacctataaaactctgtcatttgagcatcagtgccaacccattttactagcgactgaaatcgcgagtgccgatttctgcgcagactatatcgtttacgaacacaatcaggaatgggcaatcggcatcaataagcattcacaactcacggtaaaccaagtgggtgatatcgttgacttcgcaggcgtcagacaaagcgttaatcaaaataatatttgccaagcgattcatcaggcaacccaaaaaatacaaatcaaagactggagactatttggacgtgtagacttcgagttctgccattttgctcacaacttaaagcaaaaagagaccgaaagatctctactagaactttttgtaccagaaacagatatacgaatcagccaaacacatattaccattcgtacaatggatgaggccgttatacctcaaattcaacgaattgcagctgactgtaataactataaagctcaaccaactaaatcacataaaagcatgacacaaaaagatattgtgcgatgtgaagaagtaaaaaaatactaccaagacgtcgtccaacacgcagtaaatgaaatcaaagccgacaaatataaaaaagtaattctgtcacgccccgctattctgccttcatctatagatattaaaaacagcttcatagcaggaagaaaacataatacacctgctcgttctttcatgctccagatgggaggatttgaggcatttggattttctccagaaacggttctagaagtagatacttacggaaatttgagtacccaaccactagcaggaacacgtgcactgccatcggatcttacagaagccaagcgtttaaaaaatgaacttcttaccgatccaaaagagatcgctgagcatgcagcatcggtcaaacttgccgtcgaagaattggagcaagtgtgtgcaagtgaaaccgtcaatatcgctgagttcatgcatatttctgaaagaggcagtgtgcagcacctcgcctctcgtgtaacgggaactctaactgaaaacaaatcagcatgggatgcatttaaagttctcttcccagccatcacagcgtcaggtatccctaaacgtgaagccattgatgctattgcccgattcgaacctcttccgcgaggtttatatagtggaagtattcttgtttccgatcaaaacggatttttcgacgcggcacttatattacgagcagcatataaacataaatcactctctatacttcaagccggtgcaggtatcattagcttatctacccctcaaagagaatgggaagagacctgtgaaaaaatggcttgtgtcctcaatcacttagttttttcacaagaaaatacaccgcaactgcttccatcaagcgaaactgcctgtgaggaagaatcatga

SEQ ID NO: 3436 - protein, 467 aa, Photobacterium profundum
MANKNMQTYKTLSFEHQCQPILLATEIASADFCADYIVYEHNQEWAIGINKHSQLTVNQVGDIVDFAGVRQSVNQNNICQAIHQATQKIQIKDWRLFGRVDFEFCHFAHNLKQKETERSLLELFVPETDIRISQTHITIRTMDEAVIPQIQRIAADCNNYKAQPTKSHKSMTQKDIVRCEEVKKYYQDVVQHAVNEIKADKYKKVILSRPAILPSSIDIKNSFIAGRKHNTPARSFMLQMGGFEAFGFSPETVLEVDTYGNLSTQPLAGTRALPSDLTEAKRLKNELLTDPKEIAEHAASVKLAVEELEQVCASETVNIAEFMHISERGSVQHLASRVTGTLTENKSAWDAFKVLFPAITASGIPKREAIDAIARFEPLPRGLYSGSILVSDQNGFFDAALILRAAYKHKSLSILQAGAGIISLSTPQREWEETCEKMACVLNHLVFSQENTPQLLPSSETACEEES

SEQ ID NO: 3437 - DNA, 1320 bp, Methanococcus maripaludis
  CDS (1)..(1320)
atgtataaattggattatgtaaatcctctaaaactttacggggttttaagggatgaaggaaaatatccagtaatgcttgaatcaagagctaaaggacaagttaatgcaaggtacacatacatttcttcaaatcctgaatacatgcttagaatcggaaataaaaccaaaatggacaacgaaacgatttcaaaagaaagtaacccgttcaaagctttaaaagaaaacttcaaggttactcaaaaaggtgaccgttttactggaggatacgttggatatattgcatacgactgtattcataactacatcggcggaaaaattgaagaaccttcagtatttggatactacgatcacatgtatgtttacgaccacgaaacgaataatttttattatcattctgaaacgaataatcctgaagaattaagaaatgctgaaacaactgttgaaaaagcaaaaaattttaaaattgaagaagaagacggcggaattgaagttttgggttgcgatgcagatttggatgattacgtaaaaatggttgaaaaaactaaagaatacatttattcaggcgatgcttttcaggtcgttccttcaagagaatatcgcttgaaaaatgaattttctgcatttcaactttacagaaaccttagaaatgtaaatccaagtccttacatgtttttgcttgaatttgacaaggatgtagttggagcatctccagaaacaatggcttcagttcagaacaatatcttaaaagtaaaccctattgcggggactactgcaattggaaaaactgaaaacgaaactcaaaaattggcagaagcacttttaaaagatgaaaaagagcgagcagaacacatgatgcttgttgaccttgcaagaaatgatgtcaggaaagtttcaaaatctggaagcattgtacttgaaaggtttttcgacgttgtaagatacagccatgttcagcacattgaaagtgaggtgcttggaacattaaaagataattcaacaatatttgatgcaatagaagccgcatttcctgcaggaaccttaaccggagctccaaagtttagggcaatggaaattattgacgaagttgaaaaatcaagaagaaaaatttacggtggagctgttggatacttttcaaacagtggcaatgcggaccttgcaattggaattagaatggctgaaattgacagcgtttgccgggtaagggcaggcggaggggtggttgctgattccgtacctgaaaatgaatactacgaaacagagcggaaaatggccgcaatgatgaaagcactgggtgttcgaaatgatagtgataatagataa

SEQ ID NO: 3438 - protein, 439 aa, Methanococcus maripaludis
MYKLDYVNPLKLYGVLRDEGKYPVMLESRAKGQVNARYTYISSNPEYMLRIGNKTKMDNETISKESNPFKALKENFKVTQKGDRFTGGYVGYIAYDCIHNYIGGKIEEPSVFGYYDHMYVYDHETNNFYYHSETNNPEELRNAETTVEKAKNFKIEEEDGGIEVLGCDADLDDYVKMVEKTKEYIYSGDAFQVVPSREYRLKNEFSAFQLYRNLRNVNPSPYMFLLEFDKDVVGASPETMASVQNNILKVNPIAGTTAIGKTENETQKLAEALLKDEKERAEHMMLVDLARNDVRKVSKSGSIVLERFFDVVRYSHVQHIESEVLGTLKDNSTIFDAIEAAFPAGTLTGAPKFRAMEIIDEVEKSRRKIYGGAVGYFSNSGNADLAIGIRMAEIDSVCRVRAGGGVVADSVPENEYYETERKMAAMMKALGVRNDSDNR

SEQ ID NO: 3439 - DNA, 1305 bp, Parachlamydia sp
  CDS (1)..(1305)
atgcttttttctggaggcgaatttgactcctctgagcattcttttttatctctttttccgattgaaattgtaattgcaaaagatcggcaagtgatccataaaacaaagcaacagattttccagcaagagataaaaaatccttgggaagctcttcaaaaatttttttttgattcgttagaaaataactctgaaaactacgcttttggatttttcggttatgaaatgggattttcctccgatcctgatgtacaattattttgccaatctcatgaatggacacctgatgccatgtggcaaaaatgcgcaattacaattatctataaccattctaaccaacaggctatccttaaaatagctgattttactgaccaaacactaaaccctttacatcaacattgggttaaaaaactttctgataaaaattggtgggaaagtgatagctttaattttttttcccgaacttcacaaaaaacagaagctcaattaaaaaacttttctctttcaaatcgtcaacttacttatttaaagatgattgatgaggcaaaagagtggattttttcgggacatgtttaccaaattaatttatcccaagaatttacatttgaaggtgttccgcgaccttttgacgtctttcgtcaattaatagaaatcaatcccgctcccttttccgcttatttgaaagcagattattatacaattgtatcaagctctcctgaaaggtttttgcaaaaaaaggaaaggctattagaaacgcgcccaattaaaggaacaatacaaagaggtgggtattttgaagaagatcaattgttcaaagaaagattactatcatctgaaaaagaaaaagctgagctgttaatgattacagatttaatgcgcaatgatttaggtaaaatcagtgaaattggcagtgttaaaacggttgatttgtggcgttgtgaggcctatacgaacgtatatcacttgatttcaattattcgtgctattgctttaaagcatctaaaacctttagaaattatccgtagcgcatttccaggtggctctattaccggttgtcccaaattgaaagcgatggaatgtatacaaaaattagaaaatcgttcgcggggtatttatacgggttcgatgggatatatgacaggaaaaggagattttgatttgaatattgcgattcgaactttggtatttaaagacaattacattagcttccaagtgggaggtggaattgttatcgattctgatccaattaatgaatatgcagaaactctttttaagggtgactcattatttcgagtactaaagacttaa

SEQ ID NO: 3440 - protein, 434 aa, Parachlamydia sp
MLFSGGEFDSSEHSFLSLFPIEIVIAKDRQVIHKTKQQIFQQEIKNPWEALQKFFFDSLENNSENYAFGFFGYEMGFSSDPDVQLFCQSHEWTPDAMWQKCAITIIYNHSNQQAILKIADFTDQTLNPLHQHWVKKLSDKNWWESDSFNFFSRTSQKTEAQLKNFSLSNRQLTYLKMIDEAKEWIFSGHVYQINLSQEFTFEGVPRPFDVFRQLIEINPAPFSAYLKADYYTIVSSSPERFLQKKERLLETRPIKGTIQRGGYFEEDQLFKERLLSSEKEKAELLMITDLMRNDLGKISEIGSVKTVDLWRCEAYTNVYHLISIIRAIALKHLKPLEIIRSAFPGGSITGCPKLKAMECIQKLENRSRGIYTGSMGYMTGKGDFDLNIAIRTLVFKDNYISFQVGGGIVIDSDPINEYAETLFKGDSLFRVLKT

SEQ ID NO: 3441 - DNA, 2160 bp, Rhodopseudomonas palustris
  CDS (1)..(2160)
atgaacaggaccgttttctcgcttcccgcgaccagcgactataagaccgccgcgggcctcgcggtgacgcgcagcgcccagccttttgccggcggccaggcgctcgacgagctgatcgatctgctcgaccaccgccgcggcgtgatgctgtcgtccggcacaaccgtgccgggccgctacgagagcttcgacctcggctttgccgatccgccgctggcgctcaccactagggccgaaaaattcaccatcgaggcgctcaatccgcgcggccgggtgctgatcgcgttcctgtccgacaagcttgaagagccctgcgtggtggtggagcaggcctgcgccaccaagatcaggggccacatcgtccgcggcgaggccccggtcgacgaagaacaacgcacccgccgcgccagcgcgatctccctggtgcgcgcggtgattgctgccttcgcctcgccggccgatccgatgctcgggctgtacggcgccttcgcctacgaccttgtgttccagttcgaggatctgaagcagaagcgtgcccgcgaagccgaccagcgcgacatcgtgctgtacgtgccggatcgcctgctggcctacgatcgcgccaccggccgcggcgtcgacatttcctacgaattcgcctggaagggccagtccaccgccggcctgccgaacgagaccgccgagagcgtctacacccagaccggccggcagggtttcgccgaccacgccccgggcgactatcccaaggtggtcgagaaggcccgcgcggcgttcgcccgcggcgacctgttcgaggcggtgccgggccagctgttcggcgagccatgcgagcggtcgccggccgaagtgttcaagcggttgtgccggatcaacccgtcgccctatggcggcctgctcaatctcggcgacggcgaattcctggtgtcggcctcgccggaaatgttcgtccgctcggacggccgccggatcgagacctgcccgatctccggcactatcgcccgcggcgtcgatgcgatcagcgatgctgagcagatccagaagctcttgaactccgagaaggacgagttcgagctgaatatgtgcaccgacgtcgaccgcaacgacaaggcgcgggtctgcgtgccgggcacgatcaaagttctcgcgcgccgccagatcgagacctattcgaagctgttccacaccgtcgatcacgtcgagggcatgctgcgaccgggtttcgacgcgctcgacgccttcctcacccacgcctgggcggtcaccgtcaccggcgcgccgaagctgtgggcgatgcagttcgtcgaggatcacgagcgtagcccgcggcgctggtatgccggcgcgttcggcgtggtcggcttcgatggctcgatcaacaccggcctcaccatccgcaccatccggatgaaggacggcctcgccgaagttcgcgtcggcgccacctgcctgttcgacagcaatccggtcgccgaggacaaggaatgccaggtcaaggccgcggcactgttccaggcgctgcgcggcgatcccgccaagccgctgtcggcggtggcgccggacgccactggctcgggcaagaaggtgctgctggtcgaccacgacgacagcttcgtgcacatgctggcggactatttcaggcaggtcggcgcccaggtcaccgtggtgcgctacgttcacggcctgaagatgctggccgaaaacagctatgatcttctggtgctgtcgcccggtcccggccggccggaggacttcaagatcaaggatacgatcgacgccgcgctcgccaagaagctgccgatcttcggcgtctgcctcggcgtccaggcgatgggcgaatattttggcggtacgctcggccagctcgcgcagccggctcacggccgcccgtcgcggattcaggtgcgcggcggcgcgctgatgcgcggtctcccgaacgaggtcaccatcggccgctaccactcgctctatgtcgacatgcgcgacatgccgaaggagctgaccgtcaccgcctccaccgatgacggcatcgcgatggcgatcgagcacaagaccctgccggtcggcggcgtgcagttccaccccgagtcgctgatgtcgctcggcggcgaggtcgggctgcggatcgtcgaaaacgccttccggctcggccaggcggcctaa

SEQ ID NO: 3442 - protein, 719 aa, Rhodopseudomonas palustris
MNRTVFSLPATSDYKTAAGLAVTRSAQPFAGGQALDELIDLLDHRRGVMLSSGTTVPGRYESFDLGFADPPLALTTRAEKFTIEALNPRGRVLIAFLSDKLEEPCVVVEQACATKIRGHIVRGEAPVDEEQRTRRASAISLVRAVIAAFASPADPMLGLYGAFAYDLVFQFEDLKQKRAREADQRDIVLYVPDRLLAYDRATGRGVDISYEFAWKGQSTAGLPNETAESVYTQTGRQGFADHAPGDYPKVVEKARAAFARGDLFEAVPGQLFGEPCERSPAEVFKRLCRINPSPYGGLLNLGDGEFLVSASPEMFVRSDGRRIETCPISGTIARGVDAISDAEQIQKLLNSEKDEFELNMCTDVDRNDKARVCVPGTIKVLARRQIETYSKLFHTVDHVEGMLRPGFDALDAFLTHAWAVTVTGAPKLWAMQFVEDHERSPRRWYAGAFGVVGFDGSINTGLTIRTIRMKDGLAEVRVGATCLFDSNPVAEDKECQVKAAALFQALRGDPAKPLSAVAPDATGSGKKVLLVDHDDSFVHMLADYFRQVGAQVTVVRYVHGLKMLAENSYDLLVLSPGPGRPEDFKIKDTIDAALAKKLPIFGVCLGVQAMGEYFGGTLGQLAQPAHGRPSRIQVRGGALMRGLPNEVTIGRYHSLYVDMRDMPKELTVTASTDDGIAMAIEHKTLPVGGVQFHPESLMSLGGEVGLRIVENAFRLGQAA

SEQ ID NO: 3443 - DNA, 1554 bp, Corynebacterium diphtheriae
  CDS (1)..(1554)
atggcagatttccatgcatccgcccgcgaggtgcgctatcacgaggatgccgccgacctctttcatcatcttggcgggacctcggctagtgactccgttcttttagagtccgcagacattaaatccaagaagaacaccacatccatggcagtacttcaatcagcggttcgcgtgacgtgcatggggcaaaccgtgaccgccacgcccctaacatctacgggccatacaatggtggcgcgcctacaggagcactttggcacgagcggcacgaaatttagtttccgccgctccgagcttcacgacgaacgccagcgcctccttgacaccaataacgccgagattcttcgcctcctacagtgtgaggccggctattccggtgagcagttaccacttcttgccggcggtttcgccttcgactacgtggagacatttgagcaattacctcctgtaccggtaggggataattcttatcccgattaccagtttgtggtggcagaaacagtgctggtgaccgatcatctcaagcgcagtgcggttatcgagggcgtgtccattgatccaagcgagttggaggatcgactagattcccttgttgccacgattgacagccatgaaacagtcgaggaatgtcccgcgaccacggcaaccaatgagatattgactgtgcgtgccgatatttctgatgtggatttttgccaaagcgtaagcgcactgcaggacaatatccaggcgggagacatctatcaggtggttccagcacgcagctttagcgcgccctgtgagagtgcttatgcagcttatagacacttgcgcacaatcaatcccagcccctatatgttttacgtgcgcggcattacccccatttcatgcaattcaaataaaacatatgagctgataggagcgtcgccggagtctaatctcaagttcgattccagaacacgcgagatacaattgtatccgatcgccggtacccggccacggggacttaatcccgacgggagtattaatcacgaactcgacattcgtgccgagctggatatgcgaactaacgtcaaggaaatcgccgaacatactatgctagttgatcttgcacgcaatgatcttgcacgtgtttcattgcccacaacacgtcgcgttgcagagttattgcaggtagatcgctactcccgggtgatgcatctcgttagccgtgtggtagctacgctggatccagagttcgacgctattaacgcctaccgtgcctgcatgaacatgggaacgctaaccggagcaccaaaattgcgcgcaattgaattactgcgaggtgtggaagctaaacgtcgcggttcctatggtggtgcggttggataccttcaaggagatggctccatggatacttgcattgtcattcgttccgcctttattcaggatggggtagcggtggtacaggccggtgccggagtggtgcgggattctattccacaatcagaggccgatgaaacactccataaggcctatgccgttttgcatgccattgcattggcggccggaaaggatctggaggtggttcgctaa

SEQ ID NO: 3444 - protein, 517 aa, Corynebacterium diphtheriae
MADFHASAREVRYHEDAADLFHHLGGTSASDSVLLESADIKSKKNTTSMAVLQSAVRVTCMGQTVTATPLTSTGHTMVARLQEHFGTSGTKFSFRRSELHDERQRLLDTNNAEILRLLQCEAGYSGEQLPLLAGGFAFDYVETFEQLPPVPVGDNSYPDYQFVVAETVLVTDHLKRSAVIEGVSIDPSELEDRLDSLVATIDSHETVEECPATTATNEILTVRADISDVDFCQSVSALQDNIQAGDIYQVVPARSFSAPCESAYAAYRHLRTINPSPYMFYVRGITPISCNSNKTYELIGASPESNLKFDSRTREIQLYPIAGTRPRGLNPDGSINHELDIRAELDMRTNVKEIAEHTMLVDLARNDLARVSLPTTRRVAELLQVDRYSRVMHLVSRVVATLDPEFDAINAYRACMNMGTLTGAPKLRAIELLRGVEAKRRGSYGGAVGYLQGDGSMDTCIVIRSAFIQDGVAVVQAGAGVVRDSIPQSEADETLHKAYAVLHAIALAAGKDLEVVR

SEQ ID NO: 3445 - DNA, 3174 bp, Lycopersicon esculentum
  CDS (121)..(2829)
atttctgcaccaagcgttttcggatctgttaacttcattaatgagatctgcttgttggcttaatgcttatttttgcggagggatttggttggtgaacctgcggtttcgttacaagcataaatgaattctgccatgtcttcgtcatcatcatttatggttgcctcttcctgctgccaaaatcttcaaaccagaaaatattttcttttagcacctgaaccttttgagaagattggtatgatagatgcactccaaaaatataaccgtaaggaaaggaaggtatttatttcaagtcatttagtgcctggacatttggatgcatcgggaacaagaaaaaagtttttacatgagccagttccgaagttagaatttgtacgcacactactaattgacaactatgacagttacacttacaatattttccaagagctctcaatcattaatggaatgcctccggtggtgattcggaatgatgagtggacatggaaagaagtttatcattacctgtacgaagaaaggacgtttgacaatattgttatatcacctggtcctggctctccaacatgtccatcagatataggaatttgcctgaggctcttgcttgaatgcattgatatcccgatactaggcgtctgccttggtcaccaggcattgggatatgtgcatggtgctgaagttgtacatgcacctgaacctttccatggtcgtttgagtgatattgagcacaatggttgtcaattattccatgaaattccttcaggaagaagttctggatttaaggtggtacggtaccattcccttgtaatagacccgaaatcacttccgaaggaactcattcctatagcttggacctcaacagctgagacactccctttccagggtgtcaaacgatccaattcattcttaaatgcgtccaaagaaaataaagatatttttaatgggatgtcggagctatcagatgattcaaaggatgtgaaaggtggaaaagtcctcatgggtatcatgcattctagtaggcctcactatggattgcagttccacccagaaagtgttgcaacatgttacggaagacagcttttcaagaatttccggaaaatcacagaggattattggctcctgctgatgtcaacctccttcaatgaaagaagggctcattatgctgcatgcatgcaggtgcctaatttagacccgctgtcccgaagtgttgcaaaacgtgggcatctggtgaataaattgattgagaggagaactgccgaagtggatggaaccttaaatctatcacatccaggtcacagtgtaaaatttttgaagatgacatggaaaaaacttgattgctctgcgagccaagtaggtggagcggataatattttctgtgaactatttggagatcaagaggctaaaaacagtttttggctggatagctcttcaatagagaaggaaagggctagattttcctttatggggggaaagggtggctccctctggaagcaacttagttttaggttgtcaaatcgaagtgacagaatgtgtaaaggaggtggccatctatcagttgaagatgctaatggtcatgttatttctaaatttttggaagatggattttttgattatttagataaggagctcctatcattttgtttcgatgagaaggattatgaaggattaccatttgatttttatggtggttacattggttatatcgggtatgatcttaaagctgaatgtggtgtggcatctaatcgtcatagatccaaaacaccagatgcttgtttattctttacagataacgttattgtcattgatcatcagtatgatgacatatatactttgtcattacacgatggcagcacaagtactacttctcgcttggaagatctggagcagaggctgctcaacttgagagcttttacgcccagaaggctacaatcgcaggcatctcgaggattttctgtagtcgaactaaaatcagggttttctgctgagaaatcaagagagcagtatatcaaagacgttgagaattgtcaagagttcataaaagaaggagaaagttatgagttgtgtcttacaactcagatgagaatgaagttggggggaatagattctctggaactttatcgtaatctcagaataagaaatcctgcaccatatgctgcctggcttaatttttcaagggaaaacctaagcatatgttgttcatcacctgaaaggttcctacgattggacaggaatgctattctagaagcaaaacccataaaagggactatagctcgtggttccaccccaaaggaagatgaatttctgaaactgcaattagaatgcagtgaaaaggatcaggcggaaaatttgatgattgttgacttgttgaggaatgaccttgggcgtgtatgtgagactggctctgttcatgtcccacatctcatggaaattgaatcctatgcaacagttcataccatggtcagtacgattcgggggaaaaagcgatcagatgcaagtgcaattgattgtgttagagctgcattccctggtgggtcaatgacaggtgcaccaaagttgagatcaatggaacttcttgatcatcttgaaaattgttcgaggggcatatactcgggctgcattggatttttttcttataaccaagcatttgatctcaatattgtgatacggacggttgtcatacacgagggagaagcttcagtaggagcaggaggagccatcactgctctttcagatcctaatgatgagtatgaagaaatgcttcttaaaactcgagcaccgattaaggctgttcttgaacatcagagcagcatcttctcatcagatgctcagaagtgacatgaccagttgaaatgtccaatgcagaaatagtggtattgaactctcttagattctgggaaaatgtgggagcaattgcagcttctagtagttataattaaaagggaggggaaacagtggatgaaagcctatataattcatgcaaatatttgtcatgaccttgttttgtcagcacaatctattcattcttttgagcatagtgtttggaaaatatagccatggtagcatacagatctgcagtgactaaaatactgtacatagaagattttgaaagacctgtagaagattacagatatgtttgtgaagttgtactagtactgaattgatgattccacgtttcatttt

SEQ ID NO: 3446 - protein, 902 aa, Lycopersicon esculentum
MNSAMSSSSSFMVASSCCQNLQTRKYFLLAPEPFEKIGMIDALQKYNRKERKVFISSHLVPGHLDASGTRKKFLHEPVPKLEFVRTLLIDNYDSYTYNIFQELSIINGMPPVVIRNDEWTWKEVYHYLYEERTFDNIVISPGPGSPTCPSDIGICLRLLLECIDIPILGVCLGHQALGYVHGAEVVHAPEPFHGRLSDIEHNGCQLFHEIPSGRSSGFKVVRYHSLVIDPKSLPKELIPIAWTSTAETLPFQGVKRSNSFLNASKENKDIFNGMSELSDDSKDVKGGKVLMGIMHSSRPHYGLQFHPESVATCYGRQLFKNFRKITEDYWLLLMSTSFNERRAHYAACMQVPNLDPLSRSVAKRGHLVNKLIERRTAEVDGTLNLSHPGHSVKFLKMTWKKLDCSASQVGGADNIFCELFGDQEAKNSFWLDSSSIEKERARFSFMGGKGGSLWKQLSFRLSNRSDRMCKGGGHLSVEDANGHVISKFLEDGFFDYLDKELLSFCFDEKDYEGLPFDFYGGYIGYIGYDLKAECGVASNRHRSKTPDACLFFTDNVIVIDHQYDDIYTLSLHDGSTSTTSRLEDLEQRLLNLRAFTPRRLQSQASRGFSVVELKSGFSAEKSREQYIKDVENCQEFIKEGESYELCLTTQMRMKLGGIDSLELYRNLRIRNPAPYAAWLNFSRENLSICCSSPERFLRLDRNAILEAKPIKGTIARGSTPKEDEFLKLQLECSEKDQAENLMIVDLLRNDLGRVCETGSVHVPHLMEIESYATVHTMVSTIRGKKRSDASAIDCVRAAFPGGSMTGAPKLRSMELLDHLENCSRGIYSGCIGFFSYNQAFDLNIVIRTVVIHEGEASVGAGGAITALSDPNDEYEEMLLKTRAPIKAVLEHQSSIFSSDAQK

SEQ ID NO: 3447 - DNA, 1848 bp, uncultured bacterium
  CDS (1)..(1848)
atgagcagcagcacggcgccacggccaccaccggtggcgctgatcgatttcccatcggcccagggtcgccagcgattgaacttcgggccggccttgcactggctggtcgccaccgaagccgaccaggtcaggcgggtcatcgatgccgcccatgagcacgccagacaaggccgctggtgcgtgggctgggtggcctacgaagcggcccccgctttcgacgtgcacctgcctgtgcacccgcctgaacccggccagccgctcgccctgttcgccgtgttcgagcatgccctgccctggcctgatgaggccccgtcggccgcctggcagaccgcgccctggcaatcgggcctgaacgagcaggacttcaccgaccaggtggaagccatccgcgagttgatccgggccggcgaggtctaccaggtcaacctgaccacgccgctgcgcagccagttgcagccccaggcgcctgacaccgccctgcactacttccacgccttgcaccgcagccagccggatggctatgcggcttacctggacatggcttcggcaggcctggtgcaggcggtgcctgccgtcctgggccccagccacgtgctgagcgtgtcgcccgagctgttcttccactggcatgaaggccggatcaccacgcgcccgatgaaaggcacggctgcacgtggcaccacgcctgacaccgacgaggccgccgcccggcacctgcgcaccagcgacaaagagcgcgccgagaacctgatgatcgtggacctgttgcgcaacgacctgtcgcgcatcgcgcaggtcggctcggtgcgggtgccgtcgctgttcgatgtgcaggccttgcccaccgtgtggcagatgacctcgacggtggaggcgcgcacgctggatgggctgcgcctgtccgacgtctttggcgcgctgtttccttgcggctcggtgacgggggcgcccaagcgccgtgccatgcaccacatcgccaggctggagggtgcgccacggggcgtgtactgcggcgccgtcggcctgatggcgccgggtggcgaggtgaccttcaatgtgcccatccgcaccgtggtgctgcgggcaggacaagccgcgtgggaagcccgctgcggcatcggcagcggcatcacgctggacgccacgccgcaagccgaggcccaggaatggcgccacaagcaggccttcctgaaacgcgcggcccagcccttcgaactgctggaatcgctgcgcctggaacaaggtcgcgtcgcccggctggaagcgcacctgcaacgcctgtcgggcggtgcgcggcatttcggcatcccgctcgacctcgatgcggcgcgcgaggcgctggccttgcaagcccaggcccatccgcaagggacgcacaaggtgcggctgctggtcgacgcgcaaggccgcgtcacgtgcgaagccgcaccgctggccgccagcccctggcccatcaccgtggccctggccacgcggcccatgccccaggccgacgagttcatcgcgcacaagaccacgcagcgcggtgcctatgcgcccttcagcacgccctccggctgcttcgacacgctgctgtggaacgcgcaaggcgagctcaccgagttcaccatcggcaacgtggcggtgaaactggcgggcgaatggttcacgccgcccgccgcaagcggcctcttgcccggtgtgatgcgccagacactgctggccgaaggccgcctgcgcgagcgccgcatcaccgtcgatgaactgttgcaccagtccgagggcctggcgctgatcaacagcgtgcgcgggtggctggacgcccgcctcgcatccccaccccacgacccactcatcgtcggagattga

SEQ ID NO: 3448 - protein, 615 aa, uncultured bacterium
MSSSTAPRPPPVALIDFPSAQGRQRLNFGPALHWLVATEADQVRRVIDAAHEHARQGRWCVGWVAYEAAPAFDVHLPVHPPEPGQPLALFAVFEHALPWPDEAPSAAWQTAPWQSGLNEQDFTDQVEAIRELIRAGEVYQVNLTTPLRSQLQPQAPDTALHYFHALHRSQPDGYAAYLDMASAGLVQAVPAVLGPSHVLSVSPELFFHWHEGRITTRPMKGTAARGTTPDTDEAAARHLRTSDKERAENLMIVDLLRNDLSRIAQVGSVRVPSLFDVQALPTVWQMTSTVEARTLDGLRLSDVFGALFPCGSVTGAPKRRAMHHIARLEGAPRGVYCGAVGLMAPGGEVTFNVPIRTVVLRAGQAAWEARCGIGSGITLDATPQAEAQEWRHKQAFLKRAAQPFELLESLRLEQGRVARLEAHLQRLSGGARHFGIPLDLDAAREALALQAQAHPQGTHKVRLLVDAQGRVTCEAAPLAASPWPITVALATRPMPQADEFIAHKTTQRGAYAPFSTPSGCFDTLLWNAQGELTEFTIGNVAVKLAGEWFTPPAASGLLPGVMRQTLLAEGRLRERRITVDELLHQSEGLALINSVRGWLDARLASPPHDPLIVGD

SEQ ID NO: 3449 - DNA, 2151 bp, Xanthomonas albilineans
  CDS (1)..(2151)
atgcgctgccttatcataaataattacgattcgttcacttggaatctcgccgactacgtagcgcagatcttcggcgaagatcccctggtggtgcacaacgacgagtactcctggcacgaactgaaggaccgcgggggattttcctcgatcatcgtttcgcccggtcccggctcggtggttaatgaagcggattttcacatctcgctgcaggcgctggagcagaacgaatttccggtgttaggcgtatgcctgggctttcagggacttgcgcatgtctatggtggccgcatcctgcatgcgccggtgccctttcatggccgtcgctccaccgtcatcaacaccggcgacggtttgttcgaaggcatcccgcagcgtttcgaggcagtgcgctatcactcgttgatggtctgccagcaatcgctgccgcctgtgctgaaagtgacggcgcgtaccgattgcggtgtggtgatgggcttgcagcacgtgcaacacccgaaatggggagtacagttccaccccgaatcgatcctcaccgaacacggcaagcgcattgttgctaactttgccaagctggctgcgcgccacagtgcaccgttacttgccgggtcggagcaggccggcaaggttttaagcgtttgcgcgcccgagatggtgacaccgcgggtacgtcgcatgctgagccggaagatcaagtgccgttggcaggcggaagatgtctttctggccttgttcgctgacgaaaagcattgcttctggctggacagccagctggtctgcagtccaatggcgcgctattcgttcatgggagcggtgaacgagagcgaggtagtgcggcattgcgtgcggccagggagcatggtgcaggaggcaggcgagcggtttcttgctgagatggatcgggcgttgcaatcggtgcttactgaggacgtcgccgagcggccaccgttcgcgtttcgcggcggctacgtgggctacatgagctacgaaatgaaatcggtgttcggcgcgccggcttcacatgccaatgccatccccgatgcgttgtggatgcgcgtggagcgcttcgttgccttcgaccacgccactgaggaggtatggttgctggcgctcgccgatacggaggatctgtcggcattggcttggctagacgccatcgagcaacgtatccatgccattggtcaagcggctccggcttgcatttcgctaggcctgcgcagcatggaaatcgagctcaatcatggtcgtcgcggctaccttgaggcaatcgagcgttgcaaacaacgcatcgtcgatggcgagtcctatgaaatctgtcttaccgacctgttctcgttccaggccgagctggatccattgatgctctatcgctacatgcggcgagggaacccagcgccgttcggggcctatttgcgtaacggtagcgattgtatccttagtacttcaccagagcgttttctggaagtggacggccacggcacgattcagaccaagccaatcaagggcacctgccgccgtgccgaggatccccaactggaccgtaacttggccatgcgcctggccgcctcggaaaaggaccgagcggaaaacttgatgatcgtcgacttgatgcgcaacgacctaagccgcgtggcggtgcccggcagcgtcaccgtgcccaagctgatggacatcgaaagctacaagaccgtgcatcagatggtcagcacggtggaagcgaggctgcgcgccgattgcagtctagtcgacctgcttaaggcggtgttccccggcggctcgatcaccggcgcaccgaagttgcgcagtatggagattattgatggcctggagaatgcgccgcgtggcgtgtattgcggcagcatcggctacctgggctacaactgcgtcgccgacctaaacattgcgatccgcagtctttcttatgacgggcaggaaatacgtttcggcgccggcggcgccatcaccttcctgtccgacccgcaggatgagttcgacgaagtgttgctgaaggcggaggcgatcctcaagccgatctggcattatctacatgcgccgaacactcccctgcactacgagttgcgagaggacaagctgctgctagccgagcactgcgttagcgaaatgccggccaggcaggccttcatcgaaccatga

SEQ ID NO: 3450 - protein, 716 aa, Xanthomonas albilineans
MRCLIINNYDSFTWNLADYVAQIFGEDPLVVHNDEYSWHELKDRGGFSSIIVSPGPGSVVNEADFHISLQALEQNEFPVLGVCLGFQGLAHVYGGRILHAPVPFHGRRSTVINTGDGLFEGIPQRFEAVRYHSLMVCQQSLPPVLKVTARTDCGVVMGLQHVQHPKWGVQFHPESILTEHGKRIVANFAKLAARHSAPLLAGSEQAGKVLSVCAPEMVTPRVRRMLSRKIKCRWQAEDVFLALFADEKHCFWLDSQLVCSPMARYSFMGAVNESEVVRHCVRPGSMVQEAGERFLAEMDRALQSVLTEDVAERPPFAFRGGYVGYMSYEMKSVFGAPASHANAIPDALWMRVERFVAFDHATEEVWLLALADTEDLSALAWLDAIEQRIHAIGQAAPACISLGLRSMEIELNHGRRGYLEAIERCKQRIVDGESYEICLTDLFSFQAELDPLMLYRYMRRGNPAPFGAYLRNGSDCILSTSPERFLEVDGHGTIQTKPIKGTCRRAEDPQLDRNLAMRLAASEKDRAENLMIVDLMRNDLSRVAVPGSVTVPKLMDIESYKTVHQMVSTVEARLRADCSLVDLLKAVFPGGSITGAPKLRSMEIIDGLENAPRGVYCGSIGYLGYNCVADLNIAIRSLSYDGQEIRFGAGGAITFLSDPQDEFDEVLLKAEAILKPIWHYLHAPNTPLHYELREDKLLLAEHCVSEMPARQAFIEP

SEQ ID NO: 3451 - DNA, 2088 bp, Streptomyces thioluteus
  CDS (1)..(2088): n means a or g or c or t/u, s means g or c
atgcgggtgctgttgatcgacaactacgactsstwcacctacaacctgttccagctcctcgccgaggtgtacggcaaggaaccgacggtcctcgtcaacgacgacccgtcgtggccggagctggacccggcgatgttcgactgcgtcgtcgtctcgcccggcccgggccgcccccagcacccggccgacctcggcttctgccaggaggtcctggaccgctggacggacaccccggtcctcggggtgtgcctggggcaccaggcgatcgcccaccaccacggcgcggacgtggccgagggcacgccgaagcacggtcacctggcgcgggtccggcacggcgggcgggacctcttcgacggcctgccgcagaacttcaccgcggtgcgctaccactcgctgcgggccgccgaacccctgccggaggagctggaggccaccgcctgggccgaggacggcaccgtcatggcgctgcggcaccgcacgctgccccgctggggcgtgcagttccacccggagtccatcgcgagcgagtggggcgcccaactgctccagaacttcgcgaagctcgtcggcgccgagtacgccgccgcgccccgggaacgggcgcggtgggccgccccgttggaggacgcccccgcggaggcgccggaactgcggcccgtgttcgaggtgatcgaccgggccgtggacaccgcggagctgttcaccacgctgtactccgcgagcgccggctgcttctggctcgacagcagcgcgccggggatcgggccggcccggttctcgttcctcggggacgactccggccccctcgccgagacgctgacgtaccggaccggggagaacacggtcgcggtgcgcgacgccgccggtgaacgggccgagcccggcaccatcttcgaggtgctccagcagcggctccgcgaccgccggctcagcacgccggagctgcccttcgacctcaacggcggctacgtcggctacttcggctacgagctcaagggcgagtgcggcagcccgaacgtccaccggtccgaaaccccggacgccgtctggacgttcgccgaccggctgatcgcggtggaccacctggaagagaagacctacgtcgtggccgtgagcggcaccgggccgggcgaggaggacgcggcccgggcctgggtgacggagaccgcccggcgggcccgcgaactgccggaccccgccccgtccgaggcacccgccccggccgccacggcgccgtccgaacaggtcgacatcgcccgcgaccgcggccagtacgtgagcgacatcaaggactgcctcgacgagctgcacagcggcgagagctacgagatctgcctgaccaaccggatccggctgcccgagctgaaggacccgctcggctaccacctcctgctccggcgcctcaaccccgccccctacggcgcgttcctgcgccacgagggcgtgagcgtcgtgtgctcctccccggagcggttcctgcggatcgaccgggacggcgtcgtggagagccggcccatcaagggaacggccccccggggcgaggacccggccgccgacgaggcgctccgggtgtcgctcgccgcctcggccaagacccgggccgagaacctcatgatcgtcgacctgctccgcaacgacctgggccgggtgtgcgaggtcggttccgtcgacgtccccgcctacatggtcaccgagacgtacgcgacggtgcaccagctggtcaccacggtccggggccgcctgcggcacgacgtggacccggtcgcctgcgtccgggcctgcttccccggcggctcgatgacgggcgccccgaagctgcggacgatggccatcatcgaccgcctggagcaggaggcccgcggcatctactccggcaccatcggctacttcgggctctccggcgccgcggacctcaacatcgtcatccgcaccgccgtctccaccggtacgggcacggtcatcggcaccggcggcgccatcgtcctcgactcggacccggacgaggagttcgacgaggtgctgctcaagggccacgcgctggtgcgggcgcacgggctgctggagggggccgcggaggccccgtag

SEQ ID NO: 3452 - protein, 695 aa, Streptomyces thioluteus
  Xaa in position 11 and 12 is unknown
MRVLLIDNYDXXTYNLFQLLAEVYGKEPTVLVNDDPSWPELDPAMFDCVVVSPGPGRPQHPADLGFCQEVLDRWTDTPVLGVCLGHQAIAHHHGADVAEGTPKHGHLARVRHGGRDLFDGLPQNFTAVRYHSLRAAEPLPEELEATAWAEDGTVMALRHRTLPRWGVQFHPESIASEWGAQLLQNFAKLVGAEYAAAPRERARWAAPLEDAPAEAPELRPVFEVIDRAVDTAELFTTLYSASAGCFWLDSSAPGIGPARFSFLGDDSGPLAETLTYRTGENTVAVRDAAGERAEPGTIFEVLQQRLRDRRLSTPELPFDLNGGYVGYFGYELKGECGSPNVHRSETPDAVWTFADRLIAVDHLEEKTYVVAVSGTGPGEEDAARAWVTETARRARELPDPAPSEAPAPAATAPSEQVDIARDRGQYVSDIKDCLDELHSGESYEICLTNRIRLPELKDPLGYHLLLRRLNPAPYGAFLRHEGVSVVCSSPERFLRIDRDGVVESRPIKGTAPRGEDPAADEALRVSLAASAKTRAENLMIVDLLRNDLGRVCEVGSVDVPAYMVTETYATVHQLVTTVRGRLRHDVDPVACVRACFPGGSMTGAPKLRTMAIIDRLEQEARGIYSGTIGYFGLSGAADLNIVIRTAVSTGTGTVIGTGGAIVLDSDPDEEFDEVLLKGHALVRAHGLLEGAAEAP

SEQ ID NO: 3453 - DNA, 1707 bp, Listeria monocytogenes
  CDS (1)..(1707)
atgagcttattacgatttgattttgaaggcgacacaaaaatttttgaaaatccactgtatgaactagttacgcatgatttagcagaagttcttcctataatgaaagcagccgaagaagcccaaaaatcaggaaaatacgtcgccggttttgtcagttatgaggccgcgcctgcttttcgaagtaatttaaaaacaaaaaaaccgagcggaaacatgcccctcgtctggtttggcgtatacgataattttaacgttacagctaccgaaacaccagattcctcgccgctctcttttaaaatgaatactagtttccctgaatacgccgagaaaatagagcaaatcaaagctgaaattgcagctggaaatacttaccaaataaactacaccgtgcgacttcaaagtgatgtgccaaacagcttttcttctcaagcgacttatgaaacgttacagcagattggaaaggcgaattacaccgccctactttcaaccagtgactttgagattatctcggcttcacccgagctcttttttaaatggaaggaaaatcttctaacgacacgcccgatgaaaggtactattcgccgcggaataacggagcaagcggacttagaagcacatgattggctaaaaaacgatcctaaaaaccgtgcagaaaatgtgatgattgtcgatttactacggaacgaccttgggatgattgctgtacccgggagtgtcaaggttcctaagttaatgacgctagaaccttacccaactgtttggcaaatgacttcaaccgttacagcagaaacacctcctgagactgatttaacagctgtttttaaagcactcttcccatgtggctcaataactggtgcgcctaaagcacgaacaatggaaattatttcagaactagaagattctcctcgtggtgtttactgcggagcaattggctttttagaacctaacggaaatgcgattttcaatgtaccgattcgtactattgctatcgcagacaacaaggcaacttatggtgttggtggcggtatcgtctgggattcggaagccgctagcgaattttccgaaatccacgcaaaatcagctattttagaaaagacgacaaaattttctttaattgaatgtttgcgaattgaaaatggtgagcttttccgaaccgaatatcatttaaaacgactacaaacaagcgcagactttttcggtattccttttaatagggaagaaacagagaaactatggaccaaaactgcgcaaaaaaatacgaccgacacatacaaaatgcgctttttattacatcctgatggcgcacatgatctagaactaacaagaattgatacaaaaaacaagcgaataacagcgcaacttgctgataaaccagtcccttcgaatgatttatttctctatcataaaacgactcatcgaaaggtctatgaaaacttaaaaaatactcaaaccgaggaaacactactttggaatgaacggggtgaactgacagaatttattaacgggaatatagttctaggtataaatggctgttttttcacgccaccagtaacttcaggtcttctttcagggacaatgagagcagaactattagctaaaaataagatttccgagaaaacactagcaaaaaaagaccttttagaagcggactatgtgtggttaattaatagcgtaagaggatttatagaagtagaaatcaaacaataa

SEQ ID NO: 3454 - protein, 568 aa, Listeria monocytogenes
MSLLRFDFEGDTKIFENPLYELVTHDLAEVLPIMKAAEEAQKSGKYVAGFVSYEAAPAFRSNLKTKKPSGNMPLVWFGVYDNFNVTATETPDSSPLSFKMNTSFPEYAEKIEQIKAEIAAGNTYQINYTVRLQSDVPNSFSSQATYETLQQIGKANYTALLSTSDFEIISASPELFFKWKENLLTTRPMKGTIRRGITEQADLEAHDWLKNDPKNRAENVMIVDLLRNDLGMIAVPGSVKVPKLMTLEPYPTVWQMTSTVTAETPPETDLTAVFKALFPCGSITGAPKARTMEIISELEDSPRGVYCGAIGFLEPNGNAIFNVPIRTIAIADNKATYGVGGGIVWDSEAASEFSEIHAKSAILEKTTKFSLIECLRIENGELFRTEYHLKRLQTSADFFGIPFNREETEKLWTKTAQKNTTDTYKMRFLLHPDGAHDLELTRIDTKNKRITAQLADKPVPSNDLFLYHKTTHRKVYENLKNTQTEETLLWNERGELTEFINGNIVLGINGCFFTPPVTSGLLSGTMRAELLAKNKISEKTLAKKDLLEADYVWLINSVRGFIEVEIKQ

SEQ ID NO: 3455 - DNA, 1374 bp, Listeria monocytogenes
  CDS (1)..(1374)
atgattaagatgagaaaaacgaaaaaaatagatgctgacacactaacggctattctggcgtttcaaagaatttcaggtacagggaaaagtttgctagagggggcggcgaaagatgcggaggctggacgttattcgatcattgctattaatccagtccatgaaattaaagtatatcaacatgattattatatcgacggtatacatcaagttgtcgcagatcctttaaaagaaattgaattatttatcgaaaaagcaaaagaagatgaagcagatttaccgcttgattcaggtgcaattggttatgttggttatgatgtcattgcgctttatgagaatttaggcgaaattccagtagaaactcgggatatgccagatattcgtttttatgtatatgaaagttttgtgattatggatcatcaggcggaagaacttattttagtgcaagataattgctattcgggaagaagtgaggcggaactagataaggcgcttgaattaatgtttactgaacttacaacgccgaaaaaggaagagcacaaggctgtccatgttcccaaaatgacatacaagagtaactacacgaaagaggagtacatggggttagtgaaaaaagcaaaaacctatatccaagagggtgacttctttcaaattgttctctcgcaacgactagaagcagatttcaccgtgacaccatttgattattatcggaaattacgtttattaaatccttctccttatctttatttcattgattttggggatacagtgctaattggctcttcgccagaaagtttgattaaaacgaaagggcggacggtaattacgaatcctattgcaggaacaagacggcgcggggcaacgaaacaagaagatgaattacttgcttcggaattgttagcggatgaaaaagaattggcagagcaccggatgttagtagatcttgggcgaaatgatattgggaaaatcgccgaaactggatcggtgcatgtgcctgtttaccttactattgaaagataccgtttcttaatgcatttagtttcagtagtagaaggaaccttaaaacccggacttactgcaatggatgctcttcggtcgacgcttccggctggtacagttagcggagcaccgaaaataagagccatggagcgaatctatgaatgggaaaatgtaaaacgtggcccatatgctggtgcggttggttatttaactaaaaatggtgattcggatttcgcgctttcgattagaacaatggtacttcataacggaaaagcttatgttcaagctggtgcaggaattgtctatgattccgatccagaaagcgaatacttagaaacattacaaaaagcaaaggcacttttggaggtgggagaatga

SEQ ID NO: 3456 - protein, 457 aa, Listeria monocytogenes
MIKMRKTKKIDADTLTAILAFQRISGTGKSLLEGAAKDAEAGRYSIIAINPVHEIKVYQHDYYIDGIHQVVADPLKEIELFIEKAKEDEADLPLDSGAIGYVGYDVIALYENLGEIPVETRDMPDIRFYVYESFVIMDHQAEELILVQDNCYSGRSEAELDKALELMFTELTTPKKEEHKAVHVPKMTYKSNYTKEEYMGLVKKAKTYIQEGDFFQIVLSQRLEADFTVTPFDYYRKLRLLNPSPYLYFIDFGDTVLIGSSPESLIKTKGRTVITNPIAGTRRRGATKQEDELLASELLADEKELAEHRMLVDLGRNDIGKIAETGSVHVPVYLTIERYRFLMHLVSVVEGTLKPGLTAMDALRSTLPAGTVSGAPKIRAMERIYEWENVKRGPYAGAVGYLTKNGDSDFALSIRTMVLHNGKAYVQAGAGIVYDSDPESEYLETLQKAKALLEVGE

SEQ ID NO: 3457 - DNA, 1599 bp, Desulfovibrio vulgaris
  CDS (1)..(1599)
atggagatggacgacgcgaaaaggcccgcaggcgcgaaacggcgcacgggcggtgaagaggacgcaggtcgtgtcgccggtcacgccacgacgcaggacaatgctcatgcgatgcccagcacgcaagccggcacgcaagccgggggcgcaggtgcccatgcggatgcgaatccggctggatgcccggatgggcgcatcgtgctgcggcagtcgtgcagcctgcttgagggcgatgtggatacgcccatcagtctgtttctgggcatggtggggtcggggcagggcatcctgctcgagagtgccgaggtggacggacgctgggggcgttacagcatcatcggcttcaacttccttctgcgtctcggctgtgcggcagggcggcttgaggtggcagtacgcgacccgcgtcttgcggcactgaaggagctggaggggatgcccttcatcgagggcgtgcgtgccgtcatgcggcggctgaccatcgaaccggaccccgacttcgccaaccagccgcccatcacgcgagccctgtacgggtacatgggctacggcgtggcaggtctgctcgaacccaaactcgccccggtgctacgggcggaagcggcagaggcgtgtcttgccctgccgggcacggtggtggtcttcgaccatctctacaaccgcctgaccatgctctcgctcaccgaccgcaacggtctgcgcatcgaccgttcggtgctcgaccgtgcgccgcagacgccggaggtggggcccacccgcgcggtgcccgacgagtcagcctacaagcgcgccgtggagcgcacccgcgagatgatccggcagggcgaggccatacaggtggtgctctccacgcggttccaggcgtccttcaatggcgaccccttcacgctgtaccgcagactgcgacgcatcaacccctcgccctacatgttcttcatgcgcctgccgggtgtctcgctgctgggttcgtcgccggaggtgatggtgcgttgcagcaaggggcggttgcaggtcagccccatcgccggaacccgtccgcgcggggtcgatgacgtcgaagacgcgcgcctcgcggcggaattgctcgatgaccccaaggaacgcgccgaacatgtcatgctggtcgacctcgggcgcaacgacctcgggcgcatcgccgcccccggtacggtgcaggtcgagcggttcatggaggtggagaagttctcgcacgtcatgcacctcacctcgcgggtgaccgcagacctcgcagaggggcacgacgcactggacgtgctgacggccacgtttccggcaggcacggtgagtggtgcccccaaggtgcgcgccatggaaatcatcgccgaggccgaaggacagccgcgcggcccctatgccgggtgcataggctggttcggactcgaccgtgacagcgtgagtctcgacaccggcatcaccatccgcagcatgtgggtgcgcgaggggcaggtgcactggcaggcgggggcgggcatcgtgttcgactcgaaacccgccgcggaatggaaggagtgctgcaacaaggcggcggccatgcgtgccgcactggatggaggctgtcatgttcctgctcatcgataa

SEQ ID NO: 3458 - protein, 532 aa, Desulfovibrio vulgaris
MEMDDAKRPAGAKRRTGGEEDAGRVAGHATTQDNAHAMPSTQAGTQAGGAGAHADANPAGCPDGRIVLRQSCSLLEGDVDTPISLFLGMVGSGQGILLESAEVDGRWGRYSIIGFNFLLRLGCAAGRLEVAVRDPRLAALKELEGMPFIEGVRAVMRRLTIEPDPDFANQPPITRALYGYMGYGVAGLLEPKLAPVLRAEAAEACLALPGTVVVFDHLYNRLTMLSLTDRNGLRIDRSVLDRAPQTPEVGPTRAVPDESAYKRAVERTREMIRQGEAIQVVLSTRFQASFNGDPFTLYRRLRRINPSPYMFFMRLPGVSLLGSSPEVMVRCSKGRLQVSPIAGTRPRGVDDVEDARLAAELLDDPKERAEHVMLVDLGRNDLGRIAAPGTVQVERFMEVEKFSHVMHLTSRVTADLAEGHDALDVLTATFPAGTVSGAPKVRAMEIIAEAEGQPRGPYAGCIGWFGLDRDSVSLDTGITIRSMWVREGQVHWQAGAGIVFDSKPAAEWKECCNKAAAMRAALDGGCHVPAHR

SEQ ID NO: 3459 - DNA, 1899 bp, Thermus thermophilus
  CDS (1)..(1899)
atgcttgaccatccttgccctcaatatactgcgcctgtggccgggggtctgcttgggctctaccacgccgcccggtgctcgggcctgaggcccgccctcctggagtccttggggccgaggacgcccttttcccggctctccctcctcggggtggggcccgtgcaccgcctcgaggtctgggaggggaggctctacctggacggcaggcgggtgggggaggccctggaggtcttccgctacctggaaaggggcctaggcaagggcttcttccccgcctggatcgggtttttcgcctacgagttcgcccgccacctgggcctttccgcccacaaccccctccccggcctccccgaggccttcttcctctactaccccgaggggtacgccctctttgaggggaggctcgtgcaggccccctccttccccttgcggcccctgccctacgcccccccgccccttccccgccaccccctggtctcggacttcccccgggaggccttcttgcgcggggtggaggaggtgcgggagaggatccgcgccggggtggtctaccaggtgaacctctcccaccgcttccgcctcctaggccccgtggaccccctcctcctctacgccaggcttcgcgccctgaacccctcccccttcatggggcttttggagggggaggggtgggccgtggtctcggggagcccggagaggctcttccagaaggtgggccccagggtcttggcccggcccatcgccgggacgcggcctaggggaaggacggaggcggaggacttggccttagagcgggagctcctcgcctctcccaaggagcgggcggaacacgtgatgctcttggacctcctccggaacgacctcgcccgggtggcccgcccggggacggtgcgggtccgggagcttttcaccgtggagcgctacgcccacgtgatgcacctggtctccgaggtggagggccgcaccggggcctccttgggggaggtcttccagagcctcttccccggggggacgatcaccggggcccccaaggggacggtgatggaggccataagggagctggagcccgtcccccggggggcctacacggggagcctggggtacgtctcggggcggggggcggacttcaacatcctcatccgttccttccagaaggtgggggaggaggtcctcttctccgcgggggcgggcgtcgtcatcgcctcggaggcggagcgggagtacgaggagaccctccacaaggcgcaaagcctcctcctggccttggaaagggggaggccggggaagccccccgaggccccgaggccccgggcctcctggagcccgcccatgccctcgaggcggtacggggcccgggtcctcttcctggagaaccgggactccttcagccacaacctggtggactacctgcgggccctgggggccgaggtcgcggtggtggaccaggaggaggccccggacctcaagggcttcacccacctggtggtgggccccgggcccaaggaccccttcaccgcggggcgcgtcctggagtggacggagaaggccctggcggcggggcttcccctcctcggggtctgcctgggccaccaggccctaggggtggccctgggggcggagctttaccgggaggcccccgtgcacggggaggcccacgccgtcttccacaccggggagggcctctttagggggatcccgagccccgcccccttcgcccggtaccactccctggccttaaggcgcctttccccggggcttaggctcctcgcctggacggaagacggcgtgcccatggccatctgggacgggaggcgggcctacggggtccagttccacccggaaagcctgctttccccttacggcatgctccttctcgcccggttcctggaggtgggatga

SEQ ID NO: 3460 - protein, 632 aa, Thermus thermophilus
MLDHPCPQYTAPVAGGLLGLYHAARCSGLRPALLESLGPRTPFSRLSLLGVGPVHRLEVWEGRLYLDGRRVGEALEVFRYLERGLGKGFFPAWIGFFAYEFARHLGLSAHNPLPGLPEAFFLYYPEGYALFEGRLVQAPSFPLRPLPYAPPPLPRHPLVSDFPREAFLRGVEEVRERIRAGVVYQVNLSHRFRLLGPVDPLLLYARLRALNPSPFMGLLEGEGWAVVSGSPERLFQKVGPRVLARPIAGTRPRGRTEAEDLALERELLASPKERAEHVMLLDLLRNDLARVARPGTVRVRELFTVERYAHVMHLVSEVEGRTGASLGEVFQSLFPGGTITGAPKGTVMEAIRELEPVPRGAYTGSLGYVSGRGADFNILIRSFQKVGEEVLFSAGAGVVIASEAEREYEETLHKAQSLLLALERGRPGKPPEAPRPRASWSPPMPSRRYGARVLFLENRDSFSHNLVDYLRALGAEVAVVDQEEAPDLKGFTHLVVGPGPKDPFTAGRVLEWTEKALAAGLPLLGVCLGHQALGVALGAELYREAPVHGEAHAVFHTGEGLFRGIPSPAPFARYHSLALRRLSPGLRLLAWTEDGVPMAIWDGRRAYGVQFHPESLLSPYGMLLLARFLEVG

SEQ ID NO: 3461 - DNA, 1422 bp, Leptospira interrogans
  CDS (1)..(1422)
atggaaactccagtttctctgtttgcaaaatggggatgtgaatcttctcaaaattccttcctactcgaatctgtagaaggcggagaaaaactgggaagaaattcttttttaggtaaaactccttctcgtctccttcaaggtaaggacggtcttttttatatcacagttgcaaatgaacctcctacagaagtaatcacttatgatcctttggttcttttagaaaatcttttgggagatgacgtatatgttcaagattatcgtcttcctccttttgcaggtggagcggtcggttttttatcctttgccgcggttcgttattacgaaaatattccagatacaaaaccagaagatgaaaatgcccccgactgctattttggaatttatgatgaacttctaatagtcgatcatattgatcatgtgttaagaattgttgtcaatgcaagagtcggagaacactcctccctgagagaatgttacgattttgtaattgataaaatcaactctatcgaaaacgaaattcgaaacggaagtatcccggaagagatcaaaaatcctaaaatagcaaccggaagtctagagttaaatccgaatattccagatgaagaatataagaaaaatgtagaaaaagccaaagaatatattcaagcaggagatatttttcaggtagttccttcccgtaagttgaaatttaagccggatgttcctccgtttcaagtctatcgtggcttaagaaccgtaaatcccagtccctacatgtattatcttaagttaggcgaaattaccatcgtcggaagttctcccgaaattatggtaaaatacgctggaaatcagacctatcttcgtccgatcgccggaacccgtccacgaggcaaaaatccaaatgaagataagtttctagaagagaatcttctttctgatcctaaagaaatttccgaacatattatgttagtcgacttaggacgtaacgatctaggaagagtttgtaaacctggaagcgttcacgtgaatgatttcaaagttattgaaaaatattcccacgttatgcacattgtaagtcagtgttccggcgaactggacgatgaaaaaactgtttacgatttgattcgcgccgctcttcccgcagggaccgtgtcgggtgcgcctaaaatccgcgcgatggagattatagacgaattagaaacaactcgaagagcgatttattctggtgctttgggctatatttctttttcgggagaaactgatcttgcaatcatcattcgtacgatcgtgttttacaaagacacggcgttcttacaggcaggcggaggagttgtatacgattcggttccagagttggaattagaagaaacgaaaaataaaatggcagcgcttttaaaagcggtagagttcgcaagaaatggactcaaaggagaatggaaataa

SEQ ID NO: 3462 - protein, 473 aa, Leptospira interrogans
METPVSLFAKWGCESSQNSFLLESVEGGEKLGRNSFLGKTPSRLLQGKDGLFYITVANEPPTEVITYDPLVLLENLLGDDVYVQDYRLPPFAGGAVGFLSFAAVRYYENIPDTKPEDENAPDCYFGIYDELLIVDHIDHVLRIVVNARVGEHSSLRECYDFVIDKINSIENEIRNGSIPEEIKNPKIATGSLELNPNIPDEEYKKNVEKAKEYIQAGDIFQVVPSRKLKFKPDVPPFQVYRGLRTVNPSPYMYYLKLGEITIVGSSPEIMVKYAGNQTYLRPIAGTRPRGKNPNEDKFLEENLLSDPKEISEHIMLVDLGRNDLGRVCKPGSVHVNDFKVIEKYSHVMHIVSQCSGELDDEKTVYDLIRAALPAGTVSGAPKIRAMEIIDELETTRRAIYSGALGYISFSGETDLAIIIRTIVFYKDTAFLQAGGGVVYDSVPELELEETKNKMAALLKAVEFARNGLKGEWK

SEQ ID NO: 3463 - DNA, 1413 bp, Bacillus cereus
  CDS (1)..(1413)
atgacgaaagaagaatttataaaacaaaaaagagagagaaagacatttttagtaatcactgaagaagaaggagatagcattacgccaatttctttatatagacgtatgaaagggaagaagaaattcttattagaaagttcacagcttcatcaagataaaggacgctattcctacttagggtgtaatccgtatggggaagtgaaaagtatcggtacggaagtggaacgaacgatttacggccgggcagaaaagttgcaaggtaacgtactagaagtgttagaagaaatcgcgtcagctcaagtagacagtccatttccgttttgcggaggagcagttggttatattggctatgacgttattcggcaatatgaaaacattggagcaaatttacacgatccattgaatattccagaggtacaccttttactgtaccgtgagtttatcgtgtatgaccacttacgccaaaagttgtcgtttgtatatgtatgcagggaagatgatgcagcagattatgaagaagtatacgaaaggctgcgagtatacaaagaggaagtgctacagggagaagaagcggaagtaactgaaataagatcaacattatcattcacttcttctataacggaaaaagaattttgcgtaatggtagaaacggcgaaagaacacattcgagccggggacatattccaagtcgtattatcccagcgtttacaaagtgaatgtattggtgatccattcgcgttataccgaaaactacgaattgccaatccatcaccatatatgttttatatcgattttcaagattatgttgtaatcggttcttcgccagaaagtttgctatcggtaagagaggataaagtgatgacaaatccaattgctggtacgaggccgagagggaagacaaagcaggaagatacggaaattgaaaaagagctgttagaaaatgagaaagagcgagcagagcatatgatgcttgtagatcttgggcgaaatgatattggtagagtgagtgaaatcggctcagttacgatagataaatatatgaaagtagaaaaatattctcacgttatgcacattgtatctgaagtttacggaacattgcgaaaacaaatgagcggatttgatgcattagcgcattgcttaccggcggggacggtatcaggtgctccgaaaattagagcgatggaaattataaatgagctagagaatgaaaaaagaaatgtgtacgccggtgcagttggatacgttagtttttcagggaatcttgatatggcgcttgccattcgaacaatggtcgtgaaagatgagaaagcatacgttcaggcaggagcggggattgtctacgattcagacccagttgctgaatatgaagaaacattaaataaagcgagagcgctcttggaggtaatgaaatga

SEQ ID NO: 3464 - protein, 470 aa, Bacillus cereus
MTKEEFIKQKRERKTFLVITEEEGDSITPISLYRRMKGKKKFLLESSQLHQDKGRYSYLGCNPYGEVKSIGTEVERTIYGRAEKLQGNVLEVLEEIASAQVDSPFPFCGGAVGYIGYDVIRQYENIGANLHDPLNIPEVHLLLYREFIVYDHLRQKLSFVYVCREDDAADYEEVYERLRVYKEEVLQGEEAEVTEIRSTLSFTSSITEKEFCVMVETAKEHIRAGDIFQVVLSQRLQSECIGDPFALYRKLRIANPSPYMFYIDFQDYVVIGSSPESLLSVREDKVMTNPIAGTRPRGKTKQEDTEIEKELLENEKERAEHMMLVDLGRNDIGRVSEIGSVTIDKYMKVEKYSHVMHIVSEVYGTLRKQMSGFDALAHCLPAGTVSGAPKIRAMEIINELENEKRNVYAGAVGYVSFSGNLDMALAIRTMVVKDEKAYVQAGAGIVYDSDPVAEYEETLNKARALLEVMK

SEQ ID NO: 3465 - DNA, 1443 bp, Bacillus cereus
  CDS (1)..(1443)
atggttaatataagagggtgggataaaagaagacggggtgttgatatgcaacgaagaaaatctttagcgctttctattccatatcagttagatttctttaagcaatataaatttctttctaaggataaaccgcaacatattttgttagagagtgggcgtggcggtcgttataacattgtggggttaaacccggtagcggtaatccgagggaagggtaaaacattacatataagtgaaagtggtaaggaaacaataaagcaaggaaacccattagatttaatgcaggaatatatggagcgatggaaaacggattataatccggaatacccgccttttcaaggtggtgcaattggctactttagttatgattgcatccgttatattgaaaaacttccttctcttgccgaggatgatattaatatacctgacatattctttttattatttgatgatgtgtttgtgtatgatcaagaagaaaaagtattatggattattacacattatgcagataagcatgaagaggcaaaagaacgattaaatgaatggaaggttctttggacgacagaagcgccagaagtgactatgccgtttgcgtgccctgaaaagaaaagtgaagcagttgcttttactgaagaaggttttatgaaggcagttgaatgtattcaagaatatattggtgctggtgatgtgttccaagtgaacttgtcaacaagacaagaaagaacgttacaaacacatccactagaaatttatacaagtcttcgcgaaattaatccatctccatatatgggttacttggagcttggggattttcaaattgttagtggatcgccggagttgctaattaagaaacaaggagctgaagtaagtacaagaccaattgctggaacgagatctagaggggcgaatgagcaagaggatgaagagttggcaagagaattaattgagaatgaaaaggaacgagcagagcatgtcatgcttgtagatttagagcgaaatgatttagggcgtgtttgtaaatatggcactgtagaagtagatgaatttatggtaattgagaaatactcacacgttatgcatattgtttctaatgtgcgtggtgaggtggaagaagataaagatgcttttgatttagtgaaggctgtattccctggggggacaattactggtgccccgaaaatacgtacgatggaaattattgaagaactagaacctgttcgccgagggatttatacaggttcaattggttggattggttattctggagatacagaattgaatattgtgattaggacacttcttgctaaagatggaaaagcacatgtacaagcgggagcgggaattgtaattgattcaaatccggaaaatgaatataaagagtcgttaaaaaaggcgattgctttatggcgtgcaaaagaacgtagcgaagaaacggttaggtga

SEQ ID NO: 3466 - protein, 480 aa, Bacillus cereus
MVNIRGWDKRRRGVDMQRRKSLALSIPYQLDFFKQYKFLSKDKPQHILLESGRGGRYNIVGLNPVAVIRGKGKTLHISESGKETIKQGNPLDLMQEYMERWKTDYNPEYPPFQGGAIGYFSYDCIRYIEKLPSLAEDDINIPDIFFLLFDDVFVYDQEEKVLWIITHYADKHEEAKERLNEWKVLWTTEAPEVTMPFACPEKKSEAVAFTEEGFMKAVECIQEYIGAGDVFQVNLSTRQERTLQTHPLEIYTSLREINPSPYMGYLELGDFQIVSGSPELLIKKQGAEVSTRPIAGTRSRGANEQEDEELARELIENEKERAEHVMLVDLERNDLGRVCKYGTVEVDEFMVIEKYSHVMHIVSNVRGEVEEDKDAFDLVKAVFPGGTITGAPKIRTMEIIEELEPVRRGIYTGSIGWIGYSGDTELNIVIRTLLAKDGKAHVQAGAGIVIDSNPENEYKESLKKAIALWRAKERSEETVR

SEQ ID NO: 3467 - DNA, 1476 bp, Geobacter sulfurreducens
  CDS (1)..(1476)
atgtatttccccgatgtggatacctttcgcgccctgggcgcccggggtaacctgattcccgtctgccgcgagatcatggcggatatggacaccccggtcagtgccttccgcaagctcgacgacggccgctatgccttcctcctggagagtatcgaggggggcgaaaagtgggcccgctataccttcctcggcgccagcccctccacggtcatccggagccggggcaccaccgtcgagatcatcaccaacggcgagacccgttccgtgacgacggacgaccccctcggctttgtccgcgatttcctggcccggttccggcccgtggagatccccgggcttccccgcttcttcggcggcgccgtggggtacctcggctacgacatggtccgccaattcgagcggcttcccacggacaaacccgccgtgatcggcgcctgggactcctgtttcctcatcaccgacaccatcgtgattttcgacaatatgcgccagaagatcacggtggtctccaatgcccacctggacgagggcgtttccgtcgaagcggcctatgccgacgccgttgcccggatcgacgggatcattgcccggctcaaggcgccgctgccggcccagcccgccgcggccgcggcccggaaggtctccttttcttccaacatcacccgggaggcgttcgaggatgccgtggaacgggccaaggagtacgtccgggccggcgacatcatccaggtggtcctgtcccagcgtttttccggcgagctcaccgtggaccctctcgacatctaccgggtattgcggaccctgaacccgtcgccctacatgtttttcctccgcctggacgataccctggtggtgggcgcctctcccgaagtcatggtgcgtcgggaggggaaccgggtggagctccgccccatcgccggcacccgcccccggggcgccacgccggaacaggacgagcaactggcggaggaactcctggccgaccccaaggagcgggccgagcacgtgatgctcgtggacctggggcgcaacgacctggggcgggtctgccgcaccggcaccgtgaaggtgtcggagctcatggtgatcgagcgctactcccacgtgatgcacatcgtttccaacgtccagggcgaactggccgaggggagggacgccttcgacgtggtgcgggccaccttcccggccggcaccctctccggcgcccccaaggtgcgggccatggagatcatcgacgagctggagccggtgcgccgggaagtctacggcggcgccgtgggctacttctccttctccggcaccatggacctggccatcgccatccgcactctcgtcatccgcgacggcgtggtgcacctccaggccggggccggcatcgtggccgactctgatccggcctccgagtaccaggagacggtcaacaaggccatggccgtggtaaaggccatcgagaccgcggaaaaggggttggactga

SEQ ID NO: 3468 - protein, 491 aa, Geobacter sulfurreducens
MYFPDVDTFRALGARGNLIPVCREIMADMDTPVSAFRKLDDGRYAFLLESIEGGEKWARYTFLGASPSTVIRSRGTTVEIITNGETRSVTTDDPLGFVRDFLARFRPVEIPGLPRFFGGAVGYLGYDMVRQFERLPTDKPAVIGAWDSCFLITDTIVIFDNMRQKITVVSNAHLDEGVSVEAAYADAVARIDGIIARLKAPLPAQPAAAAARKVSFSSNITREAFEDAVERAKEYVRAGDIIQVVLSQRFSGELTVDPLDIYRVLRTLNPSPYMFFLRLDDTLVVGASPEVMVRREGNRVELRPIAGTRPRGATPEQDEQLAEELLADPKERAEHVMLVDLGRNDLGRVCRTGTVKVSELMVIERYSHVMHIVSNVQGELAEGRDAFDVVRATFPAGTLSGAPKVRAMEIIDELEPVRREVYGGAVGYFSFSGTMDLAIAIRTLVIRDGVVHLQAGAGIVADSDPASEYQETVNKAMAVVKAIETAEKGLD

SEQ ID NO: 3469 - DNA, 1506 bp, Ashbya gossypii
  CDS (1)..(1506)
atgactgtcacaatcgaaccagggctagaagcactcgagcggtgcatcgcagataacgggccggatgtcacactatacccgctctacacgtatgtgtccgccgaggagaccacgccgcatgcggcctacttaaagctggcacgtctcgatcagaacgatcacgtgccatcgtttctgctggagtccgcgaagactatggacgcgatggcgcggttctcctatatgggggtagcaccacgtcgggttctgcgcactaatgcaggtgccggggacccactgaagttgctggccgcggagttcgcgcggctgcgacccgcacgcaacacgccacagctaccagggctgagcggcggggcggtgggctacgtatcgtacgattgcgtgcgctactttgagccaaggacggctcgggagctagcggacccgctggagctgcctgaagcggctctcatgctgtttgacacggtagttgcgtacgaccacgtgtttcaccgcttccaggtggtacacaacatgcagctggagccgggaatagacctgaatgcggcatacgaggacgcaactagggccattcgcgatgtggtagataggctgacggcgagcacgcccgtgccgcagccgccgcagccgcctatccggcgggggcaggagttcagctccaatgtgggacaacagggctacgaagagtacgtgcggcgcctcaaggaacacatatacgcaggcgacatcattcaggctgtgccatcgcagcgggttgcgcggccgacgtcgctccacccgtttaacatttaccgccagctacgcatggttaacccgtcgccgtacatgttctacctggattatggagacttccaggtcgtgggtgcgtcgccagagctgctgtgcaaagtagacgaagagcggcaggtcgtcacgcatccgattgcgggcaccattcgccgtggcgtcacgcagcaggaggacgatgcacttgctgcagagcttcgcaactccgttaaggaccgagctgagcatgtcatgcttgtggacctggcgcggaacgacatcaaccgggtgtgtgacccactgacgactcgggtggacaaactaatgacggtgcagcgcttttcacacgtacagcacctggtctctgaggtaactggcaccctgcgcccagacaaggaccgttttgatgccttccgctctgtgttccctgctggcactgtctctggcgcccccaaagtccgcgctatggagctcatcggagagttggagggcgagcgtaggggcgtctacgccggagctgtaggccactggtcttacgatggtgtttcgatggatacctgtatcgcactgcgcactatggtctacaagggcggtgtggcctatctacaggctggcggcggaattgtccacgattccgatccatacgacgaatatgtcgagacgatgaacaaaatgctggcgaatcacaacacaattctgcaggcagaggaactgtgggctgaaaagataggcagtgaatag

SEQ ID NO: 3470 - protein, 501 aa, Ashbya gossypii
MTVTIEPGLEALERCIADNGPDVTLYPLYTYVSAEETTPHAAYLKLARLDQNDHVPSFLLESAKTMDAMARFSYMGVAPRRVLRTNAGAGDPLKLLAAEFARLRPARNTPQLPGLSGGAVGYVSYDCVRYFEPRTARELADPLELPEAALMLFDTVVAYDHVFHRFQVVHNMQLEPGIDLNAAYEDATRAIRDVVDRLTASTPVPQPPQPPIRRGQEFSSNVGQQGYEEYVRRLKEHIYAGDIIQAVPSQRVARPTSLHPFNIYRQLRMVNPSPYMFYLDYGDFQVVGASPELLCKVDEERQVVTHPIAGTIRRGVTQQEDDALAAELRNSVKDRAEHVMLVDLARNDINRVCDPLTTRVDKLMTVQRFSHVQHLVSEVTGTLRPDKDRFDAFRSVFPAGTVSGAPKVRAMELIGELEGERRGVYAGAVGHWSYDGVSMDTCIALRTMVYKGGVAYLQAGGGIVHDSDPYDEYVETMNKMLANHNTILQAEELWAEKIGSE

SEQ ID NO: 3471 - DNA, 1362 bp, Shigella flexneri
  CDS (1)..(1362)
atgaagacgttatctcccactgtgattactttaccctggcgtcaggacgccgctgaattttatttctcccgcttaagccacctgccgtgggcgatgcttttacactccggctatgccgatcatccgtatagccgctttgatattgtggtcgccgatccgatttgcactttaaccactttaggtaaagaaaccgttgttagtgaaagcgaaaaacgcacaacgaccactgatgacccgctacaggtgctccagcaggtgctggatcgcgcagacattcgcccaacgcataacgaagatttgccatttcagggcggcgcactggggttgtttggctacgatctgggccgccgttttgagtcactgccagaaattgcggaacaagatatcgttctgccggatatggcagtgggtatctacgattgggcgctcattgtcgaccaccagcgtcatacagtttctttgctgagtcataatgatgtcaatgcccgtcgggcctggctggaaagccagcaattctcgccgcaggaagatttcacgctcacttccgactggcaatccaatatgacccacgagcagtacggcgaaaaatttcgccaggtacaggaatatctgcacagcggtgattgctatcaggtgaatctcgcccagcgttttcatgcgacctattctggcgatgaatggcaggcattccttcagcttaatcaggccaaccgcgcgccatttagcgcttttttacgtcttgaacagggtgcaattttaagcctttcgccagagcggtttattctttgtgataatagtgaaatccagacccgcccgattaaaggcacgctaccacgcctgcccgatcctcaggaagatagcaaacaagcagaaaaactggcgaactcagcgaaagatcgtgccgaaaatctgatgattgtcgatttaatgcgtaatgatatcggtcgtgttgccgtagccggttcggtaaaagtaccagagctcttcgtggtggaacccttccctgccgtgcatcatctggtcagcactataacggcgcgactaccagaacagttacacgccagcgatctgctgcgcgcagcttttcctggtggctcaataaccggggctccgaaagtacgggctatggaaattatcgacgaactggaaccgcagcgacgtaatgcctggtgcggcagcattggctatttgagcttttgcggcaacatggataccagcattactatccgcacgctgactgccattaacggacaaatatactgctctgcgggcggtggaattgtcgccgatagccaggaagaagcggaatatcaggaaacttttgataaagttaataagatattacgccaactggagaagtaa

SEQ ID NO: 3472 - protein, 453 aa, Shigella flexneri
MKTLSPTVITLPWRQDAAEFYFSRLSHLPWAMLLHSGYADHPYSRFDIVVADPICTLTTLGKETVVSESEKRTTTTDDPLQVLQQVLDRADIRPTHNEDLPFQGGALGLFGYDLGRRFESLPEIAEQDIVLPDMAVGIYDWALIVDHQRHTVSLLSHNDVNARRAWLESQQFSPQEDFTLTSDWQSNMTHEQYGEKFRQVQEYLHSGDCYQVNLAQRFHATYSGDEWQAFLQLNQANRAPFSAFLRLEQGAILSLSPERFILCDNSEIQTRPIKGTLPRLPDPQEDSKQAEKLANSAKDRAENLMIVDLMRNDIGRVAVAGSVKVPELFVVEPFPAVHHLVSTITARLPEQLHASDLLRAAFPGGSITGAPKVRAMEIIDELEPQRRNAWCGSIGYLSFCGNMDTSITIRTLTAINGQIYCSAGGGIVADSQEEAEYQETFDKVNKILRQLEK

SEQ ID NO: 3473 - DNA, 1419 bp, Wolinella succinogenes
  CDS (1)..(1419)
atggagatttttcacgaaagactcttggtcgatcagctcactcccgtctctctttatgcaaaattgcgtgaattttttgcgggagagaccacttttttgttcgagagcgccgctagcagtagcgagagtgggactcacagctttatcatcatcggagccaaagaagaggtaatctctcaagggggcgagagtttttatatcgattctaaagggaatcgccaaaacatcggcgctaatcccttcccttttctcaaagagtactacgcgagattggaccagagtgcctatcgggcgtggggtgaagagaatggcgtgggatttgtggatggatttatcggctatatcggttatgatatcgtcaaattttttgagccctgcctcaaagaggcgatggatgcgctagaggatcagactaagattcccgatatgagattgattcgccctcgatggatcttctgctactcccacaaaaacgctcatctgagtatgctcacccaagatccccaagaggcaaaacgctttgaagcgctcaaaagcacacttcactccaaggagccctttagagagctgcttccgctcaaaaatgctaaatctggctctttctatcatgataaagagcgattctttgggatggtggatgagtcgttggagcgtattcgatcaggagatgtgtttcagattctcatctctaaccgttatatccaagaggcagagatcgatccttttagtttctatcgaatcttgcgcggcaaaaacccctctccctatctctttttactcgaatttccagattttgccatcgcgggaagctcgcctgaggtgatggtgcgtctgcaggagaattcgattcttttgcgccctattgcaggaacgagaaaacggggtaaaaatcgcctgcgcgatagagagctggagctggagctcaaaagtgacactaaagagtgtgctgaacacgtgatgctcattgacttagggcgaaatgatgtgggtcgagtcgccaaatcaggaagcgtgaaggtgggagaggtgatgagaatcgagcgctattcccatgtcatgcatatggtgagcgatgtggagggggaactaaaagagggcaaagatatgtttgacctctttgccgcaaccttcacggcgggcaccatgacgggagcccccaaaatcaaggcaatggagatcattgcagagctagagggactcaagagaggattttatagcggtgcggtggggtatttcggctttagcggagacatggatagcgcgattacgattcgcactgccctgatcaagcctgataagatattcctccaagcaggggctggaatcgtcgctgacagtcaaaaagagttggagcaccttgaggtgaccaacaagctaggcgccctcactagcaccctccaagagctcgctaagctctaa

SEQ ID NO: 3474 - protein, 472 aa, Wolinella succinogenes
MEIFHERLLVDQLTPVSLYAKLREFFAGETTFLFESAASSSESGTHSFIIIGAKEEVISQGGESFYIDSKGNRQNIGANPFPFLKEYYARLDQSAYRAWGEENGVGFVDGFIGYIGYDIVKFFEPCLKEAMDALEDQTKIPDMRLIRPRWIFCYSHKNAHLSMLTQDPQEAKRFEALKSTLHSKEPFRELLPLKNAKSGSFYHDKERFFGMVDESLERIRSGDVFQILISNRYIQEAEIDPFSFYRILRGKNPSPYLFLLEFPDFAIAGSSPEVMVRLQENSILLRPIAGTRKRGKNRLRDRELELELKSDTKECAEHVMLIDLGRNDVGRVAKSGSVKVGEVMRIERYSHVMHMVSDVEGELKEGKDMFDLFAATFTAGTMTGAPKIKAMEIIAELEGLKRGFYSGAVGYFGFSGDMDSAITIRTALIKPDKIFLQAGAGIVADSQKELEHLEVTNKLGALTSTLQELAKL

SEQ ID NO: 3475 - DNA, 1401 bp, Vibrio vulnificus
  CDS (1)..(1401)
atgcagcaatcgaactctttgtcacaaattaaacaaatgaataacagcataaatacggccatttcttcaaaaacactgccttatcaaacggaccttgcccaacagtggtttgacgccatccaacatcaaccttgggcaatgctgttgcgttcggcatcaccaacacatgttgacagccgttttgacattctcgtcgcaaagcccgttgcgacattagaaacacgtggtgcggtaactgagatcaataccaatgacgaagtcattgaaagtaaagatgatcctttcacgcttcttgcgcgttatcaacagcgttttacccctgctctatcctgtgatgaagagattccttttatgggtggtgctctgggttactttagctacgatttaggtcgtcgcgttgaaaaactgcctgagattgcaacacaagatattgctgcgcccgacatggcggtgggcatctacacatgggcattgattgtcgacaatcagacgcagacagcgcaactggttggccaagacgtagaacaagcttatcaatggctgagcacgcaaacaaaagcaaacgaagcgacgtttgcccttaccagtgattggcaatccaacatgaatcgtcgcgattaccaaggtaagtttgattgcgtacaggagtacttgctcagtggtgactgctaccaaattaacttagcgcagcgctttcatgccaattaccaaggcagcgaatggcaagcttaccagaagctagagcagagcaaccaagcaccattttctgctttcattcgtttggaggacgcggcgattttaagtgtgtcgccggagcgttttctcgagctcaaaaaacgtgtcattgaaaccaagccgatcaaaggaactcgtcctcgtcataatgatgaacaacaggacaaacaggcggcacttgagcttgccaatgccgaaaaagatcaagcggaaaatctgatgatcgtcgatctgctgcgcaacgatattggccgtgtcgccaaaccgggcagtgtgcatgttcctaaactgtttgacatcgaaagctttcccgccgtgcatcacttagtcagcacgattcgagcggagttggcagcgcagtatactgccgctgacttactgcgagcgtgtttcccgggaggctcgattaccggcgcgccgaaagtgcgcgcaatggaaatcattgaagagcttgagcctcatcgacgctcagcctattgcggtagtatcggttacatcagtcgccatggtcgcatggataccagcattacaattcgtaccttagtggcggagcaaggtaagttgttcgcttgggctgggggcggtgtagtggctgacagtcaatgcgatgcggaatatcaagagacgttagataaactgtcgaaaattctgcctacgttgcaataa

SEQ ID NO: 3476 - protein, 466 aa, Vibrio vulnificus
MQQSNSLSQIKQMNNSINTAISSKTLPYQTDLAQQWFDAIQHQPWAMLLRSASPTHVDSRFDILVAKPVATLETRGAVTEINTNDEVIESKDDPFTLLARYQQRFTPALSCDEEIPFMGGALGYFSYDLGRRVEKLPEIATQDIAAPDMAVGIYTWALIVDNQTQTAQLVGQDVEQAYQWLSTQTKANEATFALTSDWQSNMNRRDYQGKFDCVQEYLLSGDCYQINLAQRFHANYQGSEWQAYQKLEQSNQAPFSAFIRLEDAAILSVSPERFLELKKRVIETKPIKGTRPRHNDEQQDKQAALELANAEKDQAENLMIVDLLRNDIGRVAKPGSVHVPKLFDIESFPAVHHLVSTIRAELAAQYTAADLLRACFPGGSITGAPKVRAMEIIEELEPHRRSAYCGSIGYISRHGRMDTSITIRTLVAEQGKLFAWAGGGVVADSQCDAEYQETLDKLSKILPTLQ

SEQ ID NO: 3477 - DNA, 2076 bp, Photorhabdus luminescens
  CDS (1)..(2076)
atgaaaatactgctcattgataattatgattcctttacgcaaaacattgctcaatatctgtatgaagtgacgggcagtgtgccgtccgtagtcaccaattctttgacttatgaagagttaacgatagacgaatatgatgcggtagtcctttctccggggccaggacatccggctgaaagcagtgattttggggtctgtgctgaagttattgcacatgccaaagtgccactgttgggtatttgtctcggtcatcaggggattaacctggcatttggcggcgttgtagaacatgcccccaatccggtacatggctatcgcagtcgcatcaggaacactggagaaggattgttcctcggtttgcctgaacagtttgaagtggtcagatatcactcgttggtatgtacccggttgcccgacaatctgaaatgtactgcctggactgatgatggcttaatcatggcaattgagcacaccgaaaggccgatctggggggttcaatttcatcctgaatcgattgattctgaatatgggcgtgagctactcagtaatttcgtgcggatagcggagacgtataaagagaataatgaacaggaagttaccgctcagaatatatgtactgatatcaatgaggcttatcttgcagtaggtggaagacaagatctcaacctgaattatcgtgaatgtaaggagatagtcgatcctgaatccttgtttattcaacgttatggcaatgatacgcatgctttctggcttgatagtgaaaattctgatagacccaatgcccgcttctcaatgatgggcagcggtaatgaacaaggtgctgtcagacttgaatacagtgtacagactgagaatttgcgtttgatcggtcctgatggcgagaggattgttcagggagattttttctcgctgatgtctcagttgcttgatgtggtggcaatttcgacaccaaaatcgatgccattggtatttaaaggcgggtttgttggttatttaggatatgaattaaaggcgctgacaattggcagcaacaaatatcgttcagaacatcctgatgccagcttaatatttactccgcatttttttgtcttcgatcatcagcagagtaaactttatgaatgttttatcacaccaatagggcagccacatcattggtcaccggaacttttcgttaccaatacaaaaaataccggtgaagtgatacctgactttattcctggcgctgttgatcaaaataagatttgtctggaatatggcgctgagaaatatatggatggaatccataaatcactccaatacatcacagatggtgagtcctatgaaatctgtctgacgaatagggccaagatgacttattcaggacatccattggacgcttatcggcgtatgcgtcatgccagtcctgtaccttatggcgcttatctggcctgtggggatttttctgtactcagtgcatcaccagaaacgtttttacgtattgatgacgccagaaatattgagtccagaccgattaaggggacccggccacgcggaaaaacggcagccgatgatcagcatttgcagatggaattgagtcagtctactaaggatagggcagaaaatctgatgatagtggacttagtgcgccatgatcttaatcaggtatgtcgtccaggtagtgtgcatgtacctgaattatttaaagttgagagcttctcttctgtacatcaattggtttcgaccatacgcggtcaattatgtgaagaaacgtcatccatagaggctatccgggcatgttttccaggaggatcaatgaccggcgcaccgaagaagcgcacgatggagattattgatgctttagagtcatcggctcgtggtgtttactccggtgcgcttggatggttatctttcagtggtgaagtggaattgagcattgtgatacgcaccgcggtattacatcaagagtgtgctgaattcggcattgggggggcaattgttgctcattctgatccttatggcgaatttgaagagacattggtcaaagcgagtgtgccatatttcagttttagtcatatggcggaggaagtgtgtgagtaa

SEQ ID NO: 3478 - protein, 691 aa, Photorhabdus luminescens
MKILLIDNYDSFTQNIAQYLYEVTGSVPSVVTNSLTYEELTIDEYDAVVLSPGPGHPAESSDFGVCAEVIAHAKVPLLGICLGHQGINLAFGGVVEHAPNPVHGYRSRIRNTGEGLFLGLPEQFEVVRYHSLVCTRLPDNLKCTAWTDDGLIMAIEHTERPIWGVQFHPESIDSEYGRELLSNFVRIAETYKENNEQEVTAQNICTDINEAYLAVGGRQDLNLNYRECKEIVDPESLFIQRYGNDTHAFWLDSENSDRPNARFSMMGSGNEQGAVRLEYSVQTENLRLIGPDGERIVQGDFFSLMSQLLDVVAISTPKSMPLVFKGGFVGYLGYELKALTIGSNKYRSEHPDASLIFTPHFFVFDHQQSKLYECFITPIGQPHHWSPELFVTNTKNTGEVIPDFIPGAVDQNKICLEYGAEKYMDGIHKSLQYITDGESYEICLTNRAKMTYSGHPLDAYRRMRHASPVPYGAYLACGDFSVLSASPETFLRIDDARNIESRPIKGTRPRGKTAADDQHLQMELSQSTKDRAENLMIVDLVRHDLNQVCRPGSVHVPELFKVESFSSVHQLVSTIRGQLCEETSSIEAIRACFPGGSMTGAPKKRTMEIIDALESSARGVYSGALGWLSFSGEVELSIVIRTAVLHQECAEFGIGGAIVAHSDPYGEFEETLVKASVPYFSFSHMAEEVCE

SEQ ID NO: 3479 - DNA, 1371 bp, Photorhabdus luminescens
  CDS (1)..(1371)
atgagcatttcactacaaaaacggcaattaccctatcaaccagacgctgccatcaactattttgcgccgatttcaaatcagtcttgggcaatgctgctccattctggtgctgccaaccatcctcataatcggttcgatattctggttgcagaaccacggataacactgcttagtcataataaatcaactgaaataaatgaagatggcgatagctatattactgaggaagatcccttttacctgctaaaaagacaactagaaaaattaaatattacagcaaagcgtgatcctgatttgccatttcagggcggtgcgctaggtctatggggatatgatcttgggcgttaccttgaagagttaccattacaagccaaaaatgagttgtcatttccagatatggcaatcggtatttatgactgggcgctgattgttgatcatcacaaaaaagaggtgattttattcagctacagtgatgttgacacgcgcctgaactggcttacttctcaccaagtttcgccaaaaatggcttttacgttgaccagtgaatggcaatcaaatatgagtgccaaacaatatcatgagaaaattaactgcattcatcactatctgttaagtggtgattgttatcaagttaacctggcacaacgattttgcgctgattaccaaggagatgaatggcaagcattcataaaacttaatgagaacaaccgtgcacctttttccgcctttattcgtttaccggaaaacagcgttatcagcgtctctcctgaacgttttttactcctggagaataaacaaattcaaactcgcccgattaagggaacattaccgcgcttaagtgatacagaaaaggacgtactgcaagctgtaaaactggccgcctcgaaaaaagaccaggctgaaaatttgatgatcgtcgatttattgcgtaatgatattggccgggtagccacaccggggtcagttaaagttcctgaattgtttttagttgaacaattccctgccgttcatcatctggttagcacaatcaccgcaacactgccaaatgaacaacatgctacggatttattacgcgcctgctttcccggtggttctattaccggagcgcctaaaatcagagcaatggaaataatagaagagcttgaacctcaccgccgacatggatattgtggttcaattggctatattagtttctgtggcacaatggacagcaatatcaccatacgtaccctcttaactgagaaagaaaaaatatattgctgggccggtggcggaatcgttgccgacagcactgctgaaaaagagtatcaggaaacatttgataagttgaatcgtatcttaccgcaactagggaaaataaaagtaatatga

SEQ ID NO: 3480 - protein, 456 aa, Photorhabdus luminescens
MSISLQKRQLPYQPDAAINYFAPISNQSWAMLLHSGAANHPHNRFDILVAEPRITLLSHNKSTEINEDGDSYITEEDPFYLLKRQLEKLNITAKRDPDLPFQGGALGLWGYDLGRYLEELPLQAKNELSFPDMAIGIYDWALIVDHHKKEVILFSYSDVDTRLNWLTSHQVSPKMAFTLTSEWQSNMSAKQYHEKINCIHHYLLSGDCYQVNLAQRFCADYQGDEWQAFIKLNENNRAPFSAFIRLPENSVISVSPERFLLLENKQIQTRPIKGTLPRLSDTEKDVLQAVKLAASKKDQAENLMIVDLLRNDIGRVATPGSVKVPELFLVEQFPAVHHLVSTITATLPNEQHATDLLRACFPGGSITGAPKIRAMEIIEELEPHRRHGYCGSIGYISFCGTMDSNITIRTLLTEKEKIYCWAGGGIVADSTAEKEYQETFDKLNRILPQLGKIKVI

SEQ ID NO: 3481 - DNA, 1575 bp, Photorhabdus luminescens
  CDS (1)..(1575)
atgacggataaacaaccaaaaatcacagtaatcgagcaggaagctgcttaccaacccgatcctacgcagctattcaaccagctctgcggtgagcgaccagcaactttattgctagaatctgcggaaattaacagcaaaaaaaacttaaaaagtctgctaattatcgatagtgccttgcgcatcagtgccaacggcaatcaggttacttttgacgcgttaacagaaaatgggcgaaatttattacccattttggccaacaaattttccagcgacgttcaatctgaaataacacacaatgctcttcaagtgattttcccacccatcaatcacaatatagatgaagataatcgtctgaaagcggtatccgtatttgatgcactgcgtgccctgctctctctggcggaagagccgtcaccatataattcgtcaagcgcagaagcgatattcgttggcggccttttttcctacgatctggtggccggatttgagccgttaccggcagtaaaaaccgttcaacgctgcccagatttctgtttttatctcgcagaaacgttattggtgatcaaccaccagaataaaaatgcacgcttgcaaatctctcttttcagtgattctcaagcagaagagcaacgccttaaacaacgattgaaaacattagtggcactcattaccgagcccattgagccagtacaacaaatctctctgccaaccatgaaagtttcatacaatcgggatgacaagagctatgcagaaatggtggcacagttgcaacaatacatccgccaaggggatatttttcaagtagtgccatcaagacgcttctttttaccctgcccggcaccacttcatgcttatcaaaaacttaagtaccacaatccaagtccctacatgtttttcatgcaggacaaagatttctgtctgtttggcgcgtctcctgaaagcgcgcttaaatatgatgcatccaatcgccaaattgaaatctacccaatcgccggcacccgcccccgtgggcgcaatgcggccggcgagctggatgcggatcttgatagccggaccgaactggaaatgcgaacagatcataaggagctagctgagcacttaatgttagttgatttggcgcgtaatgacctggcccgcatttgtgaaccgggcagtcgctatgtcgcggatctgacaaaagttgatcgctactcttttgttatgcatctggtctcccgcgtcgtggggacattacgccatgatttagacacctttcatgcctatcaagcttgtatgaatatgggtacccttaccggcgcaccgaaagtacgcgcaatgcaacttatcgctcactatgaaagtgaacgccgtggtagttacggtggggctgtcggttatttcaccggcaaaggggatatggataattgtatcgttattcgctctgcttacgtggaagatggcatggcgacgattcaggttggcgcaggtatcgtactggattccgaacctttagccgaatccgaagagactcgtaacaaagcaagagccgtcattcgggcaattattgaggctcatcaggcagaggagactttctaa

SEQ ID NO: 3482 - protein, 524 aa, Photorhabdus luminescens
MTDKQPKITVIEQEAAYQPDPTQLFNQLCGERPATLLLESAEINSKKNLKSLLIIDSALRISANGNQVTFDALTENGRNLLPILANKFSSDVQSEITHNALQVIFPPINHNIDEDNRLKAVSVFDALRALLSLAEEPSPYNSSSAEAIFVGGLFSYDLVAGFEPLPAVKTVQRCPDFCFYLAETLLVINHQNKNARLQISLFSDSQAEEQRLKQRLKTLVALITEPIEPVQQISLPTMKVSYNRDDKSYAEMVAQLQQYIRQGDIFQVVPSRRFFLPCPAPLHAYQKLKYHNPSPYMFFMQDKDFCLFGASPESALKYDASNRQIEIYPIAGTRPRGRNAAGELDADLDSRTELEMRTDHKELAEHLMLVDLARNDLARICEPGSRYVADLTKVDRYSFVMHLVSRVVGTLRHDLDTFHAYQACMNMGTLTGAPKVRAMQLIAHYESERRGSYGGAVGYFTGKGDMDNCIVIRSAYVEDGMATIQVGAGIVLDSEPLAESEETRNKARAVIRAIIEAHQAEETF

SEQ ID NO: 3483 - DNA, 2934 bp, Photorhabdus luminescens
  CDS (1)..(2934)
atggcacctttttctattcctgggaaaacacttactatgacgccagactacctttggaatggcaaaacgctggaccaacaacttgccggatggtctggtatttggggcgataaaacagcgctgatctatcaagaacaacaactaacttaccgtgaattgcaccaatccgcagagagattggccagcggattatttcgtcgagggatccgtcgtggggataacgttatggtacaactgcctaaccgtatctcctttgtcgttacctgttttgccctgtttaggctcggtgctcatccggtgttattaatgccgacacagcgggcacatgatgttcatgctctttgccagattgcacgtccggttgcttacattatccctgattgcttccatgattttgactaccgcgaaatggcacgagaaattgcggcattttgccccgatctaaaacacattattgttgatggagaagcggaagaatttaccgcattggcatccattgatgataaaccagtaaatattcccgctccaagttatggtgatattgccgtattgctgctttcgggcggaacaaccggtacgccgaaactcattccccgtactcacgatgcttatacctatgattttgtgctctccgcccgtttgtgcgcagtaaatacggaaagtgtttatttggccgtactgcctgtggcacataacttcacgttaggcagccccggtattttgggtatcctttcccagggtggaagtgtccttctgagtgataccgccagttttgatgaggccatgccgctaatcgagcaacacaaagtgacccatttagcattagtaccggctctggctcggctctgggaacaggctcgcgactgggaacaaagcgatctttcatccctgcgctgtttgcaagtaggtggtggcaggttgacaccagaactggcgggacaagtaatagcacgccttgggcctttgcagcaggtgtttggtacagcggaaggattactctgttatacccgattggatgatccccacgaggtcatcattaatacccaaggacgtccgttatcagaagaagatgagatcaaaattgttgatgccaatttacaacctgtagtacccggtgaggtaggagagcttattacacgtggcccttacactattacgggatattaccgtgcagagcagcataataccgtagctttcaccaccgatgggttctatcgtactggcgatctggttcgtatgacctcagatggcaacctgatcgttgagggcagaattaaagagcagattaaccgcagtggtgagaaaatttcaacccaagaagttgagaccttgctgctgcaacaccctgatattgatgatgccgttgtcatttcagtgcctgatgaattgctgggtgaacgaacctgcgcctgtttacctaacaacggcaatcaaccagaaccggtgcagatagcggcatttctacaacagaaaggggttcagcgtcataaaattcctgaccaatggttgtttgtcccatattggccacttactaccgtgggaaaaattgataaacgccgcttggtacagatggcacaagcagaacatggccgcccaatgcagcaatatcatgaacaaacagttgttattaccagcactccgttagatttgatcacacatttgctttcagaaggcgaagcacaaccttatatgctctatgaagtgaaaggtgaatggtcactggggataggctgtgcagcgaccatcagtgcggatgcatcgggacaattgattgattcacaaggtaatcgccatccatacgatatcagcacgttgagccaaaaacttgaacaagcgcttaatgcccttcccattcaggattggcgggcctatggaagaacgttatttgaattctcccatatgacatatgggttgccattagcacaacagaacgaagcgttgataaaaatcactattccacagcatgaattacgcataactccaggacaggttctgatacgaacgctcgaagagagtcaactcaccatattgagggaaaaaattagccaggttgatcaattaggaacacctgttttcccgtggacaaaagatagggaaattatcagtacatcagacgcggcgaaacgttatcaggataacgtcgccaatgcggttaaggacattgcctcgggccactatcaaaaagtgatcctgtcacgtcgagttgaacttggctcggatattgacatgccacacagctactggttaggccgccaagctaacacacctgcccgctctttcttcttacgtgatgaagatttctctgtttatggttttagcccggaaaccgtagttgaagcggatggttcaggttgggttagcacgcaaccattggctggaaccagagcattgacacatgacaaagatcaggatcaacgattgagagcagatttgctttctgacccgaaggagatctctgaacatgctgtttcggctaaattggcattagaggaactggcaccgatttgtcaggctgacacactttgtgtatcagagtttatggcgattcgtgaacgaggttcagtacaacatttggcatcacgggtaaaaggattactacaaacagacaaaaatcgttgggatgcgttcatcgccctattcccggctgtaaccgcttcggggataccgaaaaaaacctctttacaggcaatttcacgttatgaaggtgaaccacgccggctttatagtggttgtgtcatgttattagatagctcaggtaaactggatgctgcgctggtattacgttctctctatcagcatcaaggtcgctgttggctccaggctggcgcaggattggtcagagattcaaaaccagaaagagagtggcaggaaacttgtgaaaaacttgactgcattatgaaatacgttcgcccttgctctggtaaaaaagagtaa

SEQ ID NO: 3484 - protein, 977 aa, Photorhabdus luminescens
MAPFSIPGKTLTMTPDYLWNGKTLDQQLAGWSGIWGDKTALIYQEQQLTYRELHQSAERLASGLFRRGIRRGDNVMVQLPNRISFVVTCFALFRLGAHPVLLMPTQRAHDVHALCQIARPVAYIIPDCFHDFDYREMAREIAAFCPDLKHIIVDGEAEEFTALASIDDKPVNIPAPSYGDIAVLLLSGGTTGTPKLIPRTHDAYTYDFVLSARLCAVNTESVYLAVLPVAHNFTLGSPGILGILSQGGSVLLSDTASFDEAMPLIEQHKVTHLALVPALARLWEQARDWEQSDLSSLRCLQVGGGRLTPELAGQVIARLGPLQQVFGTAEGLLCYTRLDDPHEVIINTQGRPLSEEDEIKIVDANLQPVVPGEVGELITRGPYTITGYYRAEQHNTVAFTTDGFYRTGDLVRMTSDGNLIVEGRIKEQINRSGEKISTQEVETLLLQHPDIDDAVVISVPDELLGERTCACLPNNGNQPEPVQIAAFLQQKGVQRHKIPDQWLFVPYWPLTTVGKIDKRRLVQMAQAEHGRPMQQYHEQTVVITSTPLDLITHLLSEGEAQPYMLYEVKGEWSLGIGCAATISADASGQLIDSQGNRHPYDISTLSQKLEQALNALPIQDWRAYGRTLFEFSHMTYGLPLAQQNEALIKITIPQHELRITPGQVLIRTLEESQLTILREKISQVDQLGTPVFPWTKDREIISTSDAAKRYQDNVANAVKDIASGHYQKVILSRRVELGSDIDMPHSYWLGRQANTPARSFFLRDEDFSVYGFSPETVVEADGSGWVSTQPLAGTRALTHDKDQDQRLRADLLSDPKEISEHAVSAKLALEELAPICQADTLCVSEFMAIRERGSVQHLASRVKGLLQTDKNRWDAFIALFPAVTASGIPKKTSLQAISRYEGEPRRLYSGCVMLLDSSGKLDAALVLRSLYQHQGRCWLQAGAGLVRDSKPEREWQETCEKLDCIMKYVRPCSGKKE

SEQ ID NO: 3485 - DNA, 1527 bp, Gloeobacter violaceus
  CDS (1)..(1527)
atggttgcgccggactttgagcgcttcgagacactggcaaaagacggcaattttattcctgtgtaccgcgagattctggcggatctcgaaacgccggtctctgcctggtatcgagtctgtgacggggcgagggaaagttttttgctcgaatcggtcgaggggggcgagaggctgggacgctacagcttcctggggtgcgagccgctctggaccctcgccgcccggggcgatacgtgcgagcaggtgtttcgcgacggtgggcggctcacccacacgggcgacccgttcgcggtgctcgatcgctgtttggaaccctaccagccggtgcacctgccggagttgccgccgggaatcggtgggctttttggttactggggctatgaactgattcgctggatcgaaccgacggtgcccgtgtatagcgatcccgacggcctgcccgacggcttctggatgcaggtcgattcgctgctcatcttcgatcaaatcaagcgcaagatctgggtgatcgcctacgcggatctgcgcgagggcgacacggcgagcgcctaccggctcgccggccaaaaagtggacgcgctggtggaacgattggcccggcccgccgccaaggccgagcccctgggcctggagtggacgccccacagggtccaagcccaaagtaccttcagccgcgagcagtactgtggggccgtcgagcgcgcccgcgaatatatccgggctggggatatctttcaggtggtactcgcccagcgcttcagcacgccctttgcgggcgagagctttgatctctaccggatgctgagggcgattaacccttcgccctacatggcttactaccagttcggcgattttcaactgatcggttcgagcccggaggtgatggtgcgtctggatcggcgcgacgggggagccctcgccaccgtccggccgatcgcgggcacccggcggcgcggccagagcgaagcggaggaccgctggctcgaaaaagatctgctcgccgatcccaaggaggtggccgagcacgtcatgctcgtggatctgggccgcaacgacctgggccgggtgtgcaaaccgggcagcgtgcgggtggacgaactgctcaccgtcgagcgctactcccacgtcatgcacatcgtctccaacgtcaccggcgaactagcctccggccgaggggcctgggatctgctcagggccacttttccggccggtacggtgagtggcgcccccaaaatccgggcgatggagattatccacgcactggaaccgtttcggcgcggaccctacgcgggcgcctacggctactacagcttcgacggccagctcaacaccgccatcaccatccgcacgctggtcgtccacggggggctcgccaacatccaggccggggcggggctggtggccgactcggtacccgagaccgagtacgaggaaacgctcaacaaagcccgcggcatgctcgaaacgatcgcccgcctcgcccggagcgggggcgcgtccgctaacgtagaagggcaagtgcaatag

SEQ ID NO: 3486 - protein, 508 aa, Gloeobacter violaceus
MVAPDFERFETLAKDGNFIPVYREILADLETPVSAWYRVCDGARESFLLESVEGGERLGRYSFLGCEPLWTLAARGDTCEQVFRDGGRLTHTGDPFAVLDRCLEPYQPVHLPELPPGIGGLFGYWGYELIRWIEPTVPVYSDPDGLPDGFWMQVDSLLIFDQIKRKIWVIAYADLREGDTASAYRLAGQKVDALVERLARPAAKAEPLGLEWTPHRVQAQSTFSREQYCGAVERAREYIRAGDIFQVVLAQRFSTPFAGESFDLYRMLRAINPSPYMAYYQFGDFQLIGSSPEVMVRLDRRDGGALATVRPIAGTRRRGQSEAEDRWLEKDLLADPKEVAEHVMLVDLGRNDLGRVCKPGSVRVDELLTVERYSHVMHIVSNVTGELASGRGAWDLLRATFPAGTVSGAPKIRAMEIIHALEPFRRGPYAGAYGYYSFDGQLNTAITIRTLVVHGGLANIQAGAGLVADSVPETEYEETLNKARGMLETIARLARSGGASANVEGQVQ

SEQ ID NO: 3487 - DNA, 1359 bp, Gloeobacter violaceus
  CDS (1)..(1359)
atgtcgatggttgcccccacctggcactggctgtaccttcccctcgaaggacgcaccggctcgtgcctgtttgagcgcctgttcggcgaggaggcggtggcggtcctgctcgaaagcccccaactctcgccgcgtaccgcccgctactcgatcttggctgcctgtccgcggcgcgtgcttgctcccgccgtcggtgagattctgcccgcgctgcgcgcttggcttgccgccgcgcggcggcagctgccgccgcccgagtggagggggctgccctttcgcggcgggcttgtgggctggttcggctacgacctggcctgggaaatcgaaaggctgccgtggctgcggaacgaccccttgccttttccgacggcctggtggtttgagccggccgtctttgccgtcgccgatcatcgcgaggataagcttttgctcgccgtcgacaatcggtcgggactcggtcccgaccggggaagcctggcgtactggtgcaagcggctcgacagaccgattttgaccgacgaggagatcaacagtggtgcgttgccgcgcctgacgtcgcgcgacaggtttttggaggctgtccatcaggtcaaggagcacattgcggccggggatatctttcagtgcaacctctcgcttcgcttcgaactcgactgggaaggcaatggctggcggctctaccgacggctggtcgggctcaatccttcgcctttcgcctgttactggcgcacgcccttcggcgaaatcgtcagctgctcgcccgagcggcttttagaagtgcgcggcgaagcgctgagcacccgcccgatcgcgggaacgcgcccgcgcgggttcaccgctgccgccgatcaacgcctggaaagcgaactgttaatcagtcccaaggaacgcgccgagcacatcatgctggtcgatctcgaacgcaacgatctcgggcgggtctcacaaccgggcagcgtgcaggtggacgaactgatggtcatcgagcgctactcccacgtcatgcacattgtctccaacgtcgtcggccgcctgcagcccggatgcgacgccctggacgcggtgcgcgccgtctatcccggcggcacgatcaccggctgtccgaaggtgcgctgcatggaaattatcgagaggctcgaaccggtgcgccgctcgcttttttacggctcggcgggttacctcgactgcaccggtgacctggatctcaacattttgatccgcacgctgctcaagtccggctcccggatttgggggcaagtcggggcgggcatcgtcgccgattctgatccccagggcgaatacctcgaatcgctcgccaaggccaaagccctctggaaagccctgggagacagtcgataa

SEQ ID NO: 3488 - protein, 452 aa, Gloeobacter violaceus
MSMVAPTWHWLYLPLEGRTGSCLFERLFGEEAVAVLLESPQLSPRTARYSILAACPRRVLAPAVGEILPALRAWLAAARRQLPPPEWRGLPFRGGLVGWFGYDLAWEIERLPWLRNDPLPFPTAWWFEPAVFAVADHREDKLLLAVDNRSGLGPDRGSLAYWCKRLDRPILTDEEINSGALPRLTSRDRFLEAVHQVKEHIAAGDIFQCNLSLRFELDWEGNGWRLYRRLVGLNPSPFACYWRTPFGEIVSCSPERLLEVRGEALSTRPIAGTRPRGFTAAADQRLESELLISPKERAEHIMLVDLERNDLGRVSQPGSVQVDELMVIERYSHVMHIVSNVVGRLQPGCDALDAVRAVYPGGTITGCPKVRCMEIIERLEPVRRSLFYGSAGYLDCTGDLDLNILIRTLLKSGSRIWGQVGAGIVADSDPQGEYLESLAKAKALWKALGDSR

SEQ ID NO: 3489 - DNA, 1293 bp, Chromobacterium violaceum
  CDS (1)..(1293)
atgttcacccagaaactcgatttcattcccgacctgctggcgctgcatgccgcggaccgcgaaaactttccctatctgatgcaatcgtccggcgacgtcggctgggacctgctgctgatgcagagcgagcggcgcgtgttcatggcgggcgaggggcaggccttcctcgaccagctgcgcgcgttccggccgcgggcggtgtccaatccgcacggcctgcctttcgtcggcggctggttcgtctacctggcctacgacctgttgtcggaattcgagccgcatgtgccggccgccttgccggacagctttccgctggcggcatgggcgcgcgcgccggccgcggtgctggtggaccgcgccaagaacgaagcctggctggtcggcgaaaccgccgatgactggcatgcgctggaacggctggtttcgatgaggcccgccttcgcgccccagccggtcgccttggccgcgctggaggaagatccgcccgagtggtataccgacgcggtggttcggctcaagcgctacatctacgaaggcgacgtgttccaggtgaacatctcgcgcggctggcgcgcccagctggcggacggcatcgccgcgcccgacctgttcgcggcgctgcgccgggccaatccggcgccgttctcggcgctggccgacttcggcgccgcgcagatcgtcagctcgtcgccggagcggctggtgcgggtgcgcgacggctgggccgaaacccggccgatcgccggcacccacccgcgctcccaggacccggccgaagacgccgagctgaaaaagcggctgatcaccagcatcaaggagcgcgccgagcatgtgatgctgatcgacctggagcgcaacgacctgggccgcatcagccggccgggcacggtggaagtcaacgagctgatggcggtggccagctacgcctacgtccatcacatcgagtccaatgtccgcggcaagctgcgcgacgacatcgcgccggcggacgtgctgcgcgcgctattccccggcggcaccatcaccggctgtcccaaggtgcggaccatgcagatcatccgcgagctggaaaacagcgcgcggcgcgcctataccggcagcctgggctatctgaaccgcgacggcagcatggacttcaacatcctgatccgcaccttcatgcaggagggcgacgcgctgcgcttccgcgccggcggcggcatcgtcgccgactccgatcccgagcgcgaattgcaggaaacccgtcacaaggcgcgcggcctgctgcgcgcgctgggcgtggagcaggcctga

SEQ ID NO: 3490 - protein, 430 aa, Chromobacterium violaceum
MFTQKLDFIPDLLALHAADRENFPYLMQSSGDVGWDLLLMQSERRVFMAGEGQAFLDQLRAFRPRAVSNPHGLPFVGGWFVYLAYDLLSEFEPHVPAALPDSFPLAAWARAPAAVLVDRAKNEAWLVGETADDWHALERLVSMRPAFAPQPVALAALEEDPPEWYTDAVVRLKRYIYEGDVFQVNISRGWRAQLADGIAAPDLFAALRRANPAPFSALADFGAAQIVSSSPERLVRVRDGWAETRPIAGTHPRSQDPAEDAELKKRLITSIKERAEHVMLIDLERNDLGRISRPGTVEVNELMAVASYAYVHHIESNVRGKLRDDIAPADVLRALFPGGTITGCPKVRTMQIIRELENSARRAYTGSLGYLNRDGSMDFNILIRTFMQEGDALRFRAGGGIVADSDPERELQETRHKARGLLRALGVEQA

SEQ ID NO: 3491 - DNA, 1467 bp, Chromobacterium violaceum
  CDS (1)..(1467)
atgcaagcgcaagagtttgaccaactggccgccgccggctacaaccgcatccccgtcacccaggaactgctggccgatctggacagcccgctgtccatctatctgaagctggccaaccagccgtacagctacctgctggaatcggtggtgggcggcgagcgccacggccgctactccatcatcggcctgccggccgacacccggctgcgcgtcaacggccagcgggtgcaggtggaatgcggcgacaaggtgatagaacgccacgacggcgacccgctggccttcatcgaggcgttccagcaccgtttccgtatccccgagctgcccggcctgccgcgctactccggcggcctggtcggctatttcggctacgacaccatacgctacattgaacgccgcctcgccgacgttcagaaacccgacccggtgggcacaccggacatcctgctgatgctgtcggaagagatcgccgtggtcgacaacctgtccggcaagctctacctggtggtctacgccgaccccgaggtgcccaacgcgctgcagaaagcgaaagcgcggctggcccagcttcgcgccaagctgcgcgagccgctggccatcccgctgtcgctgccccagccgcacgagggcgaggcggtgtcggaatacggcgaggaggcgttcaagcaggcggtggcgtcctgtcagcgctacatccacgacggcgacatcatgcaggtggtgctggcccagcgcatgcagcagccttaccacggctcgccgatcgcgctgtaccgcgcgctgcgcaacctcaacccgtcgccgtacatgttcttctaccacttcgacgacttccacgtggtgggcgcttcgccggaaatcctggtgcggcgcgaaggcgaaaccgtgaccgtgcgtccgatcgccggcacccgcccgcgcggccacacccgcgagcaggatgaggcgctggcggccgagctgctggccgaccccaaggaaatcgccgaacacgtgatgctgatggacctgggccgcaacgacgtcggccgcgtcgccgacatcggcacggtgaagatcaccgacaacatggcgatcgagcgctactcgcacgtgatgcacatcgtgtccaacgtggaaggccaggtggaccgcaagatcagcaatatcgacgtgatcaaggccaccttccccgccggcacgctgtccggcgcgcccaaggtgcgggcgatgcagatcatcgacgagttcgagccgaccaagcgcggcgtctacggcggcgcggtgggttacctcggcttcaacggcgacatggacctcgccatcgccatccgcaccgcggtgctgaagaacggcatgctctacgtgcagtccggcgccggcgtcgtcgccgactcggtgccgcaatcggaatggcaggaaacgcagaacaaggcgcgcgcggtgctgcgcgccgcgcagatggtgcgggacggcctggacgcctga

SEQ ID NO: 3492 - protein, 488 aa, Chromobacterium violaceum
MQAQEFDQLAAAGYNRIPVTQELLADLDSPLSIYLKLANQPYSYLLESVVGGERHGRYSIIGLPADTRLRVNGQRVQVECGDKVIERHDGDPLAFIEAFQHRFRIPELPGLPRYSGGLVGYFGYDTIRYIERRLADVQKPDPVGTPDILLMLSEEIAVVDNLSGKLYLVVYADPEVPNALQKAKARLAQLRAKLREPLAIPLSLPQPHEGEAVSEYGEEAFKQAVASCQRYIHDGDIMQVVLAQRMQQPYHGSPIALYRALRNLNPSPYMFFYHFDDFHVVGASPEILVRREGETVTVRPIAGTRPRGHTREQDEALAAELLADPKEIAEHVMLMDLGRNDVGRVADIGTVKITDNMAIERYSHVMHIVSNVEGQVDRKISNIDVIKATFPAGTLSGAPKVRAMQIIDEFEPTKRGVYGGAVGYLGFNGDMDLAIAIRTAVLKNGMLYVQSGAGVVADSVPQSEWQETQNKARAVLRAAQMVRDGLDA

SEQ ID NO: 3493 - DNA, 1287 bp, Synechococcus sp
  CDS (1)..(1287)
atgagcgtgccccagcggttggacctcccctggcgtgaaccgcttgccgtggcccgacagctggacggcgacgacgggctgatctggctggatggtgacggtagtgacctgggccgctgggtgaccctggccagccagccgctggaggtgatccactgccagggcctgccgggggatgcggacgcccgcgaccccttcaccgcattgaatgggctgggtccgggccactggaccggctggctcagttatgaggcggccgcctggactgaacccggcaacccctggtccagggatgccatggccaacctgtggatcgcccgccatgacccgctgctgcgatttgacctgcagcaacggcagttgtggatcgaaggcacggacccgatggcgatgcagcagctggcggcgcgactgcagcagcgagcgcccaccccgcctgccacagcgaacatcccgctggaggcctggcatcagcacaccagccgcgagggcttcgccgatggcgtacgccggatccgtgcgctgatcgccgccggtgatttgttccaggccaacctcaccgcctgctgcagcaccgactggcccggcgatgcctcagcggtggagctgtttcaacgggttcgccaacgctgcccagcgccgtttgcgggcctggtggtggcggacaacggcgaagcactgctctcctcctcgccggaacggttcctgcaggtggaccccgccggccgggtcgaaacccgaccgatcaaaggcacacggccacgccacagcgatccagaccgcgacgccgagctggcggcggagctggtctgcagcgacaaggaccgggccgaaaacgtgatgatcgtggacctgctgcgcaatgacctcggccgcgtctgccaaccgggctccatccaggtatcgcaactgctcggcctggagagctacagctcggtgcatcacctcacatcggtggtggaagggcagctgcaagccgggctcagctgggtggatctgctacgggcctgctggccgggtggatcgatcagcggcgccccgaagctgagggcctgccagcggctgcaggagctggaacccactagccgcggcccctactgcggctccctgatccgcatcgactgggacggacgcttcgacagcaacatcctgatccgcacactgatgcggaaggatcacaggctgagggcccatgccggttgcggcatcgttgccgactccgaccccgatggcgaagcagaggagctgatgtggaaattgcggccactgctggaggccctggcttga

SEQ ID NO: 3494 - protein, 428 aa, Synechococcus sp
MSVPQRLDLPWREPLAVARQLDGDDGLIWLDGDGSDLGRWVTLASQPLEVIHCQGLPGDADARDPFTALNGLGPGHWTGWLSYEAAAWTEPGNPWSRDAMANLWIARHDPLLRFDLQQRQLWIEGTDPMAMQQLAARLQQRAPTPPATANIPLEAWHQHTSREGFADGVRRIRALIAAGDLFQANLTACCSTDWPGDASAVELFQRVRQRCPAPFAGLVVADNGEALLSSSPERFLQVDPAGRVETRPIKGTRPRHSDPDRDAELAAELVCSDKDRAENVMIVDLLRNDLGRVCQPGSIQVSQLLGLESYSSVHHLTSVVEGQLQAGLSWVDLLRACWPGGSISGAPKLRACQRLQELEPTSRGPYCGSLIRIDWDGRFDSNILIRTLMRKDHRLRAHAGCGIVADSDPDGEAEELMWKLRPLLEALA

SEQ ID NO: 3495 - DNA, 1521 bp, Synechococcus sp
  CDS (1)..(1521)
atgctcagtcctgatcgcgtcgcctttcacgaggccgcagccaacggtgccaatctgattccgctggcccagagctggccggcggatcttgaaacccctctgacggcctggatcaaggtcggggccgatcatgcccctggagtgttgttggaatcggttgagggtggtgaaaccctcggcaggtggagtgtgatcgcctgcgatcccctgtggaccgcatcagcccgcaacgattgcctgcaacgacgttggcgtgacggccgcgaggaaaccttccgtggcaatcccttcgacagtctcaggcgttgtctggagccttaccgctgcatcagcctgcccggactgccaccgctagggcagctctacggtgtctggggctatgagctgattcagtggattgaacccagtgttccggtgcatccgcggcaggagtcggatccaccggacggcatctggatgctgatggactcgatcctgattttcgatcaggtgaagcgacagatcacggccgtggccttcgccgacctgagccagggtcaatcggaagacgctgcctgggacggggcgatggcgcggattgcagcgctccggcggcgcatggaagccccgctccctctggtggatccccttccctgggatgcgcaggccaagcagcttcccgatgtgaagagcaactgcagccaggagcgcttcgaggcggcggtcgacaccgcccgggaacacatcgccgccggtgacgtcttccagctggtgatcagccaacgcctggagacggttgttccccagcagccgctggagctctatcgcagcctgcggatggtcaatccatcgccctacatggccttcttcgacttcggcgactggcagttgatcggatcgagtccggaggtgatggtgcaggccgaccctgcgccggagggcatccgagccagcctcagacccattgccggcacccgtccgcgcggcacgacagcccatgaggatcgcgacctggagctggatctgctggccgaccccaaggaacgtgccgagcacgtgatgctggtggatctcggccgcaatgacctcggcagggtctgtcagcccggcagtgtggcggtgaaggatctgatggtgatcgagcggtactcgcacgtgatgcacatcgtcagccaggtggaggggcgtctggccccccagcacgacgtgtgggacctgctgatggcatccttccctgccggaaccgtgagtggagcccccaagatccgtgccatgcagctgatccatgagctggaacccgatgcccgaggcccctattccggtgtgtatggatcggtggatctggcgggagccctgaacaccgccatcacgatccgcaccatggtggttcaaccggacccgtccggtggttgcagggtgaaggtgcaggcgggtgcaggcgtggtggcggattcgaagcccacggcggaataccaggagaccctcaacaaggcccgcgggatgctcacggccctggcctgcctcaacccggagcggccatga

SEQ ID NO: 3496 - protein, 506 aa, Synechococcus sp
MLSPDRVAFHEAAANGANLIPLAQSWPADLETPLTAWIKVGADHAPGVLLESVEGGETLGRWSVIACDPLWTASARNDCLQRRWRDGREETFRGNPFDSLRRCLEPYRCISLPGLPPLGQLYGVWGYELIQWIEPSVPVHPRQESDPPDGIWMLMDSILIFDQVKRQITAVAFADLSQGQSEDAAWDGAMARIAALRRRMEAPLPLVDPLPWDAQAKQLPDVKSNCSQERFEAAVDTAREHIAAGDVFQLVISQRLETVVPQQPLELYRSLRMVNPSPYMAFFDFGDWQLIGSSPEVMVQADPAPEGIRASLRPIAGTRPRGTTAHEDRDLELDLLADPKERAEHVMLVDLGRNDLGRVCQPGSVAVKDLMVIERYSHVMHIVSQVEGRLAPQHDVWDLLMASFPAGTVSGAPKIRAMQLIHELEPDARGPYSGVYGSVDLAGALNTAITIRTMVVQPDPSGGCRVKVQAGAGVVADSKPTAEYQETLNKARGMLTALACLNPERP

SEQ ID NO: 3497 - DNA, 1644 bp, Rhodopirellula baltica
  CDS (1)..(1644)
atggaggcggactcgttcacgccttggaattctatcgctggccaacccggtttccaagcccgccgtcgcacttcacactatcgcaacgtcacaacgcgccgaaacttcatgcttggaaacctcatgcaccaaccgccgctttcgtcgttcgaatcgctggcccgtcggttcgacttcgttcccgtctaccgacgcttgctctctgatacgttgacccccgtcacggcgttcatgcacttggacgatggaggccccgctttcctgatcgaaagcgtgatcggaggcgaaaaggtgggacgtttcagcttcctgggctctcgaccactggcccgattcacggccaaaggcaacacggttcggcggacaaacatgtccaccggcgaggtcgttgaatcccagtgcgatgatccactgaacgcttttcgcgagagctttcaggaccgcactgccaccctggacgggttgcctcccttcatcggtggagcaatcgggtacgcgggttacgatgtggtgcgttatgtcgagaatttgccggacaccaccgaggacgaccgaaaccttcccgatctgaacttcgccttttatcacaccctgtgcgtgttcgatcacgtcgataaaaccatcaccgtggtctccctagccgattgccgcggcattgacgaggaaaccgattcaaccgccatttccgaggctcggcaagccgcggccgaagaagtcgaccaaacgatcaaacgcctgatgaccagtccacccgacctccgggtggacgagatcatcgaagaagaccaacgccagccgctgccggtcgagtccaacttcacccgtgagtcgttctgtgacgcggttcgccactgcgtcgagtacattcgtgccggcgatatcttccaagtcgtccccagccaacgactgaccgtcaaaagcgacgtcgacccgttcgcggtctaccgctcgctccgcgtcgtcaatccgtcgccgttcatgttctttgtccgcaacccggaatgcgtcctggtgggttgctcgccggagatcatgtgccgggtcaaagaccgtgaggtcacggtgcgtccacttgccggaacgcggccccgtggagcaactgaaaaagaagacaaagctctcgaaaaagacttgctggccgaccccaaggaacgtgccgaacacgtgatgctggtcgacctgggtcgcaacgacatcggccggatcgccgaattcggcaccgtggacttgaccgaaatcatggttatcgagcgttacagccacgtgatgcacatcagcagcgaggtgcgaggcaaactgcgggaaggcctcgacgcctttgacgctctgaaatcatgtttgcccgcggggactgtttcaggtgcccccaaagtccgggcgatgcaggtcatcgacgagatcgaaccgcatcgtcgcggcccctacggtggcgcggtgggctacatcgactaccgaggcaacatggacacctgcttggcccttcgcacgatcgtgcatcaaaacggggcgtatcacgtgcaagccggctgcggagtcgtcgccgacagcaaccccgactcggaatacgaagaaaccctcaacaaggcccgcgccctgatcgccgcgatcgagtggaccatcgcccgagaatcccgcaacgcctga

SEQ ID NO: 3498 - protein, 547 aa, Rhodopirellula baltica
MEADSFTPWNSIAGQPGFQARRRTSHYRNVTTRRNFMLGNLMHQPPLSSFESLARRFDFVPVYRRLLSDTLTPVTAFMHLDDGGPAFLIESVIGGEKVGRFSFLGSRPLARFTAKGNTVRRTNMSTGEVVESQCDDPLNAFRESFQDRTATLDGLPPFIGGAIGYAGYDVVRYVENLPDTTEDDRNLPDLNFAFYHTLCVFDHVDKTITVVSLADCRGIDEETDSTAISEARQAAAEEVDQTIKRLMTSPPDLRVDEIIEEDQRQPLPVESNFTRESFCDAVRHCVEYIRAGDIFQVVPSQRLTVKSDVDPFAVYRSLRVVNPSPFMFFVRNPECVLVGCSPEIMCRVKDREVTVRPLAGTRPRGATEKEDKALEKDLLADPKERAEHVMLVDLGRNDIGRIAEFGTVDLTEIMVIERYSHVMHISSEVRGKLREGLDAFDALKSCLPAGTVSGAPKVRAMQVIDEIEPHRRGPYGGAVGYIDYRGNMDTCLALRTIVHQNGAYHVQAGCGVVADSNPDSEYEETLNKARALIAAIEWTIARESRNA

SEQ ID NO: 3499 - DNA, 1554 bp, Rhodopirellula baltica
  CDS (1)..(1554)
atgtgcctcggcgagccaaccctcgccgaggcattttttttgcaccaatggcccgatatcactcgggcaaattttcgatccgaattgatcgcgatgcagcagactgccaagaacgcccactccgctatcaacaaacagaagatccctctgtggacgcattcgctcggccgggtcggtgatctggaagacctgttcggaaggcttgcgggaacgaaacatcggctctggttcgactcagcgtccgaccacgaacacgaccgagggcgatactcgttcctggcagcagacccggtcggctggctccacgcctccctcacagatcccgatccgtggcccaaactccacaactggtgttctcgaatcgcggacttcggccactctgccgaactgcctcccttttgcggcgggctggcgggactgattccgtatgaagcggcttggtggttggaaccaacgacccgaatgccggagagttttttaggtggtcgacctcaacttggaatggcgatcggaatctacgactggaccatcgcggtggaccactcctccggcgaagcaacgttgatcagcaacggcctggatagctcgctgaacgctgatttcgaacgagcacgccgtcgtggcgaagacgtgctgaaacgcttgagccgaaccgcccaagcacctcgcaccggtgcaccgccaccgaacgagaacctcgaatcgataggccatccaacaagagaagccggcgtccgaagcaacttcgaatcacaacgctacgtcgaggcggtcgccgagatcatcgaccgaatccgcgcgggcgactctttccaagtcaatctggctcagacactttcgcatcctgcgatgtgcgaagcaaatgagctctaccgtcgcctacgtcaatccaatccggcaccttactccgtcttctttgatgttggcaccgagcaaatcctgagctcctcaccggaaggatttttgcaggtacgcgatcgccacgttgtcacgcggccgatcaagggaaccgtgccgcgcaccggagacgagatcgaagacgaacgcttggctcaggttctcggtggtagcgcaaaggaccgagctgaaaacatcatgatcgtggatctgatgcgaaacgatctatccatcgtctgcaaagacgacagcgttcgcgtctccggactttgcgagattgaatgctaccaaagtgttcaacacctcgtatcgaccgtcaaaggcgacttgcgtgccgacgtcaccatcagcgagttgttggcagcttgcttcccaggtggaagcatcaccggcgctccaaaaatcgaagcgatgaaaaccatcgcccgactcgaaaggcaaccacgcggagcctactgcggatcgatcggttacatcagcgtttccggcaacgctgatttcaacattttgattcgaaccgtcactcaacgagatggccggtggcactttcccgtcggcggaggcgttaccgctcgcagcgaaccccaaagcgaactcgaggaaacctggaccaaagccgcgggtcttttgcgtgcaattcgaccggcggaaagctaa

SEQ ID NO: 3500 - protein, 517 aa, Rhodopirellula baltica
MCLGEPTLAEAFFLHQWPDITRANFRSELIAMQQTAKNAHSAINKQKIPLWTHSLGRVGDLEDLFGRLAGTKHRLWFDSASDHEHDRGRYSFLAADPVGWLHASLTDPDPWPKLHNWCSRIADFGHSAELPPFCGGLAGLIPYEAAWWLEPTTRMPESFLGGRPQLGMAIGIYDWTIAVDHSSGEATLISNGLDSSLNADFERARRRGEDVLKRLSRTAQAPRTGAPPPNENLESIGHPTREAGVRSNFESQRYVEAVAEIIDRIRAGDSFQVNLAQTLSHPAMCEANELYRRLRQSNPAPYSVFFDVGTEQILSSSPEGFLQVRDRHVVTRPIKGTVPRTGDEIEDERLAQVLGGSAKDRAENIMIVDLMRNDLSIVCKDDSVRVSGLCEIECYQSVQHLVSTVKGDLRADVTISELLAACFPGGSITGAPKIEAMKTIARLERQPRGAYCGSIGYISVSGNADFNILIRTVTQRDGRWHFPVGGGVTARSEPQSELEETWTKAAGLLRAIRPAES

SEQ ID NO: 3501 - DNA, 1521 bp, Prochlorococcus marinus subsp
  CDS (1)..(1521)
atgatcagttctcaaaaagatagttttttaaaggcttataaagaaggtaaaaattttatacctattttcaaaacatggcctgctgatttagagactccattatctacatggcttaaattatcaaataaagattcacatggggtcttttttgaatccgtcgaaggtggggaaaatttaggtagatggagtatcgttgctactgatcctctttgggaagcagtttgtcttggagaagaaactattaagacttggaataatggaaatagtgaaaaatataaaggcgatccttttgatttattaagaacttggaccgaagaatataagtcatataatatcgataatttaccttatgttggtcagttatatggttcttggggttatgaattaatcaatcgcatagagcctaatgtgcctattaatcctctagaagataataatataccctatggatcttggatgttttttgatcaattagtaatatttgatcaaatgaaaagatgtatcactgtagttgtatatgctgacacttccagaacatcagaaactcatgttcaagaaatttatcaagattcgattttaagaattaatagaatcaaagatttaatgagtgctccaattaatgaaagacatgctcttaactgggatgaaaaaaaagatttgaatattgcaatttcaagtaattgggaaagaaaagagtttgaagaagctgttgtttctgcaaaggaatatataagaaaaggagatatttttcaaattgttattagccaaaaatttcaatcgaaagttaaaagtgatccctttaatctatatagaagcttaaggattgttaatccttcaccttatatggctttctttgattttggatcatggtacttaataggttctagtcctgaagtaatggtcaaagcagagaagaataaaactaatcaaattgttgcaagcttaagaccgatagctggtacaaggccaagaggtcaagatgctgaacaagatttaaaatttgagaaagatttattaaaagatcctaaagagatatcagaacatgtaatgcttattgatctgggaagaaatgatttaggaagagtatgtgaaacaggcacagtagaggttaaagatttgatgataattgaaaaatattcacacgtaatgcacatagttagtgaagttgaaggtatcttaaaaagtaatactggggtatgggatttacttaaagcatgttttcctgctggtacagtaactggggctccaaaaattagagctatgcaattaattaaagactttgagaaagatgctagaggtccttatgctggagtttatgggtctatagatataaatggtgcactaaatactgcgataacaataagaacaatgatagttcagccttcaaatgatggggaatatatagtttctgttcaggctggtgctgggatagttgcagattcctctcctgcgaatgaatatcaagagactattaataaagccaaaggcatattaatggcattggcttgtttggatagataa

SEQ ID NO: 3502 - protein, 506 aa, Prochlorococcus marinus subsp
MISSQKDSFLKAYKEGKNFIPIFKTWPADLETPLSTWLKLSNKDSHGVFFESVEGGENLGRWSIVATDPLWEAVCLGEETIKTWNNGNSEKYKGDPFDLLRTWTEEYKSYNIDNLPYVGQLYGSWGYELINRIEPNVPINPLEDNNIPYGSWMFFDQLVIFDQMKRCITVVVYADTSRTSETHVQEIYQDSILRINRIKDLMSAPINERHALNWDEKKDLNIAISSNWERKEFEEAVVSAKEYIRKGDIFQIVISQKFQSKVKSDPFNLYRSLRIVNPSPYMAFFDFGSWYLIGSSPEVMVKAEKNKTNQIVASLRPIAGTRPRGQDAEQDLKFEKDLLKDPKEISEHVMLIDLGRNDLGRVCETGTVEVKDLMIIEKYSHVMHIVSEVEGILKSNTGVWDLLKACFPAGTVTGAPKIRAMQLIKDFEKDARGPYAGVYGSIDINGALNTAITIRTMIVQPSNDGEYIVSVQAGAGIVADSSPANEYQETINKAKGILMALACLDR

SEQ ID NO: 3503 - DNA, 1341 bp, Prochlorococcus marinus
  CDS (1)..(1341)
atgacttctctagagcggcgactttgccgctggcaagaaccagcgaagttggcaaaacaactcaccaaaacttggggagaagctgggcttgtctggctggatggagacggcagtggtctaggtcgttgggcgaccctggcagtcgatcccattaatcagatttgttgccgaggcatccctggcgaaaaaggcgccagcaacccattcgaagccctacgtgatctagaaccaggacactggacaggctggcttagctacgaagcagcagcatggatagaacccaaaaatccctggaaagcagattgcatggcgactctgtggatggcgcaacatgacccagtactgcgatttgaccttcaaaagcatcaactctggattgaaggatgtcatcccaaacgactgcaagaattggcaagctggctagaagccaacccacctgaagatgcacctaaaaggagcaaagatgagtcgttacttgcaacaacagacctcaatattcccgtcaatgcatggcaatggctcaccactagagctgactatgcacgtgatgtgcagcagatcagacattggattgccaacggcgatattttccaagccaatctcagcgcttgctgtaccaccacgatcccttccggaagcttcgccgtagaccttttcctaaaacttcgtcaccacaacccagctccatttgccggcctagtgatagctgcaggccttgcaaacggtgaagccgtgatctccgcctctccagagcgtttcctaaaagcactccccacaggagaaattgaaactcgaccaatcaaagggacccgaccacgccaccccaatcaaagccaagactctgatctggcagctgatcttgtttgcagcagcaaagaccgagctgaaaacgtgatgatcgtcgatctattgcgcaacgatctagggcgagtctgtcaacccggctccatcacagtgcctcaattggtaggccttgagagctatccccatgtgcatcacctcacctcaatagtgcaaggacggcttcgatcagaccaatcttgggtagacctactacaagcctgttggccgggaggctccatcagcggtgcccccaagctgcgcgcctgtcagcggctgaacgaactggaaccaacagcacgcgggccctattgcggatcgttgttgcatctcaactgggatgggcagctcgacagcagcattctgattcgctcgatgttgctcgaggggaacacgttacgagcccatgccggctgcggcatcgtgaccggttccgacccctattgcgaagctgatgagctgaactggaaactgctgccactactggaggcactgcaatga

SEQ ID NO: 3504 - protein, 446 aa, Prochlorococcus marinus
MTSLERRLCRWQEPAKLAKQLTKTWGEAGLVWLDGDGSGLGRWATLAVDPINQICCRGIPGEKGASNPFEALRDLEPGHWTGWLSYEAAAWIEPKNPWKADCMATLWMAQHDPVLRFDLQKHQLWIEGCHPKRLQELASWLEANPPEDAPKRSKDESLLATTDLNIPVNAWQWLTTRADYARDVQQIRHWIANGDIFQANLSACCTTTIPSGSFAVDLFLKLRHHNPAPFAGLVIAAGLANGEAVISASPERFLKALPTGEIETRPIKGTRPRHPNQSQDSDLAADLVCSSKDRAENVMIVDLLRNDLGRVCQPGSITVPQLVGLESYPHVHHLTSIVQGRLRSDQSWVDLLQACWPGGSISGAPKLRACQRLNELEPTARGPYCGSLLHLNWDGQLDSSILIRSMLLEGNTLRAHAGCGIVTGSDPYCEADELNWKLLPLLEALQ

SEQ ID NO: 3505 - DNA, 1521 bp, Prochlorococcus marinus
  CDS (1)..(1521)
atgctcagctctgatcgtgaccatttctttgagatggctgctagtggtgccaatttcattcctttggcccgcagttggccagcggatctggagactcctctaacaacttggttaaaagttggggcagatcatccccctggggtcttactcgaatcggtcgaagggggtgaaactcttgggcgctggagtgtggtggcctgcaatccactttggacagccacctgccgagggaaacacctcacacgtcgttggcgagaaggacgaaccgatgaagccatcggcaacccttttgaaggcctcaggcaatggcttgctccttatcgcaccgcaaccctgccaggcctacccccccttggccagctctatggaatgtggggttttgaactgatcaagtgggttgaacccacagtgcccgttcacttaagggacaacaacgatccgcctgatggcatctggatgctgatggacagcatcttgatcattgatcaagttaaacgcctcatcactgccgtggcatacgcagacctgagtgtcgagcaaacggctaacgaagcttgggacaaggcacaagcacgcattcaagacctagaaaagtgcatggcggaaccacttgcgccgattcagccactgcaatggcaaccaaaaagtcaatctccaccttccaccatcagtaactacagccaacaaggctttgaggaggcagttcaaaccgccaagcaacacatcgccgcaggtgatgtgttccagcttgtaatcagtcaacggctggagaccagagttcctcaacagccacttgagctctacagaagtctgcggatggtgaatccttctccatatatggctttctttgacttcggcgactggcagctgattggctcaagcccggaggtcatggtcaaggcggagcctgtcgccgatggcattaaggccagccttcggcctattgccggcacgcgtcagcgtggcggcaacgaacttgaggaccacaatcttgaagcagagttgatggcagatcccaaggaacgtgccgagcatgtgatgttggttgatcttggccgcaatgaccttggacgcgtttgcaggccgggcagtgtgatggtgaaagagctgatggtgatcgagaaatattcccacgtcatgcacatcgtcagtgcagtggaaggtgtgcttgccaaaggcaaggatgtttgggatctactcatggcctcattcccagcaggcacggtcagtggcgccccaaaaatcagagccatgcagctcattcatgagctcgaacccgactcaagaggaccttattcaggtgtgtatgggtccatcgatctcaacggtgctctgaatacagctataaccattcgcacaatgattgtgcggccccatcctgaaggcggctggcaagtcaaggttcaagcaggcgctggtgtggtggccgattccatccccaccaaggaatacgaagagaccctcaacaaggcaaggggaatgctcacagccctggcctgcctcgagtcccacaagtcatga

SEQ ID NO: 3506 - protein, 506 aa, Prochlorococcus marinus
MLSSDRDHFFEMAASGANFIPLARSWPADLETPLTTWLKVGADHPPGVLLESVEGGETLGRWSVVACNPLWTATCRGKHLTRRWREGRTDEAIGNPFEGLRQWLAPYRTATLPGLPPLGQLYGMWGFELIKWVEPTVPVHLRDNNDPPDGIWMLMDSILIIDQVKRLITAVAYADLSVEQTANEAWDKAQARIQDLEKCMAEPLAPIQPLQWQPKSQSPPSTISNYSQQGFEEAVQTAKQHIAAGDVFQLVISQRLETRVPQQPLELYRSLRMVNPSPYMAFFDFGDWQLIGSSPEVMVKAEPVADGIKASLRPIAGTRQRGGNELEDHNLEAELMADPKERAEHVMLVDLGRNDLGRVCRPGSVMVKELMVIEKYSHVMHIVSAVEGVLAKGKDVWDLLMASFPAGTVSGAPKIRAMQLIHELEPDSRGPYSGVYGSIDLNGALNTAITIRTMIVRPHPEGGWQVKVQAGAGVVADSIPTKEYEETLNKARGMLTALACLESHKS

SEQ ID NO: 3507 - DNA, 1518 bp, Prochlorococcus marinus
  CDS (1)..(1518)
atgtcaatatctgatcgtgtttcttttttagatgctgcttctaggggtataaattttattcccttagttcaaacttggccagcagatcttgagactcctctttctacatggctaaaaattggccagaagaatccaccaggggttctgcttgaatcagttgaaggtggagatactttgggtaggtggagtgttgtagcgtccaatccattatgggtagtgactataaaaggagagaaaataactagaacttggagaaataacgagaaagaagaatttgttggaaatccatttgaacttcttagaaagtgtttagcaccatataaatcgcaattaattcctggcctgccatctttagggcagctttatggaatgtggggatatgagttgatcaaatggattgaacctaaagtaccagtgtattctcaaaatgatgaacaattccctgatggtatctggatgttcatggataaaattttaatttttgatcaagttaaaagactaatcacagcagtatcttatggagatttgacgtccgcggattcccctgaagacgcgtatgaaaaagccttccaaggaattaaggaatttgagagtcttatgcaagaaccactgccttctattaaatctttgaaatggaaccaaaagccttcaatacctgattccattgagagtaattggagcaagtctgaatttgaacatgctgttgaagaagcaaaagaatacatttctaaaggcgatatttttcaacttgttttgagtcaaaaatttacgacccaagttcctcactctcctttggaactctataggagtttgcgaatagtcaacccttctccatttatggctttttatgattttggtgattggcaacttattggatctagtcccgaggtcatggttcaggcgaagcctattgataaaaaagtttcagcaagtttacgcccaattgcaggtactcgcccgagaggaaaaactgctaatgaagattccgagttggaagctcaacttttagctgatcctaaagaaatagctgagcatgtcatgttagtagatctaggccgcaacgatttaggacgcgtctgcagagcaggttctgtatcagtaaatgaattaatgattatcgaaaaatattcgcatgtcatgcatattgttagtgagctgcagggataccttaaagatgatatggatgtatgggatttattgatggcagcattccctgcaggaacagtctcaggggcgccaaaaattagagctatgcaattaattcatgagttggaacctcatatcagaggaccttattctggcgtatatggttcgatggatttaaatggagcattaaatactgcaataacgattcgtacaatgcttgtgtctcatcattccaaggatctttttaatgtggaagttcaagccggtgcaggaattgtggctgattcaattccacaaaatgaatttcaagaaactttgaataaagccaaaggaatgcttatcgctttgggttgcctagaaccttctatttga

SEQ ID NO: 3508 - protein, 505 aa, Prochlorococcus marinus
MSISDRVSFLDAASRGINFIPLVQTWPADLETPLSTWLKIGQKNPPGVLLESVEGGDTLGRWSVVASNPLWVVTIKGEKITRTWRNNEKEEFVGNPFELLRKCLAPYKSQLIPGLPSLGQLYGMWGYELIKWIEPKVPVYSQNDEQFPDGIWMFMDKILIFDQVKRLITAVSYGDLTSADSPEDAYEKAFQGIKEFESLMQEPLPSIKSLKWNQKPSIPDSIESNWSKSEFEHAVEEAKEYISKGDIFQLVLSQKFTTQVPHSPLELYRSLRIVNPSPFMAFYDFGDWQLIGSSPEVMVQAKPIDKKVSASLRPIAGTRPRGKTANEDSELEAQLLADPKEIAEHVMLVDLGRNDLGRVCRAGSVSVNELMIIEKYSHVMHIVSELQGYLKDDMDVWDLLMAAFPAGTVSGAPKIRAMQLIHELEPHIRGPYSGVYGSMDLNGALNTAITIRTMLVSHHSKDLFNVEVQAGAGIVADSIPQNEFQETLNKAKGMLIALGCLEPSI

SEQ ID NO: 3509 - DNA, 1497 bp, Helicobacter hepaticus
  CDS (1)..(1497)
atgtttgattttagcaattcacgcatagcctcaatagctcataaagaaatattgtgcgataatcttacccctttggcagtgcttggctcactgaatgcaaaagtgcttttagaatctgcttataacgaaacaggcaaagatagattttccattgtgattttaaacgaagcttttagaatctacaaagaatgtggtgcacattttctttatacgcaagggcaaaaaatccctttatatgaggctttagcagactatacgccactagattctatttctctacctcccacacataaagctggttttttagaatctctcgctcttgtgcgcactcttgcaccaaatcctactgatagtattcctgctcatttgcctttgcctcttggcggagcaggatatatcggttatgaattttttgcagagattgaagaggtaacatttaagaatccctccctctataatgcgcctgaatgtgcatttatctttggacgagattttttaatttttgaccatctttttgatagattgcatattgtgagtgtgggctatgcacacgagagagaagagcactcaactaagcagcgaatagagcatattgcacatagtcttgccactttagtgccacaaaatggattagattctatgcaaaaatcagattttgagtgtgtgagtgctacttcgcagcaagaatatgaatctatggtggaggcaatcaaaaaggcaatttatgcgggaaatttactccaatgtgtgccaagtcaatatatgcagattcgctcttcactttctccgcttcaagcttatcggaatttacgccatcaaaaccctagtccttatatgttttattataattttgatgattttgtgatacttggagcgagtccggagattatgctaaggcttaaaagcaagcaaggacaatcattttttacacttcgtccaattgcaggcacacgtcctagaggtgagagtgtggcgcaagatttggagcttgaaacagagcttttaaatgatgaaaaagaaaatgcagaacatctaatgttacttgatttagctcgtaatgatgcgggtaaagtaagtgtaggtggaggtgtaaaagtaatagcgcgtaataaaattgagcgatattcgcgtgttatgcacattgtatccgaagtgcaaggagagctagattctaagcattttagcaaagctgatgcgtttaaatctgtttttcctgcaggcacattaagtggtgcgccaaaaattgaggcaatcaaaaccatagaatctttagaatctcacgcacgaggtgtgtatggcggtgcgatagggtatttcacttatgatgaagatatggattttgctattgctattcgcacagcggtgtatcaaaatggtatgtattatatgcgctctggtgcgggtgtggtgcaagattctattccaagtgcagagtatatggagacacaaaataaagtccgctcacagcttgatatgtttaatatagacaaggaataa

SEQ ID NO: 3510 - protein, 498 aa, Helicobacter hepaticus
MFDFSNSRIASIAHKEILCDNLTPLAVLGSLNAKVLLESAYNETGKDRFSIVILNEAFRIYKECGAHFLYTQGQKIPLYEALADYTPLDSISLPPTHKAGFLESLALVRTLAPNPTDSIPAHLPLPLGGAGYIGYEFFAEIEEVTFKNPSLYNAPECAFIFGRDFLIFDHLFDRLHIVSVGYAHEREEHSTKQRIEHIAHSLATLVPQNGLDSMQKSDFECVSATSQQEYESMVEAIKKAIYAGNLLQCVPSQYMQIRSSLSPLQAYRNLRHQNPSPYMFYYNFDDFVILGASPEIMLRLKSKQGQSFFTLRPIAGTRPRGESVAQDLELETELLNDEKENAEHLMLLDLARNDAGKVSVGGGVKVIARNKIERYSRVMHIVSEVQGELDSKHFSKADAFKSVFPAGTLSGAPKIEAIKTIESLESHARGVYGGAIGYFTYDEDMDFAIAIRTAVYQNGMYYMRSGAGVVQDSIPSAEYMETQNKVRSQLDMFNIDKE

SEQ ID NO: 3511 - DNA, 1386 bp, Candidatus Blochmannia floridanus
  CDS (1)..(1386)
atgactgcaaatcttatagaatttccttatcatcctcattcttcattaaaactttttaaatctctatcttctaatccatggtctatattattatattccggttatgataataaacatccagatagtcgttttgatatattagtaactaatccgagtttaacactaactacatatgataaaatcactaccatttcatacaataacaaaaataaaactagcaatcaagatccttttttattattaaaaaaatatacacaaatctaccaattaaaaacagatcacaattatcctatcccattccaaggaggattcataggtgtgtttggatacgatttagtaagaaatatcgaattaataccaaccctcgcccaaaaagacattcatttaccagatatggcaataggtttttataaatgggctatcatttctgaccacaagactctaaaaaattatttagttacacataacgatcctaaaccaattttaaattggattcatcaacaatatgcatataatgataaacatatgcaatcatttcaactattaaatgcatggcaaagtaatattacaataaatgagtactcaaaaaaatttaaaatcattaaaaaacatttaaaaatgggtaattgttatcaaatatgcctatctcaacgttttaaagctccatacatagggcatgaatggacagcttttcgttatttattaaattacaatacagctcctttttctgcatttattagattaccaaattattcaagtatattaagtttttctccagaacgtttcataaaattaaaaaattcaaacattattacccagccaatcaaaggcacattagtgaaattaaaaaataccaaagaagatcaaaaacaaaaacaaaaattatcgcaatctagcaaggaccaatcagaaaacctcatgatagttgacttattaagaaatgatattggaaaagtagccattccaggtagtattcaagttactcgattatttgaaatccaatcattttctcaagtacatcatatggttagtacaattattggaaaacttgataataaattttcagctatagatttactaaaagcatgttttccaggaggatccattacaggagctccaaaaatccaagctatgaaattaatcgaaacacttgaaccacatcgtagaagtgtatggtccggtagcataggatatttaagttgctgtggcaatatggatactaatatcagtattagaactttattaactaataaatacaatcttttttgtactgttggcagcggaattatatttgaaagcaaacaagatctcgaatatcaggaaatgcaagataaaatctctactctgttaacaccattatcacaatataaccataaaaaatcttag

SEQ ID NO: 3512 - protein, 461 aa, Candidatus Blochmannia floridanus
MTANLIEFPYHPHSSLKLFKSLSSNPWSILLYSGYDNKHPDSRFDILVTNPSLTLTTYDKITTISYNNKNKTSNQDPFLLLKKYTQIYQLKTDHNYPIPFQGGFIGVFGYDLVRNIELIPTLAQKDIHLPDMAIGFYKWAIISDHKTLKNYLVTHNDPKPILNWIHQQYAYNDKHMQSFQLLNAWQSNITINEYSKKFKIIKKHLKMGNCYQICLSQRFKAPYIGHEWTAFRYLLNYNTAPFSAFIRLPNYSSILSFSPERFIKLKNSNIITQPIKGTLVKLKNTKEDQKQKQKLSQSSKDQSENLMIVDLLRNDIGKVAIPGSIQVTRLFEIQSFSQVHHMVSTIIGKLDNKFSAIDLLKACFPGGSITGAPKIQAMKLIETLEPHRRSVWSGSIGYLSCCGNMDTNISIRTLLTNKYNLFCTVGSGIIFESKQDLEYQEMQDKISTLLTPLSQYNHKKS

SEQ ID NO: 3513 - DNA, 1566 bp, Candidatus Blochmannia floridanus
  CDS (1)..(1566)
atgaaatatcaaatcacacatgcagaaaactttagaattccagtactatatcattccaatccaaccatagtttttaatcagttatgtagaaatcgttattcaacattattattagaatccgcagaaatccaaaacaaaagcaatatagaaagtatgatgattattgatagtgcattaagaatcacagcttataatacaaatgtcataattcataccctgactagaaacggaattaatttactaccactattacaaaaaacactacctagtattgttaaaataaaaaaaatacatgctggaatgcaattaacatttccaatgatacaagataaaaccgatgaagatacacgtcttaaatcaatctctattttagattgtttacgatcattactaaaaatcataaaaacgcctaaagataatcctaaatctatattcttaggaggattattttcttatgatttaatatcatgttttgaacctgtaccaaaatttaccaatgatattatatgtccagactattgcttttacttatctgaaatattattaatttttgatcatcaaaaaaaacttgcagaattacatggcacattatttattcctgatattacagaaaaaaatagattacaaagtagaatgcatgaattaaaaaaacaaattaatcatcaaacccataatactattccacataaacctatacagaatatacaattaaattgtaatcaagatgatgaatcttataaaaaaactatccgtaaaatacaacacgccatacaaagaggagaaatattacaagccgtaccatcaagatgttttttcctaccatgtccttctccgttagcagcatatcatgaattaaaaactaataatcctagtccttacatgtttttcatgcaagatgaaatattcactttatttggagcatctccagaaagctcattgaaatatgatgctaaaactagaaaaattgaaattcatcccatagccggcactagagcacgcgcatactataatgatggctcattagatatggatacagacaacaaaatagaattagaaatgcgtttaaatcataaagaattatcagaacatttaatgttagtagatttagccagaaatgatttagctcgagtttgtacagccggtagtcgctacgtagctgacttattaaaagtagaccgttattcttatgttatgcatttagtctctaaagtgataggaaaattagatcctagtcttgatgctttacatgcttatcgagcttgtatgaacatgggcacattaacaggagcaccaaaaattaaggctatgcaaataatccataaagtggaaagtagacgtcgaaatacttacggtggagcaattggatatttaacaggattaggtaatttagatacatgtatcataattagatcagcttatgttataaatggaatagctactgtacaagcaggagctggcattgtaatagattctgaaccccaatctgaagctgacgaaagtagaaataaagcacgagccgtgttacgctccattgctatagctcataattgtaaggaaattttctaa

SEQ ID NO: 3514 - protein, 521 aa, Candidatus Blochmannia floridanus
MKYQITHAENFRIPVLYHSNPTIVFNQLCRNRYSTLLLESAEIQNKSNIESMMIIDSALRITAYNTNVIIHTLTRNGINLLPLLQKTLPSIVKIKKIHAGMQLTFPMIQDKTDEDTRLKSISILDCLRSLLKIIKTPKDNPKSIFLGGLFSYDLISCFEPVPKFTNDIICPDYCFYLSEILLIFDHQKKLAELHGTLFIPDITEKNRLQSRMHELKKQINHQTHNTIPHKPIQNIQLNCNQDDESYKKTIRKIQHAIQRGEILQAVPSRCFFLPCPSPLAAYHELKTNNPSPYMFFMQDEIFTLFGASPESSLKYDAKTRKIEIHPIAGTRARAYYNDGSLDMDTDNKIELEMRLNHKELSEHLMLVDLARNDLARVCTAGSRYVADLLKVDRYSYVMHLVSKVIGKLDPSLDALHAYRACMNMGTLTGAPKIKAMQIIHKVESRRRNTYGGAIGYLTGLGNLDTCIIIRSAYVINGIATVQAGAGIVIDSEPQSEADESRNKARAVLRSIAIAHNCKEIF

SEQ ID NO: 3515 - DNA, 1428 bp, Bacillus cereus
  CDS (1)..(1428)
atgaaggacatgatgacgaaagaagaatttataaaacaaaaaagagagagaaagacatttttagtaatcactgaagaagaaggagatagcattacgccaatttctttatatagacgtatgaaagggaagcagaaattcttattagaaagttcacagcttcatcaagataaagggcgttattcttacttgggatgtaatccttatggagaagtgaaaagcgttggtacggaagtggaacgaacaatttacggccgggcagaaaagttacaaggtaatgtactgcaagtgttagaagaagtaatcgcaccatcacaagtagacagtccatttccattttgcggaggagcagttggttatattggatatgatgtcattcggcagtatgaaaacattggagcggatttacacgacccattaaatattccggaagtacaccttttactatatcgtgagtttatcgtttacgatcatttacgccaaaagttgtcgtttgtatatgtatgcaggcaagatgattcagcagattatgaagaagtatacgaaaggctacgagtatacaaagaggaagtgctacaaggagaagaagctgaagtaaatacaatacaatccccattatcatttacttcttctataacggaaaaagagttttgtgagatggtagaaatggcgaaagaatatataagagcgggagacatattccaagttgtactgtcacagcgtttacaaagtgaatgtattggtgatccattcgcgttatatcgaaaacttcgaattgcaaatccatcaccatatatgttctatatcgattttcaagattatgttgtactcggttcttcgccggaaagtttactatcagtaagggaggataaagtgatgacgaatccaattgctggtacaaggccgagggggaaaacgaagagggaagatgaggaaatcgcaaaagaactgttaggcaatgagaaagagcgagcagagcatatgatgcttgtagatcttgggcgaaacgatattggtagagtgagtgaaatcggctcggttacgatagataaatatatgaaagtagaaaaatattctcacgttatgcacattgtatccgaagtttacggaacattgcaaaaacaaatgggcggatttgatgcgttagcgtattgcttaccagcagggacggtttctggagctccgaaaattagagcgatggaaattataaatgaactagagaatgaaaaaagaaatgtatacgctggtgcagttggatacgttagtttttcaggaaatcttgatatggcgctcgccattcgaacgatggtcgtaaaggatgaaaaagcatacgttcaggcaggagcaggagtcgtttacgattcagatccagtagctgaatatgaagaaacattaaataaagcgagagcgcttttggaggtaatgaaatga

SEQ ID NO: 3516 - protein, 475 aa, Bacillus cereus
MKDMMTKEEFIKQKRERKTFLVITEEEGDSITPISLYRRMKGKQKFLLESSQLHQDKGRYSYLGCNPYGEVKSVGTEVERTIYGRAEKLQGNVLQVLEEVIAPSQVDSPFPFCGGAVGYIGYDVIRQYENIGADLHDPLNIPEVHLLLYREFIVYDHLRQKLSFVYVCRQDDSADYEEVYERLRVYKEEVLQGEEAEVNTIQSPLSFTSSITEKEFCEMVEMAKEYIRAGDIFQVVLSQRLQSECIGDPFALYRKLRIANPSPYMFYIDFQDYVVLGSSPESLLSVREDKVMTNPIAGTRPRGKTKREDEEIAKELLGNEKERAEHMMLVDLGRNDIGRVSEIGSVTIDKYMKVEKYSHVMHIVSEVYGTLQKQMGGFDALAYCLPAGTVSGAPKIRAMEIINELENEKRNVYAGAVGYVSFSGNLDMALAIRTMVVKDEKAYVQAGAGVVYDSDPVAEYEETLNKARALLEVMK

SEQ ID NO: 3517 - DNA, 1398 bp, Bacillus cereus
  CDS (1)..(1398)
atgcaacgaagaaaatctttagcgctttctattccatatcagttagatttctttaagcaatataaatttctttctcagggtaaatcgcaacatattttgttagaaagcggccgtggcggtcgttataacattgtagggctgaacccagtagcggtaatccgagggaaggatgaaacgttacatataagtgaaagtggtaagggaacaataaaacgagggaatccgttagatttaatgcaagaatatatggaacaatggaagacggactataacccagagtatccgccttttcaaggtggtgcaattggctatttcagttatgactgtatccgttatattgaaaagctgccttctcttgcggaagatgatattgatatacctgacatcttctttttattatttgatgacgtatttgtctatgatcaaaaagaacaagtgttatgggttattacgcattatgtagataaatatgaagaggcgaaagaacggctaaatgagtggaagagtctttggatgacagaagcgcctgaagtgaccgtgccctttgaaagtcctgaaaagaaaagtgaagcagttgcttttactgaagctggctttatgaaggcagttgaatgtattcaagaatatattggagcgggtgatgtgttccaagtaaacttgtcgatgagacaagaaagaacgttacagacacacccactagaaatttatacaagtcttcgtgaaattaatccatctccatatatgggttacctggagcttggggattttcaaatcgttagtggatcgccagagttgttaattaagaaacaaggaactgaagtaagtacaagaccgattgctggaacgagatctagaggcgcggatgagcaagaggatgaagaattagcaagagaattaattgagaacgaaaaagaaagagcagagcatgtaatgcttgtggatttagaaagaaatgatttaggacgtgtttgtaaatatggcactgtagaagtagatgaatttatggtaattgagaaatactcacatgttatgcatattgtttctaatgtgcgtggtgaggtggaagaagataaagatgcttttgatttagtgaaggctgtattccctgggggaacaattactggtgccccaaaaatacgtacgatggaaattattgaggaattagaacctgttcgaagagggatttatacagggtcaatcggttggattggttattctggagatacagaattgaatattgtaattagaacacttcttgctaaagatggaaaagctcatgtacaagcaggggcgggaattgtaattgattcaaatccggaaaatgaatataaagagtcgttaaaaaaggcgattgctttatggcgtgcaaaagaacgtagtgaagaaacggttaggtga

SEQ ID NO: 3518 - protein, 465 aa, Bacillus cereus
MQRRKSLALSIPYQLDFFKQYKFLSQGKSQHILLESGRGGRYNIVGLNPVAVIRGKDETLHISESGKGTIKRGNPLDLMQEYMEQWKTDYNPEYPPFQGGAIGYFSYDCIRYIEKLPSLAEDDIDIPDIFFLLFDDVFVYDQKEQVLWVITHYVDKYEEAKERLNEWKSLWMTEAPEVTVPFESPEKKSEAVAFTEAGFMKAVECIQEYIGAGDVFQVNLSMRQERTLQTHPLEIYTSLREINPSPYMGYLELGDFQIVSGSPELLIKKQGTEVSTRPIAGTRSRGADEQEDEELARELIENEKERAEHVMLVDLERNDLGRVCKYGTVEVDEFMVIEKYSHVMHIVSNVRGEVEEDKDAFDLVKAVFPGGTITGAPKIRTMEIIEELEPVRRGIYTGSIGWIGYSGDTELNIVIRTLLAKDGKAHVQAGAGIVIDSNPENEYKESLKKAIALWRAKERSEETVR

SEQ ID NO: 3519 - DNA, 1416 bp, Bacillus anthracis
  CDS (1)..(1416)
atgacaaaagaggaatttataaaacagaaagaacaaagaaaaacatttttggtaatcgctgaagaagaaggagatagcattacgccaatttctttatatagacgtatgaaaggtaaaaagaaatttttattagaaagctcacagcttcatcaagataaagggcgttattcttacttaggttgtaatccatatggtgaagtgaaaagcgttggtacggaagtggaacgaacgatttacggcagggcagaaaagttgcaaagtaacgtactacaagtgttagaagaaataatcgcaccatcacaagtagacagtccatttccattttgcggaggagcagttggatacattggctatgacgtcattcggcaatatgaaaacattggagcagatttacatgatccattgaatattccagaagtacaccttttactgtaccgtgagtttatcgtgtatgaccacttacgccaaaagttgtcgtttgtatatgtatgcagggaagatgattcagcagattatgaagaagtatacgaaaggctgcgagtatacaaagaggaagtgctacagggagaagaagcggaagtaactgaaataagatcaacattatcattcacttcttctataacggaaagagaattttgcgtgatggtagaaacggcgaaagaacacatcggggccggggacatatttcaagttgtattatctcagcgtttgcaaagcgaatgtattggagatccattcgcgttatatcgaaaacttcgaattgccaatccatcaccatatatgttttatatcgattttcaagattatgttgtactcggttcttcgccagaaagtttgttatcagtaagggaggataaagtgatgacgaatccaattgctggtacgaggccgagagggaaaacgaaggaggaagatacggagattgaaaaagaactgttagaaaatgagaaagagcgagcggagcatatgatgcttgtagatcttgggcgaaatgatattggtagagtgagtgaaatcggctcagttacgatagataaatatatgaaagtagaaaaatattctcacgttatgcacattgtatctgaagtttacggaacattgcgaaaacaaatgagcggatttgatgcattagcgtactgtttaccagcggggacggtatcaggtgctccgaaaattagagcgatggaaattataaatgagctagagaatgaaaaaagaaatgtgtacgccggtgcagttggatacgttagtttttcagggaatcttgatatggcgctcgccattcgaacaatggttgtaaaggatgaaaaagcatacgttcaggcaggagcgggtattgtttacgattcagatccagtagctgaatatgaagaaacattaaataaagcgagagcgctattggaggtaatgaaatga

SEQ ID NO: 3520 - protein, 471 aa, Bacillus anthracis
MTKEEFIKQKEQRKTFLVIAEEEGDSITPISLYRRMKGKKKFLLESSQLHQDKGRYSYLGCNPYGEVKSVGTEVERTIYGRAEKLQSNVLQVLEEIIAPSQVDSPFPFCGGAVGYIGYDVIRQYENIGADLHDPLNIPEVHLLLYREFIVYDHLRQKLSFVYVCREDDSADYEEVYERLRVYKEEVLQGEEAEVTEIRSTLSFTSSITEREFCVMVETAKEHIGAGDIFQVVLSQRLQSECIGDPFALYRKLRIANPSPYMFYIDFQDYVVLGSSPESLLSVREDKVMTNPIAGTRPRGKTKEEDTEIEKELLENEKERAEHMMLVDLGRNDIGRVSEIGSVTIDKYMKVEKYSHVMHIVSEVYGTLRKQMSGFDALAYCLPAGTVSGAPKIRAMEIINELENEKRNVYAGAVGYVSFSGNLDMALAIRTMVVKDEKAYVQAGAGIVYDSDPVAEYEETLNKARALLEVMK

SEQ ID NO: 3521 - DNA, 1482 bp, Streptomyces avermitilis
  CDS (1)..(1482)
atggacctcgagacgttccgcaagctggccaccgaccgccgtgtcattcccgtcagccgcaaactcctcgccgacggcgacaccccggtcgggctctaccgcaagctcgccgccgagcgccccggcaccttcctcctggagtccgcggagaacggccgctcggcgttcaaatggtcccgctactccttcgtgggcgtccgctccgccgccaccctcaccgagcgtgacgggcaggcgcactggctcggcaccccgcccgtgggcgtccccacggacggcgacccgctcgccgccctgcgcgccaccatcgaggcgctgcacacgccccacgaggagggcctgccgcccttcaccggcggcatggtcggctatctcggctacgacatcgtgcgccgcctggagaagatcggccccggcgagcgcgacgatctgaaacttcccgagctgaccatgctcctcaccagcgatctggccgtcatggaccactgggagggctccgtcctgctgatcgccaacgcgatcaaccacaacgacctcgacacgggcgtcgacgaggcctacgcggacgcggtcgcccgcctcgacgccatggaggcggacctgtcgcgcgcggtcgcgcagccccccgccgccctcccgccctccgaactcccggagtacaccgccctctggggcggccccgacttccaggacgccgtcgaggacatcaaggagcgcatccgggcgggcgaggcgttccaggtcgtcccctcccagcgcttcgaaacgccgtgcacggcaagcgcgttggacgtctaccgggtactgcgggcgaccaacccctcaccgtacatgtacctcttccgcttcgagggcttcgacgtggtcggctcgtcccccgaggccctcgtcaaggtcgaggacgggcaggcgatggtccaccccatcgcgggcacccggccgcgcggcgcgaccccgcaggaggaccaggccctcgcggacgagctgctggccgaccccaaggagcgcgccgagcacctgatgctcgtcgacctggggcgcaacgatctggggcgggtctgcgagcccggttccgtcgaggtcgtcgacttcatgaccatcgagcgctactcgcacgtgatgcacatcgtgtcgaccgtgaccgggcgggtcgcgcgggggcgtacggccttcgacgtgctgacggcctgcttcccggccggcaccctctccggcgcgcccaagccccgcgccctgcagatcatcgacgaactggagccgtcccggcgggggctgtacggcggctgcgtcggctacctcgacttcgcgggcgactccgacaccgccatcgccatccgcacggcgctgctgcgcgacggcacggcgtacgtgcaggcgggcgccggcatcgtcgcggactcggacccggtcgccgaggacgacgagtgccgcaacaaggcggcggcggtcctgcgcgcggtccacacggcgaaccggctgtag

SEQ ID NO: 3522 - protein, 493 aa, Streptomyces avermitilis
MDLETFRKLATDRRVIPVSRKLLADGDTPVGLYRKLAAERPGTFLLESAENGRSAFKWSRYSFVGVRSAATLTERDGQAHWLGTPPVGVPTDGDPLAALRATIEALHTPHEEGLPPFTGGMVGYLGYDIVRRLEKIGPGERDDLKLPELTMLLTSDLAVMDHWEGSVLLIANAINHNDLDTGVDEAYADAVARLDAMEADLSRAVAQPPAALPPSELPEYTALWGGPDFQDAVEDIKERIRAGEAFQVVPSQRFETPCTASALDVYRVLRATNPSPYMYLFRFEGFDVVGSSPEALVKVEDGQAMVHPIAGTRPRGATPQEDQALADELLADPKERAEHLMLVDLGRNDLGRVCEPGSVEVVDFMTIERYSHVMHIVSTVTGRVARGRTAFDVLTACFPAGTLSGAPKPRALQIIDELEPSRRGLYGGCVGYLDFAGDSDTAIAIRTALLRDGTAYVQAGAGIVADSDPVAEDDECRNKAAAVLRAVHTANRL

SEQ ID NO: 3523 - DNA, 2199 bp, Streptomyces avermitilis
  CDS (1)..(2199)
atgaagaccctgctcatcgacaattacgactcgtacacgtacaacctgttccagctgatcgccgaggtgaacggcgaggagccggtggtcgtcctcaatgacgccccgccggacgacattccggatctccgggatttcgccaacgtggtggtgtcgccggggcccggacaccccgcgaagagacgtgacttcggcatcgtcggcgagctgctcgccgcggcccccgtgcccgtgctgggcgtctgcctcggccaccagggcatcgcggcgggggagcgggcctgggtgaccccggcaccggagccccgccacggccatctgtccaccgtccggcacaacggccaggacctgttcgagggcctgccccagcagttcaccgcggtccgctaccactccctgtcggtacgggaaccgctgccactgagcctggagcccaccgcctgggcggaggacggcgtgctgatgggactgcggcaccgctcccggccgctgtggggggtgcagttccacccggagtccgtcctcaccgagttcggccaccggatgttcgtgaacttccgcgagctgacggcctcccgcgcccgcgagactcgcacggccaaggcccgtacgtccggaacgcgcacgaccgagccccccgtgcggcccccgtccccaagcgccgagggggccggggcagcacccgccgtgctggtcccccggccccgtcgcgtggccccgtcccaccgccttcacacccggcggatcgacgtggccgtggacgccgaggcggccttcacccggatgtacaccgacgcgccccgcgcgttctggctcgacagctcccgggtcgaggagggacagtcccgtttctcgttcttcggtgacggcaccggaccgctggccgagttcgtacggtacgacgtcgagagcggcctctgtgagatcgagcggcccgggcggcccgtgcgcaaggtcagggccagcgtcttcgactacctgaaacggcagttggtgacccgtcaggtggatgccacgggactgccgttcgacttcaccggcgggtatgtgggctacttcggctacgaggtgaaggccgactgcggttccgtcaaccgtcatcgggcccgaactcccgacgcctgctggctgttcgccgaccggctgatcgcagtggaccatcaggacggagccacctacgccgtctgtctcgccgagaacacccggcagggcgcacagcaagcggccgactggctcgacgcggcgatggcccagctcagtttcgtgtcctcggccaagccgaccgccccgccgcggccgacggcaccccgcctcgatgccgtggagccgtggctggtccgcgaccgtacgacctacctcgcggacatcgggacctgcaagcgggaactcaaggacggcaccagttacgagatctgtctgaccaacgcggccaggctgcccgccccgtacgacccctacgacttctaccgggtactgcgtcgtctcgacccggcgccgtacgcggcctatctgcggttcggtgacctcgatgtggccggctcgtcccccgagcgttttctgcggatcacccgcgacggcgtcgccgaggccagacccgtcaagggcaccgcgccccgcggcgagcggccggaggaggacgcccggctacgggacgcgctcaccacggacgacaagacccgcgcggagaacctggtgatcgtcgacctgctccgcaacgacctgggccgggtctgccggaccgggacggtgaaggtcacccgcctgatggcgaccgagacgtgcgccaccgtgcaccagttggtctccaccgtcgaggggcggctgcgcgagggcatcggagcggtggactgcgtacgtgtctgcttccccggaggttcggtgaccggggcgccgaaactgcgcacgatggagatcatcgactcgctggagaccgaggcccgcggggtgtactccggagccatcggctacttcgggtgcagtgggggcgcggacctcgccatcgccagccgcacggccgtgttcaccgacggggagatgcacctcggcgcgggcggtgcgatcgtcctcggctccgatccggtcggcgagtacgacgagatgctgctgaagacggccgcaccgatgcgcgcccaccgcgaccggatcgccggcctgcggcccgccgcccgcacgctcccgctgaaggaggcggtccgatga

SEQ ID NO: 3524 - protein, 732 aa, Streptomyces avermitilis
MKTLLIDNYDSYTYNLFQLIAEVNGEEPVVVLNDAPPDDIPDLRDFANVVVSPGPGHPAKRRDFGIVGELLAAAPVPVLGVCLGHQGIAAGERAWVTPAPEPRHGHLSTVRHNGQDLFEGLPQQFTAVRYHSLSVREPLPLSLEPTAWAEDGVLMGLRHRSRPLWGVQFHPESVLTEFGHRMFVNFRELTASRARETRTAKARTSGTRTTEPPVRPPSPSAEGAGAAPAVLVPRPRRVAPSHRLHTRRIDVAVDAEAAFTRMYTDAPRAFWLDSSRVEEGQSRFSFFGDGTGPLAEFVRYDVESGLCEIERPGRPVRKVRASVFDYLKRQLVTRQVDATGLPFDFTGGYVGYFGYEVKADCGSVNRHRARTPDACWLFADRLIAVDHQDGATYAVCLAENTRQGAQQAADWLDAAMAQLSFVSSAKPTAPPRPTAPRLDAVEPWLVRDRTTYLADIGTCKRELKDGTSYEICLTNAARLPAPYDPYDFYRVLRRLDPAPYAAYLRFGDLDVAGSSPERFLRITRDGVAEARPVKGTAPRGERPEEDARLRDALTTDDKTRAENLVIVDLLRNDLGRVCRTGTVKVTRLMATETCATVHQLVSTVEGRLREGIGAVDCVRVCFPGGSVTGAPKLRTMEIIDSLETEARGVYSGAIGYFGCSGGADLAIASRTAVFTDGEMHLGAGGAIVLGSDPVGEYDEMLLKTAAPMRAHRDRIAGLRPAARTLPLKEAVR

SEQ ID NO: 3525 - DNA, 1488 bp, Nitrosomonas europaea
  CDS (1)..(1488)
atgaatcattgcataactgaaagtgaattcaacgatctggcagcacaaggctataaccggatacctctggtgctggaaacattcgctgatctggatacgcccctctccatttacctcaagctggcgaaccagccttattcctatttactggaatcgatcctgggaggggagcggttcgggcgttactcggtcatcggattacctgcagaaatacggctggaagcatgttccagccgtgttcgcgtcatcagtggcaatgaaacgaaggaagaaatcgataccagcgacgtgctgggtttcattggcaccttcctgaaccggttcaaggtagcaccccatgcggaattgcctcgtttcagcggaggactggccgggtatttttcctacgataccattcgttacatcgagccaaaactagcagggcatgcacggccggatacgatacaaacaccggatattctgttactgctgtcggaagaactggttgtcatggacaatctctccggcaagctttacctgatcatctataccgacccgacactggaaaatgcctatcagaccagcaaaaatcggctccgggaattgctgcacaaactgcgagagccgctctcgataccagtcgagaaatctacttcctccaaagtagctgtgagtgaatttcccgaagccgacttcattgccgcagtggaaaaagccaagcattacatcctggagggcgacatcatgcaggttgtcctctcgcagcgtaccagcaaaccctactctgcttcaccattggcactgtatcgtgcgctgcgcagcctcaacccatcaccctatatgttcaattatcatctgggaaattttcatatcgttggcgcctcaccggaaattctggtcagactggaaaaggatacagttaccgtccgtccaattgccggtacccgaccacgtggccaggatacccaggctgacctggcactggcggcagatttgctggccgatcccaaggagcgggcggaacatatcatgctgatggatctgggacgcaacgatatcggccgggttgcccagaccggtagcgtaaaagtcactgagaacatgcagatagaatattattcgcatgtcatgcacattgtttccaatgttgaaggaaagctcaaatcgggtttgaatgcgatcgacgtactacgcgccaccttccctgcgggtaccgtcagcggcgcacccaaagtcagagcaatggaaatcatcgatgagctggaaatctccaagcgcggtatttatgctggcgcagtcggttatctcgaattcaatggcgacatggacttggccatcgcaatccgtaccggcctgatcaaggacggcatactgcatgtgcaggcgggagctggtatcgtagctgactctgttccacaaagtgagtggaccgaaacctgcaacaaagcgagggctgtcctgcgagcggcagaaattgccgagaatggcctggacagtacgatcacctga

SEQ ID NO: 3526 - protein, 495 aa, Nitrosomonas europaea
MNHCITESEFNDLAAQGYNRIPLVLETFADLDTPLSIYLKLANQPYSYLLESILGGERFGRYSVIGLPAEIRLEACSSRVRVISGNETKEEIDTSDVLGFIGTFLNRFKVAPHAELPRFSGGLAGYFSYDTIRYIEPKLAGHARPDTIQTPDILLLLSEELVVMDNLSGKLYLIIYTDPTLENAYQTSKNRLRELLHKLREPLSIPVEKSTSSKVAVSEFPEADFIAAVEKAKHYILEGDIMQVVLSQRTSKPYSASPLALYRALRSLNPSPYMFNYHLGNFHIVGASPEILVRLEKDTVTVRPIAGTRPRGQDTQADLALAADLLADPKERAEHIMLMDLGRNDIGRVAQTGSVKVTENMQIEYYSHVMHIVSNVEGKLKSGLNAIDVLRATFPAGTVSGAPKVRAMEIIDELEISKRGIYAGAVGYLEFNGDMDLAIAIRTGLIKDGILHVQAGAGIVADSVPQSEWTETCNKARAVLRAAEIAENGLDSTIT

SEQ ID NO: 3527 - DNA, 1293 bp, Coxiella burnetii
  CDS (1)..(1293)
atgaaagcaaaaattatcgagctgccttactttgaggatggggctgaatgtttttcgcattttgcgcatttgccttatgctgtttttttagatggttgcgaacgttaccatgtcataacagcacagccgcgtaaaactattaccgacaatatatttattcaaactcgcgctgctttacacgaattaaaatcgactgtacaaattcctccgtcagtttcgcatttgccttttaaaatcggcgctatcgggtatttaagttacgatttagcgcgacattattttcccttaaaggcacaaactaaaatcgatatcacgcttcctttggcggtcatggggatatacgattggagcttagtcatcgaccatcatgagcaaaaaacatgggcaattgcattttcggatgaacagttacgccatatccaaacgcaattaattacgccagcacacattgacctcttccacctgcttaacgattttcattccaacatgacccgcgacgattacgcctttgcctttaaaaaaatccaacaccacttgaggcagggcgattgctatcaagtaaatctttgccaacgttttagtgccacgtatcaaggttcaccttggtacgcctatcgatatctgcgacaaacgcaccctactcccttttcgacgtactttaaccttgacaatcagagggcgattttaagcttttctccagaacggtttttgcgagtagaaaaaaaccaagtggaaacaaaacccattaaaggcaccgcacctcgatttaaagatccatttgaagaccagcgctcagcagaaagtttattaaatagtgaaaaagaccgtgctgaaaatttaatgattgtcgatttattacgaaatgatctgtcaaaatgctgcaaacctaactccattcgtgtacctaaattagttgcgctggaaagtttccccaatgtccatcatctcgttagcaccattacaggacatttgcaggataatcaagatgcgcttgatttattgcggcattgctttccgggcggctctatcacgggcgcgcctaaattgagcgcaatgcaaattattgaaagtctcgaaacgcatcaccgttccgtttattgtggtgcgctgggttatctcgatatcagcggcgatttggattgcaatattatgattcgcaccttaatttgtgatcgcaaccgaatacattgctatggcggtggcggcattgttgctgattctgaactggaaagtgaatatcaagagtctcaattaaaagtcgaaaaactgattaatcaagtgagccgtttatga

SEQ ID NO: 3528 - protein, 430 aa, Coxiella burnetii
MKAKIIELPYFEDGAECFSHFAHLPYAVFLDGCERYHVITAQPRKTITDNIFIQTRAALHELKSTVQIPPSVSHLPFKIGAIGYLSYDLARHYFPLKAQTKIDITLPLAVMGIYDWSLVIDHHEQKTWAIAFSDEQLRHIQTQLITPAHIDLFHLLNDFHSNMTRDDYAFAFKKIQHHLRQGDCYQVNLCQRFSATYQGSPWYAYRYLRQTHPTPFSTYFNLDNQRAILSFSPERFLRVEKNQVETKPIKGTAPRFKDPFEDQRSAESLLNSEKDRAENLMIVDLLRNDLSKCCKPNSIRVPKLVALESFPNVHHLVSTITGHLQDNQDALDLLRHCFPGGSITGAPKLSAMQIIESLETHHRSVYCGALGYLDISGDLDCNIMIRTLICDRNRIHCYGGGGIVADSELESEYQESQLKVEKLINQVSRL

SEQ ID NO: 3529 - DNA, 1392 bp, Coxiella burnetii
  CDS (1)..(1392)
atgcttacgccaacccgggctttttatcaattgctggatttgtatccaacagcgattttgctggaatttagcccacgcaatgaaaagccctacgcttttatcggattcaacccgttagcccagatcatcgctcgcggggatgaaattaccgtttttttaaaaaacactgtcaccaaaatgaagggtgaccccttccatcatctacgccgtttacgccaacaaatcaattgcattgataaccatccattaacgaaattaacaggcgcagcaatcggctatttaagttacgatgctatccgttatgtagaatctattcctgatcgtcacacagcctctgaaaaaattgctgacattgattttaaattttatcgcgatggcattacctttgatctagaaagcaataatgccattgtttctcacattgttgaagttaaagacgaattaaaacattgctacgaatacggattagaaaaactagccgatattaccaataatctttttacgcccgcccgcccaaagctttcgacgaatcgaaaaactcattactcaaaatcaacttccctggatttcaaacccgatagcaatgacaccgattttaaaaaaatcgttaacaaggccaagcaatacattgccgcgggcgacatctttcaagtcgtgtcttcccgaacttttaaaaaaccgtatcaaggcaaaccctttgatatctaccgcgctttaaaaaaagtaagcccttctccctatcacttttatttacaaaatgattctcttgctatcgccggcgcttcaccggaaaaaatggttagcgttaaaaacggcataatcgacagcgtacctctcgccggcacgcggcctcgcggtaacggcaaaagtgatcagacattagcgcaggaattaataaatgatccgaaagaaacggctgagcatttaatgctagtggatctcgctcgcaatgatatcgggattgtttcacaagcgggtagcgtggaagtagcagaactgatgcagccggttaatttttcgcatgtcatgcaccttgcttctcgagttcaagtctcattagcaaaaaattatgacgcgattgatgtattaaaagctacctttcccgctggcactttaagcggtgcacctaaaattcgagcgatggaaattatcgatgaactcgaacattctcgtcgcggtttatacggtggcgccatcgttgctttagaccgcgacgataatttagatacttgcattattattcgtacgacgatagtcgaaaatggaatagcttctattcgcgcgggcgccggtattgttcatgattcggatccgattgccgaagctaatgaaacgcgtcacaaagcgaaaagcgtcatggccgccatccaactgaccgaaggaggattataa

SEQ ID NO: 3530 - protein, 463 aa, Coxiella burnetii
MLTPTRAFYQLLDLYPTAILLEFSPRNEKPYAFIGFNPLAQIIARGDEITVFLKNTVTKMKGDPFHHLRRLRQQINCIDNHPLTKLTGAAIGYLSYDAIRYVESIPDRHTASEKIADIDFKFYRDGITFDLESNNAIVSHIVEVKDELKHCYEYGLEKLADITNNLFTPARPKLSTNRKTHYSKSTSLDFKPDSNDTDFKKIVNKAKQYIAAGDIFQVVSSRTFKKPYQGKPFDIYRALKKVSPSPYHFYLQNDSLAIAGASPEKMVSVKNGIIDSVPLAGTRPRGNGKSDQTLAQELINDPKETAEHLMLVDLARNDIGIVSQAGSVEVAELMQPVNFSHVMHLASRVQVSLAKNYDAIDVLKATFPAGTLSGAPKIRAMEIIDELEHSRRGLYGGAIVALDRDDNLDTCIIIRTTIVENGIASIRAGAGIVHDSDPIAEANETRHKAKSVMAAIQLTEGGL

SEQ ID NO: 3531 - DNA, 1443 bp, Tropheryma whipplei
  CDS (1)..(1443)
atggagacaattgtggaagaagatcggggtgttttttgggtggattaccccgttgacctctccgaggattttgctgacagttgtttccgatacctctttgaagcccttttttacgattcggagaattgcttttggctggatgatgcacgaccactgcaaaaccgacgacgcagtgcgattggctctggtccgtcggtgagtcttcgatctgggagctgtcttgatccgactgatgtggagtcttttttctcaaagctcttggattgtgacccacagccttggccattaggctttgttgggtggattgattacgaagttggcgcatgtctattgggtgtaaattatccaacacagcaagatgctcctgctacaggtcaaactaatttatcctcgtggatttgctgcaaccgcgcgatatgtattgactacagaatgggattgctgaaaattatcagtttttccaaaaatactgttgatgcaaaagaatgggtaaatagggcttcaactctggttgagaagctcttgatgaaaggttcaatagaccgagaagattatatcccgcaggctaaatcaaggcatttagcaaactcaaaactcatgccaagaaatagttttgcttcagggttgcagtggcttcataccgatcaacaatatttgcaacttattcacagagttctggaaaaaatcatgcgtggagatgtttaccaaatttgtctggctaacagacttacgatcaggaactccggtaacaggtcaccattttctgccttttgggcccttagacagaaaagtccaacacagtactgtgcctatatcaaaatcggaccgcgccactttgttagctcttccccagagctttttctggcattatctgacaatattcttgtcacagaaccgatcaagggaacacgcccaaggggtaggtctccttccgaggattcatatctgatatcggagcttaaaacttctgaaaaagagaaagccgaaaaccttatgattgtcgatctaatgcgcaatgattttagtaaaatctgctcttcggttgaagttgattatatgtatagggtcagaacatataagggtttgcatcagcttgtatcgagagtaagcggtatcttgcgcccaggacgtggattttttgatattttgtgtgcaacatttccagcaggatcagtgaccggagcacctaaaatcgcagccgtcaagtctatatatgatttggaaagggcaagaaggggagtttattcaggtgcattcggttatatatcgggcgatggaaagaatatctgttttgcgatgtctattagatcagcagttttttgcaatggagaagtcagtattggtagtggagggggagtggtgtttgatagcgatccggagtttgaacttgccgagactaaactgaaggtagcggcaatgattgatgcgattttgggtaggtag

SEQ ID NO: 3532 - protein, 480 aa, Tropheryma whipplei
METIVEEDRGVFWVDYPVDLSEDFADSCFRYLFEALFYDSENCFWLDDARPLQNRRRSAIGSGPSVSLRSGSCLDPTDVESFFSKLLDCDPQPWPLGFVGWIDYEVGACLLGVNYPTQQDAPATGQTNLSSWICCNRAICIDYRMGLLKIISFSKNTVDAKEWVNRASTLVEKLLMKGSIDREDYIPQAKSRHLANSKLMPRNSFASGLQWLHTDQQYLQLIHRVLEKIMRGDVYQICLANRLTIRNSGNRSPFSAFWALRQKSPTQYCAYIKIGPRHFVSSSPELFLALSDNILVTEPIKGTRPRGRSPSEDSYLISELKTSEKEKAENLMIVDLMRNDFSKICSSVEVDYMYRVRTYKGLHQLVSRVSGILRPGRGFFDILCATFPAGSVTGAPKIAAVKSIYDLERARRGVYSGAFGYISGDGKNICFAMSIRSAVFCNGEVSIGSGGGVVFDSDPEFELAETKLKVAAMIDAILGR

SEQ ID NO: 3533 - DNA, 1494 bp, Burkholderia multivorans
  CDS (1)..(1494)
atgaccgaactcgaattccaatcgctcgcgaacgaaggctataaccgcatcccgctgatcgccgaagcgctcgccgatctcgaaacgccgctgtcgctctacctgaagctcgcgcagcccgaacgcgccggcgcgaactccttcctgctcgaatcggtggtcggcggcgaacgcttcggccgctactcgttcatcgggctgccggcacgcacgctcgtgcgcacccgcaacggcgtctccgaagtcgtgcgcgacggcgcggtcgtcgagacgcacgacggcgatccgttcgagttcatcgcgtcgttccaggcgcgcttcaaggtcgcgcagcgccccggtctgccgcgcttctgcggcggtctggccggctatttcggctacgacgcggtgcgctacatcgagaagaagctcgcacacaccgcgccgcgcgacgatctcggcctgcccgacatccagctgctgctcaccgaggaagtcgcggtgatcgacaacctcgccggcaagctgtatctgatcatctacgcggatccgggccagcccgaggcgtacgcgaaggcgaagcagcgcctgcgcgagctcaagcagcggctgcgcgcgaccgtgcagccgcccgtcacgtcggcgagcgtgcgcaccgagacgttccgcgaattcaagaaggacgactatctggccgccgtgcgtcaggcgaaggaatacatcgcggccggcgagctgatgcagatccaggtcggacagcgcctgacgaagccctatcgcgacaatccgctgtcgctgtatcgcgcgctgcgctcgctgaatccgtcgccgtacatgtactactacaacttcggcgagttccacgtggtcggcgcgtcgccggaaatcctcgtgcgccaggaaaagcgcggcgacgaccagatcgtcacgatccgcccgctcgccggcacacgcccgcgcggcaacacgcccgagcgcgacgcggaactcgcgaccgagctgctgaacgatccgaaggaaatcgccgagcacgtgatgctgattgacctcgcgcgcaacgacgtcggccgcatcgccgacatcggctcggtgcaggtgaccgacaagatggtgatcgagaagtactcgcacgtgcagcacatcgtcagctcggtcgaaggcaagctcaagcccggcatgacgaacttcgacgtgctgcgcgcgacgttcccggccggcacgctgtccggcgcgccgaaggtgcgcgcgatggagctgatcgacgagctcgagcccgtcaagcgcgggctctacggcggcgccgtcggctatctgtcgttctcgggcgagatggatctcgcgatcgcgatccgcacgggcctgatccacaacggcaacctgtatgtgcaagcggcggccggcgtcgtcgcggattcggtgcccgaatccgaatggcaagagaccgagaacaaggcgcgcgcggtgctgcgcgcggccgaacaggtccaggacggcctcgatagcgacttctga

SEQ ID NO: 3534 - protein, 497 aa, Burkholderia multivorans
MTELEFQSLANEGYNRIPLIAEALADLETPLSLYLKLAQPERAGANSFLLESVVGGERFGRYSFIGLPARTLVRTRNGVSEVVRDGAVVETHDGDPFEFIASFQARFKVAQRPGLPRFCGGLAGYFGYDAVRYIEKKLAHTAPRDDLGLPDIQLLLTEEVAVIDNLAGKLYLIIYADPGQPEAYAKAKQRLRELKQRLRATVQPPVTSASVRTETFREFKKDDYLAAVRQAKEYIAAGELMQIQVGQRLTKPYRDNPLSLYRALRSLNPSPYMYYYNFGEFHVVGASPEILVRQEKRGDDQIVTIRPLAGTRPRGNTPERDAELATELLNDPKEIAEHVMLIDLARNDVGRIADIGSVQVTDKMVIEKYSHVQHIVSSVEGKLKPGMTNFDVLRATFPAGTLSGAPKVRAMELIDELEPVKRGLYGGAVGYLSFSGEMDLAIAIRTGLIHNGNLYVQAAAGVVADSVPESEWQETENKARAVLRAAEQVQDGLDSDF

SEQ ID NO: 3535 - DNA, 1851 bp, Oryza sativa
  CDS (1)..(1851)
atggagtccatcgccgccgccacgttcacgccctcgcgcctcgccgcccgccccgccactccggcggcggcggcggccccggttagagcgagggcggcggtagcggcaggagggaggaggaggacgagtaggcgcggcggcgtgaggtgctccgcggggaagccagaggcaagcgcggtgatcaacgggagcgcggcggcgcgggcggcggaggaggacaggaggcgcttcttcgaggcggcggagcgtgggagcgggaagggcaacctggtgcccatgtgggagtgcatcgtctccgaccacctcacccccgtgctcgcctaccgctgcctcgtccccgaggacaacatggagacgcccagcttcctcttcgagtccgtcgagcaggggcccgagggcaccaccaacgtcggtcgctatagcatggtgggagcccacccagtgatggaggtcgtggcaaaggagcacaaggtcacaatcatggaccacgagaagggcaaggtgacggagcaggtcgtggatgatcctatgcagatccccaggagcatgatggaaggatggcacccgcagcagatcgatcagctccccgattccttcaccggtggatgggtcgggttcttttcctatgatacagtccgttatgttgaaaagaagaagctgcccttctccggtgctccccaggacgataggaaccttcctgatgttcaccttgggctttatgatgatgttctcgtcttcgacaatgtcgagaagaaagtatatgtcatccattgggtaaatcttgatcggcatgcaaccaccgaggatgcattccaagatggcaagtcccggctgaacctgttgctatctaaagtgcacaattcaaatgtcttctatatcttatttcattttcactccagacccaagctttctccaggatttgtaaagttacacactcggcagtttggtacacctttgaacaaatcaaccatgacaagtgatgagtacaagaatgctgttatgcaggctaaggagcatattatggctggtgatattttccagattgttttaagccagaggtttgagaggcgaacatacgccaatccatttgaagtctatcgagctttacgaattgtgaacccaagtccatacatggcatatgtacaggcaagaggctgtgtcctggtagcatctagtccagaaattcttactcgtgtgaggaagggtaaaattattaaccgtccacttgctgggactgttcgaaggggcaagacagagaaggaagatgaaatgcaagagcaacagctactaagtgatgaaaaacagtgtgctgaacatattatgcttgtagatttgggaaggaatgatgttggaaaggtctccaaacctggatctgtgaaggtggagaaattaatgaacattgaacgctactcccatgtcatgcacatcagttccacggtgagtggagagttggatgatcatctccaaagttgggatgccctgcgagccgcgttgcctgttggaacagttagtggagcaccaaaggtgaaagccatggagctgatagacgagctagaggtcacaagacgaggaccatacagtggcggccttggagggatatcatttgacggagacatgcttatcgctcttgcactccgcaccattgtgttctcaacagcgccaagccacaacacgatgtactcatacaaagacaccgagaggcgccgggagtgggtcgctcaccttcaggctggtgctggcattgtcgctgatagcagcccagacgacgagcaacgtgaatgcgagaacaaggcagccgctctggctcgagccatcgatcttgctgaatcagctttcgtagacaaggaatag

SEQ ID NO: 3536 - protein, 616 aa, Oryza sativa
MESIAAATFTPSRLAARPATPAAAAAPVRARAAVAAGGRRRTSRRGGVRCSAGKPEASAVINGSAAARAAEEDRRRFFEAAERGSGKGNLVPMWECIVSDHLTPVLAYRCLVPEDNMETPSFLFESVEQGPEGTTNVGRYSMVGAHPVMEVVAKEHKVTIMDHEKGKVTEQVVDDPMQIPRSMMEGWHPQQIDQLPDSFTGGWVGFFSYDTVRYVEKKKLPFSGAPQDDRNLPDVHLGLYDDVLVFDNVEKKVYVIHWVNLDRHATTEDAFQDGKSRLNLLLSKVHNSNVFYILFHFHSRPKLSPGFVKLHTRQFGTPLNKSTMTSDEYKNAVMQAKEHIMAGDIFQIVLSQRFERRTYANPFEVYRALRIVNPSPYMAYVQARGCVLVASSPEILTRVRKGKIINRPLAGTVRRGKTEKEDEMQEQQLLSDEKQCAEHIMLVDLGRNDVGKVSKPGSVKVEKLMNIERYSHVMHISSTVSGELDDHLQSWDALRAALPVGTVSGAPKVKAMELIDELEVTRRGPYSGGLGGISFDGDMLIALALRTIVFSTAPSHNTMYSYKDTERRREWVAHLQAGAGIVADSSPDDEQRECENKAAALARAIDLAESAFVDKE

SEQ ID NO: 3537 - DNA, 2241 bp, Neurospora crassa
  CDS (493)..(2241)
atggctcccctaccactcccacgcatacccgcctcaacggccgagaaactccaagactttgtcttcaaacggatcgtacacccagctctccaaggagtcgaagccatccaccctacaagaaccttcagccccatcacccggcggcaagatgccccgcccaccgccacggtaaccttcgtccaagtcgacaacgacaacgacaacgaccctgatgacgcgcaaaccctcagcggcggcgccattgccggcatcgtcatcggctccatcgtcggcttgcttcttctcatctggattatccgcagctgcttcaacctgggcgctccaccgacacacggcaagcgcaacagcaaggcttgcgtcacttggtgcatgatgtacacctttgatgccggcttatcggcttatcggccgtcaaggttgcgttcagccaggaacaaaccccgcccttccggcaccttttggcaggaagccccactccttcagttgttcaggatggctgccctcgacatcaggccgtccctggaggacgcgcgcaagctcttcgaccagacatgccaagcatcagcgacctcgacagcatccccaaggcccacccttctccccctctgcatctccttgcctgccgacctcttgacgccctcggccatctacctcaagctctccgcaggagcgacagctgagtactcgttcctcctcgagagcgccactggcagcaccgagactgtcggccgctacagcttcattggcgccaacccccgaaaggtcctcgagaccggccccggctaccaagatgtcggcgatcccatgaaggcccttgagcaggagctcagccaggacaaggtcctcagcatcccctccctccgactccccaagctgacgggcggcgctgtcggctacatctcgtacgactgcatcaagtacttcgagcccaggacggtcaagggtcgcgaactcaaggacaacctacacatccccgaggcccttttcatgctctacgataccatggttgcgttcgaccacttctcctccgccttcaccgtcgtcacccatgtccgacttcccgaggacccctccggcgacttcgaggcggcctacaacgcggcttgcgacagcattcgctcgacactcgaagtgatcaaccagccagagacgccgctcccgcccaaggactctagcgctcccgtcgccgatcagacattcgcttcgaacgttgggcgccacggttacgagacctttgtgacggagctcaagaagaacattgtcaagggtgacatcatccaggccgtcccatcccagcgcttctctcgcagcaccagcctgcaccccttcaacatttaccggaccctgcgcacgctcaacccctcgccgtacctcttcttcctctcgtgctctgacttccacattgttggcgcctcgcccgaatgcctgatgaagaccgacggctatgccgaccttcccacggatacccgttttggctatagtgctgccgaggcccgctctcgtcccaggatcgtcaaccacgccattgccggtaccatcaagcgtggcctcaactcggaggaggacgatgagcttgcggccgtgctgctggcctcaaccaaggaccgcgccgagcacgtcatgttggtcgatttggcccgcaacgatgtcaaccgtgtctgccacccgtctaccgtcaaggtcgaccgcctcatgcgcatcgaccgtttctcacacgtccaacatatcacctcggaggtctccggtctgctgcgccccgagtgcacccgctgggacgctttgcgctccatcttccccgccggtaccgtgtcgggcgcgcccaagattcgtgccatggagctgatttacgacttggagaaggagaagcgcggcatctacgctggcgctgccggttggttcgcctatgatgtcattcgcgtcgaaggtggtgagggtgatgcccctgttaccactttcttgagcgaaggacagatggatacctgcattgctatccgcaccatgttggtcaagaataaggttgcctacctacaggcgggcggtggtattgtatttgacagtgagaagacggaggagtggatggagaccatgaacaagttggccgccaacttgcgctgcatcgaactggctgagaagtactacggcgaaagtacgggatccaagtcggtgcaggaaatcattgaggaggagaggaagaagggcgacgagcagtacaagctgcagacgatgagcgctggggcgtaa

SEQ ID NO: 3538 - protein, 582 aa, Neurospora crassa
MAALDIRPSLEDARKLFDQTCQASATSTASPRPTLLPLCISLPADLLTPSAIYLKLSAGATAEYSFLLESATGSTETVGRYSFIGANPRKVLETGPGYQDVGDPMKALEQELSQDKVLSIPSLRLPKLTGGAVGYISYDCIKYFEPRTVKGRELKDNLHIPEALFMLYDTMVAFDHFSSAFTVVTHVRLPEDPSGDFEAAYNAACDSIRSTLEVINQPETPLPPKDSSAPVADQTFASNVGRHGYETFVTELKKNIVKGDIIQAVPSQRFSRSTSLHPFNIYRTLRTLNPSPYLFFLSCSDFHIVGASPECLMKTDGYADLPTDTRFGYSAAEARSRPRIVNHAIAGTIKRGLNSEEDDELAAVLLASTKDRAEHVMLVDLARNDVNRVCHPSTVKVDRLMRIDRFSHVQHITSEVSGLLRPECTRWDALRSIFPAGTVSGAPKIRAMELIYDLEKEKRGIYAGAAGWFAYDVIRVEGGEGDAPVTTFLSEGQMDTCIAIRTMLVKNKVAYLQAGGGIVFDSEKTEEWMETMNKLAANLRCIELAEKYYGESTGSKSVQEIIEEERKKGDEQYKLQTMSAGA

SEQ ID NO: 3539 - DNA, 1359 bp, Xylella fastidiosa
  CDS (1)..(1359)
atgacactcattcgatttctgcgtacggatccggatttattgtccatgcaccggttggcaccggagcgttatccggcgctttttgaatctactgcttctggtactcagcagagtcgttgggatgtgttgttgcatacagatggtcgtttcttccgtttggattccgatggtgtaacacgcgatgctcagggcagggcgctgtccggagactttttgcaggtattggatgcagtgtggagcactgagtacgtgctgcgtgatacgtgtgaggatgctcctccattccgtggcggttgggctttacttcttgactatgaactggctgggcaggttgagccagtgttgaaattgccagtgcgtactgatggtttgcctatggcgttagcattgcgttgtccggcagcggtattacgtgaccgccacagtggtgtttttttgattgtcgctgagctgggaaatgagcatttactggacgtgattgaggcggatttagctgctgttgccttgttgccgccattgccggtttggcgatctccagtggccgtgactgaggatgagccgtcgcagtttattgccaatgcagagcgtgtgctggattaccttcgtgagggagacgtgttccaggcaaatatctcacgcctttgggaagctcgctttgccactgcacttgatccagcagcgttgtacatgcgtttgcgtgtagccaatcctgcgcctttctcgggattgtttgtggctcatggccgagctgtggtgagctcctcaccagagcggttgatttcggtgcaaggagggcgcattcagacgcgtccgattgctggtacccggccacgttttgtcggtgaagatgacgcagcacgcatccgcgaactggtgaatcaccctaaggagcgtgctgagcatgtgatgttgattgacttagagcgtaacgatttagggagagtgtgtgtgcctgggaccgttgaggtcgatgagttgatgacggtggaaagctatgcgcatgtccatcatatcgtcagtaatgtgcgtggctggttgcctacgggcaggaccccaggggagatcattcgcgccgtgtttccgggggggacaatcactggttgtccgaaggtgcgttgcatgcagatcattgcccagctcgagcaggtggcacgcggtgcctacactggtgcctttggatggctcaattgtgatggtgatttggacctgaacattttaatccgcaccgctgagattgacggtgtgactgtacgtttccgtaacggtgccggcatcgtgatcaattcactgcctgagcgtgagctggatgagacccgtgccaaggcgactggcgtactgcgcgccctgcatgtcatctga

SEQ ID NO: 3540 - protein, 452 aa, Xylella fastidiosa
MTLIRFLRTDPDLLSMHRLAPERYPALFESTASGTQQSRWDVLLHTDGRFFRLDSDGVTRDAQGRALSGDFLQVLDAVWSTEYVLRDTCEDAPPFRGGWALLLDYELAGQVEPVLKLPVRTDGLPMALALRCPAAVLRDRHSGVFLIVAELGNEHLLDVIEADLAAVALLPPLPVWRSPVAVTEDEPSQFIANAERVLDYLREGDVFQANISRLWEARFATALDPAALYMRLRVANPAPFSGLFVAHGRAVVSSSPERLISVQGGRIQTRPIAGTRPRFVGEDDAARIRELVNHPKERAEHVMLIDLERNDLGRVCVPGTVEVDELMTVESYAHVHHIVSNVRGWLPTGRTPGEIIRAVFPGGTITGCPKVRCMQIIAQLEQVARGAYTGAFGWLNCDGDLDLNILIRTAEIDGVTVRFRNGAGIVINSLPERELDETRAKATGVLRALHVI

SEQ ID NO: 3541 - DNA, 1476 bp, Xylella fastidiosa
  CDS (1)..(1476)
atgatcactgcaatgcagtttcagcgtcaagttgccgaagggtgtacccgcattccagtggtgcgtgaagtccagtctgatttggatactccgctttcgatctatttaaagtttgccgatgctccatatacctatttgtttgagtcggtggaaggtggggagcattttgcgaggtattcgatcattgggttgccggcacgccgtgtctatacctttcatgggcataccctggtggtgagtgagttcggtaaggtgttggaaacgcgtcaagtcgccgatccgcttgccgaagttgagctgttgcgtgcgcagtatgtagtgccgcaattagaagggttgccaggttttacaggcggcttagtggggtggttcggctttgaatgtatccagtacatcgaacctcgcttcatgggaggtaaaaaacgtgatgaacttggtacgccagatattctgctgatgctttcggaagagtttgcggtgtttgacagcctcaagggtcgattatatttgatcgttcacgcggatcctgctcaaccgcattcttacgttcgtgcaatgaaacgtttggatgcgttgatccaccgtctgcggcaaggtgggatggattatccgcattcacatatttcggaagtgattaacgaggaagattttcactcttctttgacgcgtgagcagtatcacgctgtggtgcgtaaggcgcaggagtatgtgcgttcgggtgatatttttcaggttgtaccaagtcagcgcctgtgtacgcagtttcatgcacgtccgattgatgtatatcgggcgttgcgcacgctgaatccgtcgccttatatgtatttcattgatattggtgctactcaggtggttggttcatcaccggagatattggcgcgattgcagggggatgtggtcacggtgcgtcctattgccggcacacgcccgcgaggtgcgactccggagcatgacaaacggttggaaatggagttgttagccgatccaaaagagcgtgctgagcacgtgatgctgattgatttgggtcgcaatgatatcggacgtgttgtcgaggccgggagtgtacaagtcaaggagtcgtttgtaatcgagcgttatagtcatgtcatgcatattgtcagtgaggtcaccggtatcttgaagccgggtttgaactacgttgatgtgttacgtgcaacgttccctgcgggtactgtgtccggagcgccaaagattcgtgcattggagattatccgtgagttggaaccagtgtgtcgcaacgtatattccggtgcagtgggttacattggctggcatggagatgctgatactgcaatcgcgattcgtactgcggtgattcaaaacggttgcttgtacgtgcaggctggcggtggtgtggtgtatgactcggatccagatttggagtggcaggaaaccatgaacaaggcgcgtgcattatttagggctgtggcgcaggcggccagagggttgtga

SEQ ID NO: 3542 - protein, 491 aa, Xylella fastidiosa
MITAMQFQRQVAEGCTRIPVVREVQSDLDTPLSIYLKFADAPYTYLFESVEGGEHFARYSIIGLPARRVYTFHGHTLVVSEFGKVLETRQVADPLAEVELLRAQYVVPQLEGLPGFTGGLVGWFGFECIQYIEPRFMGGKKRDELGTPDILLMLSEEFAVFDSLKGRLYLIVHADPAQPHSYVRAMKRLDALIHRLRQGGMDYPHSHISEVINEEDFHSSLTREQYHAVVRKAQEYVRSGDIFQVVPSQRLCTQFHARPIDVYRALRTLNPSPYMYFIDIGATQVVGSSPEILARLQGDVVTVRPIAGTRPRGATPEHDKRLEMELLADPKERAEHVMLIDLGRNDIGRVVEAGSVQVKESFVIERYSHVMHIVSEVTGILKPGLNYVDVLRATFPAGTVSGAPKIRALEIIRELEPVCRNVYSGAVGYIGWHGDADTAIAIRTAVIQNGCLYVQAGGGVVYDSDPDLEWQETMNKARALFRAVAQAARGL

SEQ ID NO: 3543 - DNA, 1365 bp, Vibrio parahaemolyticus
  CDS (1)..(1365)
atggacaatcaattcattgattttaaagcgctggaatacgcaccagagtttgctcttcatctattttctcgcattcaacaccagccttggacgatgttgctgcgttctgcatcaaaaacgcatatcgatagtcgcttcgatgtattggttgccaacccaattgcaacgttagaaaccattgccgacagcacacaagttgaaacgccatcgaatgcctattcaattcaagatgacccattcacgctacttcatcagttgcaagaacagtggcttcctcacgttgagttaaataaagaattggatttgccttttgtcggcggagcgctcggttacttcagttacgatttaggtcgacgcgtagaaacaatgccagaacaggccgaaaaggatctcaacacgcctgatatggcggtaggtctgtatgaatgggccgtcgttgttgaccacaagcttaaaaaagcatgcttagtcggtcagaatatagagcaagcttggcaatggttagacaaacaagaagcggagcaaagtgtagacttcgctctgtccggcgattggcagtcaaacatgacgaaagagagctacgccactcgctttgacaaggtgcaagaatacttgttgagcggtgactgctatcagatcaatttggcgcaacgctttaacgcaccatatctaggcagcgagtggcaagcgtatctgaaattggagtccgccaaccaagcgccattctcagcgtttatccgtatgcctgagtcttcgattttgagtatctctccagagcgctttttagaactcaaagatcgcgtcattgaaacgaaaccaatcaaaggtactcgaccacgcagcgaagatccaaagcaagataacgctaatgcccatgacttgcagacagcggaaaaagatcaggcagaaaacctgatgattgtcgatttgctgcgtaatgacattggtcgagttgcatcaccgggtagcgttcacgtgccaaagctgtttgatattgaaagcttccctgccgtgcatcatttggtgagcaccattcgtgcgaatttggacgagcaatattctcctgcagatttgctacgagcgtgcttcccgggcggttcaattacgggcgcacctaaagttcgcgcaatgcagatcattgaagagttggagccacatcgacgcagcgcgtattgcggcagtattggctacatttctcgccatggtcgtatggataccagcatcaccatccgtactctcgtcgcggaaaatcacaaactgtacgcttgggctggcggcggcgtcgttgcagatagcgattgtgcctctgaatatcaagaaacgttggataagctttcaaagattttgccagcgctgcaatcgtag

SEQ ID NO: 3544 - protein, 454 aa, Vibrio parahaemolyticus
MDNQFIDFKALEYAPEFALHLFSRIQHQPWTMLLRSASKTHIDSRFDVLVANPIATLETIADSTQVETPSNAYSIQDDPFTLLHQLQEQWLPHVELNKELDLPFVGGALGYFSYDLGRRVETMPEQAEKDLNTPDMAVGLYEWAVVVDHKLKKACLVGQNIEQAWQWLDKQEAEQSVDFALSGDWQSNMTKESYATRFDKVQEYLLSGDCYQINLAQRFNAPYLGSEWQAYLKLESANQAPFSAFIRMPESSILSISPERFLELKDRVIETKPIKGTRPRSEDPKQDNANAHDLQTAEKDQAENLMIVDLLRNDIGRVASPGSVHVPKLFDIESFPAVHHLVSTIRANLDEQYSPADLLRACFPGGSITGAPKVRAMQIIEELEPHRRSAYCGSIGYISRHGRMDTSITIRTLVAENHKLYAWAGGGVVADSDCASEYQETLDKLSKILPALQS

SEQ ID NO: 3545 - DNA, 1344 bp, Pseudomonas syringae
  CDS (1)..(1344)
atgcccacctgttcgatacatcccctgccctatagcgccgacccggccgtgtttttctcgcggatctgtcaggcgccgggggccgtgctgctcgacagcggcagaccggttgccgagcgcggccgctacgacctgctcagcgcctggccacggcaggaactgacgattgcggatggcgagagcggcacggcttacctgcaacgattgcgcgacagcctggcgtcgctgggaacggcgaccttgccggcgggctgcgagctgccctttgccggcgggctgatcggctacctgagttacacgttcgggcgacgcctcgaaccgctgcccgatcaggccatcgacgacctgcaattgcccgaagcgcggctggggctctacgcctgggcgctgatcagtgatcatcaggcgcagaccagccaactgatgtttcatccagacttggccgacaccgagcgcgagcggctggttgacctgttcactggcagcatcagcgaggcgccatcgcacttcaggctcagccaaccgtttcaggccagtatcagcgccgacgactaccaggacgccttcgagcgaattcaggcttatattcaggcaggcgactgttatcaggtcaatttcgcacaacgctttcaggcgcagtgcactggcgatccgtgggcagcttattgcgcgcttcgagcagcctgcccgacgccgttttccggctacctgggcctgtcgggcgccgatgcggttttgagcctttcgccggagcgtttcgtcaagatcagcgcgaggcaggtggaaacccgcccgatcaaaggcacgcgcccgcgcagccaggacgctgtgcaagacgccgctttcgcccaagagctgctgaacagcgagaaggatcgcgccgaaaacctgatgattgtcgacctgctgcgcaacgacctggggcgcagctgcacaacaggctcggtgaaagtgcccgagttgttcagcctggaaagctaccccaacgtgcaccatctggtgagcagcgtgaccggcgagctggcggccggcaacgatgctctggacctgatcgccggcagcttccccggcggctccatcacgggtgcgccgaagatccgcgccatgcagatcatcgacgaactggaaccgactcgccgcagcctgtactgcgggtcgctgctgtatgtggatgtacgcggcgagatggacagctccatcgccatccgcagcctgctggtcaaggacgggcgcatttcctgttggggcggcggcggcattgtggcggactctcactgcgaggccgaatatcaggaaaccttcaccaaggtccgcgtgctgctagaaacgcttgaggcactttga

SEQ ID NO: 3546 - protein, 447 aa, Pseudomonas syringae
MPTCSIHPLPYSADPAVFFSRICQAPGAVLLDSGRPVAERGRYDLLSAWPRQELTIADGESGTAYLQRLRDSLASLGTATLPAGCELPFAGGLIGYLSYTFGRRLEPLPDQAIDDLQLPEARLGLYAWALISDHQAQTSQLMFHPDLADTERERLVDLFTGSISEAPSHFRLSQPFQASISADDYQDAFERIQAYIQAGDCYQVNFAQRFQAQCTGDPWAAYCALRAACPTPFSGYLGLSGADAVLSLSPERFVKISARQVETRPIKGTRPRSQDAVQDAAFAQELLNSEKDRAENLMIVDLLRNDLGRSCTTGSVKVPELFSLESYPNVHHLVSSVTGELAAGNDALDLIAGSFPGGSITGAPKIRAMQIIDELEPTRRSLYCGSLLYVDVRGEMDSSIAIRSLLVKDGRISCWGGGGIVADSHCEAEYQETFTKVRVLLETLEAL

SEQ ID NO: 3547 - DNA, 1482 bp, Pseudomonas syringae
  CDS (1)..(1482)
atgaaccgtgaagaattcctgcgtttggctgctgatggctacaaccgcatcccgcttgcccgcgaaaccctggctgacttcgacacgccgctgtcgatctacctcaagcttgccgatcagccgaactcctacttgctggaatcggtgcagggcggtgagaaatggggtcgttactcgatcatcggcctgccttgccgcactgtgatgcgcgtacatggccatcacgtcagcgtgacccacgatggcgtcgagatcgaaagcctggacgttgaagacccgctggacttcgtcgagaccttcaaagcgcgctacaacgtgccgaccatcgccggtctgccgcgtttcaatggcgggttggtcggttatttcggttatgactgcgtgcgttacgtcgaaaagcgtcttgccaactgcccgaaccctgacccgctgggcgtaccggatatcctgttgatggtgtccgatgccgtggtggtattcgacaatttggcgggcaagatgcacgccatcgtattggtcgacccggcgcagcaggacgcttacgacagtggcgctgcactgcttgatgagctgatgcacaagctgcgtcagccgatcacaccgcgtcgtggcctggatctggaccggcctccggctgccgacccggtgtttcgctcaagcttcacgcagaatgattacgaaaccgcagtcgacacgatcaagcagtacatcctggcgggcgacgtgatgcaggtcgtgccatcgcaacgcatgtccatcgattttgctgcagcgcccattgacctgtaccgtgcgctgcgctgcttcaacccgacgccgtacatgtatttctttaacttcggcgacttccacgttgtcggcagttcgccggaagtgctggtgcgcgtcgaggacaacctgatcacggttcggccaatcgccggtacgcgtccgcgcggggctactgaagaagcggatcgtgcgctggaagaggatctgctgtccgatcacaaggagatcgccgagcacttgatgctgatcgatctgggtcgtaatgacgtcgggcgggtgtccgggatcggtacggtcaaattgaccgagaagatggttatcgagcgttactccaacgtgatgcacattgtttccaacgtcactggcgagctgaaaagcgggctgacggcgatggatgcactgcgggcgattctgccggccggcaccttgtccggtgcgccgaaaatccgcgccatggaaatcatcgacgagctggagccggtcaagcgtggcgtctacggcggggcggtggggtacatggcgtggaacggcaacatggacaccgccatcgcaattcgtacggcggtgatcaagaacggtgagctgcacgtgcaggctggcggcggtatcgtcgccgactcggtgccagcactggagtgggaagaaaccctcaacaaacgccgcgccatgttccgtgccgtggctttggcttcgcagactgccgagggttga

SEQ ID NO: 3548 - protein, 493 aa, Pseudomonas syringae
MNREEFLRLAADGYNRIPLARETLADFDTPLSIYLKLADQPNSYLLESVQGGEKWGRYSIIGLPCRTVMRVHGHHVSVTHDGVEIESLDVEDPLDFVETFKARYNVPTIAGLPRFNGGLVGYFGYDCVRYVEKRLANCPNPDPLGVPDILLMVSDAVVVFDNLAGKMHAIVLVDPAQQDAYDSGAALLDELMHKLRQPITPRRGLDLDRPPAADPVFRSSFTQNDYETAVDTIKQYILAGDVMQVVPSQRMSIDFAAAPIDLYRALRCFNPTPYMYFFNFGDFHVVGSSPEVLVRVEDNLITVRPIAGTRPRGATEEADRALEEDLLSDHKEIAEHLMLIDLGRNDVGRVSGIGTVKLTEKMVIERYSNVMHIVSNVTGELKSGLTAMDALRAILPAGTLSGAPKIRAMEIIDELEPVKRGVYGGAVGYMAWNGNMDTAIAIRTAVIKNGELHVQAGGGIVADSVPALEWEETLNKRRAMFRAVALASQTAEG

SEQ ID NO: 3549 - DNA, 1341 bp, Pseudomonas putida
  CDS (1)..(1341)
atgccgacctgcacgctacaccccctgccctaccagcccgaccctgccgcctatttcgcccacctgcgccaggcccccggtgcgatcctgctcgacagcgctcgccccggcgccgaacgcgggcgtttcgacctgctcagcgcctggccgctgcaacaactgcaggcgcagcccgatgaagatggccgcgtcttcctccagcgcctgcgcgctggcctggcacaactgggccacgccgacttgcccaacggtgtagagctgcccttcgccgggggcctgatcggctacctgagctacgacttcggccgccgcctggaacacctgccaagcctggccgtggacgacctgggcctgccagacgcacaactgggcctgtatgcctgggcactggtcagcgatcacttgctcggcaccagccagctggtgttccaccctagcctggccggcgacgagcgcgaacgcctgatcagcctgttccaggacaccagcgccaccaccggcgacttccggctgctcgcgccgatggccggtgacctggagccggagcaatacaaaaccgctttcgaccaggtacaacgctacatccaggccggtgactgctaccagatcaacctcacccaacgctttcgcgcaccctgccaaggcgatccatggcgggcctaccaggccctgcgccaggcctgcccgacccccttctccggctaccagcaactggccgacggcagtaccctgctgagcttttcgcccgagcgcttcatccgcgtcagccagggccaggtggaaacccggccgatcaagggcacccgcccacgcgccagtgacccggcgcaagaccagcgtaatgcccaggagctgctgcacagcccgaaggaccgctcggaaaacctgatgatcgtcgacctgctgcgcaacgacctggggcgcacgtgcgagattggctcagtgaaggtaccggaactgttcagcctggagagttaccccaacgtgcaccatctggtcagcagcatcaccggccagctggccagcgacaaggatgcgctggacctgatcggcgacagcttccctggcggctcgatcaccggcgcaccgaagatccgcgccatgcagatcatcgacgaactggagcccgcgcgccgcgcgctgtactgcggctcgctgctgtatgtggatgtgcgcggcgaaatggacagttcgatcgccattcgcagcttgctgatcaaagatggccaggtcagttgctggggcggcggcgcggtggtagccgactcgcagtggcaggccgagtatgaagagtcgatcgccaaagtgcgggtgctgatgcagaccctgcagggcttgtag

SEQ ID NO: 3550 - protein, 446 aa, Pseudomonas putida
MPTCTLHPLPYQPDPAAYFAHLRQAPGAILLDSARPGAERGRFDLLSAWPLQQLQAQPDEDGRVFLQRLRAGLAQLGHADLPNGVELPFAGGLIGYLSYDFGRRLEHLPSLAVDDLGLPDAQLGLYAWALVSDHLLGTSQLVFHPSLAGDERERLISLFQDTSATTGDFRLLAPMAGDLEPEQYKTAFDQVQRYIQAGDCYQINLTQRFRAPCQGDPWRAYQALRQACPTPFSGYQQLADGSTLLSFSPERFIRVSQGQVETRPIKGTRPRASDPAQDQRNAQELLHSPKDRSENLMIVDLLRNDLGRTCEIGSVKVPELFSLESYPNVHHLVSSITGQLASDKDALDLIGDSFPGGSITGAPKIRAMQIIDELEPARRALYCGSLLYVDVRGEMDSSIAIRSLLIKDGQVSCWGGGAVVADSQWQAEYEESIAKVRVLMQTLQGL

SEQ ID NO: 3551 - DNA, 1482 bp, Pseudomonas putida
  CDS (1)..(1482)
atgaaccgcgaagaattcctgcgcctggccgctgccggctacaaccgtattcccttggcctgtgaaaccttggccgacttcgacacgccgctgtcgatctacctgaaactggctgaccagcccaactcgtacctgctcgaatcggtgcagggcggggagaagtggggccgttactcgatgatcggcttgccatcgcgcaccgtgatgcgtgtgcatggctaccgtgtcagcatcctgcacgatggcgtcgaggtggaaagctgtgaggtcgaagacccgctggcattcgttgaaaccttcaaggaccgctacaaagttgccgatatcccaggcctgccgcgtttcaatggcggcctggtcggctactttggctacgactgcgtgcgctatgtagaaaagcgcctgggggccagccccaacccagacccgctgggcgtaccggatatcctgctgatggtgtccgacgcggtggtggtgttcgacaacctggcgggcaagatgcacgccatcgtgttggtcgacccagctgaagatcaggccttcgaacagggccaggcacgtctgcaaggcttgctggaaaccttgcgccagccaatcaccccgcgccgcggcctggacctgagcggcccgcaggcggccgagccggcgttccgctccagctacacccgcgaggattacgaaaacgccgtcggtcgtatcaaggaatacatcctggccggggactgtatgcaggtggtgccgtcgcagcgcatgtcgatcgatttcaaggctgcgcctatcgacctgtaccgcgcgctacgctgcttcaacccgacgccatatatgtacttcttcaacttcggtgacttccatgtggtcggcagctcgcccgaagtgttggtacgtgtcgaggacaacctggtcaccgtacgcccgattgccggtacccgcccgcgtggtgcgaccgaagaggccgatcgtgcgctggaagatgacctgctgtcggacgacaaggaaattgccgagcacctgatgctgatcgatctgggccgcaacgatgtcggccgtgtgtcttcgaccggcagtgtgcgcctgaccgagaagatggtgatcgagcgttactccaacgtgatgcacattgtttccaacgttaccggccagctgcgtgaaggcctgacggcgatggatgcactgcgggcgattctgccggctggcaccttgtcgggtgcgcccaagatccgtgcgatggagatcatcgacgagctggaaccggtcaagcgtggggtttacggcggtgccgtcggctattttgcctggaacggcaacatggataccgcaattgccattcgtaccgcagtgatcaaggacggcgagctgcatgtgcaggccggtggcggcatcgttgccgactcggtgccggcgctggaatgggaagaaaccatcaacaagcgccgggcgatgttccgtgcggtggcgttggccgagcagacttccgccagataa

SEQ ID NO: 3552 - protein, 493 aa, Pseudomonas putida
MNREEFLRLAAAGYNRIPLACETLADFDTPLSIYLKLADQPNSYLLESVQGGEKWGRYSMIGLPSRTVMRVHGYRVSILHDGVEVESCEVEDPLAFVETFKDRYKVADIPGLPRFNGGLVGYFGYDCVRYVEKRLGASPNPDPLGVPDILLMVSDAVVVFDNLAGKMHAIVLVDPAEDQAFEQGQARLQGLLETLRQPITPRRGLDLSGPQAAEPAFRSSYTREDYENAVGRIKEYILAGDCMQVVPSQRMSIDFKAAPIDLYRALRCFNPTPYMYFFNFGDFHVVGSSPEVLVRVEDNLVTVRPIAGTRPRGATEEADRALEDDLLSDDKEIAEHLMLIDLGRNDVGRVSSTGSVRLTEKMVIERYSNVMHIVSNVTGQLREGLTAMDALRAILPAGTLSGAPKIRAMEIIDELEPVKRGVYGGAVGYFAWNGNMDTAIAIRTAVIKDGELHVQAGGGIVADSVPALEWEETINKRRAMFRAVALAEQTSAR

SEQ ID NO: 3553 - DNA, 1437 bp, Lactobacillus plantarum
  CDS (1)..(1437)
atgaatccaacattaccaaccttgattccttatcaggatcattatccctacgtaccagtgatggtcaaacgaccactcgccacatttgaccccattgcggttgctaaaattgtccaccagatggggaacggtttcgcgctgacgattgatcggcaccaacgatatagctattttagttttaaaccacagcgaagtctcacgggtcggcaactagccaagcacaaacgaccagctaatgagacactccaagccattctaaaccaatatcgaacaccacgaattcaaggattaccaccatttacggggggcttgatagggtacttcggctatgagtatattcaacaatttgtactcaagttgcatttgaaatcaccagcaaccgcagatctcgatgacttaggtttattcttagttacgagtgtgctcgtctatgatcatcgacatcatgagcttgggttgacgcagctgatttcaactgcggatttagcggcaacttacgccgtgactcaaacggctctaacgcaacagttagccgccattattgaacaattacagcaaccaatagctctgccaccatttgacttacagcaaccattacacatgcaagcggatcaagcgacctatgcgcgtcaggttgaccgaattcgccaacacatctacgctggtgatattttccaaatgatatatgctaatccatgtttggggaccatgagcgggtcattgctggcagtttatcagcaacttcaaaaaacagcggccccgtatacctgttattttaaacaggctaatttcgaaatgacggtggcctcaccagaaacgttagtgacgaaggatggggaacaaatcgcgacgtatccattggccgggacgagacgccgtggtcgaacacctgccgaggatcagcagttggctcatgaattacaaaccagccctaaagagattgccgagcacaatatgttagttgatttgggacgtaacgatttaggacaagttgcaaagtttaaaagtgtccgagtgactaatttacggcgattaattcgttattcgcaagtcatgcacttagggtctcgggtggccgcagaagtggcgccgactactacagcactccaagtgcttgccgctacttttccagctgggacgttagctggcgcgcctaagattgaagcaatgaccctgattaatcattatgagcaggtgccgcggggtgcttatggtggttgctttggttacttggattgtaacggtaatttagacatggcgattggcatccggctggcctaccgaatgaatgaacagttggtgattccagcgggtgcgggcattgttgctgacagtatcggcgctcaagaatttaaggagtgccagaataaacaacgagtgatcgttaatgcagtacaagacgcgaaaggacgagttaaagatggaattattaattga

SEQ ID NO: 3554 - protein, 478 aa, Lactobacillus plantarum
MNPTLPTLIPYQDHYPYVPVMVKRPLATFDPIAVAKIVHQMGNGFALTIDRHQRYSYFSFKPQRSLTGRQLAKHKRPANETLQAILNQYRTPRIQGLPPFTGGLIGYFGYEYIQQFVLKLHLKSPATADLDDLGLFLVTSVLVYDHRHHELGLTQLISTADLAATYAVTQTALTQQLAAIIEQLQQPIALPPFDLQQPLHMQADQATYARQVDRIRQHIYAGDIFQMIYANPCLGTMSGSLLAVYQQLQKTAAPYTCYFKQANFEMTVASPETLVTKDGEQIATYPLAGTRRRGRTPAEDQQLAHELQTSPKEIAEHNMLVDLGRNDLGQVAKFKSVRVTNLRRLIRYSQVMHLGSRVAAEVAPTTTALQVLAATFPAGTLAGAPKIEAMTLINHYEQVPRGAYGGCFGYLDCNGNLDMAIGIRLAYRMNEQLVIPAGAGIVADSIGAQEFKECQNKQRVIVNAVQDAKGRVKDGIIN

SEQ ID NO: 3555 - DNA, 2166 bp, Bradyrhizobium japonicum
  CDS (1)..(2166)
atgaacaggacagtctttgccctcccggccagaagcgattacgtgacccgcggcggtctcgcgatcacgcgcgtggcggagcagtttaccggcggcgcgagccggctcgacgatctcgtcaacctgctcgaccgccgccgcggcgtggtgctgtcctcgggcacgaccgtgccgggccgctacgagagcttcgacctcggcttctccgatccgccgctcaagctcgagaccacaggcgtcaatttcaagctggaagccctgaacgagcgcggccaggtgctgatcgccttccttgccgatgtcctgcgcgagccctgcgtggtgatatccgaaaagaccgcttcgcgcctcgccggccacatcatccgcggcgatgccccggtcgaggaagaccagcgcacccggcgcgccagcgtggtgtcgctggtgcgcgacctcgtcgccgccttctccgccaatgacgacgggctgctcggcctgttcggcgccttcgcctacgatctcgtgttccagatcgaggatctcgtgcagaagcgcgcgcgcgagagcgaccagcgcgacatcgtgctctacgttcccgatcgcctgctggcctatgaccgcgccaccggccgcggcgtcgtgctcagctacgacttcacgtggaagggcagatccaccgagggcctgccgcgcgagaccgccgacagcccgtacatgaagacaccgcgccagggctttgccgatcatgcgcccggcgaataccaggccaccgtcgagaccgcgcgcgcggcctttgcccgcggcgatctgttcgaggccgtgccgggccagctgttcgccgagccctgcgatcgttctccggcggaagtgttccagcgcctctgtgtcatcaacccgtcgccctacggcgcgctgatgaatctcggcgacggcgagtttctcgtctccgcctcgcccgagatgttcgtgcgttcggacggccgccgcgtcgagacctgcccgatctcgggcaccatcgcgcgcggcaccgatgcgatcggcgatgccgagcagatccgccagctcctgaattcggagaaggacgagttcgagctcaacatgtgcaccgacgttgatcgcaacgacaaggcgcgcgtctgcgtccccggcaccatcaaggtgctggcgcgccggcagatcgagacctactcaaaactgttccacaccgtcgaccacgtcgagggcatgctgcgtcccggcttcgacgcgctcgatgccttcctcacccatgcctgggccgtcaccgtgacaggtgcgccgaagctctgggcgatgcagttcgtcgaggatcacgagcggtcgccgcggcgctggtatgcgggtgcgatcggcgcggtgaatttcgacggcagcatcaataccggcctcaccatccgcaccatccgcatgaaggatggtctcgccgaggtgcgcgtcggcgccacctgcctgttcgattccgatcccgctgccgaggaccgcgaatgccaggtcaaggcggcggcgctgttccaggcgctgcgcggcgatccgccaaaaccgctctcgacctttgcgcccgatgcgaccggaagcggcaagcgggtgctgctgatcgaccacgacgacagcttcgtgcacatgctcgccgactatttccgccaggtcggcgccagcgtcaccgtggtccgctatgtgcatgcgctcgacatgctcaagcagaagaggtgggatttgctggtgctgtcgcccggcccgggcaggcccgaagatttcgggatcaggaagacgatcgatgcggcgctggagaacaagctgccggtgttcggcgtctgcctcggcgtgcaggcgatcggcgaatattttggcggcgagctcggccagctcacgcatcccgcccacggccggccctcgcgggtgcaggtgcgcggcggccgcctgatgcgcaatttgccgagcgagatcgtgatcggccgctatcactcgctctatgtcgagcgcgacagcatgccggaggttttgtccgtcaccgccagcaccgaggacggcgtcgctatggcgctggagcacaagaccctgccggtcgcgggcgtgcaattccacccggagtcgctgatgtcgctcggcggcgaggtgggcttgaggattgtcgagaacgcgttccggctggatgcgcgtgttgattga

SEQ ID NO: 3556 - protein, 721 aa, Bradyrhizobium japonicum
MNRTVFALPARSDYVTRGGLAITRVAEQFTGGASRLDDLVNLLDRRRGVVLSSGTTVPGRYESFDLGFSDPPLKLETTGVNFKLEALNERGQVLIAFLADVLREPCVVISEKTASRLAGHIIRGDAPVEEDQRTRRASVVSLVRDLVAAFSANDDGLLGLFGAFAYDLVFQIEDLVQKRARESDQRDIVLYVPDRLLAYDRATGRGVVLSYDFTWKGRSTEGLPRETADSPYMKTPRQGFADHAPGEYQATVETARAAFARGDLFEAVPGQLFAEPCDRSPAEVFQRLCVINPSPYGALMNLGDGEFLVSASPEMFVRSDGRRVETCPISGTIARGTDAIGDAEQIRQLLNSEKDEFELNMCTDVDRNDKARVCVPGTIKVLARRQIETYSKLFHTVDHVEGMLRPGFDALDAFLTHAWAVTVTGAPKLWAMQFVEDHERSPRRWYAGAIGAVNFDGSINTGLTIRTIRMKDGLAEVRVGATCLFDSDPAAEDRECQVKAAALFQALRGDPPKPLSTFAPDATGSGKRVLLIDHDDSFVHMLADYFRQVGASVTVVRYVHALDMLKQKRWDLLVLSPGPGRPEDFGIRKTIDAALENKLPVFGVCLGVQAIGEYFGGELGQLTHPAHGRPSRVQVRGGRLMRNLPSEIVIGRYHSLYVERDSMPEVLSVTASTEDGVAMALEHKTLPVAGVQFHPESLMSLGGEVGLRIVENAFRLDARVD

SEQ ID NO: 3557 - DNA, 1407 bp, Bacteroides thetaiotaomicron
  CDS (1)..(1407)
atgaaaacattcagttatacagcccatagcaaacaggtactcggagatatgcacactcctgtcagtatctatctgaaagtacgtgatatgtacccacaatctgcattgatggagagttccgattatcatgcaggagaaaattccctctcgttcatcgctctttgtccgctggcaagtatcggtgtcaatagcggaatagtcactgctagttatcctgacaaaagtcggaaggaagagccgctcacccaatcattcacggtagaaaaagcgatgaatcaattcatcagtcagtttcaagtgaccggagaaaacaagaatgtgtgcggactttacggatacaccacattcaacgcagtgaaatacttcgaacatatcccggtgaaagaaagtcatgatgagcagaatgatgctccggacttgctatacatattatataagtatatcatcgttttcaatcatttcaagaatgaattgacattggtagaaatgctgggcgaaggtgaagaaagcggtttgccggaactggaggccgctatcgaaaacagaaattatgcttcttataatttctcggtgacaggtcctgtcagcagcccgatctccgatgaggagcataaagcgaacgttcgcaagggtattgcccattgtatgcgtggtgatgtttttcagattgtcctttccagaagattcatccagccttatgccggagatgatttcaaagtctatcgtgctcttcgcagcatcaacccttctccttatcttttctatttcgatttcggaggataccgcattttcggttcttctccggagactcactgtaaaattgaagacggacgtgcctacatcgacccgattgccggaacaacccgccgtaccggagatacggtaaaagaccgcgaattggcggaagcactgcttgccgatccgaaagagaacgcggagcatgtgatgctggttgatctggcaagaaatgatctttcacgtaattgccatgatgtacgggtattgttttataaggaaccacagtattacagtcatgtgattcatctggtcagccgcgtgagcggtcagctgaatgaaggggcggataagattaaaactttcatcgatactttccctgcgggaacgttgagcggagcaccgaaagtacgcgccatgcagctgatcagtgaaatcgaacctcataaccgcggtgcttatggcggctgtatcggctttatcggacttaacggagaactgaaccaggcaatcaccatccgtacttttgtcagccgtaataacgagttatggttccaggccggaggcggtatcgttgcacgcagtcaggatgaatacgagttgcaagaggtaaacaataaattaggagctcttaaaaaggctatcgatttagctgttaatttaaaaaactaa

SEQ ID NO: 3558 - protein, 468 aa, Bacteroides thetaiotaomicron
MKTFSYTAHSKQVLGDMHTPVSIYLKVRDMYPQSALMESSDYHAGENSLSFIALCPLASIGVNSGIVTASYPDKSRKEEPLTQSFTVEKAMNQFISQFQVTGENKNVCGLYGYTTFNAVKYFEHIPVKESHDEQNDAPDLLYILYKYIIVFNHFKNELTLVEMLGEGEESGLPELEAAIENRNYASYNFSVTGPVSSPISDEEHKANVRKGIAHCMRGDVFQIVLSRRFIQPYAGDDFKVYRALRSINPSPYLFYFDFGGYRIFGSSPETHCKIEDGRAYIDPIAGTTRRTGDTVKDRELAEALLADPKENAEHVMLVDLARNDLSRNCHDVRVLFYKEPQYYSHVIHLVSRVSGQLNEGADKIKTFIDTFPAGTLSGAPKVRAMQLISEIEPHNRGAYGGCIGFIGLNGELNQAITIRTFVSRNNELWFQAGGGIVARSQDEYELQEVNNKLGALKKAIDLAVNLKN

SEQ ID NO: 3559 - DNA, 1407 bp, Staphylococcus epidermidis
  CDS (1)..(1407)
atggatattgtatacaaaaaggtgaatgctcaaattacgccagaagctttagcaaaattaaaacaaaaaaagatcatttttgaaagtacaaatcaacagaaacttaaaggtaggtactcgatagtagtattcgatcattatggcaaaattacattagataattctcaacttttaattaatttagacaatcattgtgaaatagttaagaatcaaccgtatcaacgacttaaggaatttgtagataaatattattttgaaatcaaagataaatatttaaaagatttaccttttatttcgggctttatagggacatgtagctttgatttagtacgacatgaatttaaaaaattacaagatattaaattagaagatcatcaaactcatgatgtccaattttatctagtggaagatgtatttgtttttgatcattataaagatgaattatatattatcgcaagtaacttattttctgatagaacaaaagagagattaaaggaatctattgaacgtaaaattgaagatttaaaaaacatacatttttcggttgaggatataaattataaatccatccctcgacatataaccaccaatatatcagagcaacaatttgttcaaactattagaattttaaaaaagaaaattactgaaggagatatgtttcaagtagttccttcaagaatttatagttataaacaccattttcaacacaatttacatcaattaacttttcagttatatcaaaatttaaagcgacaaaatcctagtccatatatgtattatattaataaagatgtaccgattgtaataggaagttctcctgaaagttttgtaaaggtaaaagatggaaaagtttatacgaatcctatagctggaacaattaaaagaggtcaaaataaaaaagaagatgaaaataatgaaaagacattaatgaaagatgaaaaggaattgagtgaacatcgtatgctcgtagatttaggaagaaatgatattcatcgaataagtaaaacaggcacttcacaaattaccaaactaatgacaatagaacgttatgaacatgtcatgcatatcgttagtgaagttattggagaattaaaaccccatctatctcctatgagcgtcatcgcaagtttgctaccaacgggtactgtctcaggtgcacctaaacttagagctatacagagaatatacgaatcttatccttataaaagaggtatctatagcggtggtgttgggtatatcaactgtaatcatcatttagattttgcattggctatacgtaccatgattatcgatgaggaaaaagtcagtgtcgaggcaggatgtggagtagtatatgattctattccagagaaagaacttgaagaaacaaaacttaaagctaaaagtttattggaggtaactccatga

SEQ ID NO: 3560 - protein, 468 aa, Staphylococcus epidermidis
MDIVYKKVNAQITPEALAKLKQKKIIFESTNQQKLKGRYSIVVFDHYGKITLDNSQLLINLDNHCEIVKNQPYQRLKEFVDKYYFEIKDKYLKDLPFISGFIGTCSFDLVRHEFKKLQDIKLEDHQTHDVQFYLVEDVFVFDHYKDELYIIASNLFSDRTKERLKESIERKIEDLKNIHFSVEDINYKSIPRHITTNISEQQFVQTIRILKKKITEGDMFQVVPSRIYSYKHHFQHNLHQLTFQLYQNLKRQNPSPYMYYINKDVPIVIGSSPESFVKVKDGKVYTNPIAGTIKRGQNKKEDENNEKTLMKDEKELSEHRMLVDLGRNDIHRISKTGTSQITKLMTIERYEHVMHIVSEVIGELKPHLSPMSVIASLLPTGTVSGAPKLRAIQRIYESYPYKRGIYSGGVGYINCNHHLDFALAIRTMIIDEEKVSVEAGCGVVYDSIPEKELEETKLKAKSLLEVTP

SEQ ID NO: 3561 - DNA, 1161 bp, Staphylococcus epidermidis
  CDS (10)..(1161)
gggttaaatatgcacattgaatttaagtatcgctattatgaaaatgaaaaggactatgaagactatcaattagaaatggataactttcaagattctaaaattgcatatcgtcttgatgaagtaggggatgtcattcactttgcagaacaagaacaacgtaacggaagctatgttgcactttatgttacttatgaagcagcacctttttttaataaggaaatggtggtcaataatgtgaaacaatcccatatttttgctgcagcttattcatttaaatcggtcaattcgataaaaaatataaaaaaagtaatgcccaataaaaatcatataaaaactgaaggattttatttttgtgaaagtgataaagcgatgattaacaagatcaaatcgattcataaagccattattgaaggggcaacgtatcaggtgaattacacaacccgcttaaaagcagaagttttctgtcctataagtcacttatattatcaacttactatgtcacaaaatggtaattataccgttttaatggacacacctgatataaaagtagcatcaatatcgcctgaacttttctttcaaaaaggtgactataaaggtaaatcaaatatgattgttagtaagccgatgaaagggactatgcctagagggaaaaatgttaaagaagatgagctatattataataatttaaaaacctcctctaaagatatggcggagaatgtgatgattgtagacttattacgtaacgatattacaagaattgctcaaagtggaactatagatgtacctgaattgttttcgattgagaaatatgacacagttttccaaatgaccagtacagtgtgtggccgattacaagatgacattcaattgatagatatgatgcgagcgctctttccttgtggttctattacaggtgcaccaaaaataaatacaatgcaatatatagctcagttggaggacatgccaagatccatttactgtggaacaattggcttattacttccaaaccaaaggatgatatttaatatccctatacggacaattgagtataatcatgaagaagcggtttatggggtgggtgctggtataacaattgattcagtacccgaaaatgaagttcaggaatttcacgataaaactaaaattttggagcggttataa

SEQ ID NO: 3562 - protein, 383 aa, Staphylococcus epidermidis
MHIEFKYRYYENEKDYEDYQLEMDNFQDSKIAYRLDEVGDVIHFAEQEQRNGSYVALYVTYEAAPFFNKEMVVNNVKQSHIFAAAYSFKSVNSIKNIKKVMPNKNHIKTEGFYFCESDKAMINKIKSIHKAIIEGATYQVNYTTRLKAEVFCPISHLYYQLTMSQNGNYTVLMDTPDIKVASISPELFFQKGDYKGKSNMIVSKPMKGTMPRGKNVKEDELYYNNLKTSSKDMAENVMIVDLLRNDITRIAQSGTIDVPELFSIEKYDTVFQMTSTVCGRLQDDIQLIDMMRALFPCGSITGAPKINTMQYIAQLEDMPRSIYCGTIGLLLPNQRMIFNIPIRTIEYNHEEAVYGVGAGITIDSVPENEVQEFHDKTKILERL

SEQ ID NO: 3563 - DNA, 1401 bp, Vibrio vulnificus
  CDS (1)..(1401)
atgcagcaatcgaactctttgtcacaaattaaacaaatgaataacagcataaatacggccatttcttcaaaaacactgccttatcaaacggacctttcccaacagtggtttgacaccatccaacatcaaccttgggcaatgctgttgcgttcggcatcaccaacacatgttgacagccgttttgacattctcgtcgcaaagcccgttgcgacattagaaacacgtggtgcggtgactgagatcaacaccaatgacgaagtcattgaaagtaaagatgatcctttcacgcttcttgcgcgttatcaacagcgttttacccctgctctatccagtgatgaagagattccttttattggtggcgctctgggttactttagctacgatttaggtcgttgcgttgaaaaactgcctgagattgcaacacaagatatcgctgcgcccgacatggcagtgggcatctacacatgggcgttgattgtcgatcatcagacgcagaccgcgcaactggttggccaagacgtagaacaagcttatcaatggctaagcacgcaaacaaaagcggatgatgcgacgtttgccctgaccagtgattggcaatccaacatgaatcgtcgtgattaccaaagtaagttcgattgcgtacaggagtacttgctcagtggtgactgctaccaaattaacttagcgcagcgctttcatgccaattaccaaggcagcgaatggcaagcttaccagaagctagagcagagcaaccaagcaccattttctgctttcattcgtttgaaggacgcggcgattttaagtgtgtcgccggagcgttttctcgagctcaaaaaacgtgtcattgaaaccaagccgatcaaaggaactcgtcctcgtcataatgatgaacaacaggacaaacaggcggcacttgagcttgccaatgccgaaaaagatcaagcggaaaatctgatgatcgtcgatctgctgcgcaacgatattggccgtgtcgccaaaccgggcagcgtgcatgttcctaaactgtttgacatcgaaagctttcccgccgtgcatcacttagtcagcacgattcgagctgagttggcagcgcagtatactgccgctgacttactgcgagcgtgtttcccgggaggctcgattaccggcgcgccgaaagtgcgcgcaatggaaatcattgaagagcttgagcctcatcgacgctcagcctattgcggtagtatcggttacatcagtcgccatggtcgcatggataccagcattacaattcgtaccttagtggcggagcaaggtaagttgttcgcttgggctgggggcggtgtagtggctgacagtcaatgcgatgcggaatatcaagagacgttagataaactgtcgaaaattctaccaacattgcaataa

SEQ ID NO: 3564 - protein, 466 aa, Vibrio vulnificus
MQQSNSLSQIKQMNNSINTAISSKTLPYQTDLSQQWFDTIQHQPWAMLLRSASPTHVDSRFDILVAKPVATLETRGAVTEINTNDEVIESKDDPFTLLARYQQRFTPALSSDEEIPFIGGALGYFSYDLGRCVEKLPEIATQDIAAPDMAVGIYTWALIVDHQTQTAQLVGQDVEQAYQWLSTQTKADDATFALTSDWQSNMNRRDYQSKFDCVQEYLLSGDCYQINLAQRFHANYQGSEWQAYQKLEQSNQAPFSAFIRLKDAAILSVSPERFLELKKRVIETKPIKGTRPRHNDEQQDKQAALELANAEKDQAENLMIVDLLRNDIGRVAKPGSVHVPKLFDIESFPAVHHLVSTIRAELAAQYTAADLLRACFPGGSITGAPKVRAMEIIEELEPHRRSAYCGSIGYISRHGRMDTSITIRTLVAEQGKLFAWAGGGVVADSQCDAEYQETLDKLSKILPTLQ

SEQ ID NO: 3565 - DNA, 1566 bp, Vibrio vulnificus
  CDS (1)..(1566)
atgaacaaggccattaacatcaccacactaggacagctagagcttctgtcaacgacggttccttaccattcggatcctacgcgcctttttcacactttgtgtgaaaacaagcgcgatagcttattgctcgaatcagctgaaatcgattcaaaacaagatcttaaaagcttactgattgtcgattccgcggtacgtatggtttgccatggccatgtcgtgaccatgacggcactcagtgacaacggcaagaatctgttaacgcatttgacaaagaatgtcgcgcaagaggttgaacatcagtttgatggacaacaacttactctcaccttctcaagcccagatgaccgcctagatgaagactctcgcttacgtgaagcctctagtttcgacgcattgagactggttcaacacagttttgatttggcggaaaaagacaagcacgcgatctttatcggcggtctgtttgcctatgacttggtggccaactttgaaccactgggtgaagcccacgcaataaatcaatgtcctgactatgtcttctacgtggcagaaacgctgatggtggtcgaccaccagaccgagagttgccatttacaagcaacgctttttgcagacgactcacaaaaagaagcactaaatcagcgtattgaacaaatccgcactctgtgtgctaccccgaaagcgctacctaaagccattcatctcgataaggttgaggtcgataccaatatcagcgatgacgccttttgccaagtggtacgcgacctaaagcaatacgtagtcaaaggcgacattttccaagtcgtaccatcacgccgctttaccctgccctgcccgtcaccattggcggcgtataaagagctcaaagtcagcaacccaagcccttacatgttttacatgcaagatgaactctttacgttgtttggcgcatcaccggaaagcgcgttgaaatatgaaacgcaaaccaatcaggtggagatctaccccattgctggtactcgacgccgtggcaagcgagccaatggtgagatcgatttcgacctcgatagtcgaattgaactcgaacttcgcactgacaagaaagaaaacgccgagcacatgatgttggtggatctcgctcgaaatgatgtcgcacgcatttctcgcgcagggacacgccacgtcgccgatttacttaaagtggaccgctacagccatgtgatgcacttggtctcacgcgttgttggacaattacgtgacgatcttgacgcactacacgcctaccaagcgtgtatgaatatgggcacattaacgggcgctccgaaaattcgtgccatgcaattgattcgtgatgttgaaggggctcgccgtggcagttacggtggggctgtcggttacctcactggcgaagggacactggatacctgtatcgtgattcgttcggcttacgttgaaaacggcattgcacaagtgcaagccggtgccggagtggtctttgattccgccccccaagccgaagccgatgagacgcgcggcaaagctcaggcagtcatctctgccattcagaaagcccacaaggagtcgtaa

SEQ ID NO: 3566 - protein, 521 aa, Vibrio vulnificus
MNKAINITTLGQLELLSTTVPYHSDPTRLFHTLCENKRDSLLLESAEIDSKQDLKSLLIVDSAVRMVCHGHVVTMTALSDNGKNLLTHLTKNVAQEVEHQFDGQQLTLTFSSPDDRLDEDSRLREASSFDALRLVQHSFDLAEKDKHAIFIGGLFAYDLVANFEPLGEAHAINQCPDYVFYVAETLMVVDHQTESCHLQATLFADDSQKEALNQRIEQIRTLCATPKALPKAIHLDKVEVDTNISDDAFCQVVRDLKQYVVKGDIFQVVPSRRFTLPCPSPLAAYKELKVSNPSPYMFYMQDELFTLFGASPESALKYETQTNQVEIYPIAGTRRRGKRANGEIDFDLDSRIELELRTDKKENAEHMMLVDLARNDVARISRAGTRHVADLLKVDRYSHVMHLVSRVVGQLRDDLDALHAYQACMNMGTLTGAPKIRAMQLIRDVEGARRGSYGGAVGYLTGEGTLDTCIVIRSAYVENGIAQVQAGAGVVFDSAPQAEADETRGKAQAVISAIQKAHKES

SEQ ID NO: 3567 - DNA, 1521 bp, Synechococcus elongatus
  CDS (1)..(1521)
atgtaccccgattttcagactttttgtcagcttgccgagcagggtaactttatccccctctatgaggagtgggtggcggatatggatacacctgtgtcggcttggtatcgggtctgtcgcgatcgcccctacaactttttgctcgagtccgtcgagggaggcgaacaactggcccgctacagtctcctcagttgtgatcccctgtgggtactggaaacccgcggcaaccaaaccacccaaacccatcgcgatgggtcagttaccaggtttaccggcaatcccttcaccattttggccaactgccttgcaccctatcagccggtgaagctagcgcaactgccggggggcattggtggtctttttggtttttggggctatgaactgattcagtggattgagccacgggttcccattcatcctgccacggcaagggatttgcctgacggggtgtggatgcaggtggatcaaatcctgatttttgatcaggtgaagcgaaaaatctgggcggtggtctatgccgatacccgtgagacggacttgaaaacagcctatacccacgcgagcgatcgcctagagcggcttttgcgtaaactgcaaacccgtattccccctgaggccactcagctccattggcaacccagtcgtcagatccccagttacactagcaacattacctccgaagccttccgtaccaatgtggcgcgcgctaaggactatattcgtgcgggggatattttccaagtcgttctctcccaacgcctcagtgccacctaccgcggcgatccctttgccctctatcgctccttgcgcctgattaacccttccccctacatggcctactttcaatttggcacgtggcagatcattggctctagtccagaggtcatggttaaagccgagcaccatcctgaaaacgctggctctctccttgcgactgtgcgtcctattgccggtactcgccagcgggggcacacctacaccgaagatcagcagcttgccgcagaactccttgccgataccaaagaagtggccgaacacgtcatgctggttgatttggggcgcaatgatttggggcgcgtgtgtcgtcaggggagtgtcagcgttgaagcctttatggtgattgagcgctattcccatgtcatgcacattgtcagtaatgtggtgggtgaactattgcctgataaaacggcatgggacttactccaagcctgtttccccgctggtacagtcagtggtgcccccaaaattcgtgccatggaaattatctatgaattggagggttgccgccgtggcccctactccggtgcctatggttactatgactttgaaggtcaactcaatacagcgatcgccattcgcacaatggtggtgcaacccctgacggaccatcaacatctgattcatgtgcaagcgggtgctggtattgttgccgactccgatccgcagcgggaatacgaagaaaccctcaacaaagcacgggggctgttggaagcgatttctgccctgacaacaaaaccttaa

SEQ ID NO: 3568 - protein, 506 aa, Synechococcus elongatus
MYPDFQTFCQLAEQGNFIPLYEEWVADMDTPVSAWYRVCRDRPYNFLLESVEGGEQLARYSLLSCDPLWVLETRGNQTTQTHRDGSVTRFTGNPFTILANCLAPYQPVKLAQLPGGIGGLFGFWGYELIQWIEPRVPIHPATARDLPDGVWMQVDQILIFDQVKRKIWAVVYADTRETDLKTAYTHASDRLERLLRKLQTRIPPEATQLHWQPSRQIPSYTSNITSEAFRTNVARAKDYIRAGDIFQVVLSQRLSATYRGDPFALYRSLRLINPSPYMAYFQFGTWQIIGSSPEVMVKAEHHPENAGSLLATVRPIAGTRQRGHTYTEDQQLAAELLADTKEVAEHVMLVDLGRNDLGRVCRQGSVSVEAFMVIERYSHVMHIVSNVVGELLPDKTAWDLLQACFPAGTVSGAPKIRAMEIIYELEGCRRGPYSGAYGYYDFEGQLNTAIAIRTMVVQPLTDHQHLIHVQAGAGIVADSDPQREYEETLNKARGLLEAISALTTKP

SEQ ID NO: 3569 - DNA, 1377 bp, Synechococcus elongatus
  CDS (1)..(1377)
atgatgggcccctgtgagccgtggctttggcgttctctgcccctgggtgggcgcacgggtcgcgtgatttttcaacagttgtttttgagggagccgattgctgtcctactggaaagtccagcccaagcccccacaccccaagctcgctactccatttgtgcggggtcaccgcggcgcgatcgccagtgggtgttatccctcggtgaagtgctgccaacattacaaacatttccccagggaagcactgtgcctgaagcagtcagccatctgccctttgcaggcgggtggttgggatggctggggtacgaattggcatgggaaattgaagcgctacccccgcccaaacccgatccgcttccttttccagtggccttttggtatgagcctcaagcctttgctgtcttggatcatcaggcggattgcctgtatctggcggcgtcgagcgcgagtcaactggcggcgctgcaacaaactcttgaagagccttcccctgagcagtccctcttattccccgatcgccccggcaggattgagctagcggcgggctggcagccccatacctaccaagcagccgttgagcacattctccgccatatccgcgctggcgatatttttcaggccaatctgtcggcgcgcttttgccatgatggcggcgttgatccgtggcaacaatatctgcggctacagcagattaacccctctccctttgccagcttttggcagaccccttggggctacattgtcagttgttcaccggaacgcttggtgcaggttcagggcgattgggtgcaaacacgacccattgccggtacccgtccccgtggccaaacccctgcggccgatcgcgcctatgccgaggaactccgtagcaatatcaaggaacaggcagaacacattatgcttgtggatttggagcgcaacgacttggggcggatctgccaatggggcactgtggtggtggatgaactcctaagtttggagtactacagccatgtgatgcacctcgtgagcaatgtgcgcggcaagttgcagccggggagatcccccgtggatgtcatccgtgctctctttccgggtggcaccatcactggctgtcccaaggtgcgctgcatggagattttggcaggtcttgagccctttccccgcaatttgttctacggttcctgtggctactgggatcagcgagggcatctggacttgaatatcctcatccgtaccctcttggtggggcgcgatcgccagacaacttggggacaagtcggtgccggtattgtggccgacagcgctccagagcgggaatggcacgaatccctgagcaaagcccaagccctactccttgccctcggaacaccaacgcccattgccacccattcctaa

SEQ ID NO: 3570 - protein, 458 aa, Synechococcus elongatus
MMGPCEPWLWRSLPLGGRTGRVIFQQLFLREPIAVLLESPAQAPTPQARYSICAGSPRRDRQWVLSLGEVLPTLQTFPQGSTVPEAVSHLPFAGGWLGWLGYELAWEIEALPPPKPDPLPFPVAFWYEPQAFAVLDHQADCLYLAASSASQLAALQQTLEEPSPEQSLLFPDRPGRIELAAGWQPHTYQAAVEHILRHIRAGDIFQANLSARFCHDGGVDPWQQYLRLQQINPSPFASFWQTPWGYIVSCSPERLVQVQGDWVQTRPIAGTRPRGQTPAADRAYAEELRSNIKEQAEHIMLVDLERNDLGRICQWGTVVVDELLSLEYYSHVMHLVSNVRGKLQPGRSPVDVIRALFPGGTITGCPKVRCMEILAGLEPFPRNLFYGSCGYWDQRGHLDLNILIRTLLVGRDRQTTWGQVGAGIVADSAPEREWHESLSKAQALLLALGTPTPIATHS

SEQ ID NO: 3571 - DNA, 1362 bp, Streptococcus mutans
  CDS (1)..(1362)
atgaaaaagaagatattgagtgctgatattttgaccccaatccttgcttacatgcgtgtacagggcgaccataaggtgattttggagtctatccctcgtgaaaaggaaaatgcgcgtttttcaattgttgcttacaatcctgtttttgaaatcaaatttgaaaatgggcaattgacagagaatgacaaagttattgaaagtgatcccttagattatctcagtcaaatcactgtcaaatcacaactgtctcaagatttaccttttaatggtggcgctattggttttgtgggctatgacatggttggtctttatgaaaatattggcaagattcctcaagatacgattggaacaccggatatgcacttttttgtttatgaatcttatcttatttttgatcataagaaagaaaaaattgtcattgttgaagataatatttacagcggcagagaagaagaggaacaaaaggctgccttgcaggaagtcttagcagatcttaaaaaacaggcggttgatgaattttcggaacgcgatttacacactttgacttttaggaaccatttggaagaagctacttttaaagacatggttaccaaagcaaaaaaatttattcgtcagggagatatgtttcaatgcgtgctcagccagcgtttctcagcggatattagtggcaagccgctagatttttatcgtaatttacgtattaccaacccttccaattatctttacttttatgattttggtgattatcagattattggagccagtccagaaagtctcgtttctcttaaaaatggtgtggttactacaaatcctattgcaggaacacgtcctcgtggtgccaacgatcagaaagacaaagacttatctgaagagctcttatcagatgtcaaggaagtagcagagcaccgtatgttggtagatttgggccgcaacgatattgggaaaattgctgaggtaggaagtgttcaagttaccaagtatatggaagtcgaattttttcgctatgttatgcatttaactagtgttgtcaagggtaaacttctgtcaggtttgactggtatggatgctcttaagtcaacattgccagcgggtacggtatcaggagcaccgaaaattcgtgctatgaagcgcatttatgagttggaaaaagaaaagcgcggtatctatgcaggagcaattggttatctgtcagcaagcggagatatggactttgccattgccattcgtaccatgattatcaaaaatcaaaaggcttatgttcaagcaggtgcggggattgtctatgatagcgttcctgaaaatgaatactacgaaaccattaataaggccaaagcaatgactagaataggagagatacagtga

SEQ ID NO: 3572 - protein, 453 aa, Streptococcus mutans
MKKKILSADILTPILAYMRVQGDHKVILESIPREKENARFSIVAYNPVFEIKFENGQLTENDKVIESDPLDYLSQITVKSQLSQDLPFNGGAIGFVGYDMVGLYENIGKIPQDTIGTPDMHFFVYESYLIFDHKKEKIVIVEDNIYSGREEEEQKAALQEVLADLKKQAVDEFSERDLHTLTFRNHLEEATFKDMVTKAKKFIRQGDMFQCVLSQRFSADISGKPLDFYRNLRITNPSNYLYFYDFGDYQIIGASPESLVSLKNGVVTTNPIAGTRPRGANDQKDKDLSEELLSDVKEVAEHRMLVDLGRNDIGKIAEVGSVQVTKYMEVEFFRYVMHLTSVVKGKLLSGLTGMDALKSTLPAGTVSGAPKIRAMKRIYELEKEKRGIYAGAIGYLSASGDMDFAIAIRTMIIKNQKAYVQAGAGIVYDSVPENEYYETINKAKAMTRIGEIQ

SEQ ID NO: 3573 - DNA, 1725 bp, Shewanella oneidensis
  CDS (1)..(1725)
atgaccctaaagacatttaatcaggttacccaagccgatagagcgaatttagcctcgtctcaacagacattcgcacgttcacatacgctcaaagccaccctggtataccatagcgatccactgcgtctgtaccagcacatcactgaagatgcgccccataccatgttgttagaatcagcggaaatcaacagtaaggaaaatcttaaaagcatggtgatgacccatgcggcactgatgatccgctgcgacggttatcgtttacgctttagcgcactgaccgacaatggtgccagtttgctcacgcccattgagcaattttttatggcgcgttcatgccatacacaatgccaacgcaatggccaacacttagtggtgacgctgcaaaaagacactgagcttaaggatgaagatgcgcgcttaaaatccacctcgcccctcgatggtttgcgcttgtttgttaaacatatcgactgcggcgctcatactgacagccaatccaagccagcgttcgaagacttatttttaggtggcgtgctttcctacgatttgattgataccgtcgagccgctgccagaagccccgaatggtgcaaatgattgtcctgattatttattttatctcgccgaaaccttaattcttatcgatcacaaacaaaaacaagccgagattatcacccacaacttcagtgaaagcgcagaacaacattcagaggtgacccaagccttagccgagcgagttgaaaacatccgcgcccaatgtgaagccttagccaagagtgcaacgcctgcgcctgccctcgttggcataacagccacagagcaagtgaatgtcagtgatgaggcctttaaacaaactgttatcgatttaaaagaacacattattgcgggcgatatcttccaagtggtgccttctcgcagttttagcctgccctgcccgaataccttaggtgcttaccgcgcgctgcgtctaaccaatcctagcccctatatgttttatttcaggggaaatgatttcaccctgtttggcgcctcgccagaaagcgcgctgaaatttgattccagcaacaatcaggtcgaagtctatccaatcgcaggtacccgtaaacgcggcaaaaccgccagtggcgagattgatttcgacctcgatagccgcatcgaactcgaactgcgtttagataaaaaagagttatctgaacatttaatgctggtcgatttggctcgcaacgatatcgcccgaatcagccaaagcggcagtcgtaaagtggctgagttacttaaagtcgaccgctactcccacgtcatgcaccttgtgagccgcgtcaccggccaattacgccaagacttagatgcgctccacgcctaccaagcctgtatgaacatgggcactttagttggcgcgcccaaagttcgtgcttcgcaattagtgcgtcaggcagaaaagacccgccgaggcagctatggcggcgccgtgggctacctcaatgcccttggcgatatggatacctgcattgtgatccgctccgcttttgttaaagacggtgtagcccatatccaagccggtgcaggagtggtgtttgactccgatccacaaagtgaagccgatgaaacccgccaaaaggcgcaagcggtgatttcggccatcaaaatgggcgcaggtttagcaggcataaataactgcaacgagcacacttccacaaaagtctcaacagcagcgcagcaaggataa

SEQ ID NO: 3574 - protein, 574 aa, Shewanella oneidensis
MTLKTFNQVTQADRANLASSQQTFARSHTLKATLVYHSDPLRLYQHITEDAPHTMLLESAEINSKENLKSMVMTHAALMIRCDGYRLRFSALTDNGASLLTPIEQFFMARSCHTQCQRNGQHLVVTLQKDTELKDEDARLKSTSPLDGLRLFVKHIDCGAHTDSQSKPAFEDLFLGGVLSYDLIDTVEPLPEAPNGANDCPDYLFYLAETLILIDHKQKQAEIITHNFSESAEQHSEVTQALAERVENIRAQCEALAKSATPAPALVGITATEQVNVSDEAFKQTVIDLKEHIIAGDIFQVVPSRSFSLPCPNTLGAYRALRLTNPSPYMFYFRGNDFTLFGASPESALKFDSSNNQVEVYPIAGTRKRGKTASGEIDFDLDSRIELELRLDKKELSEHLMLVDLARNDIARISQSGSRKVAELLKVDRYSHVMHLVSRVTGQLRQDLDALHAYQACMNMGTLVGAPKVRASQLVRQAEKTRRGSYGGAVGYLNALGDMDTCIVIRSAFVKDGVAHIQAGAGVVFDSDPQSEADETRQKAQAVISAIKMGAGLAGINNCNEHTSTKVSTAAQQG

SEQ ID NO: 3575 - DNA, 1404 bp, Shewanella oneidensis
  CDS (1)..(1404)
atggtaaatagggcgtcaaaacagcttgcatcacgccaacttgactggacattaagcacggcagacctctttgaacactttgcggcagaaccttgggcaatactgctcgactcggccaatgccccccatctggatgctaagttcgatatcatttgcgtaaatcccattgccacccttatcacccatggtgaactgaccgaaattaaggttcagttgcccgaattaaccattcccacccaaatgagtgcaaccgatgatccctttacgctggtcaaccagttattgcgccactggtatccgcaatcctttgcttgtgaactcccctttagtggcggcgccatgggcagctttagctacgatttaggccgtcgtgttgaagctatccccaatattgcggcgcaagatattcaacttggggagatgaatattggtttttacgactgggccctaatttttgactatcagcaacaatgctggcatttagtgcattatttgggtgaaaccgcgctagaaactcaattgaaaataattgaagcaaaaatggctaaaactgtaaaaatagccgaattcaccctcgttaccccttgggctgcacaactcaaaaaggctgattacgttaaaaaattcaatcaagttcaagcctacctgcatagcggcgattgctatcaaattaatttaacgcaacgatttgaagcacaatatcaaggcgatgaatggagcgcctattgcaaactgcgcagtgccaatcaggcgcccttctctgcctttatgcggcttaatgacaatacgattttatcgatttcgcctgagcgttttattcagctgcgcggggatgatattcaaaccaaaccgattaaaggcactctgccgcgccataacgaccctgcgctagataagcaagcggcgcaaatactcgccaactccccaaaggatcgcgccgaaaacgtgatgattgtggatttgctacgtaatgatatcggcaaagtcgcggcgcccggctcagtgcaagtgccgcatctatttgccgtcgaaagctttccggctgtgcatcatttagtgagtaccgtcaccgctaaactcgatccacaataccaagcctgtgatttgctgcgggcagcctttcccggtggttcaattaccggcgcccccaaaattcgcgctatggaaattattgaagaattggaaccctcacgccgcagcctgtattgtggttcaataggctatatcagccaagatgggcaaatggatactagcattaccatccgcaccattgttgccgagcgcggcaagctctattgttgggcaggcgggggcatcgtcgccgactccgatgtcgatgcggaatatcaagaaagcttcgacaaggtgagccgaattttacccctgttagaaaatcagcgataa

SEQ ID NO: 3576 - protein, 467 aa, Shewanella oneidensis
MVNRASKQLASRQLDWTLSTADLFEHFAAEPWAILLDSANAPHLDAKFDIICVNPIATLITHGELTEIKVQLPELTIPTQMSATDDPFTLVNQLLRHWYPQSFACELPFSGGAMGSFSYDLGRRVEAIPNIAAQDIQLGEMNIGFYDWALIFDYQQQCWHLVHYLGETALETQLKIIEAKMAKTVKIAEFTLVTPWAAQLKKADYVKKFNQVQAYLHSGDCYQINLTQRFEAQYQGDEWSAYCKLRSANQAPFSAFMRLNDNTILSISPERFIQLRGDDIQTKPIKGTLPRHNDPALDKQAAQILANSPKDRAENVMIVDLLRNDIGKVAAPGSVQVPHLFAVESFPAVHHLVSTVTAKLDPQYQACDLLRAAFPGGSITGAPKIRAMEIIEELEPSRRSLYCGSIGYISQDGQMDTSITIRTIVAERGKLYCWAGGGIVADSDVDAEYQESFDKVSRILPLLENQR

SEQ ID NO: 3577 - DNA, 1407 bp, Oceanobacillus iheyensis
  CDS (1)..(1407)
atgagtatccattatgtagttgagaaacaaccaatcgatcgattattacctattcaagtactaacccaactaactagcacaaaaaaatatttattagaaagcagctttccgcatgaagaaaaaggacgcttttcatttctaggaatgaatccataccaagaaattctaggattcgataaccgtaccaagatttgcaactatacgaatgacgaagatgaatgggtagaacaacatgccttacattatataaaacaccatctacctaaagccgaaatcgatatttccattccattctatggtggcgcaatcggatatatcggctacgatacgatacgttcctttgaacacatcggagatcgattacccgatgaacgaaacatgccagacatacatctgatgttatttgaagatacgatcatattcgaccatgaacaagatacctgctacctccttgtgattgatacggattcatccacttctcgagatgatttacaggaacgtctaggccaactcagaaaaataataaagaaagcaagagcagcgacagtccccatcccagcgagatattcatttactccagagatggaccaagacgtattcgaaaaaaatgtagctactgcaaaaaaacatattgaagacggagatatttttcaagttgtattgtctcagcgaatgaaggcaaaggtcgaaaatccagaaaccttttccctctccttttatgaacaactgagacaatcgaatccttccccttacatgttttatatggattttaatgattacctcattcttggggcttcaccagaaagtctcatcgaaacaactggcaagaagatcatcacgaatccaatagcaggtacaagaaaaagaggaagcacgaacgaaattgatctcatgctcacagaggaattgcttgctgatgaaaaagaaagagcggagcatcaaatgcttgtagatctaagtagaaatgaccttggaaaggtatgtgaaatcggaagtattgatattccggtatatatgaaaatagaaaaatatcaacatgtcatgcatatggtctctgaagtcactggcattttaaaatctaactactctagtattgatgctttaatctcttgtttaccagctggaacagtatccggagcacccaaaatacgtgcaatgcaaataatcaacgagttagagcaacaccaaagaggtccttatggaggaggtattggatttattaactttcaacaagatgttcacatggctttagctattcgaacggtgatcgttaaagatgacaaagcatacttacaagcaggagcaggaatcgtttatgattccatacctacaagtgagtatattgaaacgctaaataaagccaaatcatttatggaggtggacgatcatgattttattaatcgataa

SEQ ID NO: 3578 - protein, 468 aa, Oceanobacillus iheyensis
MSIHYVVEKQPIDRLLPIQVLTQLTSTKKYLLESSFPHEEKGRFSFLGMNPYQEILGFDNRTKICNYTNDEDEWVEQHALHYIKHHLPKAEIDISIPFYGGAIGYIGYDTIRSFEHIGDRLPDERNMPDIHLMLFEDTIIFDHEQDTCYLLVIDTDSSTSRDDLQERLGQLRKIIKKARAATVPIPARYSFTPEMDQDVFEKNVATAKKHIEDGDIFQVVLSQRMKAKVENPETFSLSFYEQLRQSNPSPYMFYMDFNDYLILGASPESLIETTGKKIITNPIAGTRKRGSTNEIDLMLTEELLADEKERAEHQMLVDLSRNDLGKVCEIGSIDIPVYMKIEKYQHVMHMVSEVTGILKSNYSSIDALISCLPAGTVSGAPKIRAMQIINELEQHQRGPYGGGIGFINFQQDVHMALAIRTVIVKDDKAYLQAGAGIVYDSIPTSEYIETLNKAKSFMEVDDHDFINR

SEQ ID NO: 3579 - DNA, 1362 bp, Escherichia coli O6
  CDS (1)..(1362)
atgaagacgttatctcccgctgtgattactttaccctggcgtcaggacgccgctgaattgtatttctcccgcttaagccacctgccgtgggcgatgcttttacactccggctatgccgatcatccatatagccgctttgatattgtggtcgccgagccgatttgcactttaaccactttcggtaaagaaaccgttgttagtgaaagcgaaaaacgcacaacgaccactgatgacccgctacaggtgctccagcaggtgctggatcgcgcagacattcgcccagcgcataacgaagatttgccatttcagggcggcgcgctggggttgtttggctacgatctgggccgccgttttgagtcactgccagaaattgcacagcaagatatcgttctgccggatatggctgtgggtatctacgactgggcgctggttgttgaccaccagcgtcaaacagtttctttgctgagtcataatgatgtcaatgctcgtcgggcctggctggaaagccagcaattctcgccgcaggaagatttcacgctcacttccgactggcaatccaatatgacccgcgagcagtacggcgaaaaatttcgccaggtacaggaatatctgcacagcggtgattgctatcaggtgaatctcgcccagcgttttcatgcgacctattctggcgatgaatggcaggcattccttcagcttaatcaggccaaccgcgcgccatttagcgcttttttacgtcttgaacagagtgcaattttaagcctttcgccagagcggtttattctttgtgataatagtgaaatccagacccgcccgattaaaggcacgctaccacgcctgcccgatcctcaggaagatagcaaacaagcagaaaaactggcgaactcagcgaaagatcgtgccgaaaatctgatgattgtcgatttaatgcgtaatgatatcggtcgtgttgccgtagcaggttcggtaaaagtaccagagctgttcgtggtggaacccttccctgccgtgcatcatctggtcagcaccataacggcgcaactaccagaacagttacacgccagcgatctgctgcgcgcggcttttcctggtggctcaataaccggggctccgaaagtacgggctatggaaattatcgacgaactggaaccgcagcgacgcaatgcctggtgcggcagcattggctatttgagcttttgcggcaacatggacaccagcattactatccgcacgctgactgccattaacggacaaatttactgctctgcggggggtggaattgtcgccgatagccaggaagaagcggaatatcaggaaacttttgataaagttaataagatattacgccaactggagaagtaa

SEQ ID NO: 3580 - protein, 453 aa, Escherichia coli O6
MKTLSPAVITLPWRQDAAELYFSRLSHLPWAMLLHSGYADHPYSRFDIVVAEPICTLTTFGKETVVSESEKRTTTTDDPLQVLQQVLDRADIRPAHNEDLPFQGGALGLFGYDLGRRFESLPEIAQQDIVLPDMAVGIYDWALVVDHQRQTVSLLSHNDVNARRAWLESQQFSPQEDFTLTSDWQSNMTREQYGEKFRQVQEYLHSGDCYQVNLAQRFHATYSGDEWQAFLQLNQANRAPFSAFLRLEQSAILSLSPERFILCDNSEIQTRPIKGTLPRLPDPQEDSKQAEKLANSAKDRAENLMIVDLMRNDIGRVAVAGSVKVPELFVVEPFPAVHHLVSTITAQLPEQLHASDLLRAAFPGGSITGAPKVRAMEIIDELEPQRRNAWCGSIGYLSFCGNMDTSITIRTLTAINGQIYCSAGGGIVADSQEEAEYQETFDKVNKILRQLEK

SEQ ID NO: 3581 - DNA, 1668 bp, Corynebacterium efficiens
  CDS (1)..(1668)
atgttcttaaacgttcgtcccagtgaaaggcccggttcccatgtcagttgtgacacccgtcctgagtctcaggcaggtgagtgccccatgagcaccgccccccatgttctatcccgcacggtgcggtaccacgaggatgcctccagtctgttcgcccacctcggtgggactgtagccgatgatgcggcgctgttggagagcgcggacatcaccaccaagaacggcatctcctccctggctgtgctcaagggttcggtccgggtcacctgcgagggccagcgggtcacggcgcagcctctgaccgagtcggggcgcatcgtagcctcccgcctggcggaggagctgggtgagtaccggatctccgcactgtcgccggagcatggcaacccggtcaccttcgagttcccggtctcggatgcggtggatgagcgcgagcgcctcacctccatcagcacgatcgaggtgctgcggaagctgcagttcgattccggttatgatcacccggcgctgccgttgctgatgggcggtttcgccttcgactacctggagaccttcgagactctgccggcggtgggagaggggatcaacacctaccccgattatcagttcctggtcgcggagatcatcctggacatcaaccaccaggagcagaccgcccagctggtcggtgtgtccagcgacccggacgcgctgggggaggagctcgcgcagctcgccgggcttatcgacgccgcactgcccggctccgatcacgcctacaaggtcaccccacacgccggcgacaccctgcgcgtggtcgccgacatcccggatgcggagttccgccagcaggtcgccgatctcaaggacaatatccacaacggtgacatctatcaggtggtgccggcgcggtccttctccgcaccgtgcccggatgccttcgcagcctatctccagctgcgggccaccaacccgagcccgtacatgttctatgtgcgcggtctggacaacaaccgtccctatgaactcttcggcgcctccccggagtccaacctgaagttcaccgccgccaccggcgagctgcagctgtatccgatcgccggcacccgcccgcgtgggttgaatgcggatggcaccattaatgatgagttggatatccgtaatgaactggatatgcgcaccaacgccaaggaggttgcggagcacaccatgctggtggatctcgcccgcaatgacctggcgcgggtgtcggtaccggcgacccgtcgcgtggcggatctgctccaggtcgaccgctactcccgggtgatgcacctggtgtcccgggtcaccgccaccctggatccggagctggatgccctggatgcctaccgtgcgtgcatgaacatggggacgttgacgggtgccccgaagttgcgcgccatggagttgctgcggggcgtcgagaagcgtcgccgtgggtcctacggcggtgccgtggggtacctgcgcggcaatggcgacatggataactgcattgtcatccgctccgcgttcgtgcaggacggggtggcggccgtgcaggccggcgccggtgttgtgcgcgattccaatccccagtccgaagccgatgagacactgcacaaggcctatgccgtgctcaatgccatcgcactcgccgccggttccaccctggaggtcgtccgatga

SEQ ID NO: 3582 - protein, 555 aa, Corynebacterium efficiens
MFLNVRPSERPGSHVSCDTRPESQAGECPMSTAPHVLSRTVRYHEDASSLFAHLGGTVADDAALLESADITTKNGISSLAVLKGSVRVTCEGQRVTAQPLTESGRIVASRLAEELGEYRISALSPEHGNPVTFEFPVSDAVDERERLTSISTIEVLRKLQFDSGYDHPALPLLMGGFAFDYLETFETLPAVGEGINTYPDYQFLVAEIILDINHQEQTAQLVGVSSDPDALGEELAQLAGLIDAALPGSDHAYKVTPHAGDTLRVVADIPDAEFRQQVADLKDNIHNGDIYQVVPARSFSAPCPDAFAAYLQLRATNPSPYMFYVRGLDNNRPYELFGASPESNLKFTAATGELQLYPIAGTRPRGLNADGTINDELDIRNELDMRTNAKEVAEHTMLVDLARNDLARVSVPATRRVADLLQVDRYSRVMHLVSRVTATLDPELDALDAYRACMNMGTLTGAPKLRAMELLRGVEKRRRGSYGGAVGYLRGNGDMDNCIVIRSAFVQDGVAAVQAGAGVVRDSNPQSEADETLHKAYAVLNAIALAAGSTLEVVR

SEQ ID NO: 3583 - DNA, 1869 bp, Corynebacterium efficiens
  CDS (1)..(1869)
atgcgcgtactgatcatcgacaattatgattccttcaccttcaacctcgccacgtatgtggaggaggtcaccggtgcggcaccgacggtggtgcccaatgatgcgcagatcgacgagacgctgttcgacgccgtcatcatctcacccggccccggccaccccggggtggcggcggatttcggcagctgccgcggggtgatcgaacgtggtctggtcccggtcctcggggtgtgcctggggcatcagggcatcgcgctcgcccacggcggcgcggtgggcccggcgccggtcccggtgcacggtcaggtcacccgcatccaccacgacgggtccgagcttttcgacgccatcccgccccagttcgacgccgtccgttaccactccctggtggccaccgatctgccgccggaactggaggtcaccgcgaggaccggggacgggctgatcatggcgctgcgccaccgcgagctgccccagtggggtgtgcagttccacccggaatccatcggcgggcagttcgggcaccggatcatggcgaatttcctgagcctggcgcgtcgacaagcgcaccggtgggagatcaccgagcatgtggtggagacaagcgtcgacccggcggcggtgttcgagacgctcttcgccgggtcggagcacgcgttctggctcgatgatccgcagggcaccacctatatgggtgatgcctccgggccgcatgcacggatccgcacccaccgggtgggggagggggagctgttcgactggctgcgtgatgatctgcgtcgcaaccgcgtggccccgggggtgggtttccgcctggggtgggtgggatacctcgggtatgagatgaaggccgaatgcggggtggacaatcggcacgcctcatcgcatcccgatgcccacctgatcttcgccgaccgggccatcgccatcgaacccggccgcgtgtggctcatggcgctcggtgagcagggggagtggttcgcggagatgaccgccgccctggggcagctgcgcccaccccgtgccgctgccgccccggccgcccagctcaccgtccgggatgaccgcgacagctacctggacatgatcgcccgcgcccaggagttgatcacccgcggggagtcctatgagatctgcctgaccacccagctgcgcgcggaggtggaggtggatcccctcgccgcctatctggcgctgcgggcggccaaccccacctcctatggatcattcctgcagctgggggagatggcggtgctgagctcgtcgccggaacggttcatcaccatcgacgcctccggacgtgtggaatccaaacccatcaagggcacccgcccgcggggcagtaccgagcaggaggatgcggccttgatcgccgatctcaccgacaaccccaaggaccgcgccgagaacctcatgatcgtcgacctggtccgcaatgatctcgcccgcggggcgcaaccggcaacggtgcaggtggagaagcttttcgacgtcgagacctacgccaccgtccaccagctcgtcagcaccattaccgcccagctggagggtaaggaccccattgactgcgtgcgggcggcgttccccggtggttccatgaccggtgcaccgaagatccgcaccatggagatcatcgacgagctggagaccggcccccgtggtgtctattccggtggcctgggctatttctcccttgatggggcggtggatctgtcgatggtgatccgcaccgtggtctacacccccggcgtcctggagtacggggtcggcggggcgatcctggccctgtcggaccccgccgcagagtgggaggagatccgggtgaaatcgaggcccctgctgggtctgctcggggtggagttcccgtga

SEQ ID NO: 3584 - protein, 622 aa, Corynebacterium efficiens
MRVLIIDNYDSFTFNLATYVEEVTGAAPTVVPNDAQIDETLFDAVIISPGPGHPGVAADFGSCRGVIERGLVPVLGVCLGHQGIALAHGGAVGPAPVPVHGQVTRIHHDGSELFDAIPPQFDAVRYHSLVATDLPPELEVTARTGDGLIMALRHRELPQWGVQFHPESIGGQFGHRIMANFLSLARRQAHRWEITEHVVETSVDPAAVFETLFAGSEHAFWLDDPQGTTYMGDASGPHARIRTHRVGEGELFDWLRDDLRRNRVAPGVGFRLGWVGYLGYEMKAECGVDNRHASSHPDAHLIFADRAIAIEPGRVWLMALGEQGEWFAEMTAALGQLRPPRAAAAPAAQLTVRDDRDSYLDMIARAQELITRGESYEICLTTQLRAEVEVDPLAAYLALRAANPTSYGSFLQLGEMAVLSSSPERFITIDASGRVESKPIKGTRPRGSTEQEDAALIADLTDNPKDRAENLMIVDLVRNDLARGAQPATVQVEKLFDVETYATVHQLVSTITAQLEGKDPIDCVRAAFPGGSMTGAPKIRTMEIIDELETGPRGVYSGGLGYFSLDGAVDLSMVIRTVVYTPGVLEYGVGGAILALSDPAAEWEEIRVKSRPLLGLLGVEFP

SEQ ID NO: 3585 - DNA, 1557 bp, Bifidobacterium longum
  CDS (1)..(1557)
atgagcgaatgcagcgtcaaacacctgaagtggggcgccacctggcccagtcgcgaacagttccacgaactggccgacgccggataccgtgtgattccgattgtgcgccgtctgctcgccgactcgctcaccccggtcggcttctacgagcgtctcgccggcggccgatccggcaccttcatcctcgaatcggcggaatacggcggcacgtggagccgttacagttttatcggcgtcaactcgatggcccagctgcgctccaacaacggtcaggccgactggctgggcaaggtcccggtcggcgtgcccgtcaccggtgacgtagtcgaagtcgctcacgccacgttgaagactctgaaggccccgcatgtggaaggcctgccgaacctgaccagcggtctggtcggcacggtcggctgggatgccatccgccactgggaaccgaccctgcgcgccgaagctccggacgagaccggccagcctgagaccgtgcttgccctggccaccgatatcgccgtggtcgaccacgtatccggttcggtatggctcatcgccaatgcggtgaatgtggatgataaatccactcgcgccgacgctgcctacaacgaggccgtcgctcgactcgaccagatgcagcgcgatgccgccaccccggctccggacgagtctcgcgtcaacatcctggacgaaacggtcgcccaacccgagctgcgcttccgcaccgagaagagccactacgagcaggccgtcgaacgagccaagcagtacatcgtcgacggcgacgtgttccaggtggtcatctcccagcgcctcgacatcgattcgcctgctgacccgttcgacgtgtaccgtgtgttgcgcacgctgaacccgagcccgtacatgtatttcatggcgttgaccgacgctcagggccgcgacttcaacgtgatcggctccagcccggaaaccctcatcaaggtggacaacggccacgcgatgaccttcccgattgctggatcccgccctcgcggcgccacccctgaggaagacgagaaattcgccaaggagctgcttgccgatccgaaggaatgcagcgagcacatcatgctcgtcgacctgtctcgcaacgacctgagtaaggtgtgcgtgccgcagtccgtggaagtcgtgcagctcatggacatcaagcgtttcagccacatcatgcacatctgctcgacggtcaccggcaaggtcgacccctcgctgaccgcattcgatgtgttcaagtccgcgttcccggccggcacgctgtctggcgcgcctaagccgcgcgcagtcgaaatcatcgacgagttggaaccggccgaccgcggcatctacggcggcaccgtcggctacttcgatttctccggcaacatggacatggccatcgccatccgcaccgcgttcctgcgcgaccatgaggcgagcgtgcaggccggtgccggcattgtgctcgactccgtgcccgccaccgaatggcaggagacgcgcaacaaggccgaggccagcgtcgaatccatccagatcgccgcccagttgcgcgaactgtaa

SEQ ID NO: 3586 - protein, 518 aa, Bifidobacterium longum
MSECSVKHLKWGATWPSREQFHELADAGYRVIPIVRRLLADSLTPVGFYERLAGGRSGTFILESAEYGGTWSRYSFIGVNSMAQLRSNNGQADWLGKVPVGVPVTGDVVEVAHATLKTLKAPHVEGLPNLTSGLVGTVGWDAIRHWEPTLRAEAPDETGQPETVLALATDIAVVDHVSGSVWLIANAVNVDDKSTRADAAYNEAVARLDQMQRDAATPAPDESRVNILDETVAQPELRFRTEKSHYEQAVERAKQYIVDGDVFQVVISQRLDIDSPADPFDVYRVLRTLNPSPYMYFMALTDAQGRDFNVIGSSPETLIKVDNGHAMTFPIAGSRPRGATPEEDEKFAKELLADPKECSEHIMLVDLSRNDLSKVCVPQSVEVVQLMDIKRFSHIMHICSTVTGKVDPSLTAFDVFKSAFPAGTLSGAPKPRAVEIIDELEPADRGIYGGTVGYFDFSGNMDMAIAIRTAFLRDHEASVQAGAGIVLDSVPATEWQETRNKAEASVESIQIAAQLREL

SEQ ID NO: 3587 - DNA, 1482 bp, Streptomyces globisporus
  CDS (1)..(1482)
atgaccgaccagtgcgtggtctcggccccggtgcgggtgcggacacgacgcctcgatgtgaaggagacgggcgccctgcccgcctaccgcgcgctggccgagcacttcggccccgacgaggtctacctcctggagtccgcggccggcccggcccgcgaccgcaggcaccagttcgtcggcttcggcgcgctgctctcgctctcggtcaccgaccgggtggtgcgcgtcgagggcgtacccgccctgcggggcctgctcctggagcgggccggcgcgctcctggaggacggcccccaggggctgcggctgcgtaccgcgggcgggttgtggccgctgctgcgggccatgcgggacatgttcgacgccgaggggtccgcgtccggcttccgcttcgggttcctcgggttcttcgggtacgacacggcccgctacatcgaggacctgccccacctcatcgagaaccggcctggcctgccggacgtacgcatggtcctgcaccggggcagcgtggtcaccgatctcgccaccggccgatgcgaactgctgctccacgagtccccgtactggcccggcctcgcgccggagaccgtcaccgggctcctcgccgacgtggagcaggcctggcccgatccgtccgcagacggcttccccgcctccgcggtcaccgacgacagcgcccccgaagtgttcgcgaacgacgtcgagcggtgtctgaagcacatcgccgtcggcgacatctaccaggtgcagatcggtcacgagctctccatccgctcgacggccgaccccgcggacgtctaccagcgcctgcgcgggcggaacgcctccccgtacatgtatctggcgggcatcgacgggcaccgtctgatcggcgccagccccgagctgttcgtacgcatcgaggacggcgaggtcacgatgcggccgatcgcgggcacggtgccgcggtccggcgcggacggcggcatcgccgcgggagtccggctgaggtcggatcccaaggagatcgccgagcacaccatgctggtggacctctgccgcaacgacatcggacggatcgcccggccgaacacgctcgacgtacccgaccagctggacgtggagggctactcccacgtgctgcacctggtctccacggtcgtcggccgggcgcgggtggacaccgatgccttcgacaccatcgccgccctgttccccgccggcaccatgacgggcgcgccgaagatccgcgccatggagatcatcgagtccgtcgaacgcagccgccgcggcctgtacgccggggcgctcggcctcctcgacgtgggcgggtacaccaacctcgcgctgtgcatccggacccttttccaccacgagggcgtctaccgcacccgggcctcggccggaatcgtcgccgattccgaaccgggggcggagtggaccgagacgctggccaagatgagcgccactcactgggcggtcaccggagaggagttgctgtga

SEQ ID NO: 3588 - protein, 493 aa, Streptomyces globisporus
MTDQCVVSAPVRVRTRRLDVKETGALPAYRALAEHFGPDEVYLLESAAGPARDRRHQFVGFGALLSLSVTDRVVRVEGVPALRGLLLERAGALLEDGPQGLRLRTAGGLWPLLRAMRDMFDAEGSASGFRFGFLGFFGYDTARYIEDLPHLIENRPGLPDVRMVLHRGSVVTDLATGRCELLLHESPYWPGLAPETVTGLLADVEQAWPDPSADGFPASAVTDDSAPEVFANDVERCLKHIAVGDIYQVQIGHELSIRSTADPADVYQRLRGRNASPYMYLAGIDGHRLIGASPELFVRIEDGEVTMRPIAGTVPRSGADGGIAAGVRLRSDPKEIAEHTMLVDLCRNDIGRIARPNTLDVPDQLDVEGYSHVLHLVSTVVGRARVDTDAFDTIAALFPAGTMTGAPKIRAMEIIESVERSRRGLYAGALGLLDVGGYTNLALCIRTLFHHEGVYRTRASAGIVADSEPGAEWTETLAKMSATHWAVTGEELL

SEQ ID NO: 3589 - DNA, 1686 bp, Streptococcus pyogenes
  CDS (1)..(1686)
atggtagccaagtccttagatcaggtcggtccagtcattgaaaacgtacaacactaccaacagctgggctattacgtggtgggctatctcagttacgaagcaactgctttttttgacaatgccttacaaacccataatgacagactaggcaacgagtaccttgcctattttacggtgcacaaaacctgtcaaaaaaaagacctacctcttgattatgacagcattactatccctaaccaatgggtcagcctcactcaaaaagaagcctatcaaaaagccattgaaaccattcaccatgagatgcgacagggcaatacttatcaggtcaactatacccttcaattaactcaggaactcaatgcagctgacagcttagccatttacaataaactcgtcattgaacaggccgctggctacaatgcctatatcgcccatgatgactttgctgttatttcggctagtcctgagttgttctttaaacaagagggcaacaggttaactacaagacctatgaagggtaccaccaagcgtggggttaatagctggctggatcaacaagaacatgactggctccaaactgatgggaaaaatcgctctgaaaacatgatgattgtggatttgctccgcaatgacatggggaaaatttgccaaacaggcagtgtttgtgtcgataggctctgtgaggtcgagcgatactctaccgtctggcaaatgacctcaactattgttggtgacctcaaagcggactgtgacctgatagacattctcacagctctctttccttgtggctctatcacgggggctcctaaagtctccaccatggcaattatcacatctctggagccaaaaccaagggggatttattgtggaagtattggcatttgcctacctgatggtcgccgtttcttcaatgttcccattagaaccatccagctcagtcataatcaagctacttatggtgtcggaggcggtatcacttggcaaagcaagtgggaagacgaatacgaagaagtccagcaaaaaacaacttttctctatcggcacaaacaaatctttgacctcaaaacaaccgccaaggtggaacaccaaaaaatagccttccttgagcaacacctcaatcgccttaaagaagcagccacttattttgcttacccttataatgaaaaagctttgcagaaacaactagcaacctatttggaaaataaggataatgctgcctaccgcttgatgattcgtttatccaaagatggaaagattagcctctctgatcaacctttggagcctttatcagccgattttctgacagctcaactctccttacaggacaaggacgtgacagcttcgccttttacctactttaagaccagctaccggcctcatattgagcaaaaatcttatgaacagctattctataaccaagcggggcaattattggaaacgtccattggcaatctctttgttcagctgggtcagaccctctacacaccaccagtggctgtggggattttaccaggactttttcgccaagaactgctagctactggtcaagctcaggaaaaagaggtgacactagctgatttaaaagaggctagcgctatttttggaggaaatgctgtccgtggcctctatcctctcaaccttgagcttactcaccttgatgccctcttaactaagagtcaagcctaa

SEQ ID NO: 3590 - protein, 561 aa, Streptococcus pyogenes
MVAKSLDQVGPVIENVQHYQQLGYYVVGYLSYEATAFFDNALQTHNDRLGNEYLAYFTVHKTCQKKDLPLDYDSITIPNQWVSLTQKEAYQKAIETIHHEMRQGNTYQVNYTLQLTQELNAADSLAIYNKLVIEQAAGYNAYIAHDDFAVISASPELFFKQEGNRLTTRPMKGTTKRGVNSWLDQQEHDWLQTDGKNRSENMMIVDLLRNDMGKICQTGSVCVDRLCEVERYSTVWQMTSTIVGDLKADCDLIDILTALFPCGSITGAPKVSTMAIITSLEPKPRGIYCGSIGICLPDGRRFFNVPIRTIQLSHNQATYGVGGGITWQSKWEDEYEEVQQKTTFLYRHKQIFDLKTTAKVEHQKIAFLEQHLNRLKEAATYFAYPYNEKALQKQLATYLENKDNAAYRLMIRLSKDGKISLSDQPLEPLSADFLTAQLSLQDKDVTASPFTYFKTSYRPHIEQKSYEQLFYNQAGQLLETSIGNLFVQLGQTLYTPPVAVGILPGLFRQELLATGQAQEKEVTLADLKEASAIFGGNAVRGLYPLNLELTHLDALLTKSQA

SEQ ID NO: 3591 - DNA, 1887 bp, Chlorobium tepidum
  CDS (1)..(1887)
atggctcgaagaggtgctcgggaaacccattctgatcgaagcccgcgtccggtaatggctttgtacgaaaagcttgctagtccgggatcgctctggtttgaatcgaccttgcccggcgcgctctacggcgattccctctttttctccgatccgctcgaaacgctgacgctccatgcgggcgacagcgtcgcgccgtggttcgccacgctggagtcgcggctcgacgcaggcctctgcctcgctggatggctcagctatgaggcgggttacctgctcgatccggcactcgcggctctcgcatctgccggggctgatcgcgagcttcttggctggttcggcgtctatggtcgcccggagcgcgtccgccgcgaaacggttgaggccgaggacgcggcggcagcggcgcggagctgcgcagtcagcggattcggtttcgagttcagcgaggcggagtattgcgagcgcatcgacagacttcggactgagatcgcggcgggcaacgtctatcaggcaaacttcaccgggcgctgccgcttcagcttcgacggtgctgtcgaagcgctttacgtcaagatgaagcgtcgccaaccctcgccgtggtcggccttcctcaacaccggcgaccgtcagattctttccttttcccctgaactctttttcgccagcgatggccgcttgatcgaaaccatgccgatgaagggcaccgcgccgcgccgcgagcggcccgaagaagacctcgccgaaaaggcggggctggcaaagtgtgagaagaaccgcgcggagaacctgatgatcgtcgatctgttgcgcaacgacctggggcgcatctgcgcgaccggctcggtgcaggcctccgggctgttcgagacgcagacctatccgacgctgcaccagatggtttcgaccgtgcgtggcgagctgcgtccggcgacccggctgcacgatcttttccgggcgctgtttccctccggctccgtgaccggtgcgccgaaggtgcgggcgatgcagctcatctgcgagttggaaaaaagcctgcgaggggtttacaccggcgcggtcggtttcatgctgcccgaagggcgtatggccttcaacgtggcgatccgtaccatcgaactgcgagggcagagcggtgtttacggtacggggagcggcatcgtctgggactccgacccgcacgcggagtttcgcgaatgtatgctcaagacgcggattctcgccgacctcgtgccgccctccgatccatcggttccgggcattttcgagacgatgcaatggaacggcggggagttcctgctggctggcgaccatctcgaccggctcgtttcgtccgccatggcgctcggatttacgttcgaccgcgccgctatcgccgaggcgctgtctgccaaggaacgcgagttgaggaaaaacggtggcaggcatcgcgtgcggcttacactttctcacgacggtgggattttgataacttcggagccgttcgatttcgatgcatccggcaagtccgtccgggtctgcattgccgccgagcgggtcgattcgcgcgatccgctgcttcggcacaagagcgtcgctcgcgagcggtacgatcgcgccttgcgcgaggcgcgggagcgtggattcggcgaagtactgtttctgaacgagcgcaacgaagtcaccgaaggggcgatcagcaatgtgctcgcccgcatcgacgggcgctggctgacgccgccggagtcgtgcggactgctcaatggtgttttccgccgctacctcctgcgctcgcgcccgtggatcgtcgaaaaagcgtttacccttgacgatctgcaccgggccgatatggtgttcgtttgcaactcactgcgcggcgtgcgcccggtggcgatcgtctttccggaataa

SEQ ID NO: 3592 - protein, 628 aa, Chlorobium tepidum
MARRGARETHSDRSPRPVMALYEKLASPGSLWFESTLPGALYGDSLFFSDPLETLTLHAGDSVAPWFATLESRLDAGLCLAGWLSYEAGYLLDPALAALASAGADRELLGWFGVYGRPERVRRETVEAEDAAAAARSCAVSGFGFEFSEAEYCERIDRLRTEIAAGNVYQANFTGRCRFSFDGAVEALYVKMKRRQPSPWSAFLNTGDRQILSFSPELFFASDGRLIETMPMKGTAPRRERPEEDLAEKAGLAKCEKNRAENLMIVDLLRNDLGRICATGSVQASGLFETQTYPTLHQMVSTVRGELRPATRLHDLFRALFPSGSVTGAPKVRAMQLICELEKSLRGVYTGAVGFMLPEGRMAFNVAIRTIELRGQSGVYGTGSGIVWDSDPHAEFRECMLKTRILADLVPPSDPSVPGIFETMQWNGGEFLLAGDHLDRLVSSAMALGFTFDRAAIAEALSAKERELRKNGGRHRVRLTLSHDGGILITSEPFDFDASGKSVRVCIAAERVDSRDPLLRHKSVARERYDRALREARERGFGEVLFLNERNEVTEGAISNVLARIDGRWLTPPESCGLLNGVFRRYLLRSRPWIVEKAFTLDDLHRADMVFVCNSLRGVRPVAIVFPE

SEQ ID NO: 3593 - DNA, 1515 bp, Chlorobium tepidum
  CDS (1)..(1515)
atgatcagatctttttcggacaatacggccgacccggcaaaggagccgtcttttattctgacccctctggtcagaacctttcaggctgatacggaaaccccggtgtcggtgtacctcaaactccagcgcccttactcctgcctgctcgagtcggtcgaaggggaggagcgtatggcccgttattcctatatcgccgtcgatccggtagccgtactcaaggggacggttggcggagagattttgcttgacgttcgtgacgagcgtttccgccagttgtctgccattgttgaacaggagcgtgaccttcgcgccgtcgtggatcgctgcatggcgatgttctcctccgaaaagctgcctcgccacaagagcggttcgcagcagatgagcacctccggtgtgttcggttatttcggttacgacaccatgcacctcatcgaaaagattcccgccgccgagcagcccgatccggcagggatgccagacctttgcttgcttttctgcgacacgctcgtcatctttgacaacgtgatgcgcaagctctttctcgtgaccaactatctcgacgccgccgaccgcacgcgcgccgaccgcaaaatcgacgagcttgccgcactgttgcagaagccgctcgtgcctgctctcgtgccgtttcagcccgagaaaccggagccggtcatctcgaacaccacgcgtgacgagtattacgccaaggtgctcaaggccaaggagtacattctgagcggtgacatcttccaggtgcagatttcgcagcgcctgaagcgcaagctgcacacccgtccgttcgacgtctatcgcgcgctccggacgatcaacccttcgccttacctctacttctttgacttcgaggattttcatgtcgtcggctcatcgcccgagctgctggtcaaggtagagcgcgaccacaccggacgccgcatggtcgatacccggcctatcgccggaacgcgacggcgcggcgagagcttcgaggaggacgagcgcaacgccaaggagctgatctccgacgaaaaggagcgggccgagcacctgatgctcatcgacctaagccgcaacgacatcgggcgcatcgccaagatcggcacggtcgagaccaacgagatgatggtgatcgagaagtactcgcatgttatgcacatcgtcagcaacgtccggggtgaattgcaggacggtctgacggcgatggacgccttctggtcgtgcttcccggcgggaacgctgaccggcgcgccgaaggttcgcgccatggagatcatctacgagctggagaaagagaagcgcggcctttacggcggcgcggtgggctacctcgatttccgggggcagctcaacactgccatcgctatccgcacgatggtgatccgcgacggcgttatctacttccaggcggcgggcggcatcgtggccgattcgacgccagaatttgaatacgaagagaccatgaacaagatgagagcaggcctgacggctcttgaaagtattgagacctttgtctga

SEQ ID NO: 3594 - protein, 504 aa, Chlorobium tepidum
MIRSFSDNTADPAKEPSFILTPLVRTFQADTETPVSVYLKLQRPYSCLLESVEGEERMARYSYIAVDPVAVLKGTVGGEILLDVRDERFRQLSAIVEQERDLRAVVDRCMAMFSSEKLPRHKSGSQQMSTSGVFGYFGYDTMHLIEKIPAAEQPDPAGMPDLCLLFCDTLVIFDNVMRKLFLVTNYLDAADRTRADRKIDELAALLQKPLVPALVPFQPEKPEPVISNTTRDEYYAKVLKAKEYILSGDIFQVQISQRLKRKLHTRPFDVYRALRTINPSPYLYFFDFEDFHVVGSSPELLVKVERDHTGRRMVDTRPIAGTRRRGESFEEDERNAKELISDEKERAEHLMLIDLSRNDIGRIAKIGTVETNEMMVIEKYSHVMHIVSNVRGELQDGLTAMDAFWSCFPAGTLTGAPKVRAMEIIYELEKEKRGLYGGAVGYLDFRGQLNTAIAIRTMVIRDGVIYFQAAGGIVADSTPEFEYEETMNKMRAGLTALESIETFV

SEQ ID NO: 3595 - DNA, 1832 bp, Acinetobacter baumannii
  CDS (321)..(1637)
cgcgtgtacgtaatactggtgaagccccacgtcctaagacgatgtttgagccaggtgaagaattacttgttattgacggtccattcacagactttaaaggtgtggtggaagaggttcaatacgataagtcacgtttaacgttgacgattaacgtgtttaatcgaccaactcaggttgaactcgaatttcgccaagtcgaaaaaacgatttaatcttaattggttgaaaagcgcccgattttatcgggcattgttgttgtaacagtattgttacgtagaaattggggagcctaacggcgtttgtacccagaggtatttaaaatggctaagaagattgacggctatatcaagctgcaagttccagctggtaaagcaaatccatctccaccgattggtcctgcactaggtcaacgtggtgtaaacatcatggcgttctgtaaagaattccaaaaacaatttaaagttcctacggctaaactcttaccagacttaccaagttttacgggcggcttggtgggttatttgggctacgatgctgtccgctacatcgagccacgtttaaagaatgtacctgcggctgatccgattacgctgccagatttatggttgatgctctcaaagacagtcattgtttttgacaatcttaaagatacgctatttttaattgtgcatgcggatacagagcagagtaatgcttatgaagacgctcaacaaaaattagatcaattagaacagttgttggcgactccagttagtttgcaagcgcgaccacatacgcctccgcattttgaatcaattactggtaaagcaaaattcttagagacggtagagaaggttaaagaatatattcgtgcaggcgatgtgatgcaggttgtacctgggcagcgtatggtttctgattttgatggagaagctttacaggtttaccgtgcattacgtcatttaaatccatcaccttatctattcttggttcaaggacaaacgattactgataaaaaaccatttcatattgttggttcatcaccggaaattttatctcgtttagaaaatggtattgctacagttcgacctttggcaggaactagaccgcgcggtaaaactaaagaagaagatatagcattagaaaaagatttgctttctgatgaaaaagagattgctgaacatttaatgctgattgatcttgggcgaaacgatgtagggcgcgtatcaaaaataggtaaggtccaagttacggatcaaatggtgatcgagcgctattcacatgtcatgcatattgtttcaaatgtacaaggtgaagtgcgtgatgatatcgatgcacttgatgtatttaaagccacctttccggcaggaacgttatcaggtgccccaaaaattcgtgcaatggaaattattgatgaagtagagcctgtgaaaagaggagtttttggcggggctgttggttatttgggatggcatggtgaaatggatatgtcgattgcaatccgtacttgtgttatccgtgacaaaaaggtgtatgtacaggctggtgcagggctagttgctgactcaaatccagaatctgagtggaatgaaacccaaataaaagctcgcgcagtgatcaaagcggttgaattatcatcaaacggattgattttatgagtttttagcggtttttttaaaaaaaccgcttgcatcgtttggaagttttgctaaactgcacaccgttccgatacgaaacgtacgaaacactaagaaacgccggcatagctcagttggtagagcaactgacttgtaatcagtaggtccacagttcgaatccgtgtgccggcaccattttaaagtgttaagttaatt

SEQ ID NO: 3596 - protein, 438 aa, Acinetobacter baumannii
MAKKIDGYIKLQVPAGKANPSPPIGPALGQRGVNIMAFCKEFQKQFKVPTAKLLPDLPSFTGGLVGYLGYDAVRYIEPRLKNVPAADPITLPDLWLMLSKTVIVFDNLKDTLFLIVHADTEQSNAYEDAQQKLDQLEQLLATPVSLQARPHTPPHFESITGKAKFLETVEKVKEYIRAGDVMQVVPGQRMVSDFDGEALQVYRALRHLNPSPYLFLVQGQTITDKKPFHIVGSSPEILSRLENGIATVRPLAGTRPRGKTKEEDIALEKDLLSDEKEIAEHLMLIDLGRNDVGRVSKIGKVQVTDQMVIERYSHVMHIVSNVQGEVRDDIDALDVFKATFPAGTLSGAPKIRAMEIIDEVEPVKRGVFGGAVGYLGWHGEMDMSIAIRTCVIRDKKVYVQAGAGLVADSNPESEWNETQIKARAVIKAVELSSNGLIL

SEQ ID NO: 3597 - DNA, 1356 bp, Xanthomonas campestris
  CDS (1)..(1356)
atgacgctgacccgaccactgcacgcggacatcgacctgctggcgctgcatcgcctggcaccgcagcggtatcccgcgttgctggaatccagcgcgtcgggcaccgcgcacgggcgttgggatgtgttgctgctggcgcagggcgcgcagctgcgtctggacccggacggctgcacccgcaatggtgacggccaactgctggaaggcggctttctcgacgccctggatgcagcctggcaggccgagcggctgccgcacgagggcgaaagttcttggccgtttcgcggtggctgggcggtgctgctggactatgaggtggccgcacaggtcgagccgatcctgcgcctgcccatgcgcagcgacgccgcgcccgcggcattggccctgcgggcgccggcggcagtgctgcgcgaccgcatggacgggcgctgcttcgccgtggccgagccggggcgcgaagacctgctgcagcagattgacgacgacatcaccgcctgcgccagcctgccagccttgcctgcctgggcagcgccgacggtggtgcaggaagacccgcctgagcaattcaccgatgcggtgctgcgggtgctggactatttgcgtgccggcgatgtgttccaggccaatatctcgcgcgcctggcaggcgcagttcgatcggcccgtcgaccctgccgccttgcatgcgcggctgcgtgcggccaatccggcgccgttttccggcctgtttgtggcggccgggcgcgcgatggtgagttcttcgccggagcggttggtgtcggtgcacgggcgagtagtgcagacccggccgattgccgggacccgtgcacgctttgccggtgacgatgatgccgcgcgcatccgcgagctggtcggtcacccgaaggaacgcgccgaacacgtgatgctgatcgacctggagcgcaacgacctgggccgcatctgcgcgccgggcagcgtggaggtggacgaactgatgggcgtagagagctatgcgcacgtgcatcacatcgtcagcaatgtccgcggccggttgcggcagggcgtcacccctggcgaggtgattgcggcggtatttccgggcggcaccatcaccggctgcccgaaggtgcgctgcatgcagatcattgccgagctggaacagaccgcgcgtggcgcctataccggcgcgttcggttggctcaaccgcgacggcgacatggatctgaacatcctgatccgcaccgccgaagtggccggcagccaggtacggttccgcaccggtgctggcatcgtggtggactcggacccgcagcgggaactggacgaaacccgtgccaaggcgcgcgggctgctgcgtgcgctggacccggcatga

SEQ ID NO: 3598 - protein, 451 aa, Xanthomonas campestris
MTLTRPLHADIDLLALHRLAPQRYPALLESSASGTAHGRWDVLLLAQGAQLRLDPDGCTRNGDGQLLEGGFLDALDAAWQAERLPHEGESSWPFRGGWAVLLDYEVAAQVEPILRLPMRSDAAPAALALRAPAAVLRDRMDGRCFAVAEPGREDLLQQIDDDITACASLPALPAWAAPTVVQEDPPEQFTDAVLRVLDYLRAGDVFQANISRAWQAQFDRPVDPAALHARLRAANPAPFSGLFVAAGRAMVSSSPERLVSVHGRVVQTRPIAGTRARFAGDDDAARIRELVGHPKERAEHVMLIDLERNDLGRICAPGSVEVDELMGVESYAHVHHIVSNVRGRLRQGVTPGEVIAAVFPGGTITGCPKVRCMQIIAELEQTARGAYTGAFGWLNRDGDMDLNILIRTAEVAGSQVRFRTGAGIVVDSDPQRELDETRAKARGLLRALDPA

SEQ ID NO: 3599 - DNA, 1356 bp, Xanthomonas axonopodis
  CDS (1)..(1356)
atgacgcttacccgatcactgcacgcggacatcgacctgctggcgctgcatcggctgtcaccgcaacgctatccggccctgctggagtccagcgcttccggcaccgagcatggtcgctgggatgtgctgctgctggcagaggggccatgcctgcggctggatccggacggatgtacgcgcgatggcgctgggcggttgctggagggcggctttctggcggcgctggatgccgcctggcaggccgagcgcgtgccgcacgacgcggcaagcccatggccgtttcgcggcggttgggcagtgctgctggattacgaacttgccgcgcaggtcgagccgattctgcaactgcccacgcgccgcgacggcgtgcccaccgcgctggccttgcgcgcgccggcagcggtgctgcgcgatcgcctgcacgggcgctgtgtggcgctggcagagccgggccgcgaggagttgttgcagcagatcggcgacgaccttgctgcctgcgctgcactgccgccgctgcctgcctgggccgggccgcttgcggtggacgaagaggcccccgagcgttttaccggggcagtggagcgcgtgctcgattacctgcgtgccggcgatgtcttccaggccaatatctcgcgcgcctggcacgcggcattcgctgcggtggtcgatccggccgcgttgcatgcgcgcctgcgtgcggccaatccggcgccgtttgccggcctgttcgttgccgccgggcgtgcagtggccagttcctcgccagagcggctggtctcggtacagggcgatgtggtgcagacgcgcccgatcgccggcacccgcgcgcggtttgccggggacgacgatgccgcacgtatccgggagctggtcgggcatccgaaggagcgcgccgagcacgtgatgctgatcgatctggagcgcaacgacctgggccgcatctgcgcgccgggcaccgtggaggtggacgagttgatgtgcgtggagagctatgcgcatgtgcatcacatcgtcagcaacgtgcgcgggcgtctgcgcgccggggtaacgcccggtgaggtgattgccgcggtgtttcccggtggcaccattaccggttgcccgaaggtgcgctgcatgcaggtcatcgccgagctcgaacaaactgcgcgcggggcctataccggtgcattcggctggctcaatcgtgatggcgacatggatctgaatatcctgatccgcaccgccgaggtggccggtcaccatgtgcatttccgcaccggtgccgggatcgtggtggattcggatccgcagcgcgagctggatgaaacccgcgccaaggcgcgtggcgtgttgcgtgcgatcgagcagacatga

SEQ ID NO: 3600 - protein, 451 aa, Xanthomonas axonopodis
MTLTRSLHADIDLLALHRLSPQRYPALLESSASGTEHGRWDVLLLAEGPCLRLDPDGCTRDGAGRLLEGGFLAALDAAWQAERVPHDAASPWPFRGGWAVLLDYELAAQVEPILQLPTRRDGVPTALALRAPAAVLRDRLHGRCVALAEPGREELLQQIGDDLAACAALPPLPAWAGPLAVDEEAPERFTGAVERVLDYLRAGDVFQANISRAWHAAFAAVVDPAALHARLRAANPAPFAGLFVAAGRAVASSSPERLVSVQGDVVQTRPIAGTRARFAGDDDAARIRELVGHPKERAEHVMLIDLERNDLGRICAPGTVEVDELMCVESYAHVHHIVSNVRGRLRAGVTPGEVIAAVFPGGTITGCPKVRCMQVIAELEQTARGAYTGAFGWLNRDGDMDLNILIRTAEVAGHHVHFRTGAGIVVDSDPQRELDETRAKARGVLRAIEQT

SEQ ID NO: 3601 - DNA, 1476 bp, Xanthomonas axonopodis
  CDS (1)..(1476)
atgatcactgcagagcagttccagcgccaggccgctgaaggtcacacccgtattcccgttgtccgcgaagtgttgtccgacctggacacgccgctctcggtctacctgaagctcgccgacggcgcctatacctatctgttcgaatcggtcgaaggcggggagcgcttcgggcgctactccatcatcggcctgccggcgcggcgcgtgtacagctttcggggccacacgctggaggtcagcgaacacggcgaagtcgtcgagacccgtgaggtcgccgacccgctggccgaagtcgatgcgttgcgggccgaacattcggtgccgcagctggatgggctgcccggcttcaccggcgggctggtcggctggttcggtttcgagtgcatccaatacatcgagccgcgcctggggagtggcgacaagcccgacgaactcggcacgccggacatcctgctgatgctctccgaagagctggcggtgttcgacaatctcaagggccgtctgtacctgatcgtgcatgccgacccgcggcagccgcaagcctatgtgcgcgccaatcggcgcctggacgagctggcgcatcgcctgcgtcagggcggcgccggttacccgcaggcgcagatttccgatgcgatcgacgaagcggacttccattcctcttttacccgcgaggaatatcacgccgtggtgcgcaaggcgcaggaatacgtgcgtgccggcgatatcttccaggtagtgccatcgcaacgcttgcgcgtgccgttccgcgcgcgcccggtggatgtgtatcgcgcgttgcgtgcactgaatccgtcgccgtacatgtattttctcgatgtcggcggtacccaggtggttggttcgtcgccagaaattctggcgcgcctgcgcgatggcgtggtcactgtgcgcccgatcgccggcacccgcccgcgcggcgccacgcccgaactggacaaggcactggaagccgaactgctggccgacccgaaggaacgcgccgagcacgtgatgctgatcgatctgggtcgcaacgatgtcggccgcgtggccgaaccgggcacggtcaaggtcggcgagcagttcgtgatcgaacgctatagccatgtcatgcacatcgtcagcgaggtgaccggcaccctgaaagccggcctgaattatagcgacgtgctgcgcgccaccttcccggccggcactgtcagcggcgcgccgaagatccgcgcgctggaaatcatccgcgagctggagccggtcaaacgcaacgtgtattccggcgcggtcggctatatcggctggcatggcgatgccgataccgccatcgccatccgcaccgccgtcatccaggacggttacctgtatgtgcaggccggcggcggcgtggtctacgactccgaccccgacctggagtggcaggaaaccatgaacaaggggcgtgcgctgtttcgcgcagttgcccaggcggcgaagggcctgtga

SEQ ID NO: 3602 - protein, 491 aa, Xanthomonas axonopodis
MITAEQFQRQAAEGHTRIPVVREVLSDLDTPLSVYLKLADGAYTYLFESVEGGERFGRYSIIGLPARRVYSFRGHTLEVSEHGEVVETREVADPLAEVDALRAEHSVPQLDGLPGFTGGLVGWFGFECIQYIEPRLGSGDKPDELGTPDILLMLSEELAVFDNLKGRLYLIVHADPRQPQAYVRANRRLDELAHRLRQGGAGYPQAQISDAIDEADFHSSFTREEYHAVVRKAQEYVRAGDIFQVVPSQRLRVPFRARPVDVYRALRALNPSPYMYFLDVGGTQVVGSSPEILARLRDGVVTVRPIAGTRPRGATPELDKALEAELLADPKERAEHVMLIDLGRNDVGRVAEPGTVKVGEQFVIERYSHVMHIVSEVTGTLKAGLNYSDVLRATFPAGTVSGAPKIRALEIIRELEPVKRNVYSGAVGYIGWHGDADTAIAIRTAVIQDGYLYVQAGGGVVYDSDPDLEWQETMNKGRALFRAVAQAAKGL

SEQ ID NO: 3603 - DNA, 1839 bp, Methanosarcina mazei
  CDS (1)..(1839)
atgctttcctttgacattggggaagaagagtttaagagacttgtatcagggcttgaaaaaccaggtcttatccagctccttgcaaaagtggattcaaatttttctcgttcctgttctcctctcgatctttatcaaatactgaaaaaatctggatgttcaggaggttcaggatactcctaccttctcgaatccgtggaaaaacaggcgagcaaagcaaggtattcttttgttggaaattccccggattctctcctgacaattaacgacaggaagctttcccttgaactccttaacccgaatgcctctgatttttttgaagaaatagtctcaaaagtgaaaaaagtatgctcagccggaacaggagaagaagtagaagaagtagctaaagaaaaagagaaagaaaacaaaaacaaaaacaaaaaacgtggagaagaaaataatgcagaagaggataatgcagaagagaatactgaagtgcgaaaactccgaaaattcacggcctctatcccggaaggaaaagactcttttgatgcacttcgcctggtttttcctccggcaaacgggattgagttcctcaatgaaaagcgctttgaaaggcagacttttctcggaggagctatcgggtacacggcttatgatgcagtttatgacagctggcttggggctgataagggctttgaatccgaaatcccggaacttcagtaccttctggtcacgaaaagttatgttttcgaccacctgaccgaagaggtctatatcgtggtcactccctttataaatccagactcggatacaggaaaaatatatgaagaagccctttcagaggcagaaaaactttattcagctatcagggaagtttccctgtatgaaagtacaggaaaagcagcatttctgaatcggttagcaggaccacaatcaacagaattacagccaacgaaattacagtcagcagaattacaatcaacagcgtcaaactcaacaggattacagttggaagggtcaggttcacctttacaggtctgcagttctgacagatctgagtttgaaacttctgtactcagggcaaaagaacacatttttgcaggggatatcttccaggctgtcctgtccagaaaatgtgagttcaggcttgaacagcctccattcgagctttatgcacagctcagggcgataaaccccagtccttatatgtatattttcgagttcggagacctggcaatagtgggggcaagccctgaaaccctgatgactgtacataagcgtacagttatgataaatcccattgcaggcacatgcccaagggggaaatccgaagttgaagatgaaatactggcttcccatatgctcaatgatgaaaaagaaagggcggaacatgtaatgctggttgacctggggagaaacgatgtccgcatggtttgcgaaagcggctccgtaaaagtttcaggatttatgaaagtcctcaagtattctcatgtacagcacatagaaagtacggtttcgggaaccctgaggcctgaatgcgaccagttcgatgccttcagggcaatctttcctgcagggaccctttcaggagctccgaaaatcagggcaatggagattatttccgaacttgaaacagccccgagggggatttacggcggtggagtcgggtattacagctggaacggggacgctgattttgcaatagtgataagaaccctgcttatacaggggaaaaaggtttcattacagtcaggggcagggattgttgcggattccgatcctgcatatgagttcagggaaacagaaaggaaaatggcagcaatgcttacagctataggtggagaaactgagctctga

SEQ ID NO: 3604 - protein, 612 aa, Methanosarcina mazei
MLSFDIGEEEFKRLVSGLEKPGLIQLLAKVDSNFSRSCSPLDLYQILKKSGCSGGSGYSYLLESVEKQASKARYSFVGNSPDSLLTINDRKLSLELLNPNASDFFEEIVSKVKKVCSAGTGEEVEEVAKEKEKENKNKNKKRGEENNAEEDNAEENTEVRKLRKFTASIPEGKDSFDALRLVFPPANGIEFLNEKRFERQTFLGGAIGYTAYDAVYDSWLGADKGFESEIPELQYLLVTKSYVFDHLTEEVYIVVTPFINPDSDTGKIYEEALSEAEKLYSAIREVSLYESTGKAAFLNRLAGPQSTELQPTKLQSAELQSTASNSTGLQLEGSGSPLQVCSSDRSEFETSVLRAKEHIFAGDIFQAVLSRKCEFRLEQPPFELYAQLRAINPSPYMYIFEFGDLAIVGASPETLMTVHKRTVMINPIAGTCPRGKSEVEDEILASHMLNDEKERAEHVMLVDLGRNDVRMVCESGSVKVSGFMKVLKYSHVQHIESTVSGTLRPECDQFDAFRAIFPAGTLSGAPKIRAMEIISELETAPRGIYGGGVGYYSWNGDADFAIVIRTLLIQGKKVSLQSGAGIVADSDPAYEFRETERKMAAMLTAIGGETEL

SEQ ID NO: 3605 - DNA, 1362 bp, Fusobacterium nucleatum
  CDS (1)..(1362)
atgcaaatagaagttaaaaaacttgagaaatatattgatatttatgatatttatgatatttttagagtattgatgagtcaagataattttaaagaaaataagctttcatttttagactcttcattaaaaaataaatatggaaaatattcaataatagggataaattcttatttagaattaaaagaaaaagataataaattctatataaatgataagttaagtgatgaaaattttgaagaatatttagatagatttttaaaggaaaataaacaagaaaataaatatgatttacctttaatttcaggaggaatagcatatttttcttatgactatggaagaaaatttgaaaatataaagacaagacataagaaagatgtggatattccagaagcagttatcagattttacaaaacttatataattgaagatattgaaaagcaagaaatatacataagttaccaagataaaaaagattttgataatttaataaatattttagaaaatactaaaatagaagaagaaaatttaataaaaaataataatcttgcaaactttaaatctaattttgaaaaagatgagtatttaaaagctatcaaaaagactattgactatatcattgagggagatatttacataatgaacttaactcaaagacttatgatagaaagtaaaaaatctcctttacaagtattttcatatttaaggaaatttaatccagcaccttttggagcatatttagattttgataattttgaagttgtaagtgcctcacctgaaagatttatcaaaatgaaagatagacttatagaaacaagacctattaaggggacaagaaaaagaggagcaacaacagaagaagatttagctttaaagaatgagttagcaaactctgaaaaagataaaagtgagcttttaatgatagttgacttggaaagaaatgatttaaatcgtatttgtgagttaaaatcagtagttgtggatgagctttttgaagtggaaacttattcaacagtttttcatttagtttcaacaataagagggaaattgaaagaagaatatagttttgtagatttgataaaagctacttttccaggaggttcaattacaggagcacctaagataagagcaatggaaataatagatgaattagaaaattcaagaagagatttatacacaggttcaataggttatgtttcatttaatggagattgtgatttgaatattgttataagaactgcaattcataaagaaggtaagtattatcttggtgtaggtggaggaattacctgtgaatctgagttagattttgaatatgaagaaactttacaaaaggcaaaagctattttggaggctatatgttaa

SEQ ID NO: 3606 - protein, 453 aa, Fusobacterium nucleatum
MQIEVKKLEKYIDIYDIYDIFRVLMSQDNFKENKLSFLDSSLKNKYGKYSIIGINSYLELKEKDNKFYINDKLSDENFEEYLDRFLKENKQENKYDLPLISGGIAYFSYDYGRKFENIKTRHKKDVDIPEAVIRFYKTYIIEDIEKQEIYISYQDKKDFDNLINILENTKIEEENLIKNNNLANFKSNFEKDEYLKAIKKTIDYIIEGDIYIMNLTQRLMIESKKSPLQVFSYLRKFNPAPFGAYLDFDNFEVVSASPERFIKMKDRLIETRPIKGTRKRGATTEEDLALKNELANSEKDKSELLMIVDLERNDLNRICELKSVVVDELFEVETYSTVFHLVSTIRGKLKEEYSFVDLIKATFPGGSITGAPKIRAMEIIDELENSRRDLYTGSIGYVSFNGDCDLNIVIRTAIHKEGKYYLGVGGGITCESELDFEYEETLQKAKAILEAIC

SEQ ID NO: 3607 - DNA, 1431 bp, Thermoanaerobacter tengcongensis
  CDS (1)..(1431)
atggtaaatatttctaaagaagatttttatgcctataaaaaaatgggatacactttcccagtatatgaggaaataaatggtgatgaaatcacgccaataaacgttttttatagtctttctggtaaacacaaatttttattggaaagtgcaaatggagggagtcactggggtagatattcttttataggaaaggacccttatttgtcagttttaagctatggaagggatataaaaattatcacaacagaagaagaatcgaataaaagaggtttagcactggaagaggtaaaaaactttctgcagattaattataacccattagggcttaacattccttttacaggaggtgcggtaggctatgtatcttatgatgcgataaggctttatgaaaaattgccagaaaaaaatcctgatgaaataaatataccggatgtatacttcatgttttacaagagtttcatctgctatgaccattttaagcatgaagtctacattgtctacaatgtatttgctaatgaggataccgagtatgaggaagttttgcaaaagattaatgagcttttaaatgagataaagtcaaataaaatagagtttcacgacctttcgcttcaagaagaaaaagtgataacttacaacttcacaaaagaagagttttgtcaaattgttgaaagagccaaaaaatacattgaaaaaggagacatatttcaagtggtgttatcccagaggctaaaggcaaagacaaattcagatccttttgagatttacaggaggttgcgttcaaagaatccatctccctatcttttctatatcgactttggcgattttcagcttctgggttcttctcctgaaagtcttgtgagagtctttcaagacaaagtgaccacaaatcctatagcaggcacaagacgaaggggaaaagatgaaaaagaggatttaaaaaacaaagaagaacttttgaaggatgaaaaagaaagggcagagcatgtgatgttggttgacttagggagaaacgacataggaaaggtcagtgaatttggaagtgttaaagtggagcgctttatggaggtggatttttactctcatgtaatgcacattgtatcaactgtttctggaaaattaaaaaaaggatttaccgcttttgatgcccttatagcttgtcttcctgcaggcacagtttctggagcgccaaagataagagcgatggaaataatagaggaattagaaaatgtaaaaaggtccttttacgcaggggctgttggctatttttcctataacggcaatatggatatgtgcatagcaataaggactattctcataaaagaaaatactgcttattttcaagcaggagcaggtattgtgtatgactcaattcctgagatggaatactatgaaattttaaataaagtgatggtacttaaggaggttctttga

SEQ ID NO: 3608 - protein, 476 aa, Thermoanaerobacter tengcongensis
MVNISKEDFYAYKKMGYTFPVYEEINGDEITPINVFYSLSGKHKFLLESANGGSHWGRYSFIGKDPYLSVLSYGRDIKIITTEEESNKRGLALEEVKNFLQINYNPLGLNIPFTGGAVGYVSYDAIRLYEKLPEKNPDEINIPDVYFMFYKSFICYDHFKHEVYIVYNVFANEDTEYEEVLQKINELLNEIKSNKIEFHDLSLQEEKVITYNFTKEEFCQIVERAKKYIEKGDIFQVVLSQRLKAKTNSDPFEIYRRLRSKNPSPYLFYIDFGDFQLLGSSPESLVRVFQDKVTTNPIAGTRRRGKDEKEDLKNKEELLKDEKERAEHVMLVDLGRNDIGKVSEFGSVKVERFMEVDFYSHVMHIVSTVSGKLKKGFTAFDALIACLPAGTVSGAPKIRAMEIIEELENVKRSFYAGAVGYFSYNGNMDMCIAIRTILIKENTAYFQAGAGIVYDSIPEMEYYEILNKVMVLKEVL

SEQ ID NO: 3609 - DNA, 1683 bp, Methanosarcina acetivorans
  CDS (1)..(1683)
atgctttcctttgatcttggaaaagaagaatttctggagcttgtctccgggctcgaaaagccgggccttgtccagctctttgcaaaagtagaaggctgttcccctgcctgctctcccctcgaactttacggagccctgcggggttcagggacaacaggctactcttacctgctggaatccgtggaaaagcaggaaagcagggcaaggtactcttttgttggaaacgaccccgatgccgtgctgaaaataaatgaccgaaaaatttcccttgaactcctgaacccgaaagcttctcctctctttgaagcgatttgcacaaagatggaggaagtctgcggcccggaaaccgcagaaaaagaaaatgaatcaaagaaaaatgcaggtccggaaaagtttacggctgcaattcccagaggaaaagatgttttcgatgctctccgcctggcttttcctccggcaaacgggatagaacttctcaattccaggcgttttgcgaggcagactttcctggggggagctatcggctatactgcgtacgacgcaatctatgacagctggttaggagtcgagaagggctttgagtccgacattcccgaccttcagtacctcctcgtttcgaagagttttgtcctcgaccacctgactgaagaggtttacatagttctcacccccttcgtaagcccgggttcggatgcagaacaggtgtacgaagaagctctctcggaagcagaacggttttactccgtaattaaaaaagctactcaaccggaagatgcagcaaaggcagcagaaggaataattgcatcaggcacagatgtttccggtccggcaaaagccccaaattcaaatgtgcaggtctgcagcgttgatcggtcgggatttgaggagtccgtactccaggcaaaggagcatatttttgcaggagatattttccaggtcgtcctttccaggaaatgcgagtttaaaatggaacagtctcctttcgagctttacatacagctccgggcaataaacccgagtccctacatgtatatctttgagtttggggaccttgcaattgtgggggcaagccctgaaaccctgctgaccgtacacaaacgcactgttataataaaccccattgcaggcacctgtccgaggggaaagtccgaagctgaagacgaaaccctggcttcacacatgctcaacgacgaaaaggaaagggcggaacatgtaatgctagttgacctcggacgaaacgatgtccggatggtttcggaaagcggctcggtcaaggtctcaggttttatgaaagtcctgaagtattcccatgtccagcacatcgaaagcacggtttcgggaaccctaaggcccgaatgtgaccaattcgatgccttcagggcggtatttcctgcaggaacactttcaggggctccgaaaattcgggcaatggagattatttccgaacgtgaagctgtcccaagaggaatttacggaggtggggttgggtactacagctggaacggagatgctgattttgcaattgtaatcaggaccctgcttatacagggaagaaaggcttctgtgcaggcaggggcaggaattgttgcggactcagatcctgcgtatgagttcagggaaacagaccggaaaatggcagcaatgcttacagctatcggcggagaaatccgggttgagaaatga

SEQ ID NO: 3610 - protein, 560 aa, Methanosarcina acetivorans
MLSFDLGKEEFLELVSGLEKPGLVQLFAKVEGCSPACSPLELYGALRGSGTTGYSYLLESVEKQESRARYSFVGNDPDAVLKINDRKISLELLNPKASPLFEAICTKMEEVCGPETAEKENESKKNAGPEKFTAAIPRGKDVFDALRLAFPPANGIELLNSRRFARQTFLGGAIGYTAYDAIYDSWLGVEKGFESDIPDLQYLLVSKSFVLDHLTEEVYIVLTPFVSPGSDAEQVYEEALSEAERFYSVIKKATQPEDAAKAAEGIIASGTDVSGPAKAPNSNVQVCSVDRSGFEESVLQAKEHIFAGDIFQVVLSRKCEFKMEQSPFELYIQLRAINPSPYMYIFEFGDLAIVGASPETLLTVHKRTVIINPIAGTCPRGKSEAEDETLASHMLNDEKERAEHVMLVDLGRNDVRMVSESGSVKVSGFMKVLKYSHVQHIESTVSGTLRPECDQFDAFRAVFPAGTLSGAPKIRAMEIISEREAVPRGIYGGGVGYYSWNGDADFAIVIRTLLIQGRKASVQAGAGIVADSDPAYEFRETDRKMAAMLTAIGGEIRVEK

SEQ ID NO: 3611 - DNA, 1407 bp, Methanopyrus kandleri
  CDS (1)..(1407)
atgcgcttgactgtaagggagctagatatagacaggtctcccgacgaggtctacgcggccttgaggacgctgtcctcacacacgttcctattcgagtcggccgagatcggtgccagcggccggtactccttcgtaggcttctcaccggcgcttaggatagagtgcgtcgacggtcgagtccgcgtggacgtcggtgacccggagtacgccgatttagtggttgaaggtcgaaaggaaacggatgaggaccacttccagctcatgcgccgcgtgttctcccgaatcccgaaggtcgaggggtccggcttcgtcggcggtctcgtgggctacatatcgtacgacgtcgtcgaagactggctggacgtcaaatcgaccaccgtcgccgacccggagtggccgtccttcgagctgtgcctctacgactcggtggtgcgcttcgaccactacgaggacagagtcgagctgatctccgtccatcccgacgactacgaggtcgagtggacggcggaggcgatcgaggagtgtgtccgagaggtgagcggacagacggcccctaaggtgcaccggacgggggagctgaagcgggacctggagaaagaggagttcgaggggatcgtcgagcgggcgaaggagtacataatctcgggggacatcttccaggttgtactctcgaggcgggtggaggtgcgagcggtcgcggatccgctcgaggtgtaccgaaggctccgcgacatcaacccgtccccgtacatgtactgcttggagttcggcgagcggaggatcatcgggtccagtcccgagacgctcgtccggctggaaggtgatcgcatcatcacgaaacccatagccggcaccaggccccgtggtagtaccccagaagaggacgaagagctggcccgtgagatgctcgaagatgagaaagagctcgcggagcacgcgatgctcgtggatctcgccagaaacgacgtgggtaaggtctcgagacccggaacggtcgaagtcacgcggctcatggagatcgagaagtacagtcacgtgcagcacatcgtgtccgaggtggtgggtgagagaaaggagggagttaccccctgggacgtactccgggcgacgttcccggccggaaccgtctccggggccccgaaggtgagggctatggaaatcatcgacgagctggaggtgtacaagcgaggcccgtacgccggaggcgtcggatacgtcagctggacaggggatatggacttcgcgatatcgatccgtaccattttctcgacgggccgtcgatggttcacgcaggcgggtgccggtatcgtgtacgactcggtgcccgaaaacgagtggttcgaaactgaaaataaaatgaaagcgatggtgggagctatccttgaggagactagttctgataaataa

SEQ ID NO: 3612 - protein, 468 aa, Methanopyrus kandleri
MRLTVRELDIDRSPDEVYAALRTLSSHTFLFESAEIGASGRYSFVGFSPALRIECVDGRVRVDVGDPEYADLVVEGRKETDEDHFQLMRRVFSRIPKVEGSGFVGGLVGYISYDVVEDWLDVKSTTVADPEWPSFELCLYDSVVRFDHYEDRVELISVHPDDYEVEWTAEAIEECVREVSGQTAPKVHRTGELKRDLEKEEFEGIVERAKEYIISGDIFQVVLSRRVEVRAVADPLEVYRRLRDINPSPYMYCLEFGERRIIGSSPETLVRLEGDRIITKPIAGTRPRGSTPEEDEELAREMLEDEKELAEHAMLVDLARNDVGKVSRPGTVEVTRLMEIEKYSHVQHIVSEVVGERKEGVTPWDVLRATFPAGTVSGAPKVRAMEIIDELEVYKRGPYAGGVGYVSWTGDMDFAISIRTIFSTGRRWFTQAGAGIVYDSVPENEWFETENKMKAMVGAILEETSSDK

SEQ ID NO: 3613 - DNA, 1299 bp, Pyrococcus furiosus
  CDS (1)..(1299)
atgcttatcaaagagttagatcgagtgtctcctcttcgcttataccttattctcagacaacttgagtatccttttatcctaatgtcagcagaaaagcatagcaaaaaggccagattcacttacctctcagcagcacctgaattcattgtgagtataaatgagagaggaacttatttagatggaaaaaaggtatcaaaagaaagaaatccatttaaggggttaaagggctttataaagcactcaataagtggagaaagattcatgggcggcttggttggatatatagcttatgatgccgttcacaactacatagaggggaatgttgaggagccttcagtttttggctattatccatggacatacatttatgatcatttagaaaataaactctactttgtttccctagaagaaccgccatttgatccagaagctatagtggaaaaggccaaaagggcaaaaattcccagagaggatggaggaagttcaattttaaaaactgatgcaaataaagaagagtttgttgaaattgtagaaaaaggaaaagagtacatattttcaggagacgtatttcaagtagtcctttcgagagagtacgtagttgagacggacttagatccttttacaatctaccttagattgctagacattaatccatcgccttatacttttctccttgaatttgaaaaagtagtggtgggagcgtctcctgaaacaatgggctctgttgaaggaaaaattgttaagataaacccaattgccggaactattccaaggggaaagaacgaggaagaagacaaggcacttgaaaaagccctactctctgatgagaaagaaagagcggagcatgtaatgctagtggatttagctagaaatgacgttaggagagtttcgaaacccaggagtgttaaggtagtgaggtactttgatgtggtcaagtatagctatgtccagcacattgaaagtgagataattggggagttggccgaggataaagacatgtttgatgcaattgaggcaactttcccagctggaacattgacaggagctccaaaaattagggcaatggaaattatagatgaactggaaaaaagcaggagaagagtttatggaggagctgttggatatttttccgtaacaggctatgcagattttgccatagcgataagaatggcggaaatagataagcacgctcacattagagcgggagcaggtatagttgcagattcaattccagaaaaggagttttatgaaactgaaaacaagatgagggctgttctaaaagcctttggggtggagtag

SEQ ID NO: 3614 - protein, 432 aa, Pyrococcus furiosus
MLIKELDRVSPLRLYLILRQLEYPFILMSAEKHSKKARFTYLSAAPEFIVSINERGTYLDGKKVSKERNPFKGLKGFIKHSISGERFMGGLVGYIAYDAVHNYIEGNVEEPSVFGYYPWTYIYDHLENKLYFVSLEEPPFDPEAIVEKAKRAKIPREDGGSSILKTDANKEEFVEIVEKGKEYIFSGDVFQVVLSREYVVETDLDPFTIYLRLLDINPSPYTFLLEFEKVVVGASPETMGSVEGKIVKINPIAGTIPRGKNEEEDKALEKALLSDEKERAEHVMLVDLARNDVRRVSKPRSVKVVRYFDVVKYSYVQHIESEIIGELAEDKDMFDAIEATFPAGTLTGAPKIRAMEIIDELEKSRRRVYGGAVGYFSVTGYADFAIAIRMAEIDKHAHIRAGAGIVADSIPEKEFYETENKMRAVLKAFGVE

SEQ ID NO: 3615 - DNA, 1347 bp, Clostridium perfringens
  CDS (1)..(1347)
atgaattttgaaattaaggaaatagaaaataagcttaagccacatgaagtatattttttatttaaagatgaaataaacagtatatttttagatagttcaaaggaagatagcgaattttctttatattcattcataggattaaatccttttaaaaagtttatctctaagggaaatgagatttttatagatgaaaaactagtcttaggagatccttttaaaaaattagaagagcttattttagaatataaaataaattataatagtgagataccttttttaggaggtgctatgggatatttttcttatgatataggaagagttattgaagatatgcctaaaagtgctaaggatgatgtgtgtattccagatagttattttttattttatgataatgtaataatatttgatttgagaaatcaaaaaacatatataacagccctaggaattaaggaagagtcagaaaaaagtatagctaatatttatgagaggataaaagataaggatataaatttaaatatcagcttagataaaaatactgagtttagttcaaatttttcaagagaagaatacataaattcagtaaaaaaggttaaagagtacataaaagaagggcatacatatattgcaaacctaacacagagattttcctgtgattttaattctgatccttttgatacatatataagtttgagaagtataaataaagcccctttttcctgttatttaaatttagatggttttcaaattataagttcttctccagagaggtttttaaaagtgtttaataataaggttgaaacaagaccaattaaaggcacaagaccaagaggaaaagataaattagaagatgaaaagaataaaaaagaacttttaaatagtgaaaaggataagtcagagcttttaatgattgttgatttagagagaaatgatttaagtaaggtatgcaaacctttttctgtgaaggttacagaattatttaaattagaggaatatgctacagtatttcacttagtttccacagttataggagaactaaaggaagatgttagttctgtaaaatgtataagagaatgttttccaggaggttctataacaggcgctcctaaaataagaagtatggagataatagaggaactagaaggcattagaagagggatatatactgggtccataggttattttgatttaagaggaaattgtgattttaatatagtaataagaactatattagcaaaagataataaggcttattttggagtaggtggaggcataactattgaatcagaagaagagatggaatatgaggaaactttagataaggcaaaggctttaatgagagtattataa

SEQ ID NO: 3616 - protein, 448 aa, Clostridium perfringens
MNFEIKEIENKLKPHEVYFLFKDEINSIFLDSSKEDSEFSLYSFIGLNPFKKFISKGNEIFIDEKLVLGDPFKKLEELILEYKINYNSEIPFLGGAMGYFSYDIGRVIEDMPKSAKDDVCIPDSYFLFYDNVIIFDLRNQKTYITALGIKEESEKSIANIYERIKDKDINLNISLDKNTEFSSNFSREEYINSVKKVKEYIKEGHTYIANLTQRFSCDFNSDPFDTYISLRSINKAPFSCYLNLDGFQIISSSPERFLKVFNNKVETRPIKGTRPRGKDKLEDEKNKKELLNSEKDKSELLMIVDLERNDLSKVCKPFSVKVTELFKLEEYATVFHLVSTVIGELKEDVSSVKCIRECFPGGSITGAPKIRSMEIIEELEGIRRGIYTGSIGYFDLRGNCDFNIVIRTILAKDNKAYFGVGGGITIESEEEMEYEETLDKAKALMRVL

SEQ ID NO: 3617 - DNA, 1530 bp, Ralstonia solanacearum
  CDS (1)..(1530)
atgaccgaactcgaattcaaatcgctggccgaccagggctacaaccgcatcccgctgatcgccgaggcgctggccgacctggagacgccgctctcgctgtacctgaagctggcgcaatcgcacgaccgcggcacgcacaccttcctgctggaatccgtggtgggcggcgagcgcttcgggcgctattccttcatcggcctgcatgcgcgcacgctgctgcgcaccaccggccaccgcaccgaggtcgtcaccgacggccaggtggtcgaaacgcatgacggcaatccgctggaattcatcgccgccttcgagcaacgccacaagatcgcgctgcgcccgggcctgccgcggttctgcggcggcctggccggctatttcggctacgacgccgtgcgctacatcgagccgcgcctgaccgacaccgcgccgcccgatgacctgcagttgcccgacatccagctgatgctgtgcgaagagctggccgtgatcgacaacctgtcgggcaagctctacctgatcgtctatgccgatccgtccaagcccgaggcttatccgcgcgccaggcagcgcctgcgcgaactgcgcgccaagctgcggcatccggtggacgtgccggtgacctcgccgtcggtgcgcacggacatcgtgcgggaattcgacaaggcggactacatcaccgcggtgctcaaggccaaggagtacatcgcggcgggcgatatgatgcaggtgcaggtcggccagcgcctggtcaagccgttccgcgacgcgccgctgtcgctgtaccgcgcgctgcgctcgctgaacccgtcgccctatatgtacttctacaacttcggcgacatgcagatcgtcggggcctcgccggagatcctggtgcgccaggaagagcgccgcgtgccggccggcgcgaacggcaacggcgcggaggaatccgcccgcatcgtgacgatccgcccgctggcgggcacccgcccgcgcggcagcacgcccgagcgcgacgcggaactggccaccgagctgctcaacgacccgaaggagatcgccgagcacgtcatgctgatcgacctggcgcgcaatgacatcggccgcatcgccgagatcggctcggtcaaggtgaccgaccagatggtcatcgagaagtattcgcacgtgcagcacatcgtcagctcggtcgaggggcgcctgaagcccggcatgaccaatatggacgtgctgcgcgccaccttccccgcaggcacgctgtcgggcgcgcccaaggtgcgggcgatggagatcatcgacgagctggagccggtcaagcgcggcatctacggcggcgcggtgggctacctgtcgttctcgggcgagatggacctggcgatcgccatccgcaccggcatcatcaaggacggcaacctgtacgtgcaggccgccgccggcgtggtggccgattccgacccggatgccgaatggcgcgagaccgaacacaaggcgcgcgccgtgctgcgcgccgccgagcaggtccaggacggcctggacgccgatttctga

SEQ ID NO: 3618 - protein, 509 aa, Ralstonia solanacearum
MTELEFKSLADQGYNRIPLIAEALADLETPLSLYLKLAQSHDRGTHTFLLESVVGGERFGRYSFIGLHARTLLRTTGHRTEVVTDGQVVETHDGNPLEFIAAFEQRHKIALRPGLPRFCGGLAGYFGYDAVRYIEPRLTDTAPPDDLQLPDIQLMLCEELAVIDNLSGKLYLIVYADPSKPEAYPRARQRLRELRAKLRHPVDVPVTSPSVRTDIVREFDKADYITAVLKAKEYIAAGDMMQVQVGQRLVKPFRDAPLSLYRALRSLNPSPYMYFYNFGDMQIVGASPEILVRQEERRVPAGANGNGAEESARIVTIRPLAGTRPRGSTPERDAELATELLNDPKEIAEHVMLIDLARNDIGRIAEIGSVKVTDQMVIEKYSHVQHIVSSVEGRLKPGMTNMDVLRATFPAGTLSGAPKVRAMEIIDELEPVKRGIYGGAVGYLSFSGEMDLAIAIRTGIIKDGNLYVQAAAGVVADSDPDAEWRETEHKARAVLRAAEQVQDGLDADF

SEQ ID NO: 3619 - DNA, 1269 bp, Pyrobaculum aerophilum
  CDS (1)..(1269)
atgagaaaagtccccctatcaaaactgcctgagcccagggccctcgcgcgggggctttacgcagatggggaggagttcgtggcgttgttagaatcgggtatgggttacgctgaacgcagtagatatactctcgtggcgtggggagtagctgagaaatacgtctcgtgggggcccgacgtatataaaatggcgtatactgcgtataagaagataagacagttcaactcgccgtttggaggcgacgtagtcataggggctgtttcttacgacgcctctgcgtatatagagccattgctgttacgttacgggaaggtcgacaagacgctccccgcggcgtttttcataaagccagagggctgggttttgtacgacaaactcctaggccgcgcctatatttacggagagctcccggccctaaaaagcgggggagtcgactcgccccgcgtgagggggcctgtggctgggactgacgacagttcgtttaagaggtgggttgcggaggcgaagaggaggattgaagagggtgagatattccaagtggtgctctcgcggcatgtggatttcgcggtggatggggatctcttctccctctacacctccatggcatctataaacccctctccctatatgtactttataaagtggagggggctgtacctcttgggcacttcccctgagttattagtaaaagtccagggagatagggcggagacgcaccccattgctgggacaaggccgaggggggccactgaggaagaggacttagcccttgaggaggatatgttgcaagacgagaaagagctggcagagcactatatgttagtggacctcgcccgcaacgacttgggcagagtctgcaggcccggcactgtaaaagtcgacgagttattcgccgtagagaaatacagcagagttcaacacatagtgtcgcgggttttgtgcgtcctcgagaaaaaggccactccagtagacgcgttatttgccacacaccccgccggcactgtatcgggggctcccaaggtgagggccatggagataatcgccgagcttgaagacgagcccaggggttattatgccggctcagttggcttcctctcgccgaatatgtccgaattcgccattgtgattagaaccgccattgttaaagacgggctactcagacttcaagccggggctggggtggtgtatgactcaacgcccgagagggagttccgggaaactgaggcaaaacttaaagcgttaaaagaggcgctggggctatggacttga

SEQ ID NO: 3620 - protein, 422 aa, Pyrobaculum aerophilum
MRKVPLSKLPEPRALARGLYADGEEFVALLESGMGYAERSRYTLVAWGVAEKYVSWGPDVYKMAYTAYKKIRQFNSPFGGDVVIGAVSYDASAYIEPLLLRYGKVDKTLPAAFFIKPEGWVLYDKLLGRAYIYGELPALKSGGVDSPRVRGPVAGTDDSSFKRWVAEAKRRIEEGEIFQVVLSRHVDFAVDGDLFSLYTSMASINPSPYMYFIKWRGLYLLGTSPELLVKVQGDRAETHPIAGTRPRGATEEEDLALEEDMLQDEKELAEHYMLVDLARNDLGRVCRPGTVKVDELFAVEKYSRVQHIVSRVLCVLEKKATPVDALFATHPAGTVSGAPKVRAMEIIAELEDEPRGYYAGSVGFLSPNMSEFAIVIRTAIVKDGLLRLQAGAGVVYDSTPEREFRETEAKLKALKEALGLWT

SEQ ID NO: 3621 - DNA, 1479 bp, Arabidopsis thaliana
  CDS (1)..(1479)
atgatcaagaggctccaagtttccttttcgaatctgttgagccaggacatcactcttccactgtttgtcgttggagcgcatccgaaaatggaaattgtggcaaaggagaataaagttacagtcatggatcatgtgaaaggcactaagactacagaggaagttgaagatccaatgatgattcctagaagaatctcagagacttggaaaccacaattgatcgatgatcttcctgatgttttttgtggtggatgggttggttacttttcttatgatactgttccctatgccgaaaagcgaaagctacctctctcaaaggctccggttgatgaccgaaatttaccagatatgcatcttggtctttatgatgatgtggttgtgtttgatcatgtcgaaaagaaaatacatataattcattgggtgaggttatcagaaaactcatcatttgatgatgtttatgctaatgctgtgaaacacttggaagaacttgtttcgaggatcaaatgcatgaatccccccaagctaccttatggatcagtggacttgcacacaaatcaatttggcactcctttggaaaaatcaagcatgacaagtgatgcatataagaatgctgtacttcaagccaaagaacacatactggctggagatatctttcagattgttttaagtcaaagatttgagcgccacacttttgcccatccgtttgaagtttatcgagctttgagaattgtgaacccaagtccttctatgtgttacttgcaagcaagaggttgtattctagtagcgtcaagtcctgagattctcactagagtgaagaaaaacaagatcgtgaatagaccactagcaggaactgcaagacgaggaaagagtttcgaggaggatcaaatgttggaggaggcacttttaaaagatgaaaaacagtgtgcagaacacatcatgctcgttgacttgggtcgcaatgatgttggaaaggtgtccaagaacggctcagtgaaagtagaaaggctcatgaatatagagcgttattctcatgtcatgcatattagctcaacggtgattggagagttgcaagagaatctgacttgctgggacacgcttcgtgctgctttacccgttggaaccgttagcggagctccaaaggtgaaggctatggagttgatcgatgagctagaggtgactagaagaggtccatatagtggtggattcggtagtgtctcattcactggagacatggacatagctttggctcttaggaccattgtgttcccaacacaagctcgttacgacacaatgtactcatacaaagacaaagacacgccacgccgtgagtgggtagcctatctacaagcaggtgcaggcattgtagctgatagtgacccagaggatgagcaccgtgagtgtcagaacaaagctgctgggctagcacgtgccattgacttggctgagtctgcattcgttgataaaagtgatacaacaatctag

SEQ ID NO: 3622 - protein, 492 aa, Arabidopsis thaliana
MIKRLQVSFSNLLSQDITLPLFVVGAHPKMEIVAKENKVTVMDHVKGTKTTEEVEDPMMIPRRISETWKPQLIDDLPDVFCGGWVGYFSYDTVPYAEKRKLPLSKAPVDDRNLPDMHLGLYDDVVVFDHVEKKIHIIHWVRLSENSSFDDVYANAVKHLEELVSRIKCMNPPKLPYGSVDLHTNQFGTPLEKSSMTSDAYKNAVLQAKEHILAGDIFQIVLSQRFERHTFAHPFEVYRALRIVNPSPSMCYLQARGCILVASSPEILTRVKKNKIVNRPLAGTARRGKSFEEDQMLEEALLKDEKQCAEHIMLVDLGRNDVGKVSKNGSVKVERLMNIERYSHVMHISSTVIGELQENLTCWDTLRAALPVGTVSGAPKVKAMELIDELEVTRRGPYSGGFGSVSFTGDMDIALALRTIVFPTQARYDTMYSYKDKDTPRREWVAYLQAGAGIVADSDPEDEHRECQNKAAGLARAIDLAESAFVDKSDTTI

SEQ ID NO: 3623 - DNA, 1302 bp, Sulfolobus tokodaii
  CDS (1)..(1302)
atggaaatctatcctataacttcttttgctcaaccttatgaagtatttaaatgtatattagatgaggcagatatagcagcactattagaaagtggttctggtcctcaacataaatcgagatatagtataatagcatggggaaagaaagggtatcttaatataaacggagttaggtcttctggcgatattaatgatagcttctatgaccctatcgaggtcttagagaagtttctttccaaagctcctttgcttaatttacctggaagattcaaaggaggtataattgggtacgttagctatgacgctgtgagatattgggaatctataagagatttgaagagagaggcagaagaatggcctaatatggaattttttataccagagaatgttatagtctatgatcatattgaaggcaaagtatatgttgagggtgagctacctaaggttacaatatgtaaggatattggtaatgtgaagttcgaatttgaaatagaatctttagataaaacgcaatttgaaaaagctgtttcggacatcttggattacataaaaaatggatatgcttttcagatagtaatttctaggtttttaagatatatttacagaggagatttaatgagtttctattacaacctaaggaaaataaatccatctccctatatgtattatttaaagttttatgatagacatgttatcggatctagcccagaaacattatttagtttgcaagatggtatagttgagacgtatcctatagctggatcaagacctagaggagcgacaccagaagaagatttgaatttagaaaaagaacttttagcttctgagaaagaaagggctgaacatataatgctagttgatttagctaggaatgatataggtaaagtttgttacatgggctcagttaaggttcctgaatttatgtacatagaaaaatatagtcatgtacaacatatagtaagtaaggtagtaggtacattaaaaagaaattatagtgcatttgacgttttaaaggctgtattccctgccggtactgtaagtggagcaccaaaacccatggctatgaatgttattgaattattagagccgtttaagagaggaccctatgctggaggagtaggtttcttttcggctaatggtgatgcagaatttgcaataactataagaagtgcttttgtaaataaagatttattcagaattcaagccggtgctggtatagtttatgactcaataccggaaatggaatattatgagactgaacataaaatgagagccttaaaagttgctatgggggtagtttag

SEQ ID NO: 3624 - protein, 433 aa, Sulfolobus tokodaii
MEIYPITSFAQPYEVFKCILDEADIAALLESGSGPQHKSRYSIIAWGKKGYLNINGVRSSGDINDSFYDPIEVLEKFLSKAPLLNLPGRFKGGIIGYVSYDAVRYWESIRDLKREAEEWPNMEFFIPENVIVYDHIEGKVYVEGELPKVTICKDIGNVKFEFEIESLDKTQFEKAVSDILDYIKNGYAFQIVISRFLRYIYRGDLMSFYYNLRKINPSPYMYYLKFYDRHVIGSSPETLFSLQDGIVETYPIAGSRPRGATPEEDLNLEKELLASEKERAEHIMLVDLARNDIGKVCYMGSVKVPEFMYIEKYSHVQHIVSKVVGTLKRNYSAFDVLKAVFPAGTVSGAPKPMAMNVIELLEPFKRGPYAGGVGFFSANGDAEFAITIRSAFVNKDLFRIQAGAGIVYDSIPEMEYYETEHKMRALKVAMGVV

SEQ ID NO: 3625 - DNA, 1056 bp, Thermoplasma volcanium
  CDS (1)..(1056)
atgttagctgatcagatagatgagtttaggacctatagtaattttgcatattttgcctctttccctgacagggtaaatggatatgagtacgtatttgcatcagataccttccaaaatgatccttctaagatattcgatggcgctcttaggccaattctagtaacatacgattatgtaaacgagatcttcgatacgaaggttaagagttctggatggccatactttctatctatggatgcggaaactattgaaaaacgtccaataatgcgtacttctgcctttaaaaagaagaactcaggtagcttaaaggatgaagcgttggagggaaagattaggaaaatagtgaatctaataaggaacggggaagttttgcaggtagtaatttcccgggaatttgaggctaacgtaaatgttaacgaaaagattcatgaattcctcacgaaggatcggtcaagatacgtcttttactataggttcggcaagtacgaagtggttggaagttccccggagaatatatttacggttatagggaacagaatttatgtcgatcctatcgctgggacaatatcacattcatttagctccgatacactctatagaagtgaaaaggatagatgtgagcataggatgcttcttgacctggctaggaacgatgtaagcaaatttgctgacattggcagcctagaagttcctaaggtgatggaaattgaggaattttcaagtgtaaagcaccttgtaagccaggtaaaggctacgttctcaaacaagaattatgtggacattctaagggcaatgtttcctgccggcaccgtaacgggatcgccaaaggagagggctattgagatcatagacaagttcgaagaaacgcctaggggcccttacggcggagctgtaggaatagtcggttcaggtatatttgatatggggcttgccatacgcatggcctattcttctggaaatggttttagggtgcgtgcaggtgcaggcatagtcaaggattccgatccctcttctgaggtcaatgagatatataacaaggcgaggtcagttctatga

SEQ ID NO: 3626 - protein, 351 aa, Thermoplasma volcanium
MLADQIDEFRTYSNFAYFASFPDRVNGYEYVFASDTFQNDPSKIFDGALRPILVTYDYVNEIFDTKVKSSGWPYFLSMDAETIEKRPIMRTSAFKKKNSGSLKDEALEGKIRKIVNLIRNGEVLQVVISREFEANVNVNEKIHEFLTKDRSRYVFYYRFGKYEVVGSSPENIFTVIGNRIYVDPIAGTISHSFSSDTLYRSEKDRCEHRMLLDLARNDVSKFADIGSLEVPKVMEIEEFSSVKHLVSQVKATFSNKNYVDILRAMFPAGTVTGSPKERAIEIIDKFEETPRGPYGGAVGIVGSGIFDMGLAIRMAYSSGNGFRVRAGAGIVKDSDPSSEVNEIYNKARSVL

SEQ ID NO: 3627 - DNA, 2202 bp, Rhizobium loti
  CDS (1)..(2202)
atggagacggcaatgacgatgaaggttctggaaaacggcgctgaaagcttcgtgaccgcgggtggcatcaccattacgcgtgagcgccacgaccggccctatgcgggtgcgatcgacgcttatgtcgatggcttgaactcgcgccgcggcgcggtgttttcctccaactacgaatatcccggccgctatacgcgctgggacaccgccatcatcgatccgccgctggtcatttccgcgcggggccgcgccatgcgcatcgaagcgctgaaccgccgcggcgaggcgctgttgccggtgatcggcaaaacgctgggcggccttgccgacatcaccatcgccgagacgacgaagacgctcatccgcctcgacgtcgccaagcccggccgcgtcttcacggaggaagagcgcagccgcgtgccctcggtcttcaccgtgctgcgcgccatcaccgctttgttcaaaaccgacgaggacgccaatctcggcctctatggcgccttcggctacgacctctccttccagttcgacccggtcgactacaagctcgagcgcaagcccagccagcgcgacctcgtgctgttcctgcccgacgagatcctggtcgtcgaccactattccgccaaagcctggaccgaccgctacgactattcgggcgaaggattttcgaccgaaggtctgccgcgcgacgcaatcgccgagccgttcaagaccgccgaccgcatcccgccgcgcggtgaccatgagccgggcgaatacgctaatctggtgcggcgtgccatggactcgttcaagcgcggcgacctgttcgaggtcgtgcccggccagatgttctacgagcgctgcgagacgcagccctccgacatttcgcgcaagctgaaatcgatcaacccctcgccttattcgttcttcatcaacctcggcgaaaacgaatatctgatcggcgcctcgcccgaaatgttcgtgcgcgtcaatggccgccgcgtcgaaacctgcccgatttcgggcaccatcaaacgcggcgacgacgccatttccgatagcgagcagatcctgaagctgctcaattcgaagaaggacgaatccgagctcacaatgtgctcggacgtcgaccgcaacgacaagtcgcgggtctgcgagcccggctcggtgcgcgtcatcggccgccgccagatcgagatgtattcgcgcctcatccacaccgtcgatcacatcgaaggccggctgcgcgaaggcatggacgctttcgacgccttcctgtcgcatgcctgggcggtcactgtcaccggcgcgccgaaactgtgggccatgcgcttcatcgagcagaacgagaagagcccgcgcgcctggtatggcggcgcaatcggcatggtcaacttcaacggcgacatgaacaccggcctgacgctgcgcaccatccgcatcaaggacggcattgccgaagtgcgggccggcgcgacattgctgttcgacagcattcccgaggaagaagaagccgaaaccgaactgaaggcatccgccatgctctccgccatccgcgacgccaagacgggcaactccgccagcaccgagcgcaccaccgcgcgggtcggcgacggcgtcaacatcctgctcgtcgaccacgaggactctttcgtccacacgctggccaactacttccgccagaccggcgccaatgtctcgaccgtgcgcacgccggtgccggacgaagtgttcgagcggctgaagccggaccttgtcgtgctctcacccggaccgggtacgccgaaggatttcgattgcgccgcgaccatcagacgagcgcgcgcccgcgacctgccgatcttcggcgtctgcctaggcctgcaggcgctggccgaggcctatggcggggaactgcgccagctgcatattcccatgcacggcaagccctcgcgcatccgcgtctccaagcccggcatcatcttctccggcctgcccaaggaagtcactgtcggccgttaccactcgatcttcgccgatccggtgcgcttgcccgatgatttcattgtcacggcagagactgaggacggcatcatcatggctttcgagcaccgcaaggagccgatcgcggcggtgcagttccacccggaatcgatcatgacgctcggccacaatgccggcatgcgcatcatcgagaacatcgtcgcccatttgccgcgcaaggccaaggaaaaggcagcctga

SEQ ID NO: 3628 - protein, 733 aa, Rhizobium loti
METAMTMKVLENGAESFVTAGGITITRERHDRPYAGAIDAYVDGLNSRRGAVFSSNYEYPGRYTRWDTAIIDPPLVISARGRAMRIEALNRRGEALLPVIGKTLGGLADITIAETTKTLIRLDVAKPGRVFTEEERSRVPSVFTVLRAITALFKTDEDANLGLYGAFGYDLSFQFDPVDYKLERKPSQRDLVLFLPDEILVVDHYSAKAWTDRYDYSGEGFSTEGLPRDAIAEPFKTADRIPPRGDHEPGEYANLVRRAMDSFKRGDLFEVVPGQMFYERCETQPSDISRKLKSINPSPYSFFINLGENEYLIGASPEMFVRVNGRRVETCPISGTIKRGDDAISDSEQILKLLNSKKDESELTMCSDVDRNDKSRVCEPGSVRVIGRRQIEMYSRLIHTVDHIEGRLREGMDAFDAFLSHAWAVTVTGAPKLWAMRFIEQNEKSPRAWYGGAIGMVNFNGDMNTGLTLRTIRIKDGIAEVRAGATLLFDSIPEEEEAETELKASAMLSAIRDAKTGNSASTERTTARVGDGVNILLVDHEDSFVHTLANYFRQTGANVSTVRTPVPDEVFERLKPDLVVLSPGPGTPKDFDCAATIRRARARDLPIFGVCLGLQALAEAYGGELRQLHIPMHGKPSRIRVSKPGIIFSGLPKEVTVGRYHSIFADPVRLPDDFIVTAETEDGIIMAFEHRKEPIAAVQFHPESIMTLGHNAGMRIIENIVAHLPRKAKEKAA

SEQ ID NO: 3629 - DNA, 3859 bp, Brucella abortus
  CDS (341)..(2536): n means a or g or c or t/u, s means g or c, y means t/u or c
gcctgtttttacaagcattcgggttttctttttatcctgatagcaagaaataatgtcatatgataaatccgggtttccaatttttccggttgccaaggtggcatgtttgaacgctaaccagtacttccatgaacatttcgcgcattatcgtcatcaacggttggtggtgggctcgctaaaagcggccacgcaggcgttcgtgcatatgcgttcagaagacaggccgctgggattatccgggcggcctttttgtttggctgttggaataagaccgaaagcatgtctcgcgaagcgggaacaggaaatattcggaaacgaaagagatttgggatagccgatcatgaatgcgaagactgcggatagcgagatattccagcacgaaacggctggcggtatcatcgtcgagcgggtgcgccacctcacggcctataagggcgccattgaaagctatatcgatgtgctgaacgaatggcgcggtgcggtgttctcgtccaattacgaatatccgggccgctatacgcgatgggataccgcaattgtcgatccgccggtcgtcatcacgtcgcgtgcccgcacgatgcgcatcgaggcgctgaacgcgcgcggcgtcatcctgcttcggcccattctggataccgtcaaggcgctttcggaagtaaagatcgaccagtccggcgaaaaccgtatcgatctgacgattgtggaaccggtcggcaccttcacggaagaagaacgctcgcgcatgccctcggtctttacggtgctgcgcgccatagtcgggcttttcttctcggaggaggatgccaatctcggcctttatggcgcctttggctatgatctggcgttccagttcgatcccatccagtacaagctgaagcgcccggacgaccagcgtgacctcgtgctgttcattcccgacgaaatcttcgtcgccgaccattatgcggcgcgcgcctgggtggaccgttatgaatttcgctgcggcggttcgtccacgcacggtcttgatcgcgcgacgccggtggtgcctttcaagccatcggagcgcaagcttgcgcgcggcgatcataatccgggtgaatatgccaggcttgtcgagcgcgccaaggaaagcttcaagcgcggcgacctgttcgaggttgtgccgggccagaccttctatgagcgctgccacacggcgccgtcggagattttccgccggctgaagtcgatcaatccttcgccctattcctttttcatcaatctgggcgagagcgaatatctggtcggcgcatcgccggaaatgtttgtgcgcgtcaatgggcggsgcatcgagacctgcccgatttccggcaccatcaagcgcggtgaagatgcaatttcggattctgagcagatattgaaactgcttaattccaagaaggacgaatccgagctgaccatgtgttcggatgtggaccgcaacgacaagagccgcgtttgcgagccgggttcggtgcgtgttatcggtcgccgccagatcgagatgtattcccgcctgatccatacggtcgatcatatcgaaggccgcctgcgtgacggcatggatgcgtttgacggcttcctcagccatgcatgggctgtgacggtgacaggcgcgccgaagctgtgggcaatgcgctttcttgaggaaaacgaacgcagcccgcgcgcatggtatggcggcgcgatcggcatgatgcatttcaatggcgatatgaatacagggctgacgctgcgcaccatccgcatcaaggatggtgtggcggaaatccgtgcaggggcgacgcttctgttcgattccaaccctgacgaggaagaagacgagaccgaattgaaggcatcgcccatgattgcggctgtgcgggacgcacagaagagcaatcagatcgcggaagaaagtgtggcgccaaaggtgggtgagggggtttcgatcctgctggtcgatcacgaggattccttcgtccatacgcttgccaattatttccgccagacgggcgccaaggtttccaccgtgcgttcaccggtggcagaggagatattcgaccgcgtcaatcccgatctggtggtgttatcgccgggaccgggctcgccgcaggatttcgattgcaaggcgaccatcgataaggcgcgcaagcgccagcttycgatttttggsgtctgcctcggccttcaggcactggcggaagcctatggcggggcgttgcgccagcttcgcgttccggtgcatggcaagccttcacgcatccgcgtatcaaagccggagcgcattttctccggcttgccggaggaagtgacggtggggcgttatcattcgatcttcgccgatcctgaacgcctgccggatgattttctcgtcacagccgaaacggaagacgggatcatcatggcttttgaacataaacatgaaccggtggcagccgttcaattccatcccgaatccatcatgacgcttggccataatgccggtatgcgcatgatcgagaatgtcgtgacgcatcttgcaggcaagcacaaggcgcgccgcaccaactattgatagaatatattccgccctaacttkgaagccagccgcaggccaaaaccttggcgggtttggtttttttcaatgcttttggggsgattcctggcctgttgcttgctccggcaactcatttgcaactgtaataccttacatttgcaggaaaaaattagagcgcgtttcgatctgattgaatcagatcggcgctctaatcctttgttttgacgcgcatcttttcccgaaaaccgtttcacacttttcgggatgcgctctaaatgctggaacgcaaaaaacagggtacgaagttttgtttttctggggtatagagcatttccagcaaaagtgtgaaacggttttgtgccggataatgcgacaaaacaaagagttagagcgtttccagcgatttcgttgaaacaggaaccgctctggcgaacgaatgaagggcttacgcgtaggcccgtcccggtttcgggaaagatcaagataaccaaaggttcattatggacgcgagtgcaaaggttcggcggcttgccgcttggtctattcccgttgctttcggtgtgatggggctgaaatatgtggcctatgcgctgacaggctccgtggctctttattcggatgcactcgaatcgattgtcaatgtgattgcggcaatcggcgccgtggtgggccattcgggtcaagctatctgcccgccgacgacaatcatcccttcgggcaccacaaggcggaatatatttcggctgtggtggagggcgttctgattacggtcgccgcacttttgatcttccgcgaggcctggtttgcactggaaacaccgcgaatgctcgatgaaccctggytgggtctcggcatcaacatggctgctgctgccataamcggcctgtgggcgacattgttgattcgcaccggacgcaaattccgctcgccagcactggaagccgacgccaagcacatcatgacggatgtgttcacctctgcgggcgttctggtcggccttgtcggcgtggtggtaaccggttggtcggtgctcgatccattgctcgccattctggtggccatcaatattctctggcagggctggcacgtcatcaattcctcggtccaggggctgatggatattgcggtcgagccgaccgaggaaatgcgtatccgcaatgttatctcggccaatgcgggtggggctatcgaggttcacgctctcaagacacgcattgcggrccgcgtgaccttcatcgagtttcaccttgtcgtggcggcggatatgagcgtcggcgatgcacatgtcatctgtgaccgcatcgaggatgcggtgaaggcgcagatcgagggggggcccgg

SEQ ID NO: 3630 - protein, 731 aa, Brucella abortus
  Xaa in position 323 and 602 is unknown
MNAKTADSEIFQHETAGGIIVERVRHLTAYKGAIESYIDVLNEWRGAVFSSNYEYPGRYTRWDTAIVDPPVVITSRARTMRIEALNARGVILLRPILDTVKALSEVKIDQSGENRIDLTIVEPVGTFTEEERSRMPSVFTVLRAIVGLFFSEEDANLGLYGAFGYDLAFQFDPIQYKLKRPDDQRDLVLFIPDEIFVADHYAARAWVDRYEFRCGGSSTHGLDRATPVVPFKPSERKLARGDHNPGEYARLVERAKESFKRGDLFEVVPGQTFYERCHTAPSEIFRRLKSINPSPYSFFINLGESEYLVGASPEMFVRVNGRXIETCPISGTIKRGEDAISDSEQILKLLNSKKDESELTMCSDVDRNDKSRVCEPGSVRVIGRRQIEMYSRLIHTVDHIEGRLRDGMDAFDGFLSHAWAVTVTGAPKLWAMRFLEENERSPRAWYGGAIGMMHFNGDMNTGLTLRTIRIKDGVAEIRAGATLLFDSNPDEEEDETELKASPMIAAVRDAQKSNQIAEESVAPKVGEGVSILLVDHEDSFVHTLANYFRQTGAKVSTVRSPVAEEIFDRVNPDLVVLSPGPGSPQDFDCKATIDKARKRQLXIFGVCLGLQALAEAYGGALRQLRVPVHGKPSRIRVSKPERIFSGLPEEVTVGRYHSIFADPERLPDDFLVTAETEDGIIMAFEHKHEPVAAVQFHPESIMTLGHNAGMRMIENVVTHLAGKHKARRTNY

SEQ ID NO: 3631 - DNA, 1410 bp, Bradyrhizobium japonicum
  CDS (1)..(1410)
atgaccgataacccgatgtacgttcgcgagttgcagtgggttgaacctgtcacagcgatgcgacgtcttgggcatcgatcgcatctcacgtttctcgatagcgcagcaaggcacgagctgcttgggcgctactcatatctaacgtgcgaccccttcagcacctacagggtcgcgaacggccaagccagttggaacggactgactctcgaggccgatccatggaaggtccttcgcacgctactcgcgaagtacccgcaagagcatcgtcccgatctcccgccattccagggaggagcggcaggctaccttgcctacgacatgaacaggacattggagcgattgtctgccccgccaattgccggtctgggtttgccccaatccatcctgcatttctatgacgtggtcatcagcttcgcccaccgggataacaaatgctggatcgtctcgaccggatggccggagcaggatcgcgtgcgacggagcgaacgagcgcttcgtcgagccgacgagtttgcagcattgcttgccggtccaaacgcgccacagaagggttgtcccagcaaagcgggcgcgtggcgctcgaacttcagccgcgacggctacattgcggcggtacaacgcgtgatcgacttgattctcgcgggtgacgtgttccagacaaatattgcgcagcgtttcagcacccgcctgtcgacctcgtttgatccgctcgccttctattgccagctacgatcattgaatccggcgccttttgcggccctgctgcgatggggaaagctgaccatcgcatcaagttcgccggaacgattcctgaaacttgaggggcgacaagtcgagacacgccccatcaagggcacgatagcgcgttcgcctgatcccaaggaagaccaccgccgtgcggctgctctcctcgcttccgaaaaggatcaggccgagaacacgatgattgtcgaccttttgcgtaacgatctgtcacgcgtttgcactgcgcattcggtcggggttccggccctatgcaatctcgagtcctatgcctcggtgcaccatctcgtgtcgatcgttacggggaaacttgccggagacgaagacgccgttagcctgctccgcgcttgctttcccggcggctccattacgggagcgccaaagccgcggtcgatggaaattattacagaaatcgagcgcatagcgcgagaggtctattgtggggcgatcggcttcatcggcttcaacgggcacatggacaccagtattgcgatccgcactgtcacgatcgacggcgacctggctgtgtttcatgcgggcagcggtataacggccctgtcgaagcccgaggccgaatacgaggaaacgctcaccaaggcagagcgaatctttgatgcatttggtactgaaccagctggtgcattttga

SEQ ID NO: 3632 - protein, 469 aa, Bradyrhizobium japonicum
MTDNPMYVRELQWVEPVTAMRRLGHRSHLTFLDSAARHELLGRYSYLTCDPFSTYRVANGQASWNGLTLEADPWKVLRTLLAKYPQEHRPDLPPFQGGAAGYLAYDMNRTLERLSAPPIAGLGLPQSILHFYDVVISFAHRDNKCWIVSTGWPEQDRVRRSERALRRADEFAALLAGPNAPQKGCPSKAGAWRSNFSRDGYIAAVQRVIDLILAGDVFQTNIAQRFSTRLSTSFDPLAFYCQLRSLNPAPFAALLRWGKLTIASSSPERFLKLEGRQVETRPIKGTIARSPDPKEDHRRAAALLASEKDQAENTMIVDLLRNDLSRVCTAHSVGVPALCNLESYASVHHLVSIVTGKLAGDEDAVSLLRACFPGGSITGAPKPRSMEIITEIERIAREVYCGAIGFIGFNGHMDTSIAIRTVTIDGDLAVFHAGSGITALSKPEAEYEETLTKAERIFDAFGTEPAGAF

SEQ ID NO: 3633 - DNA, 2145 bp, Catharanthus roseus
  CDS (53)..(1879)
ctcattcattcattcagtggctgctcaacacagcacaattctcaatattgcaatgcaatctgtatcatcttcttcttcaatttctactttcaagtctggatcgctatctccggtaatggaaaccctagcatttttctcagaaaccgaacgtttgcccttctcttctccatgttccgtccagttacaaagctatttctttcgccaactcgcctgctgctctcttcacctcctcgtcttatcaagtccgctgctcgataaatgttctgccgtctcgccgccttcatttgtcgaccattcagcgaagttcaaggtggcggcgaagcatgggaacttgattcctttgtacaggcctatattttcagatcacttgacgccagttctagcttaccgttgcttggttaaggaagatgacagagaagctcccagctttctttttgagtccgttgagcctggcttgaaagtctccaacgttgggagatatagtgtgattggagctcaaccaactatggaaatagttgctaaagagaacatggtgactgtgatggatcaccgtcaaggtcgtcgtgtggagcagtatgaggaggatcccatggtagttcctcggagaattatggagaagtggaaaccccagcggaccgaggagctacctgaagctttttgtggtggctgggttggttatttctcatatgatacagtaaggtatgtagagaagaagaagttgccattctcaaatgctcctgtggatgatagagaccttcctgacattcatctaggactttatgatgatgtaattgtatttgaccatgtggagaagaaagcttatgtaatacattgggtgcggctggatcaattttcttctgttgaggaggcttataaagatggaatgaagcgcttggaatctttggtatcgagagtgcatgacatagtccctcctaagttgtccgcggggtcgattaatttacatactagtctttttggccctaaattgaagaattcgaccatgacaagtgaagaatatgagaaagccgtcttgcaggctaaggagcacatcctggctggggacatattccagcttgtcctaagtcagcgttttgaacggcgaacatttgcagatccatttgaagtctaccgagcattgagaattgtcaacccaagtccatatatgacttatttacaagcaagagggtgtattttggttgcttcaagtcctgaaattcttactcgagttaaacagggaacaataacaaatcggcccttagcagggactactcggagggggaaaacaccaaaagaagattatatgttggaacaacagctccttaatgatgaaaaacaatgtgcagaacacattatgcttgtagacttgggaaggaatgatgttggaaaggtatcaaaacctggttctgagaaggtggagaaactgatgaacattgaaccatattcacatgtcatgcacatcagctctacagttactggagagttacttgataacttaactagctgggacgttctacgtgcagcattgcctgttggaactgttagtggagcaccaaaggtcaaagctatggaattgatcgatgaactggaagttacaaggcgtggaccatatagtggtggatttggaggaatttccttttccggtgatatggatgttgcattagcattgagaaccattgtattctccattggaacaagatatgacactatgtactcttacaagacgaggttcaagcgccgagaatggatcgcccatctgcaagctggtgcaggtatagtagccgatagtgatccagctgacgagcagagagaatgtgaaaataaatctgcagctcttgctcgcgctattgatcttgcagagtcatcatttgttgataaatgatcggccaagaaagaagtcgtctccttgccacatcgcgatcgttgtgtgtatcaaaatggtaggagaaaactgtatgatttttgcaaggcagatttcttgatgatttttagcaaaatttggccttggagaagtccctagttagttgtggttagttagtcataataatccatgaatcatccattgtaggtcagtaaatttggtgtaatgttgtttttattggaaaccaataatgccaattgatgagccttaaaaaaaaaaaaaaaaaa

SEQ ID NO: 3634 - protein, 608 aa, Catharanthus roseus
MQSVSSSSSISTFKSGSLSPVMETLAFFSETERLPFSSPCSVQLQSYFFRQLACCSLHLLVLSSPLLDKCSAVSPPSFVDHSAKFKVAAKHGNLIPLYRPIFSDHLTPVLAYRCLVKEDDREAPSFLFESVEPGLKVSNVGRYSVIGAQPTMEIVAKENMVTVMDHRQGRRVEQYEEDPMVVPRRIMEKWKPQRTEELPEAFCGGWVGYFSYDTVRYVEKKKLPFSNAPVDDRDLPDIHLGLYDDVIVFDHVEKKAYVIHWVRLDQFSSVEEAYKDGMKRLESLVSRVHDIVPPKLSAGSINLHTSLFGPKLKNSTMTSEEYEKAVLQAKEHILAGDIFQLVLSQRFERRTFADPFEVYRALRIVNPSPYMTYLQARGCILVASSPEILTRVKQGTITNRPLAGTTRRGKTPKEDYMLEQQLLNDEKQCAEHIMLVDLGRNDVGKVSKPGSEKVEKLMNIEPYSHVMHISSTVTGELLDNLTSWDVLRAALPVGTVSGAPKVKAMELIDELEVTRRGPYSGGFGGISFSGDMDVALALRTIVFSIGTRYDTMYSYKTRFKRREWIAHLQAGAGIVADSDPADEQRECENKSAALARAIDLAESSFVDK

SEQ ID NO: 3635 - DNA, 1551 bp, Pasteurella multocida
  CDS (1)..(1551)
atgtcattcgcttttattcataccttaactcaatcattaccttattacgccgatccaacacatgtttttgcggcactctgtcaggataaaaccaacacgctgttactcgaatctgctgaaattcacagtaaaaatagtttaaaaagcctcttagttatacaacccgcactaaaaattacctgtcatggattacgtgtgaccttctgtgctaaaacacaaaatggcgtcgctgttttgcatgcacttatagagaagttacaatgtcactatgaaatcagtgcagtcacagagagtcaattctcagttatctttccaaaacttgacaaaaaccttgatgaagacaacaaattacatgcttcaacttgttttgatgcgctacgtgccctgctctcactttatcaacatagtgaggtccccgttctgttaggcggtttatttgcttatgatttagtgacccagtttatccctatggataacatccaattacaagaggatgggctcgattgccctgactattgtttctacttagcggaacatcaattgacactcgatcatcaattacaacaagctcagctacacagtttctgttttgcgccacaatatcaaacagcgctacagcaacaagctgatcagataatacaaaaatttgcaaatattgaaccgcacttacattgtgtttcagcggacactacgctgacaacgaaccttgatgatgtacaatttaaacaaattattcaggtattaaaacaacatctttatcaaggtgatgtatttcaaattgtgccttcccgtcgcttttcgttagcctgtccaaatacattggcaagttaccgacagctgaaacacacgaatccgagcccttatatgttctttatgcaagatgaagactttactctctttggcgcctcaccagaaagtgcattgaaatatacacagcaaacccgtcagctcgagatttatccgattgcgggttcacgcccgcgcggtttttatcccaatggtcagattgatccagaattggacgctcgcttagaactggaattacgtttagatcaaaaagaactcgcagaacatttgatgttagtggatttagcccgtaatgatattgcacgggtttgtgaaaccgggacacgccaagtggcggatttaatgcaggtagatcgctattctcacattatgcacttagtttctcgcgtggtgggcaaattacgacctgaattagatgcgttacacgcctatcaagcttgcatgaacatggggacactcactggtgctccaaaaattaaagcaatgcaactgctctatcaagttgaacaacaaaaacgacatagttatggcggtgcggtagggtatctcgcttcgaatggcgatttagacacgtgtattgtgatacgttccgcctttgtgcaacaaggtattgcctacatccaagccggttgtggcgaagtgctcgattcagatccgcaaaaagaagccgatgaaacacgacacaaagcacaagccgtgattaacgcgattgttcaaactcaccaaacacctcgtcaagcataa

SEQ ID NO: 3636 - protein, 516 aa, Pasteurella multocida
MSFAFIHTLTQSLPYYADPTHVFAALCQDKTNTLLLESAEIHSKNSLKSLLVIQPALKITCHGLRVTFCAKTQNGVAVLHALIEKLQCHYEISAVTESQFSVIFPKLDKNLDEDNKLHASTCFDALRALLSLYQHSEVPVLLGGLFAYDLVTQFIPMDNIQLQEDGLDCPDYCFYLAEHQLTLDHQLQQAQLHSFCFAPQYQTALQQQADQIIQKFANIEPHLHCVSADTTLTTNLDDVQFKQIIQVLKQHLYQGDVFQIVPSRRFSLACPNTLASYRQLKHTNPSPYMFFMQDEDFTLFGASPESALKYTQQTRQLEIYPIAGSRPRGFYPNGQIDPELDARLELELRLDQKELAEHLMLVDLARNDIARVCETGTRQVADLMQVDRYSHIMHLVSRVVGKLRPELDALHAYQACMNMGTLTGAPKIKAMQLLYQVEQQKRHSYGGAVGYLASNGDLDTCIVIRSAFVQQGIAYIQAGCGEVLDSDPQKEADETRHKAQAVINAIVQTHQTPRQA

SEQ ID NO: 3637 - DNA, 1416 bp, Streptomyces coelicolor
  CDS (1)..(1416)
atgagcaccggatcccggaacatctgggaggcatgggcgaggtccgtcccaccactcgtgtgcgcgagcacccgcgagccctgccacgacccggccgccaccgccacccgcctcgcacgggcgggcttggcgggccagtacgtggtgtacgagtcggaaggcggggtctggcacttcgctgcgggctccgacgtcagcgtcaccgcggatgccaccggcatcaccgcgcgggccgccgggcgtacctggagctcgcgcacgcagcggcggccgttgacggcgttcgccgacgccctggccgcgttgccgcccgtgtccggcttgcccgacgagagcggcgaggagcgccgcttctacggctgggcggccttcgaactcgcccacctcctgcacgcggaccccgcgacggccggagaccggccgctgctgcacgccctgatcccgtccgtcgaagtgaccctcaccggcgactcgacagtgatccgcgcggtggacgaggcatgggcgcgcaaggtcgccgacctgctcgcggagcccgcggccgagcagaccccccacgacgaaccggcgcgggaccggaccgaggacgtcatcgccgtcggtaccgccgcctacggccgagcggtctcccgcacggtccgggacatccgcgccgggttgctggagaaggccgtcgtctcccggcaggtccccctgcccgccgagccgcgccccgacttccccgcgacctacctcgcgggccgccgggccaacacaccggcacgttcctacgtgctggacctcggcggttaccgggctgccggattcagccccgagaccgttctcgaggtcgaagacgacgggcgggtcagcacccagccgctcgcgggcacgcgcgccctgggcgccgacccggcggagaacgagcgccggcgcgcggaactgctcagcgaccccaaggagatacacgaacacgccgtgtccgtacgtctcgcctgggaggagatggcggccgtgtgccgtcccggctccgtggtggtcgaggagtacatggcggtccgcccacgaggatcggtgcagcacctggcctcacgggtgacgggccggctccggccggacgccggaccctgggacgccttcgcctccctgttccccgcgatcaccgccaccggagtctccaaacgcgccgcgctccaggccctggcccgccacgaggaagggccacgcggcctgtacggcggggcggtcttccggggcagcaccagcggcgccctcgacgccgccctcgtcctgcgcaccctgatcggcgcgggcgacgaggcgtggctgcgagccggcgccggggtcaccgcccagtccagccccgagcgggagaccgaggagacctgcgagaaactccgcagcgtcgccccgtacctgaggttctccctgacctga

SEQ ID NO: 3638 - protein, 471 aa, Streptomyces coelicolor
MSTGSRNIWEAWARSVPPLVCASTREPCHDPAATATRLARAGLAGQYVVYESEGGVWHFAAGSDVSVTADATGITARAAGRTWSSRTQRRPLTAFADALAALPPVSGLPDESGEERRFYGWAAFELAHLLHADPATAGDRPLLHALIPSVEVTLTGDSTVIRAVDEAWARKVADLLAEPAAEQTPHDEPARDRTEDVIAVGTAAYGRAVSRTVRDIRAGLLEKAVVSRQVPLPAEPRPDFPATYLAGRRANTPARSYVLDLGGYRAAGFSPETVLEVEDDGRVSTQPLAGTRALGADPAENERRRAELLSDPKEIHEHAVSVRLAWEEMAAVCRPGSVVVEEYMAVRPRGSVQHLASRVTGRLRPDAGPWDAFASLFPAITATGVSKRAALQALARHEEGPRGLYGGAVFRGSTSGALDAALVLRTLIGAGDEAWLRAGAGVTAQSSPERETEETCEKLRSVAPYLRFSLT

SEQ ID NO: 3639 - DNA, 1350 bp, Xanthomonas albilineans
  CDS (1)..(1350)
atgctgcgtaccgttcccctgccggccgagattgatctgctggccttgcatcgtctggcgccgcagcgctatccggtgttgctggagtcggcggcatcgggcaccgcgcaagggcgctgggatttgctgttggtcgccgacggccaggggctgcgcctggatcgtgatggtgtcacccgcgaactgcagggggtggccgtcgagggcgatttcctgagtgtgctggatgcgcgctggcacgccgcgcgcagcgcgcgcgacgagccgcgctggccgttccgcggtggttgggcgttgctgctggattacgaactggccgcgcaggttgaaccgatactaccgttgccgcagtccgcggcggcgacgcccgcggcgctggccttgcgttgccccgccgcgttgctgcgcgaccatgtcagcggcgattgcgtggcggtggccgagtccgcgcatgcggcgctgttggagaccgtccttgccgatctaggtgccttgcccggtgcggccccggcgcctgtctggaccgcgccgctggcgatcgaggaagacccgccgcaacgctttatcgagggggtgcgccgtattctcgattacctgggggccggtgacgtatttcaggtcaacctgtcgcggcgctggacggcgcgcttcgctgcggcggtggcgccggcggcgctgtacgcgcagttgcgccgtgccaacccggcgccgtttgctggcctgttcgtcggtcatggtcgtgccgtggtgagttcctcgccggagcgtttagtgtcggtgcgcggcgacgtggtcgagactcggccgattgcgggtacccgcgcgcgcgcgccgggcgacgacgctgccgcgcgcatccgcgaactggtcggccatcccaaggaacgtgccgagcacgtgatgctgatcgatctggaacgcaacgacttgggccggatttgcgcgcctgacagtgtcgaagtggacgaactgatgacggtggagagctatgcccatgtgcatcacatcgtcagcaacgtgcgcggccgcctgcgcgatggggtcagcccaggcgaggtgatccgcgccacgtttccgggcggcaccatcaccggctgtcccaaggtgcgttgcatgcagatcatcgccgaactggagcaaaccccacgcggcgcctacaccggcgcgttcggttggctgaactgcgacggcgacatggacctgaacatcctcatccgcaccgccgaggtggaggctgcgcaggtgcagttccgcaccggtgccggcatcgtgttcgattcccagcccgagcgcgaactcgacgagaccctggccaaggcgcgcggcctgctgcgcgctctggaaccctga

SEQ ID NO: 3640 - protein, 449 aa, Xanthomonas albilineans
MLRTVPLPAEIDLLALHRLAPQRYPVLLESAASGTAQGRWDLLLVADGQGLRLDRDGVTRELQGVAVEGDFLSVLDARWHAARSARDEPRWPFRGGWALLLDYELAAQVEPILPLPQSAAATPAALALRCPAALLRDHVSGDCVAVAESAHAALLETVLADLGALPGAAPAPVWTAPLAIEEDPPQRFIEGVRRILDYLGAGDVFQVNLSRRWTARFAAAVAPAALYAQLRRANPAPFAGLFVGHGRAVVSSSPERLVSVRGDVVETRPIAGTRARAPGDDAAARIRELVGHPKERAEHVMLIDLERNDLGRICAPDSVEVDELMTVESYAHVHHIVSNVRGRLRDGVSPGEVIRATFPGGTITGCPKVRCMQIIAELEQTPRGAYTGAFGWLNCDGDMDLNILIRTAEVEAAQVQFRTGAGIVFDSQPERELDETLAKARGLLRALEP

SEQ ID NO: 3641 - DNA, 1071 bp, Thermoplasma acidophilum
  CDS (1)..(1071)
atggtggtgtgcatgaacctgatcgatgagctctcagagtacagagaccgcgggtcattggcttactttgcgtcatttcctgatcgcatttcaggctacgagtacgcctttctcggagacggcatgatcacggatccggagaggatattcgacgggaagctcaggcccttgatcgtcacatacgatttcgtgaacagcgtattcggacaaaaagtccgcagatcggggtggccggagatggtctcgttcgatcctgatacggttatgaagaggaggatcgtgagaagcggctatctcaccagaaaggaggtcggcgatttctcggacccggatctttccaggaaaatagctgaggtcagggatctcataagatccggcgaggtactgcaggccgtcatatcgcgcgacttcgaagcatgcatagatccctgggaaaagctgcgggaattcatagatcacgatcggtcacgttacgttttctactacaggatcggaaaataccaggtcgtcgggagctcccccgagaacctggtcaccgtcagcggaaacgaggtgttcaccgatcccatagcgggtaccgtgccttccacggtcagatcttccgtgcttcttgaaagcatgaaggacgcaaacgagcaccgcatgcttctggatcttgccaggaacgatctcagcaagttcgcggatatcggtacgctcggcgtttccaaggtcatgcagatagaggagttctcctcagtgaagcatctggtgagccaggtgcgggcatcattttcaaacactccgtacctagacatactgaagtcgatgttccccgccggcacggtgtccggatcacccaaggaacgtgcaatagagatcatagagaagtacgaagaaacgccgcggggcccctacggcggatccataggcataaccatggacggcatgatggatcttgcgctgacaataagaagcgcgtattccgatggcagcggattccgggtcagggccggtgcaggcatagttaaggattccgatcctgatgccgaggttcgcgagatatattccaaggcgaggtcggtcatttga

SEQ ID NO: 3642 - protein, 356 aa, Thermoplasma acidophilum
MVVCMNLIDELSEYRDRGSLAYFASFPDRISGYEYAFLGDGMITDPERIFDGKLRPLIVTYDFVNSVFGQKVRRSGWPEMVSFDPDTVMKRRIVRSGYLTRKEVGDFSDPDLSRKIAEVRDLIRSGEVLQAVISRDFEACIDPWEKLREFIDHDRSRYVFYYRIGKYQVVGSSPENLVTVSGNEVFTDPIAGTVPSTVRSSVLLESMKDANEHRMLLDLARNDLSKFADIGTLGVSKVMQIEEFSSVKHLVSQVRASFSNTPYLDILKSMFPAGTVSGSPKERAIEIIEKYEETPRGPYGGSIGITMDGMMDLALTIRSAYSDGSGFRVRAGAGIVKDSDPDAEVREIYSKARSVI

SEQ ID NO: 3643 - DNA, 2986 bp, Buchnera aphidicola
  CDS (1)..(1566)
atgcaaagtattagccataaaattgaaattattcaaagacaagcacaatatcattctgatcctacattgttttcaaatcattttgcggcgtcaagatcagctacactattattagaaacagcagaaattaagaagaaaaacaacttagaaagcattatgattgttgatagtgcaatacgaatatctgctattaaaaattcagttcaaatgactgctttatctattaatggacaagcaatattagctgctttcaaacaaacatatcatcacacattaacgctattggaaaaacaatctagcctctgtttcacttttcctactatgaatcataatgctgatgaagatgaaaaaattcttgcattatcaatattcgattcgtttcgatttattatgaagctattttcgaatacgactaaagtgagtaaagggatgttttttggtggactattttcttatgatcttattgctaactttgaacaattaccggatgtaatacgaacacaaaagtgtcccgatttgtgtttttatttagctgaaactttattagtattagatcatcagaaacaacaatgtttgattcaaagtagtatatttagtcaaaataccaatgaacataagagaatcgaaataagatccaaagacatacaaaagatgttacaacaagagttgtcttacaccccacctaaaatagcacatgttcacactaatgtaacttcaaatatgagtgatgctgaatattcatcaatcattacagaattacaagaattcattcaaaaaggtgatatttttcaagttgtaccttcgcgaaaattttttttatcatgttatcatgcactgtcagcgtatcaggcattaaaaattagcaatcccagtccatatatgttttttatgcaagatcaactattcacgttatttggtgcatcccctgaaagttctttaaagtataatcgcattacaagacaagtggaactctatcctatcgccggaacgaggcctcgaggaaaacgcacagacgggagtatagattacgatttggatagcagaattgaactagaaatgagaaccaatcaaaaagagttatctgaacatttaatgcatgtagatttagctcgaaatgatctggctcgtatttgtgaaccgggttcacgatatgtatcagaattagtcaaagtagataaatattcacatgtgatgcacttggtatctaaagttatcggcacactaaaatctcatttggatgcgcttcatgcatatgcctcctgtatgaatatgggtaccttaaccggagcccctaaagtgcgtgccatggaattgattgcagcatgcgaaaaagaaacacgggggagctacggtggcgctatcggatattttactgatgaaggtaatttagatacgtgtatcaccattcgttcagcttacatcgaaaaagatatggcaacggttcaatctggagcaggtgttgtgttgaactctactgctcaagaagaggtgacagaaagtgtcaataaagctgctgcagtaattaacgctattcaaacagcacatcgtttaacaggatctttttaaaatatggctgatattttacttttagataacattgattcgtttacataccatcttgtagatcaaataagaaaacacgcacataatgtgattatatatcgtaataccgtaaaattgaattattttaacatgcctaatgcaggtaaattgcatcctgttatcatggtatctcctggaccaggtcgacccattcatgcaggatgtatgttacgcttaattaaaatagtaaagggaaaggtgccgatcataggtatttgtttaggtcatcaagcgattgtagaagcgtatggtggcgtgattgactatgctgatgcaatattccatggaaaagtgtcgcgtatctgtcacgatggtctagaaatgtttcacaatattccccaacacttatcagtagcacgatatcattcattggtgtgcaaaaaatgtccttcatactttgttgttaactcttatgttgacaatattatcatgtctatcagacataatactcatcgtgtatgtggttttcaatttcaccccgaatctatcttaacgcctgttggtgatcaattattagaacaagtcatctattgggcggtatcaaaaaatagttcacatcagaacagagtataagattgttttgcgatgatatacatcattctatcccaacacagatggtatcatttgtatatcggttatattcttttctatacattaaaacattacgattagcatacccctattattaagtttcaccccttttttaaacggttgcttcaatacaagttatccacaagttatccacaatagagataatctactaaattagattgtaagatagaaaatcgtgataagatgatatgtcttgtaagatagaaaatcgtgataagatgatatgtcttgtaattaacgatatttattgaaaatatcactaatatcctgatggctgttagtactagtgtttaataaaaagatagcatgtccgaaaaactgtatcaaatcaacaatatctagtactgtttaattaaataacagttgttatatagtgctattttaatatagttcatatgtgctgtttctattataacatcacatgctattgtattgatatgagaatattcaaaacatgtgagtaagaacataaaatacaaaaacattagatatgttttttgttactatatttattattaatatttattaattattattagtattaatatttattaattattattagtattaatatttattaattattattagtattaatatttattaattatttagtattaatttgtatatttatcatatacttaagaacatttgataccttttaaagtataaagtatatctatactaattatgtaataaaactgattgaaatcaaagacgatatgttattgataatgcaatatcatgatgtatgaacagagatgtcaaacgt

SEQ ID NO: 3644 - protein, 521 aa, Buchnera aphidicola
MQSISHKIEIIQRQAQYHSDPTLFSNHFAASRSATLLLETAEIKKKNNLESIMIVDSAIRISAIKNSVQMTALSINGQAILAAFKQTYHHTLTLLEKQSSLCFTFPTMNHNADEDEKILALSIFDSFRFIMKLFSNTTKVSKGMFFGGLFSYDLIANFEQLPDVIRTQKCPDLCFYLAETLLVLDHQKQQCLIQSSIFSQNTNEHKRIEIRSKDIQKMLQQELSYTPPKIAHVHTNVTSNMSDAEYSSIITELQEFIQKGDIFQVVPSRKFFLSCYHALSAYQALKISNPSPYMFFMQDQLFTLFGASPESSLKYNRITRQVELYPIAGTRPRGKRTDGSIDYDLDSRIELEMRTNQKELSEHLMHVDLARNDLARICEPGSRYVSELVKVDKYSHVMHLVSKVIGTLKSHLDALHAYASCMNMGTLTGAPKVRAMELIAACEKETRGSYGGAIGYFTDEGNLDTCITIRSAYIEKDMATVQSGAGVVLNSTAQEEVTESVNKAAAVINAIQTAHRLTGSF

SEQ ID NO: 3645 - DNA, 2630 bp, Buchnera aphidicola
  CDS (1)..(1566)
atgcgaataaaaatagtcgtcataaaattcaagcaaaaacaagtacattatcaccctgatcctacaattatttttaatcatctttgtggatcaagatcagcgacattattgctggaaaccgctgaaattaataagaaaaaaaatttagaaagcatcatgatcatcgacagtgcgatacgatatcccgcgatgaaaaattcagtccaaatcaccgctctttctcttaatggaagagtaatactgtcatttttaaaagatacgcttgaaaaaaaaataaccattctgtcaaatgatacaagtattaatttaatttttcctgttatagaaaaaaatattgatgaagataaaaaaattttatcattgtcaatatttgattgttttagattcattatgaatatgtttaaaaatacaaaaaaaatcagcaaagctatgtttttcggaggcctgttttcctatgatcttattgctaactttgaatctttacctcatgtaaaaagaaaacaaaaatgccctgatttatgcttttatttagcagaaaccttgctggtattagatcatcaaaaacaaacctgtttaattcaacatagtttatttagcaataattgtgatgaatataaaagaatacaaaaaagatcaaagaagatcacaaagaaactgacacaaccattatttaagattccaaaaaaaaacgtacatatggcgacctcattaacgtcaaatatgagcgatcttgaatatgcgtcgattattaaagaattacatttatttattcaaaaaggtgatatttttcaggtagtgccttcccgaaagtttttcttaccgtgctatcattcgttagcagcgtatcaagaattaaaaataagtaatccaagtccgtacatgttttttatgcaggatgaaatatttacattatttggtgcgtctccagaaagttctttaaaatatgatgaaaccaccagacaagcagaactatatcctatagcaggtacgagaccgagaggcaaaaaaaaagacggtactatagattatgatttagatagcagaattgagttagaaatgagaaccaatcaaaaggaactagccgaacacttaatgcttgttgatttagcacgaaacgatcttgctcgcatttgtgaaccgggttcacgatatgtatcagagttagtaaaagttgataaatattcacatgttattcatttagtttctagggtaattgggacattaaaatctgatttagatgctttacatgcttattctgcttgtatgaatatggggactctaactggtgtccctaaagtacgcgctatgcaactcattgcaagatatgaaaaaggaacacgaggcagctatggaggcgctataggatattttactgacacaggccagttagatacctgcataacaattcgatcagcttatgtagagcaaaatatggcaacaattcaagctggtgcaggtattgtattaaattcaatagccgaagaagaaatcaaagaaagcttaaacaaagcaaaggctgtaattaatgctataaaaacagcacattatttaataggatctttttaaacatggcaaatattttactcttagataatgttgactcctttacttataatcttgtggatcaattaagaaaacataaacataatgttttagtctatcgtaatactgttagcattcaaataatttcacagacgcttatgcaattgataaaccctattgtagtattatcgcccggcccaggtttgcctcatgcttcaggatgtatgttagatttgataaaaacagtaaagggtcaagtacctattataggtatttgtttaggacaccaagcgatagttgaggcgtatggtggaacgatcgagtatgcaagtgaaatattccatagcaaggtatctttaattcagcatgacggtttagagatgtttaaagacattccacaacctctttctgtcgcatcgatcgattcattaatttgtaatcaacttccagcgtgttttatcatcaattcctcaattgataatatgattatgtctataagacataatgctgatcgcgtatgtggttttcaatttcatcctgaatctattttaactccttatggtgatcaaatattagaacaaattatctgttggtcattattgaaatatgattcaaatatcaaataattaatatatcaaaatgattacaccaatggtatatatgatattatgaaggagtgattatccacaagttattacaacttaataaatttagtagaaatgctaattaattagcattttttaaaaaatattcaatatttctatttttgatcaaaattaatataaaaatattttttaatatatagatatagagttaataaacattgtaaacaaaaaaaaagattaataaatgtagataaaaaatacattatgcctttagaaataattcactatgattctttttatctggtatactttactaaagtaatatcaatttatttaaattatatattttatagcattgaatattattaattatgtgtctgttttagtatgtataaatgcttccacagtctgtatggctaaatcaagtgaatctattgtttatagaaaagaatgtgatataatttttttaacgaaagagatatt

SEQ ID NO: 3646 - protein, 521 aa, Buchnera aphidicola
MRIKIVVIKFKQKQVHYHPDPTIIFNHLCGSRSATLLLETAEINKKKNLESIMIIDSAIRYPAMKNSVQITALSLNGRVILSFLKDTLEKKITILSNDTSINLIFPVIEKNIDEDKKILSLSIFDCFRFIMNMFKNTKKISKAMFFGGLFSYDLIANFESLPHVKRKQKCPDLCFYLAETLLVLDHQKQTCLIQHSLFSNNCDEYKRIQKRSKKITKKLTQPLFKIPKKNVHMATSLTSNMSDLEYASIIKELHLFIQKGDIFQVVPSRKFFLPCYHSLAAYQELKISNPSPYMFFMQDEIFTLFGASPESSLKYDETTRQAELYPIAGTRPRGKKKDGTIDYDLDSRIELEMRTNQKELAEHLMLVDLARNDLARICEPGSRYVSELVKVDKYSHVIHLVSRVIGTLKSDLDALHAYSACMNMGTLTGVPKVRAMQLIARYEKGTRGSYGGAIGYFTDTGQLDTCITIRSAYVEQNMATIQAGAGIVLNSIAEEEIKESLNKAKAVINAIKTAHYLIGSF

SEQ ID NO: 3647 - DNA, 2591 bp, Buchnera aphidicola
  CDS (1)..(1560)
atgcaaaacgaccgtcatgaagttgatatttatcaaaaaaaagtgtgttatcattccgatcctacaataatttttcatcatctttgtggatcgagatcagcaacgttattactggaaacagcggaaattaacaaaaaacacaatttagaaagtatcatgatcattgacagtgcaatacgcatatctgcacaaaaaaattcagtacaaataactgccttatccctgaacggggcagcaatattagctgccttaaaacatagactgcacaaaaaagttacaatgtttgaagatagtaataaaaaaattcatttaatttttcccttgttaaacaaaaatatcgatgaagataaaaaaattcttgcattatccatctttgattgttttagattcattatcaatgcatttaaaaatacagaaaaaatcagcaaaggcatgtttttcggcggtcttttttcttatgatcttattgaaaattttgaagttttacctcttttgcaacgaaaacaacagtgccccgatttgtgtttttatttgtcagaaactttattagtttgggatcatcaaactcaaacatgtttaattcaaaacagtttatttactagggacagcaatgaacgagacagagtgaaagagagatcaaaaacgatacaacacaaattaacacaacaattgcacagcatcccccaacatcaagcacatacacaagaagcactcttgacatcaaatatgaccgatgctcaatatttatcaatgattaaacaattacaaatatttattcaaaaaggtgatatttttcaagtcgttccttctcgaaaattttttttaccgtgtcggtatgcgttgtcggcatatcaggaattaaaaaaaagtaatcccagcccttatatgttttttatgcaagatcaagcatttatattatttggccgttcgcccgaaagttctttaaaatatgatgaaaaaaacagacaaatagaactgtatcctatagcaggtacaagatctcgagggaaaaacaaaaacgggagtataaattatgatttagacagtagaattgaactagaaatgagaactaatcaaaaagaattatctgaacatttgatgcttgtagatttagcacgtaacgatcttgcccgtatttgtgaacccgggtcacgatatgtttcagagttgttaaaagtggacaaatactcacatgttatgcatttggtttcgaaagtgattggtacgttaaaatctaacttagacgtgttacacgcctatgctgcttgtatgaacatgggaactttaacgggcgcacctaaggtacgtgcgatgcaattaattgcaaaatatgaaaaagaaacaagaggcagttacggcggagctataggttatttgaccgatgcaggtaatttagacacttgcataacaattcgttctgcttatgtagaacaaaatattgcaactgtgcaagccggagcgggggtggtattaaactcaattgctaaagaagaagttcaagaaagtatcaataaagctacagccgtaattaatgctatcaaaacagcacattacatttgatgaggctcgtaaaacatggcgaatattttacttttagataatgttgattcgtttacttataatcttgtggatcaattaagaacacacaacaacactgttgtggtgtatcgtaatactgttgatatcaaaattatattacaaactttagctcaatggagcaatcctatcttagtgttgtcacctggaccggggaccccttacactgcaggatgtatgttaaatcttatcaaaagcgttaaggggaatatccctattataggaatttgtttagggcatcaagcgataatcgaagcctatggcggttcaattaagtatacagatgagatatttcatggaaaggtatctttaatcaatcacgatggtttagagatgtttaaaggcatcccccagcctttatcagtcgctcgataccactccttggtttgtgatgaaatcccttcatgttttaccgtgaattcttctatacataaaatgatcatgtctataagacataatgttgaatatgtatgcgggcttcaatttcaccccgaatctattttgacccctcatggtgaccagatattaaaacaaatcattgattgggcatcattaaaatatatctaacgatcaacatcatcgttatagaactgcgcatgttatatgataaatcttttttttttattagtttgtaatttattttgagttcatatctttttcaaaaaaagtcaatccaagttattccaggtttatcaatcaacctaatcaattattttacttatccacaggttatccacaggttatccacaagataaaataggataacctatgttattaaagttaaatatataccggttatacaaatttatataatggttattaaaaaaataaaaaaaataaaaaatactattattatattgttatttctctcttatttcagtacactaattgataattaaaattatattaaatgtttacatattttaatgctatagtatttaaaaaataacacttagacatataaaaaatcaatgaaattaatagagatgtagaaa

SEQ ID NO: 3648 - protein, 519 aa, Buchnera aphidicola
MQNDRHEVDIYQKKVCYHSDPTIIFHHLCGSRSATLLLETAEINKKHNLESIMIIDSAIRISAQKNSVQITALSLNGAAILAALKHRLHKKVTMFEDSNKKIHLIFPLLNKNIDEDKKILALSIFDCFRFIINAFKNTEKISKGMFFGGLFSYDLIENFEVLPLLQRKQQCPDLCFYLSETLLVWDHQTQTCLIQNSLFTRDSNERDRVKERSKTIQHKLTQQLHSIPQHQAHTQEALLTSNMTDAQYLSMIKQLQIFIQKGDIFQVVPSRKFFLPCRYALSAYQELKKSNPSPYMFFMQDQAFILFGRSPESSLKYDEKNRQIELYPIAGTRSRGKNKNGSINYDLDSRIELEMRTNQKELSEHLMLVDLARNDLARICEPGSRYVSELLKVDKYSHVMHLVSKVIGTLKSNLDVLHAYAACMNMGTLTGAPKVRAMQLIAKYEKETRGSYGGAIGYLTDAGNLDTCITIRSAYVEQNIATVQAGAGVVLNSIAKEEVQESINKATAVINAIKTAHYI

SEQ ID NO: 3649 - DNA, 1706 bp, Bordetella bronchiseptica
  CDS (75)..(1595)
cggaacccgtaactggaccgggctttttgctgcatgcccggtccgtaccagaaaaacgccgtacgagacccgacatgactgaacttgaattcaaagcgctggccgcccaaggctacaaccgcattcccctggtcgcggaaacctacgccgacctcgacacgccgctggcgatctacctcaagctggcccacagcggcccgcaaggcggccgcatgagctgcctgatggagtcggtggtgggcggcgagcgctttggccgctactcgttcatcggcctgccggcgcgcaccgtcatccgcgccagcggctcgaccaccgaagtgctgcaggacggccacgtcgccgaaacccacgaaggcgacccgctggcgttcatcgagtcgtaccaggcccgcttcaaggtggcgctgcgccccggcatgccgcgcttttgcggcggcctggccgggtacttcggttacgacaccgtgcgccacatcgaacagcgcctgggcccggcggtcaagccgtttcccgacggcatggaagaaggcacgcccgacatcatgctgctgcacgtcgacgaactggtcatcgtcgacaacctggccggccgcacctacctgatggtgtatgccgacccggcccagcccgaagcctacagccgcgcccagcagcgcctgctggagttgcgcgcgcggctgcgccgcccggtcgagatcccgtacagccacgccagcatgcagaccgaagagcggcgcgacttccagaaggccgactacctggccgcggtggcgcgcgccaaggaatacatcgccgccggcgacgtcatgcaggtgcaggtcggccaggtcatcgccaagccgtttcgcgacgcgccgctgtcgctgtaccgcgcgctgcgttcgctgaacccctcgccctatatgtatttctggaacttcggcgatttccaggtggtcggcgcctcgccggaaatcctggtgcgccaggagcagatcgacgaccagggcgaaacccgctcgcagatcaccatccggccgctggccggcacccgcaagcgcgghggcacgccggaagaagacctggcgctggccgccgaactgcaggccgaccccaaggagcgcgccgaacacgtgatgctgatcgacctggcgcgcaacgacgtgggccgggtggcggaaatcggctcggtgcgcgtcagcgacaccatggtcatcgagcgctactcgcatgtcatgcacctggtctccaacgtggcgggcaagctgctgcccggcatgagcagcatggatgtgctgcgcgccgccttcccggccggcacgctgaccggcgcccccaaggtacgggccatggaaatcatcgacgaactcgaaccggtgcgccgcggcatctacggcggcgccgccggctacctgagctacggcggcgaaatggacgtggccatcgcgatccgcaccggggtgatcaagaacggcacgctgtacgtgcaggccgccgcgggtatcgtggccgactccagccccgaagccgaatgggccgagaccgaggccaaggcgcgcgccgtgctgcgcgcggccgagcaggtccagcacggcctggacgaacccatctgagcccccccattgcgcagacctacgccgggccgcgcgcccggccggagaaccgaacatgctattgatgatcgacaactacgattccttcacctacaacctggtgcaatattt

SEQ ID NO: 3650 - protein, 506 aa, Bordetella bronchiseptica
MTELEFKALAAQGYNRIPLVAETYADLDTPLAIYLKLAHSGPQGGRMSCLMESVVGGERFGRYSFIGLPARTVIRASGSTTEVLQDGHVAETHEGDPLAFIESYQARFKVALRPGMPRFCGGLAGYFGYDTVRHIEQRLGPAVKPFPDGMEEGTPDIMLLHVDELVIVDNLAGRTYLMVYADPAQPEAYSRAQQRLLELRARLRRPVEIPYSHASMQTEERRDFQKADYLAAVARAKEYIAAGDVMQVQVGQVIAKPFRDAPLSLYRALRSLNPSPYMYFWNFGDFQVVGASPEILVRQEQIDDQGETRSQITIRPLAGTRKRGGTPEEDLALAAELQADPKERAEHVMLIDLARNDVGRVAEIGSVRVSDTMVIERYSHVMHLVSNVAGKLLPGMSSMDVLRAAFPAGTLTGAPKVRAMEIIDELEPVRRGIYGGAAGYLSYGGEMDVAIAIRTGVIKNGTLYVQAAAGIVADSSPEAEWAETEAKARAVLRAAEQVQHGLDEPI

SEQ ID NO: 3651 - DNA, 2027 bp, Buchnera aphidicola
  CDS (1)..(1587)
atgaaaaatagccgtcataaaattgaaattattcaaaaaaaagcgcattatcatcccgatcccacaatgatttttaatcatatttgtggattaaaatcagcaacactattattagaaacagcagaaatcaataagaaacgaaacttaggaagtattatgattattgacagtgcaatacgcatatccgcgataaaaaattcagttcagataactgctttttctttaaatgggatggcaatattgacggctttaaaaaacatgttacataataaaattaataaaattcaaatatttgaaaataaacaaaatatttatttaattttccctagtatagataaaaatattgacgaggatcaaaaaattttatcaatatcaatatttgattgttttagattcattatgaaaatgttcacgaacccccataaaatcagcaaagcaatcttttttggaggactattttcttatgatcttattgctaattttgaattcttatctcatttagtccgcaaacaaaaatgtcctgatatatgtttttatttagctgaaactttattagttttagatcatcaaaaacaaacatgtttaattcaaaatagcttgtttagtcataatatgaatgagaaatatagaattcaaaaacgatcagcagaaatagaaaagaaacttaaacaaccattatcgggaatattaactaataatgcacatgttaaagtatgtgaaacagcgtcattgacttcaaatataagcgatgttgaatatttatctattattaaaaaattacaaatatttattcaaaaaggtgatatctttcaagtcgtcccctctcgaaaattttttttaccgtgttatcatgcgttatcagcatatcaggaattaaaaaaaagcaatcctagcccctacatgttttttatgcaagatgaaatctttacattatttggagcttctcccgaaagttctttaaaatataatcatcaaaataggcaaatagaactctatccgatagcaggtaccaggcctagaggaaaaacaaaaaatggtaatatagactatgatttagacagcaaaatcgagctagaaatgagaactaatcaaaaagaattatctgagcatttaatgcttgtggatttggcacgcaacgatcttgctcgtatttgtgaaccggggtcgcgatatgttgcagagttactaaaagtcgacaaatactctcatgttatgcatttagtctcgcgcgtcattggtacgctcaaatctcacttagatgccttacacgcatattcttcttgtatgaatatgggaactttaaccggtgctccgaaggtgcgtgcgatgcaattaattgctgaatatgaaaaagaaacacggggcagctacggcggcgctataggttattttactgattctggagatttagatacctgtatcacaattcgttcagcttatatagaacaaaatattgcgactgttcaagccggggcgggtattgttttgcactcaatagcggaagaagaaatacaagaaagcttgaataaagcaactgcggtgattaatgctatcaaaacagcgcattatgtaacaggatctttttaaacatggctaatattttacttttagataatattgactcatttacttataatcttgtagatcagttaagaaacacgcaaattcatgttgtcgtttatcgcaatattgtagatattaaaattattttacatgcacttatgcaattaaaaaatccaattttaatattatcacctggccctggtttaccccgcgatgctggttgtatgcctgatttaattgaaacagttaaaggtcaagtgccgataataggtatttgtttaggccatcaagcgatcgtagaagcttatggcggtcagattggatacgcaagtgaaatattccatggacaagtgtctttaatcaatcacgacggtttggagatgtttcaaaatctccctccattgttaccagtagctcgatatcattcgttaatttgcaatcgtatccccaaagattttatcgtt

SEQ ID NO: 3652 - protein, 528 aa, Buchnera aphidicola
MKNSRHKIEIIQKKAHYHPDPTMIFNHICGLKSATLLLETAEINKKRNLGSIMIIDSAIRISAIKNSVQITAFSLNGMAILTALKNMLHNKINKIQIFENKQNIYLIFPSIDKNIDEDQKILSISIFDCFRFIMKMFTNPHKISKAIFFGGLFSYDLIANFEFLSHLVRKQKCPDICFYLAETLLVLDHQKQTCLIQNSLFSHNMNEKYRIQKRSAEIEKKLKQPLSGILTNNAHVKVCETASLTSNISDVEYLSIIKKLQIFIQKGDIFQVVPSRKFFLPCYHALSAYQELKKSNPSPYMFFMQDEIFTLFGASPESSLKYNHQNRQIELYPIAGTRPRGKTKNGNIDYDLDSKIELEMRTNQKELSEHLMLVDLARNDLARICEPGSRYVAELLKVDKYSHVMHLVSRVIGTLKSHLDALHAYSSCMNMGTLTGAPKVRAMQLIAEYEKETRGSYGGAIGYFTDSGDLDTCITIRSAYIEQNIATVQAGAGIVLHSIAEEEIQESLNKATAVINAIKTAHYVTGSF

SEQ ID NO: 3653 - DNA, 1569 bp, Buchnera aphidicola
  CDS (1)..(1569)
atgaataaacgtcttaaaagaatggatgttttaaaagttgaagctttataccaatctaatccaacaattgtttttcatcaaatctgccgaaataaaagtaatacattactcttagaatctgctgaaattaataaaagagatagtttagaaagtatgatgattatagattctgctttacgtatctcagcattaaatcaaatagttgtattagaagcattaacaaaaaatggagaaagtctattaccaatttttatatctttgctgccaaaatcagtaaaaatattggttaataaaaatttattaaaaattgaatttcctttaatttctatgaacttagatgaggataaaaaattacatgtattatctatatttgattcaatacgattcttaataaatagtactaaaaacaacaaagtgtctaaatctatgttttttggtggattgttttcatatgatttaattactaattttgaaaatcttccaaaattaaaaactactcaatcttgtcctgacttttgtttttacttggctgaaactttattagtattagatcataaaaaaaaaacttgttatatacaagctagcttattttcttcagacatatttgaaaaaaatagactacagtctagactgttaatgataaaaaaacaattatctagttctttttatccattacaacctatttttttaaaaaaaatggtattaacttgcaataagacagataaagtatatattaaaattattgaagaaatgcaaaaattaatattaattggagaaatttttcaggtagttccatcgagacgattttatttgccatgtattgattctttggcagcgtatgatgttttaaaaaaaaataatcctagcccgtatatgttttttatgcaagattctcatttcactttgtttggtgcttctccagtaagtgctttaaaatatgatgtatcgtctagacaaattgaaatttatcctattgctggaactaggccaagggaaagaaaaataaatggatcgttagatttagatttagatagtagaatagaacttgaaatgagaacaaatcataaagaattagctgaacatttaatgttagtagatttagcaagaaacgatttagcaagaatttgtgatcctggtactcgttatgtagctaatttaacacaagtagatcggtattctcacgttatgcacttagtttctcgagttgtcggaaaattaaaatctaatttagatgtatttcatgcatatcaagcatgtatgaatatgggaacgttaagtggtgccccgaaaattcgagcaatggaattaatttcatatgtagaaaaggaaaaaagaggtagttatggaggatcaataggatattttactgcttcaggagcattagatacttgcattgttattcgatctgcgtatgttgaaaataatatagctattgttcaagcaggagctggaatagttgtagattctattccgcaatcagaagcagatgaaagcaaaaataaagctaaagctgtactacaagctatttctgaatcacattcctgtcatatagagtatcataatgaatga

SEQ ID NO: 3654 - protein, 522 aa, Buchnera aphidicola
MNKRLKRMDVLKVEALYQSNPTIVFHQICRNKSNTLLLESAEINKRDSLESMMIIDSALRISALNQIVVLEALTKNGESLLPIFISLLPKSVKILVNKNLLKIEFPLISMNLDEDKKLHVLSIFDSIRFLINSTKNNKVSKSMFFGGLFSYDLITNFENLPKLKTTQSCPDFCFYLAETLLVLDHKKKTCYIQASLFSSDIFEKNRLQSRLLMIKKQLSSSFYPLQPIFLKKMVLTCNKTDKVYIKIIEEMQKLILIGEIFQVVPSRRFYLPCIDSLAAYDVLKKNNPSPYMFFMQDSHFTLFGASPVSALKYDVSSRQIEIYPIAGTRPRERKINGSLDLDLDSRIELEMRTNHKELAEHLMLVDLARNDLARICDPGTRYVANLTQVDRYSHVMHLVSRVVGKLKSNLDVFHAYQACMNMGTLSGAPKIRAMELISYVEKEKRGSYGGSIGYFTASGALDTCIVIRSAYVENNIAIVQAGAGIVVDSIPQSEADESKNKAKAVLQAISESHSCHIEYHNE

SEQ ID NO: 3655 - DNA, 2124 bp, Oryza sativa
  CDS (19)..(1839)
ggcttaaagcctatcgcaatggagtccatcgccgccgccacgttcacgccctcgcgcctcgccgcccgccccgccactccggcggcggcggcggccccggttagagcgagggcggcggtagcggcaggagggaggaggaggacgagtaggcgcggcggcgtgaggtgctccgcggggaagccagaggcaagcgcggtgatcaacgggagcgcggcggcgcgggcggcggaggaggacaggaggcgcttcttcgaggcggcggagcgtgggagcgggaagggcaacctggtgcccatgtgggagtgcatcgtctccgaccacctcacccccgtgctcgcctaccgctgcctcgtccccgaggacaacatggagacgcccagcttcctcttcgagtccgtcgagcaggggcccgagggcaccaccaacgtcggtcgctatagcatggtgggagcccacccagtgatggaggtcgtggcaaaggagcacaaggtcacaatcatggaccacgagaagggcaaggtgacggagcaggtcgtggatgatcctatgcagatccccaggagcatgatggaaggatggcacccgcagcagatcgatcagctccccgattccttcaccggtggatgggtcgggttcttttcctatgatacagtccgttatgttgaaaagaagaagctgcccttctccggtgctccccaggacgataggaaccttcctgatgttcaccttgggctttatgatgatgttctcgtcttcgacaatgtcgagaagaaagtatatgtcatccattgggtaaatcttgatcggcatgcaaccaccgaggatgcattccaagatggcaagtcccggctgaacctgttgctatctaaagtgcacaattcaaatgtacccaagctttctccaggatttgtaaagttacacactcggcagtttggtacacctttgaacaaatcaaccatgacaagtgatgagtacaagaatgctgttatgcaggctaaggagcatattatggctggtgatattttccagattgttttaagccagaggtttgagaggcgaacatacgccaatccatttgaagtctatcgagctttacgaattgtgaacccaagtccatacatggcatatgtacaggcaagaggctgtgtcctggtagcatctagtccagaaattcttactcgtgtgaggaagggtaaaattattaaccgtccacttgctgggactgttcgaaggggcaagacagagaaggaagatgaaatgcaagagcaacagctactaagtgatgaaaaacagtgtgctgaacatattatgcttgtagatttgggaaggaatgatgttggaaaggtctccaaacctggatctgtgaaggtggagaaattaatgaacattgaacgctactcccatgtcatgcacatcagttccacggtgagtggagagttggatgatcatctccaaagttgggatgccctgcgagccgcgttgcctgttggaacagttagtggagcaccaaaggtgaaagccatggagctgatagacgagctagaggtcacaagacgaggaccatacagtggcggccttggagggatatcatttgacggagacatgcttatcgctcttgcactccgcaccattgtgttctcaacagcgccaagccacaacacgatgtactcatacaaagacaccgagaggcgccgggagtgggtcgctcaccttcaggctggtgctggcattgtcgctgatagcagcccagacgacgagcaacgtgaatgcgagaacaaggcagccgctctggctcgagccatcgatcttgctgaatcagctttcgtagacaaggaatagagtctctctcaagagagttgattttgttagttcttgttcatggttcttctcgctgcatgtttagcaggaaaggtatcatcagtgagttgagagaagcaataagcctatgttgtcatgtgaatcgaataaactggaggttatggtcgtgagctattattagctgtgttcattagaaaggtatatgcttttagattgttttgtttggtggaggcatgtatagtgcgctctctggctaaatcaagcaagggcttaacaggggtattgtcaaaaaaaaaaagcggccgc

SEQ ID NO: 3656 - protein, 606 aa, Oryza sativa
MESIAAATFTPSRLAARPATPAAAAAPVRARAAVAAGGRRRTSRRGGVRCSAGKPEASAVINGSAAARAAEEDRRRFFEAAERGSGKGNLVPMWECIVSDHLTPVLAYRCLVPEDNMETPSFLFESVEQGPEGTTNVGRYSMVGAHPVMEVVAKEHKVTIMDHEKGKVTEQVVDDPMQIPRSMMEGWHPQQIDQLPDSFTGGWVGFFSYDTVRYVEKKKLPFSGAPQDDRNLPDVHLGLYDDVLVFDNVEKKVYVIHWVNLDRHATTEDAFQDGKSRLNLLLSKVHNSNVPKLSPGFVKLHTRQFGTPLNKSTMTSDEYKNAVMQAKEHIMAGDIFQIVLSQRFERRTYANPFEVYRALRIVNPSPYMAYVQARGCVLVASSPEILTRVRKGKIINRPLAGTVRRGKTEKEDEMQEQQLLSDEKQCAEHIMLVDLGRNDVGKVSKPGSVKVEKLMNIERYSHVMHISSTVSGELDDHLQSWDALRAALPVGTVSGAPKVKAMELIDELEVTRRGPYSGGLGGISFDGDMLIALALRTIVFSTAPSHNTMYSYKDTERRREWVAHLQAGAGIVADSSPDDEQRECENKAAALARAIDLAESAFVDKE

SEQ ID NO: 3657 - DNA, 1734 bp, Oryza sativa
  CDS (1)..(1734)
atggccagcctcgtgctctccctgcgcatcgcccgttccacgccgccgctggggctgggcggggggcgattccgcggccgacgaggggccgtcgcctgccgcgccgccacgttccagcagctcgacgccgtcgcggtgagggaggaggagtccaagttcaaggcgggggcggcggagggttgcaacatcctgccgctcaagcgatgcatcttctccgaccacctcacgccggtgctcgcgtaccgctgcctcgtcagggaggacgaccgcgaggcgcccagcttcctgtttgagtccgtcgagcagggatccgagggcaccaatgtggggaggtacagtgtggttggggcacagcctgcgatggagatcgtagccaaggccaaccatgtgactgtcatggatcataagatgaagtctaggagggagcaatttgcgcctgacccgatgaagataccaaggagcattatggaacagtggaacccacagattgttgaaggcctccctcatgcattttgtggaggatgggttggattcttctcttacgacacagtgcgttatgttgaaacaaagaagcttccattttctaacgcgccagaggatgataggaaccttcctgacatccatttaggcctctacaatgacatagttgtgtttgatcatgttgaaaagaaaacacatgttatacattgggtgagggtagattgccatgagtcagttgacgaagcgtatgaggacgggaagaatcagctggaagctttgttatcaagattacatagtgttaatgtgccaactcttactgctggttctgtaaaacttaacgttgggcaatttgggtcagcactacagaaatcatcaatgtcaagggaggactataagaaagctgttgttcaagcaaaagagcacattctagctggtgacatttttcaagtagtcttaagccagcgttttgagaggcgtacatttgctgacccctttgaggtgtaccgtgcattgcgtattgtcaatcctagtccttatatggcctatctacaggctcgtggttgtattctggtagcatcaagtcctgaaattcttacccgggtggaaaagaggacaattgtcaacaggccacttgctggaacaattagaagaggaaaatcgaaagcagaagacaaagttttagaacaactgctgttgagtgatggaaagcagtgtgctgagcatattatgttagtagatcttggacggaatgatgttggaaaggtgtccaaaccaggttcagtaaaggtggagaaactgatgaacgttgaacgatattcacatgtcatgcacattagctcaacagttactggagagttgcgtgatgatctgacttgttgggatgctcttcgagcagcattgcccgttggaacagttagtggtgcaccaaaggtgagagcgatggagctgattgaccagatggaagggaagatgcgtgggccgtacagtggtggctttggaggggtttctttccgtggagacatggacatcgcacttgctctccgtaccatcgtcttccccacgggatctcgcttcgacaccatgtactcctacactgacaagaatgctcgtcaggagtgggtggctcaccttcaggctggagctgggatcgtcgctgacagcaagcctgacgatgagcatcaggagtgcttgaacaaggctgctggccttgctcgtgccatcgatcttgccgagtctacattcgtagatgagtag

SEQ ID NO: 3658 - protein, 577 aa, Oryza sativa
MASLVLSLRIARSTPPLGLGGGRFRGRRGAVACRAATFQQLDAVAVREEESKFKAGAAEGCNILPLKRCIFSDHLTPVLAYRCLVREDDREAPSFLFESVEQGSEGTNVGRYSVVGAQPAMEIVAKANHVTVMDHKMKSRREQFAPDPMKIPRSIMEQWNPQIVEGLPHAFCGGWVGFFSYDTVRYVETKKLPFSNAPEDDRNLPDIHLGLYNDIVVFDHVEKKTHVIHWVRVDCHESVDEAYEDGKNQLEALLSRLHSVNVPTLTAGSVKLNVGQFGSALQKSSMSREDYKKAVVQAKEHILAGDIFQVVLSQRFERRTFADPFEVYRALRIVNPSPYMAYLQARGCILVASSPEILTRVEKRTIVNRPLAGTIRRGKSKAEDKVLEQLLLSDGKQCAEHIMLVDLGRNDVGKVSKPGSVKVEKLMNVERYSHVMHISSTVTGELRDDLTCWDALRAALPVGTVSGAPKVRAMELIDQMEGKMRGPYSGGFGGVSFRGDMDIALALRTIVFPTGSRFDTMYSYTDKNARQEWVAHLQAGAGIVADSKPDDEHQECLNKAAGLARAIDLAESTFVDE

SEQ ID NO: 3659 - DNA, 1888 bp, Lactococcus lactis
  CDS (147)..(1559)
agatctcttatagaatagcaatgaaatcttgggcgtatacgtaatatactgaatatatcaatcgtattgagcatggtatatcactgtgcaaagacatacggactgactgaacagtagcgtggcataagtcgatcgaaaggaattagatgttcacaatcagtggagtagtattgataacaagaccagtatacgatgaaggaagtttgaattactgtcagagtggagcaatgaacaacggaatcttgttggaaagtgtagaaggaaacaagcctcgatacagtatcggaggagcagaacctatcggaactatcaacgcaaacgcagtattgactgcagcaacttacgcagaagatgtaaagttcactgatgcagatcctttgaacggaactagagtagcaatctgtaacggagaagatactcaacaagaagaaatgggattccaaggaggagcattgggatacttcgcatacgatgtaggaagaagattggaaggatacaacgatttgggaatcgaagattgggcaatcccagatttggcaggaagtagttacgaaatcggagtaagtgcagatcatcaaaacgatgtaatcgtattgatcgcacatgcaagtgcagatggaaacgatgtattcatcacaagtagtagacaattgagtatggtagcaggaccaacatgttgtgcaagtggagatgtagaaatcttgagaaacaagttgcattactacggagtaatcccattcagtcaagatgattgtggattcaacagattgaaggattacttgggaagtggagatatgtaccaagtaaacttgggaaacagaaacgtaggagcaatcgtaatgacattgttccaaggatacaaccaattgagattgatgaacccgggaccatacatggtattcttggatgaagcaaacatcatcatggcaagtccagaaatcgtattggcagatgaagcaaacgatttgaacacaagaccaatcgcaggaacattgatgagattgaacgagcaagatgaagatggagtaaacgcagcatgtctgggacaacatcataaggatagagcagaacatatgatgatcgtagatttggtaagaaacgatttgggaagagtgggaagattcggaagtgtaaacgtacaagaaatcgtaggagctgaaaactacagtgtagtaatgcatatcgtaagtagagtaacaggatccttgaacgaagcattcgaagcaatggaaatcatcagagcaggattcccaggaggaagtatcacaggagcaccaaaggtaagagcaatggaaatcatcgaagaattggaaccacaaagacgagatggatggggaggaagtatcggatacatcgcatacagaggaaacatcggttacagaatcgcaatcagaacattgttcgcttgtaacggacaattgttcgcaagtagtggagcaggattggtaggagatagtatggaagacggagaatacaacgaaacattcgaaaagatgagagcattgagaagtttcttctgtgcagcggtacatatgggaaagacaccatacttgagttaattacgatccgtaatatgtacttataagcgttgcaatatgcgtaagtagtacttaattacgtaatgttttatttcaatagtaatagatcatgactagaatatcgaatgtaatagatctgatgtaattaaattcagtataatcgtatcatgacaaaatgcatgaatcgttatcggtaactataatgctcagtgatatgtgaatcgtatccgtgcctagcgatttaactaaagctagcatgataaatagaatagataactgatacaaatactagtcatacattgactatagtacgccggtacgtatagattcgtaatccgtacgtaggatcc

SEQ ID NO: 3660 - protein, 470 aa, Lactococcus lactis
MFTISGVVLITRPVYDEGSLNYCQSGAMNNGILLESVEGNKPRYSIGGAEPIGTINANAVLTAATYAEDVKFTDADPLNGTRVAICNGEDTQQEEMGFQGGALGYFAYDVGRRLEGYNDLGIEDWAIPDLAGSSYEIGVSADHQNDVIVLIAHASADGNDVFITSSRQLSMVAGPTCCASGDVEILRNKLHYYGVIPFSQDDCGFNRLKDYLGSGDMYQVNLGNRNVGAIVMTLFQGYNQLRLMNPGPYMVFLDEANIIMASPEIVLADEANDLNTRPIAGTLMRLNEQDEDGVNAACLGQHHKDRAEHMMIVDLVRNDLGRVGRFGSVNVQEIVGAENYSVVMHIVSRVTGSLNEAFEAMEIIRAGFPGGSITGAPKVRAMEIIEELEPQRRDGWGGSIGYIAYRGNIGYRIAIRTLFACNGQLFASSGAGLVGDSMEDGEYNETFEKMRALRSFFCAAVHMGKTPYLS

SEQ ID NO: 3661 - DNA, 1317 bp, Aeropyrum pernix
  CDS (1)..(1317)
atgccttcacccccagagcctcccctccactggagggactgtaggctagagcctatcctaggatttcctaggcctagggagctagccaagtcacttgaagtccagggggaggagtggatagcactccttgagagtgggggaggcctacagcataggagcaggtactctttcctagcgtggggcaggagaaagtcgagtgaaacagacgctatcagggcgtatgaggaactcgagcgcttagcggacgataagtgcagggcgctgccttgccgcagccccacgttctttctggtatcctatgaggctgttgtcggtgaggagccgtggctatcgcggctggttggtaggcatgagtggccaggtatgacagccttctcccctgaatatgttgtagtctacgatcacgcagggggaagggtgtcggtttgcccaggtgacaccccccttccggcgccggcgagtaggaaagagagtttctcggcggaaggccctacctatgagacctccaggaaagggttcgaagctatggtcgctgacgcgttggagaggatcagggctggagaggctttccaggtagtgttatccagggttgagaggtatagggtctgggggagcctgtttagcgcgtatgagaggctcgccgatgccaaccctagtccctacctatactacgctaggctgggcggcagggttatcatagggagtagcccggagctcctggtcaagctggaggcgggcagagttgagactcacccgatagctggtaccaggcctcgcggctcaacgcccattgaggacatcgagttagaagtagagttgttgaacgacgagaaggagagggcagagcatgtgatgcttgttgacctggctaggaacgatataacccgtgtatcgatccctggaaccgtacaggtaacaagcttcatggatatcgagagatacgagactgtaatgcatatagtaagcagggttgaaggagtgacaaggcccagcaccacattcgtcgaagcccttaaagccctccaccctgcaggcacggttagcggagcgccaaagcctagggccatggaaattatagccgaactagaggaagaggccaggggcccctacgcaggagccataggagtagcgggttctagcgcgggcgaggcggccatagtgctgaggagcgcctggctcctagatgacggggagaccttggaagctagagctggcgccgggatagtctatgatagcaagcccgagagagagtacatggagactgtccagaaactcggaagcctaaagagggctctgggggtggatatgtgtggctga

SEQ ID NO: 3662 - protein, 438 aa, Aeropyrum pernix
MPSPPEPPLHWRDCRLEPILGFPRPRELAKSLEVQGEEWIALLESGGGLQHRSRYSFLAWGRRKSSETDAIRAYEELERLADDKCRALPCRSPTFFLVSYEAVVGEEPWLSRLVGRHEWPGMTAFSPEYVVVYDHAGGRVSVCPGDTPLPAPASRKESFSAEGPTYETSRKGFEAMVADALERIRAGEAFQVVLSRVERYRVWGSLFSAYERLADANPSPYLYYARLGGRVIIGSSPELLVKLEAGRVETHPIAGTRPRGSTPIEDIELEVELLNDEKERAEHVMLVDLARNDITRVSIPGTVQVTSFMDIERYETVMHIVSRVEGVTRPSTTFVEALKALHPAGTVSGAPKPRAMEIIAELEEEARGPYAGAIGVAGSSAGEAAIVLRSAWLLDDGETLEARAGAGIVYDSKPEREYMETVQKLGSLKRALGVDMCG

SEQ ID NO: 3663 - DNA, 1788 bp, Arabidopsis thaliana
  CDS (1)..(1788)
atgtcttcctctatgaacgtagcgacgatgcaagcactgactttctctcgccggcttctcccttctgttgcttctcgttatctctcttcttcttctgtgaccgttactggatactccggtagaagctcggcttacgcgccttctttccgttcgattaaatgcgtctctgtttctccggaagcttcaatagtaagtgatacaaagaagttggcagatgcttctaagagtacaaaccttataccaatttaccgctgtatattctctgatcagcttactcctgttcttgcttaccgttgtttggtcaaagaagatgaccgtgaagctcctagctttcttttcgagtccgttgagcctggttctcagatgtctagcgttggtcgttatagcgttgttggggctcagcctgcgatggagatcgtggcaaaggagaataaagttattgtaatggatcacaacaatgaaaccatgactgaggaattcgtcgaagatccaatggagatcccaagaaaaatctctgagaaatggaaccctgatcctcaactagttcaggaccttccagatgcgttttgtggtgggtgggttggttttttctcgtacgacactgttcgttatgttgagaagaggaaattgccattttcaaaggcccctgaggatgataggaacttgccagacatgcatcttggtctgtacgacgatgtagttgtatttgatcacgtggaaaagaaagcatatgtcattcactggattagactagatgggagccttccttacgaaaaggcatacagtaatggaatgcaacatttggagaacttggtggccaagttacatgatattgagccgccaaaactggctgcaggtaacgtgaatcttcagacacgacaatttgggccatctttggataattcaaacgtgacatgcgaagagtacaaggaggctgtggtcaaggccaaagaacatatacttgcaggagacatatttcagatcgtgctgagtcaacgttttgagcggcgaacatttgcagacccctttgaagtttatagagcactaagagttgtgaatccaagtccgtatatgggttatttgcaggctagaggatgcattttggtagcatcaagtccagaaattctcaccaaagtaaagcagaacaagatagtgaatcggccattggcaggaaccagcaagagagggaagaatgaagttgaggataagagattagaaaaggaactgctagagaatgaaaagcaatgtgctgagcacatcatgttggttgatctcggtcgcaacgatgttggaaaggttacgaaatacggatcagtgaaagtagagaagcttatgaacatcgaacgttattcccatgttatgcatataagctccacggtgacaggagaattacaagatggtttgacttgctgggacgtactacgtgcggctttaccagtgggaacagttagtggtgcaccaaaggtcaaagctatggaactaatcgatgagctagagccaacgaggcgtggaccatacagtggcggttttggtggagtctccttcactggtgacatggacattgctttatcccttaggacaatcgtttttccgacagcatgtcaatacaatacaatgtactcttacaaggatgctaacaaacggcgtgagtgggtggcttatcttcaagctggagctggtgtagtagctgatagtgacccgcaagacgaacactgtgagtgccagaacaaagccgctggtcttgctcgagccatcgacttggctgaatctgcatttgtgaaaaaatga

SEQ ID NO: 3664 - protein, 595 aa, Arabidopsis thaliana
MSSSMNVATMQALTFSRRLLPSVASRYLSSSSVTVTGYSGRSSAYAPSFRSIKCVSVSPEASIVSDTKKLADASKSTNLIPIYRCIFSDQLTPVLAYRCLVKEDDREAPSFLFESVEPGSQMSSVGRYSVVGAQPAMEIVAKENKVIVMDHNNETMTEEFVEDPMEIPRKISEKWNPDPQLVQDLPDAFCGGWVGFFSYDTVRYVEKRKLPFSKAPEDDRNLPDMHLGLYDDVVVFDHVEKKAYVIHWIRLDGSLPYEKAYSNGMQHLENLVAKLHDIEPPKLAAGNVNLQTRQFGPSLDNSNVTCEEYKEAVVKAKEHILAGDIFQIVLSQRFERRTFADPFEVYRALRVVNPSPYMGYLQARGCILVASSPEILTKVKQNKIVNRPLAGTSKRGKNEVEDKRLEKELLENEKQCAEHIMLVDLGRNDVGKVTKYGSVKVEKLMNIERYSHVMHISSTVTGELQDGLTCWDVLRAALPVGTVSGAPKVKAMELIDELEPTRRGPYSGGFGGVSFTGDMDIALSLRTIVFPTACQYNTMYSYKDANKRREWVAYLQAGAGVVADSDPQDEHCECQNKAAGLARAIDLAESAFVKK

SEQ ID NO: 3665 - DNA, 2017 bp, Arthrobacter globiformis
  CDS (402)..(1997): n means a or g or c or t/u, s means g or c
aacaggtcctantgctgggctggatgacaaacgagnccctcaangaccataccancggcccgggtntcgttctactcccgctcccgccaggagtactggcgcaagggtgacacgtccggcctcgtgcagtgggtcaagtcggtggccctggactgcgacggcgacgccctcctcgtgcgggtggaccaggtgggtgcagcatgccacaccggtacgcggacctgctttgacttccgggccttcgacgtagtggcaggtccggccaactagcggcccccnnccccccaacaggcccccacccaacaggccctcacccaacaggccctcacactcaacaggcccccacccaacaggccccaccccactggcactggcctagaacagacggagaaccaatagcaatgcaggacctcggaatcatcagccctggcctggaagaattccgggaactcgccgcccacagccgcgtcatccctgtccggctcaaggtgctggcggacgctgaaacgccgatcgggctgtaccggaagctggcgcagggccagccaggcacgttcctcatggagtcggcagctgtcggcggcgcctggtcccgctactccttcatcggttcccggtcccgcgccacgctgaccaccaaggacggacaggcgcactggctgggcgagccgccggcgggggtgcccgtcgacggaaatccggttgatgccatccgcgacaccatcgaggcgctgcgcaccgaccggttcgacgggcttccgccgttcacctccggcctggtgggcttcctgggctgggaaacggtccgccactgggagaagctcaccagaccgcccgaggacgacctgcagctgcccgaactggcgctgaacctcgtcacggacatggccgtccacgacaacatggacggcacggtgctgctcatcgccaacgccatcaactttgacaacagctccgaacgcgttgacgaggcctggcatgacgccgtcgcccgcgtgaaggagctgctggcacgcatcagcaccccggtgctccaaccggtgtccgtgctggagccggctgccctcgattttgctgccagcgtccaggaacgctggaacgagcccgagtaccttgccgccctcgaccggggcaaggaggcgatcgtggacggcgaagtcttccaggtggtcatctcccgccgcttcgaaatggagtgcggggcgtcgcccttggatgtctaccgggtgctgcgcaacaccaacccgagcccgtacatgtacattttcagcctcgaggacgccgccggccggcagtattcgatcgtcggttcgtcgccggaggcgctggtgacggtcaccggcgaggacgtcatcacgcaccctatcgccggctcccggccgcgcggcaagaccgtggacgcggacaaggcattggccgaggaactcctcgcagaccagaaggaacgggcggaacaccttatgctggtggacctgtcccggaacgatctttcgaaggtctgcgtggcgggttccgtggacgtcacccagttcatggaggtggagcgcttcagccacatcatgcacctggtctccaccgtcgtcgggcgcctggctccgacggcgaaagcctatgacgtcctgaaggccaccttcccggccggaaccctttccggcgccccgaagccccgggcgctgcggctcctggatgaactcgagccgcaccggcgcggcatctacggcggcgtggtgggctacctggacttcgccggcgacatggacatggccattgccatccgttccgcactgctgcgcgaaggacgggcctacgtccaggcgggcggcggcatcgtggcggattcgagcaatccggccgaggcgcaggaaaccgtcaacaaggcggcggccccgctgcgtgctgtccacacggccggatcgctgcacaacatcacgccggactccgtcagcgctcccgattccgtcagcagccccgattccgtcacggaggcaaactcctgatggcggttcccgcaggatcc

SEQ ID NO: 3666 - protein, 531 aa, Arthrobacter globiformis
MQDLGIISPGLEEFRELAAHSRVIPVRLKVLADAETPIGLYRKLAQGQPGTFLMESAAVGGAWSRYSFIGSRSRATLTTKDGQAHWLGEPPAGVPVDGNPVDAIRDTIEALRTDRFDGLPPFTSGLVGFLGWETVRHWEKLTRPPEDDLQLPELALNLVTDMAVHDNMDGTVLLIANAINFDNSSERVDEAWHDAVARVKELLARISTPVLQPVSVLEPAALDFAASVQERWNEPEYLAALDRGKEAIVDGEVFQVVISRRFEMECGASPLDVYRVLRNTNPSPYMYIFSLEDAAGRQYSIVGSSPEALVTVTGEDVITHPIAGSRPRGKTVDADKALAEELLADQKERAEHLMLVDLSRNDLSKVCVAGSVDVTQFMEVERFSHIMHLVSTVVGRLAPTAKAYDVLKATFPAGTLSGAPKPRALRLLDELEPHRRGIYGGVVGYLDFAGDMDMAIAIRSALLREGRAYVQAGGGIVADSSNPAEAQETVNKAAAPLRAVHTAGSLHNITPDSVSAPDSVSSPDSVTEANS

SEQ ID NO: 3667 - DNA, 2199 bp, Azospirillum brasilense
  CDS (1)..(2199)
atgtaccccgccgaccttcttgcctcgcccgacctcctcgaaccgctgcgtttccagacgcgcggcggcgtcaccgtcacgcggcgggcgacggcgctcgacccgcggaccgccctcgacccggtgatcgacgcgctggaccgccgccgcggcctgctgctgtccagcggggtggaggcgccgggccgctaccgccgtcacgcgctgggcttcaccgaccccgcggtggcgctcacggcgcgtgggcggacgctgcgcatcgacgcgctgaacgggcgggggcaagtgctgctgcccgccgtcgccgaggccctgcgtggcctggaggccctggccggtctagaggaggcgccgtcgcgggtcactgcctcgtccgcaagcccagcaccccttcccggagaggagcggagccgccagccctccgttttctcggtcctgcgggcggtgctggatctgtttgccgcccccgacgacccgttgctcgggctctacggggccttcgcctacgacctcgccttccagttcgagccgatccgccagcggttggagcggcccgacgaccagcgcgatctgctgctctacctgccggaccggctcgtcgcgctggaccccatcgcaggactcgcccggctcgtcgcgtatgagttcatcacggcggcgggcagcaccgaggggctggagtgcggcgggcgcgaccacccctaccgtcccgacaccaacgccgaggccggctgcgaccacgcgcccggtgactatcagcgcgtcgtcgagagcgccaaggccgccttccgccgcggcgacctgttcgaggtggtgcccggccagaccttcgccgagccctgcgccgacgcgccttcgtcggtgttccggcggctgcgcgccgccaacccggcgccttacgaggccttcgtcaacctcgggcggggcgagttcctcgtcgccgccagcccggagatgtatgtgcgggtggcgggcgggcgggtggaaacctgcccgatctccggcaccgtggcgcgcggggccgacgcgctgggcgacgccgcgcaggtcctgcgcctgctgacctcggccaaggacgcggcggagctgaccatgtgcaccgacgtggaccgcaacgacaaggcgcgggtgtgcgagccgggatccgtccgggtgatcgggcggcggatgatcgagctgtactcccgtctgatccacacggtggaccatgtggagggacggctgcggtccggaatggacgcgctggacgccttcctcacccacagctgggcggtgacggtgaccggcgcgcccaagcgctgggccatgcagttcctggaggatacggagcaatcgccgcgccgctggtacggcggggccttcggccggctgggcttcgacggcgggatggacaccggcctgaccctgcgcaccatccgcatggccgagggcgttgcctacgtgcgggcgggggcgacgctgctgtccgacagcgatccggacgcggaggacgcggagtgccgcctgaaggccgccgccttccgcgacgccatccgcgggacggcggcgggtgcggcgcccacgctgccggcggctccccgtggcggggagggcaggcgggtgctgctggtggatcacgacgacagcttcgtccacacgctggccgactatctgcgccagacgggcgcttcggtgacgacgctgcgtcacagtcacgcacgggcggcgctggcggagcggaggccggatctggtcgtgctgtcccccggtccggggcgcccggcggatttcgacgtggcgggcaccatcgacgcggcgctggcgctcggcctgccggtgttcggcgtctgcctgggcctgcaagggatggtggagcgcttcggcggcgcgctggacgtgctgccggagcccgtccacggcaaggcgacggaggtccgggtgctgggcggcgcgctgttcgccggcctgccggagcggctgacggtcgggcgctaccactctctggtggcccggcgcgaccggctgccggcggacctcacggtgaccgcggagaccgccgacggtctggtgatggcggtcgagcaccggcggcttccgctcgccgccgtgcagttccaccccgagtcgatcctgtcgctcgacggtggggccggtcttgccctgctgggcaacgtgatggaccggctggccgccggcgccctgacggacgctgcggcttga

SEQ ID NO: 3668 - protein, 732 aa, Azospirillum brasilense
MYPADLLASPDLLEPLRFQTRGGVTVTRRATALDPRTALDPVIDALDRRRGLLLSSGVEAPGRYRRHALGFTDPAVALTARGRTLRIDALNGRGQVLLPAVAEALRGLEALAGLEEAPSRVTASSASPAPLPGEERSRQPSVFSVLRAVLDLFAAPDDPLLGLYGAFAYDLAFQFEPIRQRLERPDDQRDLLLYLPDRLVALDPIAGLARLVAYEFITAAGSTEGLECGGRDHPYRPDTNAEAGCDHAPGDYQRVVESAKAAFRRGDLFEVVPGQTFAEPCADAPSSVFRRLRAANPAPYEAFVNLGRGEFLVAASPEMYVRVAGGRVETCPISGTVARGADALGDAAQVLRLLTSAKDAAELTMCTDVDRNDKARVCEPGSVRVIGRRMIELYSRLIHTVDHVEGRLRSGMDALDAFLTHSWAVTVTGAPKRWAMQFLEDTEQSPRRWYGGAFGRLGFDGGMDTGLTLRTIRMAEGVAYVRAGATLLSDSDPDAEDAECRLKAAAFRDAIRGTAAGAAPTLPAAPRGGEGRRVLLVDHDDSFVHTLADYLRQTGASVTTLRHSHARAALAERRPDLVVLSPGPGRPADFDVAGTIDAALALGLPVFGVCLGLQGMVERFGGALDVLPEPVHGKATEVRVLGGALFAGLPERLTVGRYHSLVARRDRLPADLTVTAETADGLVMAVEHRRLPLAAVQFHPESILSLDGGAGLALLGNVMDRLAAGALTDAAA

SEQ ID NO: 3669 - DNA, 1542 bp, Bacillus pumilus
  CDS (1)..(1542)
atgaattcccaatcaaacctgacccaatttttaaaggacagcgagtcctacaaaacgatcccaattgttgaaaccattacagtcgatacgctctcaccgattcaaattgttgaaaaactcaaacaagatattgtgtatttgctagaaagcaaagatgagtcttccagctggtcgagatattccttcattggattacacccgtttttaaccttacacgatgaccaaaacaaatacattgcacgtgacgctgcggggcagaaactcatgcaaaagcaagagctgaaagaactgctagattggatgaaagagcaatatcaaatcaaaacgccagatattgatatcccatttacaggcggggctgttgggtacttaagctacgatctgatcccaacattgacctctgtcaggcctcaccgcagcgcatcgacgatagaaaatgcacatatttgtctgccaacgatgattgcatttgatcatgaaacaaatcatgttcattttatccagtacacgcagctaaccggacatgaaacagaggacgaaaaaatacgcgcctacaaagaaaaacaaaagcagcttgaacagatgattcacaagctccattcaaaggttgatatgaaagaactgattttatcagggaatatgaatgagccgccatcctttgaacatgtgacgtcaacctatgaaaaagcgcaatttttaaaagacgtagaaaaaatcaaagaatacattcgagcgggtgacatttttcaaggcgtactctcgcagcgatttgatatccctgtatcagtgagttcatttgagttataccgcgtgcttcggattgtgaatccatctccttatatgtattttatgaaattaaaagatcgtgatttagtcggcagctcaccagaacgattaatccatgccaaaaatgggcatttagaaattcatcctattgctggcacaagaaaacgaggaacaacaagagaagaggatgctgaactagcaagagagctgcttgaagatgaaaaggaaaaagccgagcattacatgttagtggatcttgccagaaatgatgtaggccgtgtggcagaatacggcagtgtgtccgtaccaacctttacaaaagtagtgaacttctctcatgtcatgcacatcatctccattgtgacaggaaagctaaagcgggatacacatccagttgatgcgctcatgtccgcattcccagcaggcacattaacaggtgccccgaaaataagagcgatgcaattattaaatgaaatggagcctgagccaagggaaacgtatggcggctgtattgcttatattggattcgacggcaatatcgactcttgtattacgattcgtacgatgagcgtcaaaaatcataccgcttctatacaagcaggcgccggcattgtggctgattctgtcccagaaaatgaatgggaagagacttgtaacaaggcaggagcacttctgaaagccattcagcttgcggaacatattttctcagaaaaggagagtgtgcaggatgaatcaccgactatcagctcttgttag

SEQ ID NO: 3670 - protein, 513 aa, Bacillus pumilus
MNSQSNLTQFLKDSESYKTIPIVETITVDTLSPIQIVEKLKQDIVYLLESKDESSSWSRYSFIGLHPFLTLHDDQNKYIARDAAGQKLMQKQELKELLDWMKEQYQIKTPDIDIPFTGGAVGYLSYDLIPTLTSVRPHRSASTIENAHICLPTMIAFDHETNHVHFIQYTQLTGHETEDEKIRAYKEKQKQLEQMIHKLHSKVDMKELILSGNMNEPPSFEHVTSTYEKAQFLKDVEKIKEYIRAGDIFQGVLSQRFDIPVSVSSFELYRVLRIVNPSPYMYFMKLKDRDLVGSSPERLIHAKNGHLEIHPIAGTRKRGTTREEDAELARELLEDEKEKAEHYMLVDLARNDVGRVAEYGSVSVPTFTKVVNFSHVMHIISIVTGKLKRDTHPVDALMSAFPAGTLTGAPKIRAMQLLNEMEPEPRETYGGCIAYIGFDGNIDSCITIRTMSVKNHTASIQAGAGIVADSVPENEWEETCNKAGALLKAIQLAEHIFSEKESVQDESPTISSC

SEQ ID NO: 3671 - DNA, 1527 bp, Bacillus stearothermophilus
  CDS (1)..(1527)
atgtccattgatcggctagccgcttttttagcggatgctcgccagtttcgcaccatcccgatcatgcgcaaatttttagccgatgtcatcgaaccgttgcaagtgtttgccaatttgcgcgaggaagcggtgtttctgcttgaaagcaaagacgacgaatcgccatgggcgcgttattcgtttatcggcgtggccccatttttgacgcttgagagcgagacaggagaaacgtttttgatcaaagacgagaacggaaatgtccaaatgacggcgtcgacgttgaaagaagcgtttcaagcggtcgagcgggcgctttgcgttaagccgctcgccgaagcggcgccgtttacgggcggcgcggtcggctttttaggctatgatttcatttccgccattgaaaaggtgccgcgccatcgtgcccccgacctagccatgaaagccgggcattttgtgttttgcgagtcgctgttcgcttttgatcacgaaaaacgcgagctgtctctcattcattatatccggttgaagggtcatgaaacgatgcaggagaaaatcgcgatataccgagccgccgaagaacgcatcgccgcgctggcagcgaaagcgtcgcgcccccgggccgaacagccgctgctgccggccgaagacgaggccgagcgggccgccttgttctcgaaagcgtcgtccaattacgaaaaagagcaatttttgcgtgacgtcgaggcggtgaaacagtatattgcggccggcgatgtgtttcaggcggtgctgtcgcagcggttctccgtcccggtgcaagcgggtgggtttgccatttatcgcatcttgcgccacatcaacccgtcgccgtacatgttttattttcggcttgacggcattgaaattgtcggtagttcgccggaaaagctcatccaagtgcgcaaccggcgcgccgagatcgacccgatcgccggaacaaggcggcgcggacgctcaccggcggaggatgaaaagctcgccgacgagctgtaccatgacccgaaagagcgggcggagcattatatgctcgtcgatttggcgcgcaatgacatcggccgggtggcgaagtacggaacggtcgaggtgccggtgttgatggaaatcggcaagttctctcatgtgatgcatttaatttccaaagtcgtcggcgtgcttgacgacgacatccacccgatcgacgcgctcttggccgcttttccggctggaacggtgagcggggcgcccaaagtgcgggcgatgcaaatcttgcaggagctcgagccgaccgcccgaggattgtacgctggagcgatcgcgtacatcggctttgacggcagcattgattcgtgcatcgccatccggacggcggtcattaaagacggttatgcgtacgtgcaggccggcgccggcattgtcgccgactcggttccggagcttgaatggaaagagacgcgcaacaaggcgagcgccctcatttacgccatcgaacaagcggaacgattatttgcgaaaggggaacagatcgtatgttaa

SEQ ID NO: 3672 - protein, 508 aa, Bacillus stearothermophilus
MSIDRLAAFLADARQFRTIPIMRKFLADVIEPLQVFANLREEAVFLLESKDDESPWARYSFIGVAPFLTLESETGETFLIKDENGNVQMTASTLKEAFQAVERALCVKPLAEAAPFTGGAVGFLGYDFISAIEKVPRHRAPDLAMKAGHFVFCESLFAFDHEKRELSLIHYIRLKGHETMQEKIAIYRAAEERIAALAAKASRPRAEQPLLPAEDEAERAALFSKASSNYEKEQFLRDVEAVKQYIAAGDVFQAVLSQRFSVPVQAGGFAIYRILRHINPSPYMFYFRLDGIEIVGSSPEKLIQVRNRRAEIDPIAGTRRRGRSPAEDEKLADELYHDPKERAEHYMLVDLARNDIGRVAKYGTVEVPVLMEIGKFSHVMHLISKVVGVLDDDIHPIDALLAAFPAGTVSGAPKVRAMQILQELEPTARGLYAGAIAYIGFDGSIDSCIAIRTAVIKDGYAYVQAGAGIVADSVPELEWKETRNKASALIYAIEQAERLFAKGEQIVC

SEQ ID NO: 3673 - DNA, 1545 bp, Buchnera aphidicola
  CDS (1)..(1545)
atgaaaaaaagcgcatatccaattgaaataattcaaaaacaggccccctatcatcccgatcctactatgatatttaatcacctttgtgaatcacgatcagaaacattgttactagaaacagctgataataaaaaaaaaagatctagaaagataatgattattgatagtgctatgcgaatttcttcagaacacaatgcagttaaattaacaccactatctataaatggaatggaaattttattagtcttaaaaaaaataatatccaaaaaaattgaaatataccgaagaaaaaaaaatacaattcttatttttcccaacattgaaaaagatcttgacgaagataaaaaacttttttcactatcagtttttgatgcctttagattaatcattaaaacatttgaaaatagagaaaaaaaatcaaaagcaatgtttttcgggggattattttcttacgatttaatttcagtttttgaaacattacctaaattaaaagggaatcaaaaatgttcaaatttttgtttttacctggcagaaacactacttgttttagatcatcaacaaaaaacatgcttaattcaaagcagtttatttactaaaaattcaaacgaaaaaaaaagaattgaggaaagatctgtagaaataaaacaaaaactcaatcaaaagttaaattcaataccgaaaataaaaattaaagatattaatttaacttcaaatatgaataattttgaatatgggtcaataataaaaaaactacaaaaactaatccaaaaaggtgaaatttttcaagttgtaccgtctcgaaaattttatttaccctgtcccaatccgctatctgcttatcaaaaattaaaaaaaagcaacccaagtccttatatgttttttatgcaagatcaagattttacactgtttggagcttcaccagaaagttcattaaaatatgatgaaaaaacaagaaagattgaactatatcctatcgcaggaacaagacccagggggagaactaaggatggaaatttagatttagatttagatagcagaatagaacttgaaatgagaactaatcataaagaattagcagagcacttgatgctcgtagatttagcacgtaacgatcttgctcgtatttgtaaaccgggatctagatacgtgtcggatttagtgagggtagatcgatattctcatgtaatgcacttggtatcaagagttataggtgaacttagagagggtttagacgcattacatgcatatgcttcctgtatgaacatgggaacgctaacaggtgctccaaaggtttgcgcgatgcaattaattgcggaatatgaaaaagaaaaaagaggaagttacggtggtgctataggttattttacagatttaggtaatttagacacgtgtattacaatacgttcagcgtatgtggaaaaaaggtattgctacaatcaagcaggagccggtattgtttataattcaattccagaagatgaagtaaatgaaagtttaaacaaagcgcaagctgtaattaacgctataaaaaacgcacattattaa

SEQ ID NO: 3674 - protein, 514 aa, Buchnera aphidicola
MKKSAYPIEIIQKQAPYHPDPTMIFNHLCESRSETLLLETADNKKKRSRKIMIIDSAMRISSEHNAVKLTPLSINGMEILLVLKKIISKKIEIYRRKKNTILIFPNIEKDLDEDKKLFSLSVFDAFRLIIKTFENREKKSKAMFFGGLFSYDLISVFETLPKLKGNQKCSNFCFYLAETLLVLDHQQKTCLIQSSLFTKNSNEKKRIEERSVEIKQKLNQKLNSIPKIKIKDINLTSNMNNFEYGSIIKKLQKLIQKGEIFQVVPSRKFYLPCPNPLSAYQKLKKSNPSPYMFFMQDQDFTLFGASPESSLKYDEKTRKIELYPIAGTRPRGRTKDGNLDLDLDSRIELEMRTNHKELAEHLMLVDLARNDLARICKPGSRYVSDLVRVDRYSHVMHLVSRVIGELREGLDALHAYASCMNMGTLTGAPKVCAMQLIAEYEKEKRGSYGGAIGYFTDLGNLDTCITIRSAYVEKRYCYNQAGAGIVYNSIPEDEVNESLNKAQAVINAIKNAHY

SEQ ID NO: 3675 - DNA, 1593 bp, Buchnera aphidicola
  CDS (1)..(1593)
atgtgtgaacatcttaagagtatggatgttttaaaagttgaaacattttaccaacccaatccaacagctatttttcatcatatttgtcgtaatagaagtaatacgttacttttagaatcagctgaaattaataataaaaaaaatttagaaagcatgatgattgtagattctgcattacgcatttcagctttaaatatggtagttacattagaagcattaactaaaaacggagaaagtttattacctgtctttaagtctttattaccaaaagaagtgagaattcttagtaatgacaattttttaaaaattaaattcccttcaatcgttaaagatattgatgaagacaagaagttacatgtattgtctatatttgattcgatacgttttttgataaatagtgtaaaaaataataaaggttctaagtctatgttttttggaggattatttgcatatgacttggtttctagttttgagaatttacctaaattaaaaacttctcaatcttgccctgatttttgcttttatttatctgaaatattacttgttttgaaccataaaagaagaacttgttatatacaagcaagtttgttttcttctagcaatcttgaaagaaataaattacaacatagattattagaagtaaagaacaagttgtctcaaaatttttatccattagaatcaacttcattaaaaaaaatgattttaaaatgtaatagaacagatagagaatatgaaaaaatcattaaggaaatgaaaaaatcaataatgattggagaaattttccaagttgtaccgtctagaaaattttatttgccatgtactaattcgttagcggcttatgatgttttaaaaaaaaataatcctagtccatatatgttttttatgcaagattctaattttactttatttggtgcttctccagaaagttctttaaagtatgatacattatcgcggaaaattgaaatttatcctattgcaggaactaggccgcgagccagaaagatagatggatctatagatttggatttagatagtagaatagagttggaaatgcgaacaaatcataaagagttgtctgaacatttaatgttagtggatttggcacgtaatgatttagcaaaaatttgtgatcctggaactcgttatgttgctgatttaacacaagtagataagtattctcatgttatgcatttagtatcgagagttgtgggcaagttaagattagatttagatgtttttcatgcatatcaggcatgcatgaacatgggaacattaagtggtgctccaaaaattagagcgatggagttaatttctaatgcagagaaagagaaaagaggaagttatgggggatctataggatattttactgcgtctggaacattagatatgtgtattattattagatctgcatatgtagaaaataatattgctactattcaagtaggagctggaatagtactagattctatacctcaattagaagtagatgagagtaagaataaagctaaagctgtattacaggcaatttctgaatcacattcttgtcatatagagttaaacatagaaaatgaacgacatacttttgctggataa

SEQ ID NO: 3676 - protein, 530 aa, Buchnera aphidicola
MCEHLKSMDVLKVETFYQPNPTAIFHHICRNRSNTLLLESAEINNKKNLESMMIVDSALRISALNMVVTLEALTKNGESLLPVFKSLLPKEVRILSNDNFLKIKFPSIVKDIDEDKKLHVLSIFDSIRFLINSVKNNKGSKSMFFGGLFAYDLVSSFENLPKLKTSQSCPDFCFYLSEILLVLNHKRRTCYIQASLFSSSNLERNKLQHRLLEVKNKLSQNFYPLESTSLKKMILKCNRTDREYEKIIKEMKKSIMIGEIFQVVPSRKFYLPCTNSLAAYDVLKKNNPSPYMFFMQDSNFTLFGASPESSLKYDTLSRKIEIYPIAGTRPRARKIDGSIDLDLDSRIELEMRTNHKELSEHLMLVDLARNDLAKICDPGTRYVADLTQVDKYSHVMHLVSRVVGKLRLDLDVFHAYQACMNMGTLSGAPKIRAMELISNAEKEKRGSYGGSIGYFTASGTLDMCIIIRSAYVENNIATIQVGAGIVLDSIPQLEVDESKNKAKAVLQAISESHSCHIELNIENERHTFAG

SEQ ID NO: 3677 - DNA, 3037 bp, Buchnera aphidicola
  CDS (1)..(1581)
atgtattatcgttcaataaaaagtgaaataattcaaacaatttgtacatatcatgaagaaccatccctaatttttaataaaatttgccgtacaaaaactgaaacgttattattggaatctgctacggtacatggtaaaaaaaatatagaaagtatgctaatcatagatacagcaattaaaataagttgttttaaaaatattgtagaaatagaagctatttcaaataatggtttatttctattgaatacaattgatttaaaaattttaaaaaaaaaatcaacgaaaataaaaaaaaaaaaatcaaatgtattagaaatacattttcctatttttaattattttactgacgaagataaaaaattgtttttaacatcggtttttgatgctttaagaattattaaaaaatcgattaaaaaccccgaaaagagcaaaatgggagtattttttggtggtattctatcctacgacctcatttcttcttttgagcctattcctagagtttttaattctaaatataatcatccagatttttgtttttatttatctgaaaatttattgatttttgatcataaaaaaaaaaaatgtaaattacaaacaaatatatttactgataatgaagaagaaaaattaaatatcttaaaaagaataaaaattatttataatcaaataaaagaaataaattcaaaaaaaaaaaataatagaattaatacttttaatgattttaaaacaaaaaataaaaaatgggttgattgtaaaaatgattcaaaagtctataagaataaagttaaaaaaatgaaacaaatgatactcaatggagaagtctttcagattgttatttctagaaaattttttttaccatgtccttacccattagaatcttatatatttcttaaaaaaaataatcctagtccatatatgttttttatgcaggatagacattttgttctttttggagcttcccccgaaagttctctaaaattttcgtctataactagaaaaatagaaattcatcctatagcaggaacaagacccagagctttttcttctattaaaaaaattgatataaacgaagacaataaaatggaattagctatgagaattaattcaaaagaattagctgaacattgtatgttggtcgatcttgctaggaatgatctttctcggatttgtttacctggttctcgtgttgtttctgatttaatgaaagtagttaaatattctcatgttatgcatttagtttctaaagttgaaggggtattaagaaatgatttagatatttttcatgcataccaatgttgtatgaatatgggtactttaacaggtgcgcctaaaatacgtgcaatgcaaattattgcagaagagggggagataagagaatgttacggaggagcaattggatattttacagggaagggggatttagatacatgtattgtaattagatctgcttatgtaagaaatggaatagcttgtgttcaagctggtgcaggaattgttttagattctatagctgacgaagaaaacgaagaatgtaaaaataaagcaatggctgtgattaatgctataaataaaactctttaattttttttatttacccttctttttaaaaattgaagggtaatatttttaaaaaaaatttttgataatttttatctgtggataacctgtggataagtaattaaatataaaaaaatattttggttaaaatatcttattattacaataagttacttaatgtataaaattctcaaaaaaataaattttaaaacctaaattaataaaaattttgaaaaatttaaaaaattattttttttaaaacaaattattttaaataagttattgttttgtaaagaaaaataaattttttcaaaaaaaaaaaatatataattttttattatttttttttaaattttattaatattttatttttttttattattcagtagtaaaatatgtgtataagttatgtataacctgtggataactttctttttcctgtggataaatctatatgtaaaaaatagatttttatattcaaaaaaattaataaaattaaatacttagaattatttatataattttttttatataataatttatttctatttcataaaatatatatattattattattattatttatttttttgtttttattatttattattatgtttttatttattattttaagattttttaatttatgtattttttattaaatttagttgattttttagattatttatatatattaaaaaactaaaaccttgaaataaaaagaacaaaaaagttaactatatgtctgaaattttacttattgataatttagattcattcacttacaatttagttgatatttttaaaaaaaataaatataaagtttttatttttagaaattacatatcaaaaaaaataattgaaaaaaaaattgtaaatatgaaaaacccaattttagttttttcacctggtccaggtttacctaaaaatgcaggttgtatgaattctttaattaaaacttttgaatcaaaaataccaataattggaatatgtttaggttttcaagcaataattgaaatttttgggggtagtataattcaatctaaaaaaatttatcatggtaaaatatctataataaatcacgatggtttagacatatataaaaatataaaaaatcctctacaagtaggtagatatcattcttttgtatgtaataaagttccaaataattttattgctaattctttttgtaaaaaaatagtaatgagtataaagaataaatctaaaaaaatattcggatttcaatatcacccagaatcaattttaacaccttatggagacaaaattttattaaacacaatttcatggattgaaaataaaatttaattcaaatctataaacctaaccttccaatattacctttttaaaaaaataaaaattaaatttaagacttcaataaaaataagaaaaaagtttttttttattagttatttttaaaatttttttcaattagattgctaaatttatttggggaaaataa

SEQ ID NO: 3678 - protein, 526 aa, Buchnera aphidicola
MYYRSIKSEIIQTICTYHEEPSLIFNKICRTKTETLLLESATVHGKKNIESMLIIDTAIKISCFKNIVEIEAISNNGLFLLNTIDLKILKKKSTKIKKKKSNVLEIHFPIFNYFTDEDKKLFLTSVFDALRIIKKSIKNPEKSKMGVFFGGILSYDLISSFEPIPRVFNSKYNHPDFCFYLSENLLIFDHKKKKCKLQTNIFTDNEEEKLNILKRIKIIYNQIKEINSKKKNNRINTFNDFKTKNKKWVDCKNDSKVYKNKVKKMKQMILNGEVFQIVISRKFFLPCPYPLESYIFLKKNNPSPYMFFMQDRHFVLFGASPESSLKFSSITRKIEIHPIAGTRPRAFSSIKKIDINEDNKMELAMRINSKELAEHCMLVDLARNDLSRICLPGSRVVSDLMKVVKYSHVMHLVSKVEGVLRNDLDIFHAYQCCMNMGTLTGAPKIRAMQIIAEEGEIRECYGGAIGYFTGKGDLDTCIVIRSAYVRNGIACVQAGAGIVLDSIADEENEECKNKAMAVINAINKTL

SEQ ID NO: 3679 - DNA, 1557 bp, Corynebacterium glutamicum
  CDS (1)..(1557)
atgagcacgaatccccatgttttctccctagatgtccgctatcacgaggatgcttctgcattgtttgcccacttgggtggcacaaccgcagatgatgcagccctgttggaaagcgctgatatcaccaccaagaatggtatttcttccctcgcggtgttgaagagttcggtgcgcattacgtgcacgggcaacacggtggtaacgcagccgctgacggactcgggtagggcagtggttgcgcgcctaacgcagcagcttggccagtacaacaccgcagagaacacctttagcttccccgcctcagatgcggttgatgagcgcgagcgcctcaccgcaccaagcaccatcgaagtgctgcgcaagttgcagttcgagtccggctacagcgacgcgtccctgccactgctcatgggcggtttcgcgtttgatttcttagaaacctttgaaacgctccccgctgtcgaggagagcgtcaacacttaccccgattaccagttcgtcctcgcggaaatcgtcctggacatcaatcaccaggaccagaccgccaaactcgccggcgtctccaacgccccaggcgagctcgaggccgagctcaacaagctttcattgcttatcgacgccgccctccccgcaaccgaacacgcctaccaaaccacccctcacgacggcgacactcttcgcgttgtggctgatattcccgatgctcagttccgcacccagatcaatgagctgaaagaaaacatttacaacggtgacatctaccaagttgtcccggcgcgcactttcaccgcaccatgtcctgatgcattcgctgcttatctgcagctgcgtgccaccaacccgtcgccgtacatgttctatatccgtggcctcaacgaaggccgctcctatgaactttttggcgcatcccctgagtccaacctcaagttcaccgctgctaaccgtgagctgcagctgtacccaatcgcaggtacccgcccccgtggactcaacccagatggctccatcaacgatgagctagatatccgcaatgagttggatatgcgcactgatgccaaagagatcgcggagcacaccatgcttgtcgatctcgcccgcaacgacctggcccgcgtctcggtcccagcgtcgcgccgggttgcggatcttttgcaggtggatcgctattcccgcgtgatgcacttggtgtcccgtgtgacggcgacgttggacccagagcttgatgctttggacgcctatcgggcgtgcatgaatatgggcacgttgaccggcgctccgaagttgcgcgctatggagctgttgcgcggcgtcgaaaagcgcaggcgtggttcttatggtggggcagtggggtacctgcgcggcaatggcgatatggataattgcattgttattcgttcggcgtttgtccaggatggtgtggctgctgtgcaggctggtgctggtgtggtccgcgattctaatcctcaatctgaagccgatgagacgttgcacaaggcgtatgccgtgttgaatgccattgcgcttgctgctggttccactttggaggtcatccgatag

SEQ ID NO: 3680 - protein, 518 aa, Corynebacterium glutamicum
MSTNPHVFSLDVRYHEDASALFAHLGGTTADDAALLESADITTKNGISSLAVLKSSVRITCTGNTVVTQPLTDSGRAVVARLTQQLGQYNTAENTFSFPASDAVDERERLTAPSTIEVLRKLQFESGYSDASLPLLMGGFAFDFLETFETLPAVEESVNTYPDYQFVLAEIVLDINHQDQTAKLAGVSNAPGELEAELNKLSLLIDAALPATEHAYQTTPHDGDTLRVVADIPDAQFRTQINELKENIYNGDIYQVVPARTFTAPCPDAFAAYLQLRATNPSPYMFYIRGLNEGRSYELFGASPESNLKFTAANRELQLYPIAGTRPRGLNPDGSINDELDIRNELDMRTDAKEIAEHTMLVDLARNDLARVSVPASRRVADLLQVDRYSRVMHLVSRVTATLDPELDALDAYRACMNMGTLTGAPKLRAMELLRGVEKRRRGSYGGAVGYLRGNGDMDNCIVIRSAFVQDGVAAVQAGAGVVRDSNPQSEADETLHKAYAVLNAIALAAGSTLEVIR

SEQ ID NO: 3681 - DNA, 1476 bp, Neisseria gonorrhoeae
  CDS (1)..(1476)
atgatcagcaaacaagaataccaagcccaagccgcccaaggctacaaccgcatcccgctcgtgcaagaactccttgccgacttggatacgccgctttccctctatctcaaactcgccaaccgcccctatacctacctgctcgaatccgttgtcggcggcgaacgtttcggccgctattcctttatcggcctgccttgcagccactatctcaaagccggcggcaaacacgtcgatgtttatcaaaacggcgaaatcgtcgaacaatacgacggcaatccgctaccctttatcgaagctttccacaaccgtttcaaaacacccgaaatcccaagcctgccgcgctttaccggcggcttggtcggctacttcggttacgaaaccgtctacaatttcgaacacttcgcccaccgcctgaaaaacaccgccaaagccaacccgctcggcacgcccgatattttgctgatgctgtcgcaagagttggcggtaatcgacaatttgagcggcaaaatccacctcatcgtttatgctgatccctcgcagcccgacagctacgaacgcgcccgcgaacgcctcgaagacatccgcacccagttgcgccaaagctgcgccatcccactttccctcggcagcaaacaaacccaagcagtcagcgagttcggcgaagaacctttcaaagcctgcgtcgataaaatcaaagactacattttcgcaggcgactgtatgcaggtcgtccccagccaacgcatgagcatggaatttaccgacaatccgcttgccctctaccgcgccctgcgcacgctcaacccttcgccttacctcttttactacgatttcggcgatttccacatcgtcggttcctcgcccgaaatcctcgtccgccgcgaacgcgacgacgtcatcgtccgccccatcgccggcacgcgcctgcgcggcaaaacccccgccgaagaccttgccaacgaacaagatttgttaagcgacgccaaagaaatcgccgaacacgttatgcttatcgatttggggcgcaacgatgtcggacgcatcagcaaaacaggcgaagtcaaagtcaccgacaaaatggtgattgaaaaatactcccatgtgatgcacatcgtttccaacgtcgaaggctgtttgaaagagggcgttaccaatatggacatcctcgccgccaccttccctgccggcacactctccggcgcgccaaaagtccgcgcgatggaaatcatcgaagaaatcgaaccggagaaacgcggcatctacggcggcgccgtcggcgtatggggcttcaacaacgatatggatttggcaatcgccatccgcaccgccgtgattaaaaacaataccctcttcatccaaagcggcgcgggcgtggttgccgactccgacccaacttccgaatggcaggaaactcaaaacaaagcccgcgcagtggttcgggcggcgcagatggtgcaggaagggttggataaatag

SEQ ID NO: 3682 - protein, 491 aa, Neisseria gonorrhoeae
MISKQEYQAQAAQGYNRIPLVQELLADLDTPLSLYLKLANRPYTYLLESVVGGERFGRYSFIGLPCSHYLKAGGKHVDVYQNGEIVEQYDGNPLPFIEAFHNRFKTPEIPSLPRFTGGLVGYFGYETVYNFEHFAHRLKNTAKANPLGTPDILLMLSQELAVIDNLSGKIHLIVYADPSQPDSYERARERLEDIRTQLRQSCAIPLSLGSKQTQAVSEFGEEPFKACVDKIKDYIFAGDCMQVVPSQRMSMEFTDNPLALYRALRTLNPSPYLFYYDFGDFHIVGSSPEILVRRERDDVIVRPIAGTRLRGKTPAEDLANEQDLLSDAKEIAEHVMLIDLGRNDVGRISKTGEVKVTDKMVIEKYSHVMHIVSNVEGCLKEGVTNMDILAATFPAGTLSGAPKVRAMEIIEEIEPEKRGIYGGAVGVWGFNNDMDLAIAIRTAVIKNNTLFIQSGAGVVADSDPTSEWQETQNKARAVVRAAQMVQEGLDK

SEQ ID NO: 3683 - DNA, 1476 bp, Neisseria meningitidis
  CDS (1)..(1476)
atgatcagcaaacaagaataccaagcccaagccgctcaaggctacaaccgcatcccgctcgtgcaagaactccttgccgatttggatacgccgctttccctctatctcaaactcgccaaccgcccctatacctacctgctcgaatccgttgtcggtggcgaacgtttcggccgctattcttttatcggcctgccttgcagccactatctcaaagccagcggcaaacacgtcgatgtttatcaaaacggcgaaattgtcgagcaacacgacggcaaccccctgccctttatcgaagccttccacaaccgcttcaaaacacccgaaatcccaagcctgccgcgctttaccggcggactggtcggctacttcggttacgaaaccatctacaattttgaacacttcgcccaccgcctgaaaaacaccaccaaagccgacccgctcggcacgcccgacatcctcctgatgctctcgcaagagcttgcagtagtggataacctaagcggtaaaatctacctgattgtttacgccgatccgtcgcagcccgacggctacgaacgcgcacgcgaacgcctcgaagacatccgtacacagttacgccaaagttgcgccatcccgctttcgctcggcagcaaacacaccgaagccgtcagcgaattcggcgaagagccgttcaaagcctgcgttaacaaaatcaaagactacatctttgcaggcgactgcatgcaggttgtccccagccagcgcatgagcatggaattcaccgacagctcgctcgccctctaccgcgccttgcgcacgctcaacccttcgccttatctcttctactacgatttcggcgatttccacatcgtcggctcctcgcccgaaatcctcgtccgccgcgaacgcgacgatgtcatcgtccgccccatcgccggcacgcgcctgcgcggcaaaacccccgccgaagaccttgccaacgaacaagatttgttaagcgatgccaaagaaatcgccgaacacgtcatgttgattgacttaggacgcaacgacgtcggccgcatcagtaaaaccggcgaagtcaaagttaccgacaaaatggtgattgaaaaatactcccatgtaatgcacatcgtttccaacgtcgaaggccgtctgaaagacggcatgaccaacatggacatcctcgccgctaccttccctgccggcacactctccggcgcacccaaagtccgcgccatggaaatcatcgaagaagtcgaaccaagcaaacgcggcatctacggcggtgccgtcggcgtatggggtttcaacaacgacatggatttggcaatcgccatccgcaccgccgtagtaaaaaacaacacgctatacgtccaaagcggcgcgggcgtggttgccgactccgatccggcctccgaatggcaggaaacacaaaacaaagcccgagccgtcatacacgccgcgcagatggtgcaggaagggttggataaatga

SEQ ID NO: 3684 - protein, 491 aa, Neisseria meningitidis
MISKQEYQAQAAQGYNRIPLVQELLADLDTPLSLYLKLANRPYTYLLESVVGGERFGRYSFIGLPCSHYLKASGKHVDVYQNGEIVEQHDGNPLPFIEAFHNRFKTPEIPSLPRFTGGLVGYFGYETIYNFEHFAHRLKNTTKADPLGTPDILLMLSQELAVVDNLSGKIYLIVYADPSQPDGYERARERLEDIRTQLRQSCAIPLSLGSKHTEAVSEFGEEPFKACVNKIKDYIFAGDCMQVVPSQRMSMEFTDSSLALYRALRTLNPSPYLFYYDFGDFHIVGSSPEILVRRERDDVIVRPIAGTRLRGKTPAEDLANEQDLLSDAKEIAEHVMLIDLGRNDVGRISKTGEVKVTDKMVIEKYSHVMHIVSNVEGRLKDGMTNMDILAATFPAGTLSGAPKVRAMEIIEEVEPSKRGIYGGAVGVWGFNNDMDLAIAIRTAVVKNNTLYVQSGAGVVADSDPASEWQETQNKARAVIHAAQMVQEGLDK

SEQ ID NO: 3685 - DNA, 1563 bp, Salmonella typhimurium
  CDS (1)..(1563)
atgcaaacaccaaaacccacgctcgaactgttgacctgcgatgccgcctatcgggaaaacccaacggcgctttttcaccaggtctgcggcgatcgcccggcaacgctgctgctggaatccgcggatatcgacagtaaagatgatttaaaaagcctgctgctggtagatagcgcgctgcgcattaccgctttaggtgacactgtcaccattcaggcgttatctgataatggcgcctcgttattgccgctactggataccgccctgcccgctggcgtggagaacgatgtcctgcctgccggtcgcgttctacgcttcccgcccgtcagcccattattagatgaagacgcccgtttatgctctctgtcggtatttgatgcgttccgtctgttacagggagtggtgaacataccgacgcaagagcgggaggctatgtttttcggcggtctgtttgcctacgacctggtcgctggctttgaagcgctgccacaccttgaggctggcaataactgcccggactactgcttttatttagcggaaacgctgatggttatagatcatcagaaaaaaagcacccgtattcaggccagtctgttcaccgccagcgaccgggaaaaacagcgcctcaacgcccgcctggcgtaccttagccaacagttaacccagcctgcgccgccgttgccggtgacgccggtgccggacatgcgctgtgaatgcaatcagagcgatgacgcgttcggcgcggtggtacgccagttgcaaaaagccatccgcgcgggcgagatatttcaggtggtgccgtcgcgccgcttttcactgccctgcccgtcgccgttggctgcctactacgtgctgaaaaagagcaaccccagcccgtatatgttctttatgcaggataatgatttcacgcttttcggcgcgtcgccggaaagctcgctgaaatatgacgcagccagccgtcagattgagatttatcccatcgcgggtacccgtccacgcggtcgccgcgccgatggtacgctggacagagatctcgacagccgtattgagctggacatgcgtaccgaccataaagagctttccgaacatctgatgctggtcgatctggcgcgcaatgacctggcgcgcatctgtacgccgggcagtcgctacgttgccgatctgacaaaagttgaccgctattcatacgtgatgcatctggtttcccgggtggtgggcgaactgcgtcacgatctcgacgcgctgcacgcctatcgcgcctgcatgaacatgggcaccctgagcggcgcgccgaaagtacgcgccatgcagttgattgccgatgcggaaggacagcgccgcggcagctatggcggcgcggtcggttacttcaccgcccacggcgatctggacacctgtattgttatccgttccgcgctggtggagaacggtatcgccaccgtacaggcgggtgccggaattgtgctggactctgttccgcagtctgaagccgatgaaacccgtaataaagcgcgcgccgtattgcgtgctatcgccaccgcgcatcatgcacaggagaccttctga

SEQ ID NO: 3686 - protein, 520 aa, Salmonella typhimurium
MQTPKPTLELLTCDAAYRENPTALFHQVCGDRPATLLLESADIDSKDDLKSLLLVDSALRITALGDTVTIQALSDNGASLLPLLDTALPAGVENDVLPAGRVLRFPPVSPLLDEDARLCSLSVFDAFRLLQGVVNIPTQEREAMFFGGLFAYDLVAGFEALPHLEAGNNCPDYCFYLAETLMVIDHQKKSTRIQASLFTASDREKQRLNARLAYLSQQLTQPAPPLPVTPVPDMRCECNQSDDAFGAVVRQLQKAIRAGEIFQVVPSRRFSLPCPSPLAAYYVLKKSNPSPYMFFMQDNDFTLFGASPESSLKYDAASRQIEIYPIAGTRPRGRRADGTLDRDLDSRIELDMRTDHKELSEHLMLVDLARNDLARICTPGSRYVADLTKVDRYSYVMHLVSRVVGELRHDLDALHAYRACMNMGTLSGAPKVRAMQLIADAEGQRRGSYGGAVGYFTAHGDLDTCIVIRSALVENGIATVQAGAGIVLDSVPQSEADETRNKARAVLRAIATAHHAQETF

SEQ ID NO: 3687 - DNA, 2502 bp, Serratia marcescens
  CDS (280)..(1839)
gaattcacgctgatcgctaaaacattgtgcaaaaagagggttgactttgccttcgcgaaccagttaactagtacacaagttcacggcaacggccgtgtcggatgagagttaacaaagagagtctgcaaatgaacacatacatttctcttcacggttggtggcgtacctccctcttgcgggcggtgtaatcgcgcatagctgtcatctgacaatgcagatttcctggcccgcacctgatgcgggcttttttatggacagaattcactggaaccaccgatgatgaacaccaaaccacaattgacactactgaaggtgcaagccagctaccggggcgatcccaccacccttttccaccagctgtgcggcgcccgtccggccaccctgctgctggagtcggcggaaatcaacgacaaacagaatctgcagagcctgctggtgatcgacagcgcgctgccgattaccgcactgggccacaccgttagcgtgcaggcgctgaccgccaacgggccggcgctgctgcccgtgctggacgaagcgctgccgcccgaggtgcgcaatcaggcacgccctaacggccgcgaactgaccttcccggcgatcgacgcggtgcaggacgaagacgcccgcctgcgttcactgtcggtgttcgacgcgctgcgcacgctgctgacgctggtggactctccggcggacgagcgcgaagccgtgatgctgggcggcctgttcgcctatgatttggtcgccggttttgaaaacctgccggccgtgcgccaggatcaacgctgcccggacttctgcttctatctggcggaaaccctgctggtgctcgatcaccaacgcggctcggcccgtctgcaggccagcgtcttcagtgagcaggcgagtgaagcgcagcgtttgcagcatcgcctggaacagctgcaggctgagttgcaacaacccccgcagccaatcccgcaccaaaagctggaaaacatgcagctgagctgtaaccagagtgacgaagagtacggcgcggtggtcagcgagctgcaggaagcgatccgccagggcgaaatcttccaggtggtgccgtcgcgccgcttttccctgccgtgcccggcgccgctggggccctaccaaaccttaaaagacaacaaccccagcccgtacatgttcttcatgcaggatgatgacttcaccctgttcggcgcttcgccggagagcgcgttgaaatacgacgcgggcaatcgccaaatcgaaatctacccgatcgccggcacccgcccgcgcggccgccgtgccgatgggtcgctggatttggatctcgacagccgcatcgagctggaaatgcgcaccgaccacaaagagctggccgagcacctgatgttggtcgatctggcgcgcaacgatctggcgcgcatctgccaggccggcagccgctacgtggccgacctgaccaaagtggatcgctattcgttcgtcatgcatctggtttcccgggtggtgggcaccctgcgcgccgatctcgacgtgctgcacgcctaccaggcctgcatgaacatgggcaccctcagcggcgcgccgaaagtgcgggcgatgcagctgatcgccgccctccgaagcacgcgccgcggcagctacggcggccgagtgggctacttcaccgcccaccggcatctggatacctgcatcgtcattcgctccgcctacgttgaagacgggcatcgcaccgtgcaggccggcgccggcgtggtgcaggactccatccgcaggcgggaagccgacgagacccgtaataaagcccgtgccgtgctgcgcgccatcgccactgcgcaccatgccaaggaggtgttctgatggccgatatcctgctgctcgacaacgtcgactcctttacctacaacctggtcgatcagctgcgcgccagcggccaccaggtggtgatttaccgtaatcagatcggcgccgaggtgatcatcgagcgtctgcaacatatggaacagccagtgctgatgctgtcgcccggccctggcaccccttccgaagcgggctgtatgccggaactgctgcagcgtctgcgcggccaactgccgatcatcggcatctgcctcggccaccaggcgatcgtcgaagcctatggcggccaggtcggccaggcgggcgagatcctgcacggcaaagcctcggcgatcgctcacgatggcgaaggcatgttcgccggtatggccaatccgctgccagtggcgcgctaccactcgctggtcggcagcaatatcccggccgatctcaccgtcaacgcccgttctggcgaaatggtgatggcggtgcgcgacgaccgccgccgcgtgtgcggcttccagttccacccggaatcgattctgaccacccacggcgcgcgcctgcttgagcagaccctggcctgggcgctggcgaagtaatataaggaacacgacgatgcaacctattcttcagaaactgtaccgcgccgagtcgatgagccagcaggaaagccaacagctg

SEQ ID NO: 3688 - protein, 519 aa, Serratia marcescens
MNTKPQLTLLKVQASYRGDPTTLFHQLCGARPATLLLESAEINDKQNLQSLLVIDSALPITALGHTVSVQALTANGPALLPVLDEALPPEVRNQARPNGRELTFPAIDAVQDEDARLRSLSVFDALRTLLTLVDSPADEREAVMLGGLFAYDLVAGFENLPAVRQDQRCPDFCFYLAETLLVLDHQRGSARLQASVFSEQASEAQRLQHRLEQLQAELQQPPQPIPHQKLENMQLSCNQSDEEYGAVVSELQEAIRQGEIFQVVPSRRFSLPCPAPLGPYQTLKDNNPSPYMFFMQDDDFTLFGASPESALKYDAGNRQIEIYPIAGTRPRGRRADGSLDLDLDSRIELEMRTDHKELAEHLMLVDLARNDLARICQAGSRYVADLTKVDRYSFVMHLVSRVVGTLRADLDVLHAYQACMNMGTLSGAPKVRAMQLIAALRSTRRGSYGGRVGYFTAHRHLDTCIVIRSAYVEDGHRTVQAGAGVVQDSIRRREADETRNKARAVLRAIATAHHAKEVF

SEQ ID NO: 3689 - DNA, 1626 bp, Vibrio parahaemolyticus
  CDS (1)..(1626)
atgcgactatgtactgcaggacgattaaaacagctacaaggaggtcttgtgaacaaggccattgaaattaagaaacttggacaactggaagtattaaaagcttctgttccttacactcaagacccaacccgtctgttccatactatttgtgagaacaaaacggatagcttgcttttagaatcggctgaaattgattctaaacagaatctcaaatcgctgttaatcgtcgattctgcggttcgcatcgtttgttatggacataccgtcagctttcatgctctaacggagaacggcaaaaacctactgacgcatgtgaatcaaaacgtacgtggtgaagtcgcaagccaatttgacggcgaaacactgactttagaattcatccaaccatgcgatacgattgatgaagattctcgtctacgagaagcttcttcttttgatgcgcttcgtttggtacagcacagttttgatctttcttcgcaagacaaacatgccattttccttggtggcctatttgcgtatgacttggtggcgaacttcgaaccattaggagacgcggtagcaacaaaccagtgtccagattacgtcttctatgttgcggaaacattgctggttgtagatcaccaaacagaatcctgccaactgcaagcaacattgttcgttgacggctcgcaaaaagcagcgttagaaagtcgaatcgaagatatccgagctcaatgcacatcgccaaagcgtcttccagacgcaacgcaagtggccaatatcacagctcaaccaagcgttccggatcaagacttctgtcaaatcgtccgtgatctaaaagaattcgtggtaaaaggcgatattttccaagtggttccttctcgtcgattcacattgccttgcccttctccgctagcagcttacaaagagctaaagcaaagcaacccaagcccttacatgttctacatgcaagatgagcttttcactttgtttggtgcgtctccagaaagtgccttgaagtatgaaaccgacaccaaccaaatagaaatctacccaattgcggggactcgccgtcgcggtaaacgtccaaatggcgaaatcgattttgatttagatagccgtattgaacttgaactgcgtagcgacaaaaaagagaacgctgaacatatgatgttggtagacctagctcgtaatgatgtagcgcgcatctcgcaagctggtactcgtcatgttgccgatctccttaaagtcgaccgctatagccatgttatgcacttggtgtctcgcgtggttggccagttgcgcgatgaccttgatgctttgcacgcttaccaagcttgtatgaacatgggcacgttaactggggcgccaaaaattcgtgcaatgcaactgattcgcgatgttgaaggtgctcgtcgtggcagctatggcggagcggtaggctatctgaccggagaaggcacgctcgacacttgtatcgtgattcgctcggcttacgtggaaaacggcattgctcaagtacaagcaggtgcaggcgtggtattcgattctgaccctcaagcggaagccgatgaaacacgcggaaaagctcaagcggttatctctgctattcaagcagcgcattctcaacctgctaacaaggagtag

SEQ ID NO: 3690 - protein, 541 aa, Vibrio parahaemolyticus
MRLCTAGRLKQLQGGLVNKAIEIKKLGQLEVLKASVPYTQDPTRLFHTICENKTDSLLLESAEIDSKQNLKSLLIVDSAVRIVCYGHTVSFHALTENGKNLLTHVNQNVRGEVASQFDGETLTLEFIQPCDTIDEDSRLREASSFDALRLVQHSFDLSSQDKHAIFLGGLFAYDLVANFEPLGDAVATNQCPDYVFYVAETLLVVDHQTESCQLQATLFVDGSQKAALESRIEDIRAQCTSPKRLPDATQVANITAQPSVPDQDFCQIVRDLKEFVVKGDIFQVVPSRRFTLPCPSPLAAYKELKQSNPSPYMFYMQDELFTLFGASPESALKYETDTNQIEIYPIAGTRRRGKRPNGEIDFDLDSRIELELRSDKKENAEHMMLVDLARNDVARISQAGTRHVADLLKVDRYSHVMHLVSRVVGQLRDDLDALHAYQACMNMGTLTGAPKIRAMQLIRDVEGARRGSYGGAVGYLTGEGTLDTCIVIRSAYVENGIAQVQAGAGVVFDSDPQAEADETRGKAQAVISAIQAAHSQPANKE

SEQ ID NO: 3691 - DNA, 24 bp, artificial sequence
  primer
atgcaaacacaaaaaccgactctc

SEQ ID NO: 3692 - DNA, 25 bp, artificial sequence
  primer
ttagaaagtctcctgtgcatgatgc

SEQ ID NO: 3693 - DNA, 785 bp, Escherichia coli K12
  CDS (86)..(781)
gaattcttgtcaacaattaactctgagcgcgcggcaacgctattcgactggtatcagacggatgaaatccctataattgccgcgtatggcgcttcgtcgcccccttcctaacatccaggttaatcaggtcgctaaatatatgactgatcagtctcatcagtgcgtcattatcggtatcgctggcgcatcggcttccggcaagagtcttattgccagtaccctttatcgtgaattgcgtgagcaagtcggtgatgaacacatcggcgtaattcccgaagactgctattacaaagatcaaagccatctgtcgatggaagaacgcgttaagaccaactacgaccatcccagcgcgatggatcacagtctgctgcttgagcatttacaagcgttgaaacgcggctcggcaattgacctgccggtttacagctatgttgaacatacgcgtatgaaagaaacggtgacggttgagccgaagaaggtcatcattctcgaaggcattttgttgctgacggatgcgcgtttgcgtgacgaacttaacttctccattttcgttgataccccgctggatatctgcctgatgcgccgcatcaagcgtgacgttaacgagcgtgggcgttcaatggattcagtgatggcgcaatatcaaaaaaccgtgcgcccgatgttcctgcaattcattgagccttctaaacaatatgcggacattatcgtgccgcgcggcgggaaaaaccgcatcgcgatcgatatattgaaagcgaaaataagtcagttctttgaataagctt

SEQ ID NO: 3694 - protein, 231 aa, Escherichia coli K12
MALRRPLPNIQVNQVAKYMTDQSHQCVIIGIAGASASGKSLIASTLYRELREQVGDEHIGVIPEDCYYKDQSHLSMEERVKTNYDHPSAMDHSLLLEHLQALKRGSAIDLPVYSYVEHTRMKETVTVEPKKVIILEGILLLTDARLRDELNFSIFVDTPLDICLMRRIKRDVNERGRSMDSVMAQYQKTVRPMFLQFIEPSKQYADIIVPRGGKNRIAIDILKAKISQFFE

SEQ ID NO: 3695 - DNA, 1005 bp, Nostoc sp. PCC 7120
  CDS (1)..(1005)
atgacaactaagccggaacgcgtggtactgattggagtagccggagactccgggtgcggtaaatctacgtttttgcgtcgtctgatagatttatttggtgaagagtttatgacggtcatctgtttagatgactaccattctttggatcgtaaacaacgtaaagaaactggaatcaccgcacttgaccccagggccaacaattttgacctgatgtatgagcagatcaaagcgctcaaagaagggcaaacgattaataagccgatttataaccacgaaaccggcctaattgatccacctgagatagtaaagccaaatcacattgtagtggttgagggtttacaccctctatatgatgaacgggtgagatcgctcctcgatttcagcgtctactttgacatcagcgatgaagtcaaaattgcttggaaaatccagcgtgatatggcagaaagaggtcatcgctacgaagacgttctagcggccatcaattctcgtaagccagattttcaaaaatatatcgaacctcaaagagaattcgccgatgtggtgctacaagtactacccaccaacttaatcaaggatgatacagaacgtaaagtcctacgggtgcggatgttacaacgggaaggaaaagaaggttttgaacccgcttacctgtttgatgaaggttcaacaattaactggactccttgcggacgtaagcttacctgttcttacccaggaatgcagttatactacggttccgatgtttactacggtcgctatgtctcagttctagaggtggatggtcaatttgacaacctcgaagaagtaatctacatcgaaacccacctcagcaatacatctactaagtatcaaggtgagttaactcagctgttactccaacaccgtgaatatcccggttcaaataacggaactggttttttccaagtattaacaggtttgaaaatgcgtgctgcttacgagcgcttgacaacaaaggaagccaaactagcagttcaggtttaa

SEQ ID NO: 3696 - protein, 334 aa, Nostoc sp. PCC 7120
MTTKPERVVLIGVAGDSGCGKSTFLRRLIDLFGEEFMTVICLDDYHSLDRKQRKETGITALDPRANNFDLMYEQIKALKEGQTINKPIYNHETGLIDPPEIVKPNHIVVVEGLHPLYDERVRSLLDFSVYFDISDEVKIAWKIQRDMAERGHRYEDVLAAINSRKPDFQKYIEPQREFADVVLQVLPTNLIKDDTERKVLRVRMLQREGKEGFEPAYLFDEGSTINWTPCGRKLTCSYPGMQLYYGSDVYYGRYVSVLEVDGQFDNLEEVIYIETHLSNTSTKYQGELTQLLLQHREYPGSNNGTGFFQVLTGLKMRAAYERLTTKEAKLAVQV

SEQ ID NO: 3697 - DNA, 642 bp, Salmonella enterica subsp. enterica serovar Typhi
  CDS (1)..(642)
atgactgatcagtctcatcagtgcgtcattatcggtatcgctggcgcatcggcttccggcaagagtcttattgccagtaccctttaccgcgaattgcgtgaacaagtgggtgacgaacatattggcgttattcccgaagacagttattacaaagatcaaagccatctgtcgatggaagaacgcgtaaaaactaactatgaccatccgaatgcgatggatcacagcctgctatttcagcatcttcaggcgctcaagcgcggttcggcgattgaattaccggtatacagttatgttgagcatacccgtatgcaggaaacggttcgcgtagaaccgaagaaagtgattattcttgaaggtattctgttactgaccgacgcgcgtttgcgtgaagagatgaacttctctatttttgtcgatacgccgctggatatctgtttgatgcgccgtatcaaacgcgatgtgaacgagcgtggtcgctcaatggattcggtgatggcgcaatatcagaaaacggtgcgtccgatgttcctgcaatttattgagccttccaaacaatatgcggatattatcgtgccgcgcggcggtaaaaaccgcatcgctattgatattctgaaagcgaaaatcagccagttctttgaataa

SEQ ID NO: 3698 - protein, 213 aa, Salmonella enterica subsp. enterica serovar Typhi
MTDQSHQCVIIGIAGASASGKSLIASTLYRELREQVGDEHIGVIPEDSYYKDQSHLSMEERVKTNYDHPNAMDHSLLFQHLQALKRGSAIELPVYSYVEHTRMQETVRVEPKKVIILEGILLLTDARLREEMNFSIFVDTPLDICLMRRIKRDVNERGRSMDSVMAQYQKTVRPMFLQFIEPSKQYADIIVPRGGKNRIAIDILKAKISQFFE

SEQ ID NO: 3699 - DNA, 942 bp, Nostoc sp. PCC 7120
  CDS (1)..(942)
atgatgagccgtccaataattcttggtattgttggtgatagtgctgctggcaaaactacactaactaggggcattgctcaggtactggggccagaaaatgtcacactcatctgcacagatgattatcatcggtacgatcgccaacaacgtgcagaaataggaattaccgctctccaccccgattgtaaccatttggatattatgcagcagcatctatcgctgctacgcacaggacaaccaattcttaaaccagtttatagtcacaaaaccggaagttttgagccgccccaatatataaaacccaacaaattcgttattatcgagggattacttggttattctactcgcgccgcccgtgactgttacgatgtgaaagtttacctcgctcctccagagaacctccgtgctaaatggaaagttaaacgcgacacgcaaaaacgcggctacactcccgaacaagttttagcagaactagagaagcgcgaaccagattcagaacaatttattcgtccccaaagacaatggtctgatattgttgtcagtttctatccacctcatgaggatggagatgaaaccaacggacatctcaacgtgcgtttagtattgcgtcctactattccccacccagactttacttccattattaatttgactaatggtagttctgtgtcagctattcgcctgggattggacagagatatgagtaaaccagttgatgtgttagaagttgacggtcacgccaccttagaacaggtaaacaaattagagcatattctctgttctgatatgccttacttgagtagtgtatgcgatcgcgaaagtaacccagaactcggcaagattgctgggacaactggcgaaacactacaaagttacccccttgccctgactcagttaatcatcacctaccatatgctcaaggcaacgcaaatttatcaataa

SEQ ID NO: 3700 - protein, 313 aa, Nostoc sp. PCC 7120
MMSRPIILGIVGDSAAGKTTLTRGIAQVLGPENVTLICTDDYHRYDRQQRAEIGITALHPDCNHLDIMQQHLSLLRTGQPILKPVYSHKTGSFEPPQYIKPNKFVIIEGLLGYSTRAARDCYDVKVYLAPPENLRAKWKVKRDTQKRGYTPEQVLAELEKREPDSEQFIRPQRQWSDIVVSFYPPHEDGDETNGHLNVRLVLRPTIPHPDFTSIINLTNGSSVSAIRLGLDRDMSKPVDVLEVDGHATLEQVNKLEHILCSDMPYLSSVCDRESNPELGKIAGTTGETLQSYPLALTQLIITYHMLKATQIYQ

SEQ ID NO: 3701 - DNA, 642 bp, Yersinia pestis
  CDS (1)..(642)
atgactgacaaagcacatcagtgcgtcattattgggatagcgggtgcttctgcctccggaaaaagtcttatcgccagcacgttgtatcgcgaattacgtgaacaagtaggcgaccaacatattggtgttattcctgaagatggttattacaaagaccagagccatctgtcaatggaagagcgggtcaaaacgaactacgaccacccaagcgccatggaccacaatttattgttggaacatttgcaggcgttgaaggcgggtaagcccgttgaattgcctctgtacagctatactgagcacacacgtaaaaaagaaacggttcatttagaacctaaaaaagtgatcattcttgaaggtatactgctgctgacggatatccgcttacggcaggaaatgaacttctcaatcttcgttgataccccattggatatctgcctgatgcgcagaatgaagcgtgatgtcaatgagcgtggccgttcgatggactctgttatggcccaatatcagaaaacagtccgtcctatgtttctgcaatttatagaaccatctaagcaatatgctgacattatcgttcctcgtggcggtaaaaatagaattgcgatcgatattctaaaagcgaaaatcagtcagttctttgagtaa

SEQ ID NO: 3702 - protein, 213 aa, Yersinia pestis
MTDKAHQCVIIGIAGASASGKSLIASTLYRELREQVGDQHIGVIPEDGYYKDQSHLSMEERVKTNYDHPSAMDHNLLLEHLQALKAGKPVELPLYSYTEHTRKKETVHLEPKKVIILEGILLLTDIRLRQEMNFSIFVDTPLDICLMRRMKRDVNERGRSMDSVMAQYQKTVRPMFLQFIEPSKQYADIIVPRGGKNRIAIDILKAKISQFFE

SEQ ID NO: 3703 - DNA, 1668 bp, Thermotoga maritima
  CDS (1)..(1668)
atgcgaaagatcacacttcgttcaaaactggacgggagagagatcgttttcgaggaaaatcaaaatctcttcgatatagccagagagtaccagaagtactacaggtacaaaatactggctgcgagggtgaacaacaggataatagaactcttcagaacacccgatagaagcggagaactcgaatttttagacctcacagatcccgacggactcagaatataccagagaggactcgtcttcctcgcaagtctcgccgtgagaaaactgaattcggaatggcgattgaaggtccttcactcactcgggaaggggatatactgcgaaatctataagggaaatgaattaatcgttcccgatcagaatcaggtgttcgccataaaagataagatgagagaactcgtcgagaaagatctgcctattgagaagagaacgttctacaaagacgaagcaagggagatattaatgaaggaaggacttgtgaaaacggtcaacctcttcaagtacagaaagaagagaaccgtgaagctttaccactgcgatggtttttgggcgtacttctacggatatcttccaccgagcaccggcaggattgacgttttcgatgttcagccctacaatcaggggctcgttcttgtccatccggatccaaaaacaagagagcttcccgtcatccacatgcccaaactctcccaggtgttcctcgaatacgcccgatggctgaacgttctggaactcgagtacgtatccgatctcaacgatatcatagcccgtggggaaaggcacgtggctgaccttatgcttctttccgaagcacttcatgaaaagaagatctcagacatagcggatgaaatcgcaaaagacaaaagaaaacggctcattctgattgcgggtccttcctcttcgggaaagaccaccttcgccaagagactctcactccagctcagagtgaacggtctaaaaccggttgccatttcccttgacgactactttgtggacagagaaaaaacaccgcgtgatgaaaacggaaactacgatttcgactcgatagaggccctcgacatagaactcttcaacaggaaccttcaggatcttttggctggaaaagaggtggtcctgccgaagttcaacttcaagaccggaaagagaatgagaggtcccacgctcaaattggagaaggacaacatcatcatcgtcgaaggaatacacggtctgaacgaacgtctgacggcctcaataccgaaagagcaaaagttcaagatatacgtgagtgcattgactcagctgaacatagacgatcacaacagagtcacaacaacggacacgcggctcatcagaagaatcgtgagggactacaagttccggggacacaccgcgtacgatacattgaagatgtggccaaacgtcagaaagggtgaagaaagaaacatcttcccgttccaggaagaggccgatgtgatgttcaactcggccctggtttacgaaataccagtgctcaggatattcgctgaaccgcttctcgttcaagttccggaagatgttccagagtactcggaagcgctgagacttctgaaacttctggacttcttccttccgatcacgaacatagaagatattcccgataaatcgatcctcagagagttcataggaaggagtatcttcaaatattga

SEQ ID NO: 3704 - protein, 555 aa, Thermotoga maritima
MRKITLRSKLDGREIVFEENQNLFDIAREYQKYYRYKILAARVNNRIIELFRTPDRSGELEFLDLTDPDGLRIYQRGLVFLASLAVRKLNSEWRLKVLHSLGKGIYCEIYKGNELIVPDQNQVFAIKDKMRELVEKDLPIEKRTFYKDEAREILMKEGLVKTVNLFKYRKKRTVKLYHCDGFWAYFYGYLPPSTGRIDVFDVQPYNQGLVLVHPDPKTRELPVIHMPKLSQVFLEYARWLNVLELEYVSDLNDIIARGERHVADLMLLSEALHEKKISDIADEIAKDKRKRLILIAGPSSSGKTTFAKRLSLQLRVNGLKPVAISLDDYFVDREKTPRDENGNYDFDSIEALDIELFNRNLQDLLAGKEVVLPKFNFKTGKRMRGPTLKLEKDNIIIVEGIHGLNERLTASIPKEQKFKIYVSALTQLNIDDHNRVTTTDTRLIRRIVRDYKFRGHTAYDTLKMWPNVRKGEERNIFPFQEEADVMFNSALVYEIPVLRIFAEPLLVQVPEDVPEYSEALRLLKLLDFFLPITNIEDIPDKSILREFIGRSIFKY

SEQ ID NO: 3705 - DNA, 2056 bp, Arabidopsis thaliana (mouse-ear cress)
  CDS (1)..(2025)
atgggtcaagacagcaatggaattgagtttcatcagaagagacatggtctcttgaaggatcaagtccaattggttaagagaagagactctattcggtatgaaattgtttctattcaagatcggttgtcatttgagaagggcttctttgcggttatccgtgcttgccaattgctttctcagaagaatgatgggatcatattggttggtgttgctggaccttctggtgctggaaagactgtattcactgagaagatactcaattttctgccaagtgttgctgtcatttcaatggacaattataatgattctagtcggattgttgatgggaactttgatgatccacggttaacggactatgacacattgctcaagaatcttgaagacttaaaggaaggaaagcaggttgaggttcctatttatgattttaagtccagctctcgtgttggatacaggacccttgatgtcccaccttctcggattgtgattattgaaggaatctatgctttgagtgaaaaactgcgacctttattggatcttcgtgtgtctgttactggtggagttcattttgaccttgttaaacgggttctccgtgatatacaacgtgcaggtcaacagccagaggagattatccatcagatatctgaaacagtatacccgatgtacaaagctttcattgagccagatctccagactgctcaaatcaaaatcattaataaattcaaccccttcactggttttcagagcccgacttacatcttgaagtcaagaaaggaggtatctgttgatcagatcaaggcggtcctttctgatggacatacagagactaaggaggagacctatgatatatatcttcttcctccgggtgaagatccagagtcgtgccaatcatatttgaggatgcggaataaagatggaaagtacagccttatgtttgaggaatgggttacggatactccttttgtcatatccccaaggattacatttgaagtcagtgttcgcctacttggtgggctcatggcattgggatacacaatagcaactatacttaaaaggaacagccatgtatttgctactgataaggtgtttgtgaaaatcgattggcttgagcaactgaatcgtcactacatgcaggtgcaaggtaaagatcggcaacttgtacagagtactgcagagcagctaggattggaaggatcgttcattccacgcacctatattgaacagatccaactcgaaaaactaataaatgaagtaatggccctaccagatgatctaaagaacaagcttagcttagatgaggatttggtgtctagttcaagccctaaggaagcactcttacgagcgtctgcagatagagtagccatgagaaataagaacctcaaaagaggcatgtcacactcatattcaacccaaagagataagaatctgtccaagcttgctggttattcttcaagcgataggaggtacgaagaaagaaatcacgactcgccagcgaacgaggggtttatgactctgctttcagaacaaatatcatctctcaacgagagaatggatgagttcacaagtcgaattgaagagctcaattcaaagttgagctgcaataaaaactctccaacacagcagagcttgtcaatccaaaccgaagtctgcaatgggtcagctcctacttcgtatttcatttctggtctggacaatggctgcttgacaaattccataatgccccattcatcatcctcctcccaactagccaaggattcacccttaatggaagagatatcgaccatatcacgaggacagcgtcaagttatgcatcagttggataatttgtgcaatctgatgagggaaagctcagcagaaaggtcacgcctagcaagaacagggagcagcaatagcggtaacagaggcagatcaagcaaaagctccttcttgtccaatgtggaatctaacaagctccctcttgtgttaaccgtggctatttgcagcataggtattatagtgatcaagagctacattaacaagcggcaataacatctattagccactatgggttttctcttct

SEQ ID NO: 3706 - protein, 674 aa, Arabidopsis thaliana (mouse-ear cress)
MGQDSNGIEFHQKRHGLLKDQVQLVKRRDSIRYEIVSIQDRLSFEKGFFAVIRACQLLSQKNDGIILVGVAGPSGAGKTVFTEKILNFLPSVAVISMDNYNDSSRIVDGNFDDPRLTDYDTLLKNLEDLKEGKQVEVPIYDFKSSSRVGYRTLDVPPSRIVIIEGIYALSEKLRPLLDLRVSVTGGVHFDLVKRVLRDIQRAGQQPEEIIHQISETVYPMYKAFIEPDLQTAQIKIINKFNPFTGFQSPTYILKSRKEVSVDQIKAVLSDGHTETKEETYDIYLLPPGEDPESCQSYLRMRNKDGKYSLMFEEWVTDTPFVISPRITFEVSVRLLGGLMALGYTIATILKRNSHVFATDKVFVKIDWLEQLNRHYMQVQGKDRQLVQSTAEQLGLEGSFIPRTYIEQIQLEKLINEVMALPDDLKNKLSLDEDLVSSSSPKEALLRASADRVAMRNKNLKRGMSHSYSTQRDKNLSKLAGYSSSDRRYEERNHDSPANEGFMTLLSEQISSLNERMDEFTSRIEELNSKLSCNKNSPTQQSLSIQTEVCNGSAPTSYFISGLDNGCLTNSIMPHSSSSSQLAKDSPLMEEISTISRGQRQVMHQLDNLCNLMRESSAERSRLARTGSSNSGNRGRSSKSSFLSNVESNKLPLVLTVAICSIGIIVIKSYINKRQ

SEQ ID NO: 3707 - DNA, 624 bp, Staphylococcus aureus
  CDS (1)..(624)
atgaaagctactacaatcattggcatagctggtggatctggctcaggaaaaacaactgtaactaacgaaattatgaaaaacttagaaggtcatagtgtcgctttacttgctcaagattactattataaagatcaaaagcacttgactttcgacgagcgcctagaaaccaattatgaccatccatttgcattcgataatgatttattaattgaaaatcttaaagacttgaaaaatggtaaagcagtagaagtaccgacatatgattatgctagtcatacaagaagtgacattaccattgattttaaacctaaagatgttattatcgtagaaggtattttcgctttagaaaataaggtattacgtgatatgatggatgttaaaatatatgttgatacagatgcagacttgagaatattacgccgtttaacacgagatactaaagagcgtgggcgttcaatggactctgttatcaatcaatatttaagtgttgttagacctatgcatgaccaatttattgaaccgactaagaaatatgctgatataattattcctgaaggtgggagcaataaagttgcaatagatattatgacaacaaaaattcagtctttagttagcaagcaatag

SEQ ID NO: 3708 - protein, 207 aa, Staphylococcus aureus
MKATTIIGIAGGSGSGKTTVTNEIMKNLEGHSVALLAQDYYYKDQKHLTFDERLETNYDHPFAFDNDLLIENLKDLKNGKAVEVPTYDYASHTRSDITIDFKPKDVIIVEGIFALENKVLRDMMDVKIYVDTDADLRILRRLTRDTKERGRSMDSVINQYLSVVRPMHDQFIEPTKKYADIIIPEGGSNKVAIDIMTTKIQSLVSKQ

SEQ ID NO: 3709 - DNA, 639 bp, Streptococcus pneumoniae
  CDS (1)..(639)
atgcaaaatagaccaatcattattggagtgacaggtggttctggtggtggtaaaaccagtgtttcaagagccattttatcgcattttcctgatgaaaagatttccatgattgagcatgattcatactacaaggatcagtctcatttgacctttgaagagcgtgtcaaaaccaactatgaccatccttttgcctttgatacagacttgatgatcgagcagattaaggaattgttggcagggcgtccggtggacatcccgacctacgactatacagagcatacacggagtagcaagacctatcgtcaggaacctcaagatgtctttatcgttgagggtattttggtcttggaggacaagcgtctgcgcgatttgatggatatcaagatttttgtggatacggatgacgatgtgcgcattattcgtcgtatcaagcgtgatatggaggagcgtggccgtagccttgatagcgttattaaccagtacttaggtgtggtcaaaccaatgtaccaccagtttatcgagtcaactaagcgttatgctgatatcgtcattcctgaaggggttagcaataccgtggctatcgacctgttgacgaccaagattgcaaagattttggaagaagctcgaaacagcaaataa

SEQ ID NO: 3710 - protein, 212 aa, Streptococcus pneumoniae
MQNRPIIIGVTGGSGGGKTSVSRAILSHFPDEKISMIEHDSYYKDQSHLTFEERVKTNYDHPFAFDTDLMIEQIKELLAGRPVDIPTYDYTEHTRSSKTYRQEPQDVFIVEGILVLEDKRLRDLMDIKIFVDTDDDVRIIRRIKRDMEERGRSLDSVINQYLGVVKPMYHQFIESTKRYADIVIPEGVSNTVAIDLLTTKIAKILEEARNSK

SEQ ID NO: 3711 - DNA, 642 bp, Mycoplasma genitalium
  CDS (1)..(642): transl_table=4
atggatgaaaaagggattttagttgcaattagtggtggtagttgctcaggaaaaactactgttgctgaaatgatttatcaacttttaagtaaaaaattaaaagttgcgatcatctgtcaagataactattacaagtcctataaaaataagccattattaaaaagaaaaacaataaactttgatcatcctgatgcttttgattgaaaacttttaagatcacacattgaagatcttctaaacggtagtatagttaatgttcctttatatgactacattaactataccagagctaaaaaaacagcaaaaattggtccaattgatgttgttattctagagggtttaatgccatgatttgatgaaaaattatcaagactttctaagctaaaaatatttatagaaacaaatggggaagaacgtttaattagaagaatagaaagagactgacaaaggggaagaaatattgattctattattaaacagtgacgcgaaatagtagcaccaatgtatgaaatatttgtagaaaaaatgaagcgaaatgctgatttaattctgccttgaagtcaacgcagagaagtaagtacaagtgtattggatgtcgcaattgaacacttatttcacaaaactgttgaaaaaaataattag

SEQ ID NO: 3712 - protein, 213 aa, Mycoplasma genitalium
MDEKGILVAISGGSCSGKTTVAEMIYQLLSKKLKVAIICQDNYYKSYKNKPLLKRKTINFDHPDAFDWKLLRSHIEDLLNGSIVNVPLYDYINYTRAKKTAKIGPIDVVILEGLMPWFDEKLSRLSKLKIFIETNGEERLIRRIERDWQRGRNIDSIIKQWREIVAPMYEIFVEKMKRNADLILPWSQRREVSTSVLDVAIEHLFHKTVEKNN

SEQ ID NO: 3713 - DNA, 636 bp, Bacillus halodurans
  CDS (1)..(636)
atggggaaaagaccaatcatcatcggcgtagccggagggactggctctggaaaaacaaccgtagcgaaggaaatattttatcaatttaatgaaaaatcgatcgtattaattgagcaagatgcatattataaagatcaatcacagttaagcttagaagaacgcttgcagacgaactatgaccatcctcttgcatttgacaatgatttgttaattgaacatctgcatagcttattaaacggtcaagcgattgaaaagccagtatatgactacaagctgcatacacgttcaaatgaagtgatcctagtggaaccgaaagacgtgatcattcttgaggggatcttactacttgaagatgaacggttacgcgagctaatggacattaaactgtttgttgatacagatgcagatatccgcatcattcgccgaatggtgcgcgatattcgtgagcgtgggcgaacgttggaatcggtcatcgaacagtatacaaaggtcgtccggccaatgcatatgcaatttatcgaaccgacaaagcgttatgcagatgtaatcatccctgaagggggacaaaatcgggtagccattgatttaatggtgacaaaaattcgcgcaattattgaagaaaaagccgttttataa

SEQ ID NO: 3714 - protein, 211 aa, Bacillus halodurans
MGKRPIIIGVAGGTGSGKTTVAKEIFYQFNEKSIVLIEQDAYYKDQSQLSLEERLQTNYDHPLAFDNDLLIEHLHSLLNGQAIEKPVYDYKLHTRSNEVILVEPKDVIILEGILLLEDERLRELMDIKLFVDTDADIRIIRRMVRDIRERGRTLESVIEQYTKVVRPMHMQFIEPTKRYADVIIPEGGQNRVAIDLMVTKIRAIIEEKAVL

SEQ ID NO: 3715 - DNA, 1668 bp, Treponema pallidum subsp. pallidum (syphilis spirochete)
  CDS (1)..(1668)
atgggagattggatgggcacgtttgtggtgtcactgcctggtgggcgccgagaaaagttttccgagtgcgttccagcgcgcgtcctctttgagcgattttttggcacagaatcgtctgtgtatggtttgatgtgtaacggtacaccggtactgccatgccaggtgataggcgccgacgcggtagttgagccggttcgtgaggatacggtgttaggggccgctctgtaccgtaggactgcgcgtttgctgtttgccacagcgtttcactcggtgtatccgcatgtgcgattgtttgcagggtatcgagtgcaggggggatattgctaccgtaccgagggtgcgtgcgcagatgacctggatgtttcgttggtagtgcgtaggatgaaggcgcttgtggcgcaggatgcgcccattcacatgcagtatatgacgcgtcgggaagccttgaatctgtttacgcagtggaattttccatattcacatcattatattctgggttcgtaccggactgtgtttttaacgcaggtactggacggtttttctgcgttgttttttcagccgctcatggcttctgtagggaggctcaccgtctttgaggtgcggatgtgtgctgagggttgtctgttgcgtttccctgaaggtggacaacgccacatcatttctcagcacaacgcgtcgccacagtttgtggtaatgtatcggaggcatcggcagcaagaagaacagacaaaaatatgctcagtaggacagttgaatgcgtgcattcagtctggtgatgttgcaacttgtgttgacatggctgaggcggcgcacaatcggcagattgagtgttgtgccacagaaattgcacgaagggacagcgtgcgcgtggtgtcgatagcaggaccgtcaggttctggaaagacaacgattgcaaaaaaactttcagtgcagctgcaagtacttggttacgatccgcatgtgattagtcttgatgattactatgtggggattgagcgcacgccgtgtgacgcggaaggtaatcctgattttgagtgcgtcgaagccttagatcttcccctgattaataagttgtttttggatctcttgcaggggaagcgtgttgcacttccttcgtataattttaaaacagggaaacgagagtaccgggggcgggaagtacagtttggtgagcgttcgctgcttattattgagggcatacatggcttgaacgatcggctcatctcgttgatgaaccggcgagttgtatttcggttgtacgtctctgtgttcatgcatttgtgcttggatgaacagcacagggtttcggcgtctgatggaaggttgttgcggagggttgtgcgcgacgcgcagtttcgcggtatttctgtcgaaaaaacacttgaaatgtggcaacgggtgcgtgcaggtgaagagcgctatattttcccttttcagcaccgtgcagacatgatgtttaacagtgcattggtttatgagtttgcagtgttaaagcgccgtgcacaggaagttttaagcacggtttcttctgcttgtaccacgtatagggaagtccgcaatttgcgtgccttgttggagcagttttgttcgttgtctgatgtgcatgttccgggtcagtcgatattaagagaatttattgggcaaagcgatttttgctattgtctgtag

SEQ ID NO: 3716 - protein, 555 aa, Treponema pallidum subsp. pallidum (syphilis spirochete)
MGDWMGTFVVSLPGGRREKFSECVPARVLFERFFGTESSVYGLMCNGTPVLPCQVIGADAVVEPVREDTVLGAALYRRTARLLFATAFHSVYPHVRLFAGYRVQGGYCYRTEGACADDLDVSLVVRRMKALVAQDAPIHMQYMTRREALNLFTQWNFPYSHHYILGSYRTVFLTQVLDGFSALFFQPLMASVGRLTVFEVRMCAEGCLLRFPEGGQRHIISQHNASPQFVVMYRRHRQQEEQTKICSVGQLNACIQSGDVATCVDMAEAAHNRQIECCATEIARRDSVRVVSIAGPSGSGKTTIAKKLSVQLQVLGYDPHVISLDDYYVGIERTPCDAEGNPDFECVEALDLPLINKLFLDLLQGKRVALPSYNFKTGKREYRGREVQFGERSLLIIEGIHGLNDRLISLMNRRVVFRLYVSVFMHLCLDEQHRVSASDGRLLRRVVRDAQFRGISVEKTLEMWQRVRAGEERYIFPFQHRADMMFNSALVYEFAVLKRRAQEVLSTVSSACTTYREVRNLRALLEQFCSLSDVHVPGQSILREFIGQSDFCYCL

SEQ ID NO: 3717 - DNA, 669 bp, Chlamydophila pneumoniae, Chlamydia pneumoniae
  CDS (1)..(669)
atgttgatgatgcttatgatgattattggaattacaggaggttctggagctgggaaaaccaccctaacccaaaacattaaagaaattttcggtgaggatgtgagtgttatctgccaagataattattacaaagatagatctcattatactcctgaagaacgtgccaatttaatttgggatcatccggacgcctttgataatgacttattaatttcagacataaaacgtctaaaaaataatgagattgtccaagccccagtttttgattttgttttaggtaatcgatctaaaacggagatagaaacgatctatccatctaaagttattcttgttgaaggtattctggtctttgaaaatcaagaacttagagatcttatggatattaggatctttgtagacaccgatgctgatgaaaggatactacgccgtatggttcgagatgttcaagaacaaggagatagcgtggactgcatcatgtctcgttatctttctatggtaaagcctatgcatgagaaatttatagagccgactcggaaatatgctgatatcattgtacatggaaattaccgacaaaacgtagtaacaaatattttgtcacagaaaattaaaaatcatttagagaatgccctggaaagcgatgagacgtattatatggtcaactctaagtaa

SEQ ID NO: 3718 - protein, 222 aa, Chlamydophila pneumoniae, Chlamydia pneumoniae
MLMMLMMIIGITGGSGAGKTTLTQNIKEIFGEDVSVICQDNYYKDRSHYTPEERANLIWDHPDAFDNDLLISDIKRLKNNEIVQAPVFDFVLGNRSKTEIETIYPSKVILVEGILVFENQELRDLMDIRIFVDTDADERILRRMVRDVQEQGDSVDCIMSRYLSMVKPMHEKFIEPTRKYADIIVHGNYRQNVVTNILSQKIKNHLENALESDETYYMVNSK

SEQ ID NO: 3719 - DNA, 621 bp, Lactococcus lactis subsp. lactis
  CDS (1)..(621)
atgaagaaaacgttgattattggtgtcactggtgggtcagcaagtggaaagacaagtgtttcacatgctattttagaaactttttcaaatgaacgaattgcaatgattgaacatgatagttactataaagatcaatcgcatttgacttttgaagaacggacaaaaacgaactacgaccatccattagcctttgatacagattatttaattgctcaattaaaagagcttcagtatggacgagcggttgatattccgatttatgattatgcaaaacatacgcgttcacaagaaacttaccgtcaagaacctgttgatgttttaatcgttgagggaattttggttttagaagatgaacgtttgcgtgatttaatggatatcaaaatatttgttgatacagatgacgatgtgcggattatccgtcgaattcgcagagatattgaagaaagaggaagaactcttgattcagtaattacacagtatttagatgctgttaagccaatgtatcatcaatttattgaaccaacaaagagatatgcagatgtgattattcctgaaggggtctcaaatactgttggggttgatattattacgacgaaaatcgctagcattttaaacgactaa

SEQ ID NO: 3720 - protein, 206 aa, Lactococcus lactis subsp. lactis
MKKTLIIGVTGGSASGKTSVSHAILETFSNERIAMIEHDSYYKDQSHLTFEERTKTNYDHPLAFDTDYLIAQLKELQYGRAVDIPIYDYAKHTRSQETYRQEPVDVLIVEGILVLEDERLRDLMDIKIFVDTDDDVRIIRRIRRDIEERGRTLDSVITQYLDAVKPMYHQFIEPTKRYADVIIPEGVSNTVGVDIITTKIASILND

SEQ ID NO: 3721 - DNA, 633 bp, Deinococcus radiodurans
  CDS (1)..(633)
atgagcggtcccggaacacccttcgtcatcggcgtggcgggcggctcggggtcgggcaagactaccgtgacccgccgggtcatcgagacggtgggccgcgagggggtggcggtcctcaatcaggacaactactaccgcgaccagtccgacatccccttcgagtcgcggctgcacaccaactacgaccaccccgccgctttcgactgggcgctgctgcgcgagcagctcgacgcgctgctggccggggtgccgatcgagatgcccgagtacgacttcacccagcacacccgcgccgcccacaccacccgcgtgctgccgggacgcgtggtggtgctcgaaggcttttttgccctctacgacgaggaactgcgctcgcgcatgggcctcaaggtcttcgtggacgccgacgccgacgtgcgcttcatccgtcgcctgctgcgcgatacccaggagcgcggacgcacgcccgaaagcgtcatcgagcagtacctcggcttcgtgcgccccatgcacctgagcttcgtggagccgaccaagcgctacgccgacgtgattattccccacggcggcatgaacgaaccggcgctcgacatgctcgccgcccgcattcgggtgatggctcagcgggattag

SEQ ID NO: 3722 - protein, 210 aa, Deinococcus radiodurans
MSGPGTPFVIGVAGGSGSGKTTVTRRVIETVGREGVAVLNQDNYYRDQSDIPFESRLHTNYDHPAAFDWALLREQLDALLAGVPIEMPEYDFTQHTRAAHTTRVLPGRVVVLEGFFALYDEELRSRMGLKVFVDADADVRFIRRLLRDTQERGRTPESVIEQYLGFVRPMHLSFVEPTKRYADVIIPHGGMNEPALDMLAARIRVMAQRD

SEQ ID NO: 3723 - DNA, 1932 bp, Arabidopsis thaliana (mouse-ear cress)
  CDS (1)..(1932)
atggcgctcgatagttctgttgctctgtcacctcgccggcggcatggcttgttgcgagatcaggttcagcttataaaaagaaaggactctggaagatatgagatagttccaatagaggatccattgtcttttgaaaaaggtttctacgctgttattcgtgcttgtcaattattggctcagaagaacgatgggctcattttggttgggttagctggtccttctggagctggcaaaaccattttcactgagaagattctcaattttatgcctagtattgctatcattaacatggacaactataatgatggtactcgtgttatcgatggaaactttgatgatccaaggttgactgactatgatacacttcttgacaatatacatggtctaagggatggaaaacctgttcaggttccaatatatgacttcaagtcgagttctcgaataggttacagaacgcttgaggtgcctagctctcgcattgttattctagaaggcatatatgctttgagtgagaagctacggcctttgctagatcttcgtgtctctgtcactggtggagtgcattttgatcttgttaagcgtgttttgcgggacattcaacgtgctggccaggaacctgaagaaataatccatcagatatctgagacggtttatcctatgtacaaggcgtttattgaacctgatctgaagacagctcagattaagatccttaataagttcaacccattcagtggctttcagaacccaacatatattttaaagtcatcaaaggctgtaacacccgaacaaatgaaggcagctctatctgaagatttcaaggaacgtacagaggaaacttatgacatctatctgttaccaccaggcgaggatcctgaagcatgccaatcatacctcagaatgaggaaccgagatggaaaatacaatctcatgtttgaggagtgggttacagatcgtccatttattatatcacccagaataacttttgaagttagtgttcgtcttcttggaggattaatggcactgggttataccattgcaacaatcctgaaaagaaagagtcatatctttgatgatgacaaggtaattgtgaaaactgattggttggaacaactgaatcggacatatgtacaggtacaaggtaaagaccgtacctttgtcaaaaatgtggcagaccaacttggactggaaggttcatatgttccacatacatatattgaacagatacagctggagaggcttgtgaatgatgttttggctttgccagatgacttaaaaacaaaacttagcttagatgatgatacagtttctagccctaaagaagccctctcaagagcttctgttgatagtagaatgaaatatcttcacggcggcgtatcaaagtcttacacaaacccaagacacaaagtcttgcctaacttgacaagacttgctgttaacaatagaatgttagatgccagagcccctgcttcaccggccactcttccaaatcagggttttatcactcaactttcagaccaaatatcaacactgaacgagaggatggatgaattcacatcccgcattgaagagttgaattccaagatcccgaacaggatagctccttcaggtagtcaacataacttggctttaccaatcgaaaacggtaatgggtctgtcttatcattctccgcatccgcatctcagctcgtaagggaatctcctctgatggaagaggtcgtactggttgctcgtggacagcgtcagataatgcatcaaatggacacactgagtaatcttcttcgggagtatgttggagaaaagactcgcatagagagactcgacagcagcagaacaaacagtacaacacaaaacctcgaatcctctactgtaccgattcttcttggtttggccattggctgtgtgggcatctttgcctacagtcgtctgaaatag

SEQ ID NO: 3724 - protein, 643 aa, Arabidopsis thaliana (mouse-ear cress)
MALDSSVALSPRRRHGLLRDQVQLIKRKDSGRYEIVPIEDPLSFEKGFYAVIRACQLLAQKNDGLILVGLAGPSGAGKTIFTEKILNFMPSIAIINMDNYNDGTRVIDGNFDDPRLTDYDTLLDNIHGLRDGKPVQVPIYDFKSSSRIGYRTLEVPSSRIVILEGIYALSEKLRPLLDLRVSVTGGVHFDLVKRVLRDIQRAGQEPEEIIHQISETVYPMYKAFIEPDLKTAQIKILNKFNPFSGFQNPTYILKSSKAVTPEQMKAALSEDFKERTEETYDIYLLPPGEDPEACQSYLRMRNRDGKYNLMFEEWVTDRPFIISPRITFEVSVRLLGGLMALGYTIATILKRKSHIFDDDKVIVKTDWLEQLNRTYVQVQGKDRTFVKNVADQLGLEGSYVPHTYIEQIQLERLVNDVLALPDDLKTKLSLDDDTVSSPKEALSRASVDSRMKYLHGGVSKSYTNPRHKVLPNLTRLAVNNRMLDARAPASPATLPNQGFITQLSDQISTLNERMDEFTSRIEELNSKIPNRIAPSGSQHNLALPIENGNGSVLSFSASASQLVRESPLMEEVVLVARGQRQIMHQMDTLSNLLREYVGEKTRIERLDSSRTNSTTQNLESSTVPILLGLAIGCVGIFAYSRLK

SEQ ID NO: 3725 - DNA, 636 bp, Bacillus subtilis
  CDS (1)..(636)
atgggtaagaatccagtagtcattggaatcgcaggaggttccggttcaggaaaaacgagtgtcacacggtccatttatgaacagtttaaaggacactcaattttaatgatccagcaggacctttattataaagaccaaagccatcttccgtttgaagaaaggctgaacacaaactatgatcatccgcttgcgtttgataatgactatttaatcgagcatattcaagatctattgaattaccgcccgattgaaaagccgatttatgactataagcttcacacacgttcagaagaaacggttcacgtagagccaaaggatgttattatccttgaaggcattcttgttcttgaagacaaaaggcttcgtgatctgatggatatcaagctttatgttgatacggacgctgacttgcgtatcatcagacggattatgagagatattaatgagcgcggacgctctattgattctgtcattgaacaatatgtgtcagtggtccgtccgatgcataaccaattcgtcgagccgacgaaacgatacgctgatattattatcccggaaggcggtcagaatcacgtcgcaattgatctgatggtcacaaaaattcaaaccattcttgaacaaaacgcgattttgtaa

SEQ ID NO: 3726 - protein, 211 aa, Bacillus subtilis
MGKNPVVIGIAGGSGSGKTSVTRSIYEQFKGHSILMIQQDLYYKDQSHLPFEERLNTNYDHPLAFDNDYLIEHIQDLLNYRPIEKPIYDYKLHTRSEETVHVEPKDVIILEGILVLEDKRLRDLMDIKLYVDTDADLRIIRRIMRDINERGRSIDSVIEQYVSVVRPMHNQFVEPTKRYADIIIPEGGQNHVAIDLMVTKIQTILEQNAIL

SEQ ID NO: 3727 - DNA, 624 bp, Borrelia burgdorferi (Lyme disease spirochete)
  CDS (1)..(624)
atgatggctaagattattgggatatctggtggttctggaagcggaaaaactacagttgtaagcaagattagtgagtttattccagaatttgtccttatttctcaagataattactataagagtgtaggcgattatgaacatgaattttctaaggtaaattttgatcatccggatgcttttgataataatttgttttatgaacatttaaaaaatttaaaaaaaaatagtccaatagatatgcctctttacgattttattaatcataaaagacaacttaaaacggttttggttgttccaactcctgttgttattgttgagggtattatgatttttgttgaagagagagtaagaaatttaatagatcttaaaatatatattgacaccccaaatgatattagatttattaggcgtttaagaagagatatttccaaaagaggacgtactgtagaatcggtgattgatcagtatttaaataccactagatggggttattatagatttattgagcctaccaaagaatatgctgatcttattattcccgagggaggtcataatgataaagcgctttatgtgctttcaacgtttcttaagtctttaagtaaggaagggttagattttacctaa

SEQ ID NO: 3728 - protein, 207 aa, Borrelia burgdorferi (Lyme disease spirochete)
MMAKIIGISGGSGSGKTTVVSKISEFIPEFVLISQDNYYKSVGDYEHEFSKVNFDHPDAFDNNLFYEHLKNLKKNSPIDMPLYDFINHKRQLKTVLVVPTPVVIVEGIMIFVEERVRNLIDLKIYIDTPNDIRFIRRLRRDISKRGRTVESVIDQYLNTTRWGYYRFIEPTKEYADLIIPEGGHNDKALYVLSTFLKSLSKEGLDFT

SEQ ID NO: 3729 - DNA, 624 bp, Ureaplasma urealyticum
  CDS (1)..(624): transl_table=4
atgaatactaaatccccaattcttatactaattgcaggagcttctggttctggaaaaacaacctttgctaatgaaattattgcaagaattcctaaaaatacaacaagtgttgttatttgtcaagattcttactatatttctaattcacaactaaataaaaaagaacgccgcttaattaattatgatcatccaagtagttttgaatgagagttaatgcgagagcaattaagtgacattaaaaaacgtaaaaaaattaaagtaccaatctatgattataaaactgagattcgtttagataaaacgattgatattagtgatgttgatgttatagttcttgaaggtatttatgcaatttatgatgatgtcattaatcaaatagctgatttgaaaatttttattgaaactccaaaagatgaatgtttaattcgacgaattcttcgagatgttaatgaacgtaatcgatcatttgaatctgtaattactcaatgacgtagcactgttagccctatgtatgatcaatttgttgaaccaagtaagaagaatgctaatgttagtgtgctatgaaatgaacacaatcgtgttgcattacatttaattcataaatgaataaataatatacattaa

SEQ ID NO: 3730 - protein, 207 aa, Ureaplasma urealyticum
MNTKSPILILIAGASGSGKTTFANEIIARIPKNTTSVVICQDSYYISNSQLNKKERRLINYDHPSSFEWELMREQLSDIKKRKKIKVPIYDYKTEIRLDKTIDISDVDVIVLEGIYAIYDDVINQIADLKIFIETPKDECLIRRILRDVNERNRSFESVITQWRSTVSPMYDQFVEPSKKNANVSVLWNEHNRVALHLIHKWINNIH

SEQ ID NO: 3731 - DNA, 642 bp, Haemophilus influenzae
  CDS (1)..(642)
atgtcaaatccctcttgtatcatcatcgccatcacaggtgcatctgcatcaggcaaaagttctatcgcttccactgttcacaaagagctctgtaatgaactaggctgccaagaaattggtatcattactgaagacagttactataaagatcaaagtcatttagaaatgactgagcgggtaaaaacgaattacgatcatccaaactctatggatcgcgatttacttatccaacatttaaaaaatctaaaaaatggcagtgcagtagatgtgcctgtttatagctatgtagaacatactcgcaccaacgaaacaacgcatttcacaccaaaacgaatcgtaattttagaagggattttattacttaccgatgaacgagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccgtctaaacaatatgcggatattgtcattcctcgtggtggtaaaaatcgcattgcgatcaatatgttaaaagctcaaatccttcatttattgaatcaaaaatag

SEQ ID NO: 3732 - protein, 213 aa, Haemophilus influenzae
MSNPSCIIIAITGASASGKSSIASTVHKELCNELGCQEIGIITEDSYYKDQSHLEMTERVKTNYDHPNSMDRDLLIQHLKNLKNGSAVDVPVYSYVEHTRTNETTHFTPKRIVILEGILLLTDERVRQLADISVFVDTPLDICFIRRLQRDMEERGRSLQSVIDQYRATVRPMFLQFIEPSKQYADIVIPRGGKNRIAINMLKAQILHLLNQK

SEQ ID NO: 3733 - DNA, 1470 bp, Spinacia oleracea (spinach)
  CDS (49)..(1257)
tttttttttttttaagagagagaaaatagtaaaaaaaaaacagaaaaaatggcagtgtgtacagtatacacaatcccaacaacaacccatttaggatcatcattcaaccaaaacaacaaacaagtttttttcaactacaaaagatcatcatcatcaaacaacactttatttacaacaagaccatcctatgtaataacatgttcacaacaacaaacaattgtgattggtttagcagcagattcaggttgtggtaagagtacattcatgaggaggttaacaagtgttttcggtggcgcggccgagccaccaaagggtggtaacccagattcaaacacattgattagtgacactactactgttatctgtttggatgattttcattcccttgatagaaatggcaggaaagtggaaaaagttactgctttagacccaaaagctaatgattttgatcttatgtatgaacaagttaaggctttgaaagaaggtaaagctgttgataaacctatttataatcatgtttctggtttgttggaccctcctgagcttattcaacctcctaagatcttggtcattgaagggttacaccccatgtatgacgcacgtgtgagggaattgctagacttcagcatctacttggacattagcaatgaagttaaatttgcctggaaaattcagagagacatgaaagaaagaggacacagtcttgaaagcatcaaagccagtattgaatccagaaagccagattttgatgcttacattgacccacaaaagcagcatgctgatgtagtgattgaagtattgccaactgaactcattcctgatgatgatgaaggcaaagtgttgagagtaaggatgattcagaaagaaggagtcaagtttttcaacccagtttacttgtttgatgaaggatctaccatttcatggattccatgtggtagaaaattaacatgttcttaccctggtatcaaattttcctatggcccagacaccttctatggcaacgaggtgacagtagtagagatggatgggatgtttgacagattagacgaactaatctacgtcgaaagccatttgagcaatctatcaaccaagttttatggtgaagtcactcaacaaatgttgaagcaccaaaatttcccaggaagcaacaatggaactggtttcttccaaaccataattggattgaagatcagagacttgttcgagcagctcgttgctagcaggtctacagcaactgcaacagctgctaaagcctagaaaaagctcgaattttacaacatatgataagatatggaatatgtcaatctaaattaaatctacttcatttgtaatttccactacctatattattattcttcttgtataagtttgtttttgtaggctactctgatattttctgctgttaatagacatgcaagagatggaaaatgcagttcaaaagatattcatagcatcaaaaaaaaaaaaaaa

SEQ ID NO: 3734 - protein, 402 aa, Spinacia oleracea (spinach)
MAVCTVYTIPTTTHLGSSFNQNNKQVFFNYKRSSSSNNTLFTTRPSYVITCSQQQTIVIGLAADSGCGKSTFMRRLTSVFGGAAEPPKGGNPDSNTLISDTTTVICLDDFHSLDRNGRKVEKVTALDPKANDFDLMYEQVKALKEGKAVDKPIYNHVSGLLDPPELIQPPKILVIEGLHPMYDARVRELLDFSIYLDISNEVKFAWKIQRDMKERGHSLESIKASIESRKPDFDAYIDPQKQHADVVIEVLPTELIPDDDEGKVLRVRMIQKEGVKFFNPVYLFDEGSTISWIPCGRKLTCSYPGIKFSYGPDTFYGNEVTVVEMDGMFDRLDELIYVESHLSNLSTKFYGEVTQQMLKHQNFPGSNNGTGFFQTIIGLKIRDLFEQLVASRSTATATAAKA

SEQ ID NO: 3735 - DNA, 1533 bp, Triticum sp. (wheat)
  CDS (65)..(1279)
ggcaagtctcagttacaagacttgaaggggagaagagcagctcccaagaggttgggcagcaaacatggcattctgcagcccacacaccaccacatccctgcgctccccatgcaccaccatcccaaactcaggcttcaggcagaaccaagtcatcttcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcaccagcgtgtttggaggtgccgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgagttaaattgatcatgaaagaaggcattaagttcttcaacccggtttacctcttcgatgaaggatcaaccatcaactggatcccttgtggaagaaagcttacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccattgtaggactgaagattagagatctctatgaacagatcatcgctgagagggccggcgttcctgctgaagcagcaaaagtttgatgagccccaaattcaagttcacgaatcatttcatcaccaactcaatgagaatgagcatcctcgcatttcttgtacctagtttgaatatattacagctagaagacggtagaaagttcactgcagaactcatgaaaacctgcattttgaacttctcgaaaatcctctccatgatgagggtctcttatgtctcttcttaacaaatttcgatgtacatcttctcccatgtttcaatgcagaaaatacatgtgcttgca

SEQ ID NO: 3736 - protein, 404 aa, Triticum sp. (wheat)
MAFCSPHTTTSLRSPCTTIPNSGFRQNQVIFFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 3737 - DNA, 1240 bp, Arabidopsis thaliana (mouse-ear cress)
  CDS (1)..(1188)
atggctgtctcaactatctactcaacacaagctctcaattcaactcatttcttaacctcttcttcctcctccaaacaagtcttcctctaccgtcgtcaaccacaaaccaaccgtagattcaacacactcatcacttgcgcacaagaaaccatcgtgatcggactagctgctgactctggctgcggcaaaagtacctttatgcggaggctcaccagcgtctttggtggcgctgctaagccaccaaaaggcgggaaccctgattccaacacactcatcagcgacacgaccactgtgatctgtcttgatgattaccattctttggataggtacggtaggaaagagcagaaagtcaccgctttggacccacgcgccaatgactttgatctcatgtatgagcaagtcaaagctcttaagaatggtatagccgtcgagaaaccgatttataaccatgtcactggacttcttgaccctccggagcttattcagcctcctaagattcttgtcatcgaaggtcttcacccaatgtttgatgagcgagtaagagacttactagacttcagtatctacttggacattagcaacgaagtcaaattcgcttggaaaattcagagggacatggctgaaagaggtcacagtttggagagcatcaaagcgagtatcgaagcccgaaagcccgacttcgatgcattcatcgacccgcaaaagcagtacgcggatgcggtcatagaagtgcttcctacgactctgatcccagatgacaacgaagggaaagtgttgagagtgagattgataatgaaggaaggtgttaagtacttcagcccggtttacctgttcgatgaaggttcaaccatctcgtggattccttgcggccgcaaactcacttgctcgtaccctggcatcaagttcaactacgaacctgactcctacttcgaccatgaggtatcagttttggagatggatggacaatttgatagactggacgagctgatttacgtggaaagtcacttgagcaacctctcgaccaaattctacggagaagtcactcaacaaatgctcaaacatgctgatttcccgggtagcaacaacggtactggtcttttccaaaccattgttggattgaagatcagagatctctatgagcagctcattgccaacaaagccactgctcgtgcagaagctaaagcctaaaacaaacgaagcgaagccaaatagaacgcgtcgataaatacatccgcagttt

SEQ ID NO: 3738 - protein, 395 aa, Arabidopsis thaliana (mouse-ear cress)
MAVSTIYSTQALNSTHFLTSSSSSKQVFLYRRQPQTNRRFNTLITCAQETIVIGLAADSGCGKSTFMRRLTSVFGGAAKPPKGGNPDSNTLISDTTTVICLDDYHSLDRYGRKEQKVTALDPRANDFDLMYEQVKALKNGIAVEKPIYNHVTGLLDPPELIQPPKILVIEGLHPMFDERVRDLLDFSIYLDISNEVKFAWKIQRDMAERGHSLESIKASIEARKPDFDAFIDPQKQYADAVIEVLPTTLIPDDNEGKVLRVRLIMKEGVKYFSPVYLFDEGSTISWIPCGRKLTCSYPGIKFNYEPDSYFDHEVSVLEMDGQFDRLDELIYVESHLSNLSTKFYGEVTQQMLKHADFPGSNNGTGLFQTIVGLKIRDLYEQLIANKATARAEAKA

SEQ ID NO: 3739 - DNA, 2077 bp, Saccharomyces cerevisiae
  CDS (482)..(1987)
gtgttgctatacacgcttgttatctatatagatgccaattaaacatatagcagctatccgttattacttatacaattgattaatatcactttttaattgtccgggtaactaactgtcttccactttcagcacgttctcgtcatcaggttgtatgggctagtactgttttggctacatttgagatacgagcacttaaagaattcttgcatattttcgatgattagtctttaattttcccacttgttctcactatttcctctattgtcttaatacgctcacatatcgaagtttttttttcatgcgatgagcttcgagatgaaaaaaggaaactgaaaaatttagatcgataagataagagatgtgattttttttttttttcgtaaggctgtaggccttggataacgtcttatttactatttatatgcgacatcttcgataatttcatacgtttaatttcgaactcgcatttattttatttattatgtcccatcgtatagcaccttccaaagaacgatcttcatcatttatttcaattttagacgatgaaacaagagacacattgaaagctaatgcagtcatggatggtgaagtagatgtcaaaaaaacaaaaggaaaaagctctcggtatatcccaccatggacaactccatatataataggtataggtggtgcttcaggttcaggcaagacaagcgttgctgctaagattgtgtcgtcaattaatgttccctggacagtattaatatctttggataacttttacaatccattaggcccagaggacagagccagagcctttaaaaatgaatacgatttcgacgagccaaatgccatcaacttagatttggcatataagtgcattttgaacttaaaggagggcaaaaggacaaatatcccagtttatagcttcgtccaccacaatagagttcctgataaaaatatagtcatatacggggccagtgtggtagttatcgaagggatctacgccctttacgatcgccgattgctggatttgatggacttgaaaatttatgttgacgctgatttggatgtctgcttagcaagaagattgtcgagagatatagtttccagagggagagatttggatggttgtattcaacaatgggagaaatttgtgaaaccaaatgcggtaaagtttgtgaaaccaacaatgaagaatgcagatgctatcattccatcgatgagtgataatgctacagcggtaaatttaatcattaaccacatcaagtcaaaactggaactaaaatcaaatgaacacttaagagagctaatcaaattgggctcttctccttcacaagatgtgcttaatcgtaacataattcatgaattgccgcccaccaaccaagttctttcgctgcatactatgcttctaaataaaaatctaaattgcgcggactttgttttctactttgacaggttagcaacaattttgttatcatgggcacttgatgacattcctgtagcacatacgaacataattacacctggtgagcataccatggaaaacgttattgcctgtcaattcgatcaagttacagctgttaatattattcgatctggcgattgttttatgaagtctttgagaaagacgatccccaatatcacaattggtaaattgttgattcagtccgattcacaaactggggaacctcaactgcattgcgaatttttacccccaaatatagaaaagtttggcaaggttttcttaatggaaggtcaaatcataagtggtgcggccatgatcatggccatccaggtgcttttagatcatggtattgatttggaaaagattagcgtggtggtttatttggccactgaagttggtatccgacgtatattaaatgcatttgataacaaagtcaacatttttgctggtatgatcatctccagagaaaagttacaaaatcatcaatacaaatgggcattgaccagattttttgattcaaagtattttggttgtgattgagaataattagaggcaatataaagtaaaattaaataatagtgcacgtatacatactatattagtaacctttcattctctctatggataatc

SEQ ID NO: 3740 - protein, 501 aa, Saccharomyces cerevisiae
MSHRIAPSKERSSSFISILDDETRDTLKANAVMDGEVDVKKTKGKSSRYIPPWTTPYIIGIGGASGSGKTSVAAKIVSSINVPWTVLISLDNFYNPLGPEDRARAFKNEYDFDEPNAINLDLAYKCILNLKEGKRTNIPVYSFVHHNRVPDKNIVIYGASVVVIEGIYALYDRRLLDLMDLKIYVDADLDVCLARRLSRDIVSRGRDLDGCIQQWEKFVKPNAVKFVKPTMKNADAIIPSMSDNATAVNLIINHIKSKLELKSNEHLRELIKLGSSPSQDVLNRNIIHELPPTNQVLSLHTMLLNKNLNCADFVFYFDRLATILLSWALDDIPVAHTNIITPGEHTMENVIACQFDQVTAVNIIRSGDCFMKSLRKTIPNITIGKLLIQSDSQTGEPQLHCEFLPPNIEKFGKVFLMEGQIISGAAMIMAIQVLLDHGIDLEKISVVVYLATEVGIRRILNAFDNKVNIFAGMIISREKLQNHQYKWALTRFFDSKYFGCD

SEQ ID NO: 3741 - DNA, 642 bp, Mycoplasma pneumoniae
  CDS (1)..(642): transl_table=4
atggatagtaaaaaaggaattttagtggcaattggtggcgggagttgttctggtaaaactacgatcgctgacatgatttaccaacttttgcgtaaaaagcttaaagttgctattctgccccaggacaactattacaaaccatacaagaacaaatcaatggcgcaacgcaaagcgattaacttcgatcaccccgatgcctttgattgaaagctgttgtgaagtcacctcgataacttactaatgggtaaaacagtggctgtgccaatgtatgactatgttaattacacccgtaaaaaggaaaccatagaaataggtcctttaaatgtagtcatcttggaaggtttaatgccgtggtttgatgaacggattgctaaattgtgtaagctcaagatctttgtggaagcgactggagaggaacgcttaattcgccggattgaacgggactgggaacgcggtcgtgatgtcgcttctatcattaaacaatgacgcgaagcagttagtccaatgtacgaaatctttgtcgaaaagatgaaacagaaggcagatttaattattccctggagtgaaagacacgaagtgagtactaatgtgctcgactttgcaattgaacacctctttcgcaaacacgtggatcccaactag

SEQ ID NO: 3742 - protein, 213 aa, Mycoplasma pneumoniae
MDSKKGILVAIGGGSCSGKTTIADMIYQLLRKKLKVAILPQDNYYKPYKNKSMAQRKAINFDHPDAFDWKLLWSHLDNLLMGKTVAVPMYDYVNYTRKKETIEIGPLNVVILEGLMPWFDERIAKLCKLKIFVEATGEERLIRRIERDWERGRDVASIIKQWREAVSPMYEIFVEKMKQKADLIIPWSERHEVSTNVLDFAIEHLFRKHVDPN

SEQ ID NO: 3743 - DNA, 1245 bp, Chlamydomonas reinhardtii
  CDS (28)..(1155)
gaattccgcgtcgagctgttagcaaccatggctttcactatgcgcgcccccgccccccgggctacggcccagagccgcgtgactgccaaccgggctcgtcgcagcctggttgtgcgcgctgataaggacaagacagtggtgatcggtctggccgctgactccggctgcggcaagtccaccttcatgcgccgcatgacctccatcttcggcggtgtccccaagcccccggctggcggcaaccccgactccaacaccctgatctcggacatgaccaccgtgatctgcctggacgactaccactgcctggaccgcaacggccgcaaggtcaagggcgttaccgccctggcccccgaggcccagaacttcgacctgatgtacaaccaggtcaaggccctgaaggagggcaagtcggtggacaagcccatctacaaccacgtgtccggcctgatcgacgcgcccgagaagatcgagtcgcccccgatcctggtcattgagggcctgcaccccttctatgacaagcgcgtggctgagctgctggacttcaagatctacctggacatctccgacgacatcaagttcgcctggaagattcagcgcgacatggccgagcgcggccactcgctggagtcgatcaagagctcgatcgcggcgcgcaagcccgacttcgatgcctacattgacccccagaagaaggacgctgacatgatcatccaggtgctgcccacccagctggtgcctgacgacaagggccagtacctgcgcgtgcgcctgatcatgaaggagggctccaagatgttcgaccccgtctacctgttcgacgagggctcgaccatcagctggatcccctgcggccgcaagctgacctgctcgttccccggcatcaagatgttctacggccccgacacctggtacggccaggaggtgtctgtcctggagatggacggccagttcgacaagctggaggagctcatctacgtggagagccacctgtccaacaccagcgccaagttctacggcgagatcacccagcagatgctcaagaacagcggcttccccggctccaacaacggcactggcctgttccagaccattgtgggcctgaaggtgcgcgaggtgtacgagcgcatcgtcaagaaggacgttgtgcccgtgtaaatgggtcccttaaaccggcgtatatagcggcggcgggcgcagcgggaatgctggcggcagcgagcagaccccgccccttggaacgccacg

SEQ ID NO: 3744 - protein, 375 aa, Chlamydomonas reinhardtii
MAFTMRAPAPRATAQSRVTANRARRSLVVRADKDKTVVIGLAADSGCGKSTFMRRMTSIFGGVPKPPAGGNPDSNTLISDMTTVICLDDYHCLDRNGRKVKGVTALAPEAQNFDLMYNQVKALKEGKSVDKPIYNHVSGLIDAPEKIESPPILVIEGLHPFYDKRVAELLDFKIYLDISDDIKFAWKIQRDMAERGHSLESIKSSIAARKPDFDAYIDPQKKDADMIIQVLPTQLVPDDKGQYLRVRLIMKEGSKMFDPVYLFDEGSTISWIPCGRKLTCSFPGIKMFYGPDTWYGQEVSVLEMDGQFDKLEELIYVESHLSNTSAKFYGEITQQMLKNSGFPGSNNGTGLFQTIVGLKVREVYERIVKKDVVPV

SEQ ID NO: 3745 - DNA, 1520 bp, Mesembryanthemum crystallinum (common ice plant)
  CDS (127)..(1320)
cccaaatacccacctcccattcctctctcattcctccccattctctctcctcccctgttttaaaacagagagaggtagagtaaacagaggagctaaaacaggggaaaacagagcatacagaaaacaatggcagtatcagcatacacagttcccaccacatcccacttgggattcaaccaaaaaaagcaactattcttctgcaacaagagtgcatacaagagggtgagtttcagcagcagaccatgtgtgataacatgcttagcaggtgactcacagacaattgtgattggtctagcagcagactcagggtgtggtaagagtaccttcatgaggaggttaacaagtgtatttggaggtgcagcagagccaccaaggggaggaaaccctgattcaaataccttaattagtgacacaaccactgtgatttgtttggatgattaccattcccttgataggacagggaggaaagagaaaggagttactgctttggatccaagagccaatgattttgacctcatgtatgagcaagttaaggctttgaaagaaggtaaggctgttgagaagcctatttacaaccatgttactggcttgttggatgcacctgagctcatcaagccacctaagatcttggtcattgaaggtttgcaccctatgtttgactcacgtgtgagggacttgctggacttcagtatctatttggacatcagcaatgaagtgaaatttgcctggaaaattcagagagacatggctgagagaggacacagtcttgagagcatcaaagccagtattgaagccagaaagcctgactttgatgcttacattgatccacagaagcagtatgcagatgcagtgattgaggtgttgccaacccagctcatccctggtgacaatgaaggcaaagtgttgagagtgaggttgattcagaaggaaggggtgcaatatttcagcccagtttacttgtttgatgaaggatcttctattacctggatcccttgtggcagaaaattgacatgttcttaccctggtatcaaatttttctacggccccgacacttacttcggcaatgaggtgactgtgctagagatggatgggcaatttgacagattagatgaattgatctacgttgaaagccatttgagcaacctatcaaccaagttctatggtgaagtcacccaacaaatgttgaagcaccaagacttccctggaagcaacaacggaaccggtctcttccaaaccattgttgggttgaagatcagagacctgttcgagcagcttatcgccagcaagacagcagctcctgcagcagctactaaggcctgaagctccatttgataaataaaaagcatctgaatctcattttttctccactactttcctcatttgtaacttctattaccatttctcctctataagtcggttatgtacttatgttaggctactctgaaattctataattatatagatatgcacaaaagcagagataaaaaatgcagttcaaaaaaaaaaaaaaaaaaaaaaaa

SEQ ID NO: 3746 - protein, 397 aa, Mesembryanthemum crystallinum (common ice plant)
MAVSAYTVPTTSHLGFNQKKQLFFCNKSAYKRVSFSSRPCVITCLAGDSQTIVIGLAADSGCGKSTFMRRLTSVFGGAAEPPRGGNPDSNTLISDTTTVICLDDYHSLDRTGRKEKGVTALDPRANDFDLMYEQVKALKEGKAVEKPIYNHVTGLLDAPELIKPPKILVIEGLHPMFDSRVRDLLDFSIYLDISNEVKFAWKIQRDMAERGHSLESIKASIEARKPDFDAYIDPQKQYADAVIEVLPTQLIPGDNEGKVLRVRLIQKEGVQYFSPVYLFDEGSSITWIPCGRKLTCSYPGIKFFYGPDTYFGNEVTVLEMDGQFDRLDELIYVESHLSNLSTKFYGEVTQQMLKHQDFPGSNNGTGLFQTIVGLKIRDLFEQLIASKTAAPAAATKA

SEQ ID NO: 3747 - DNA, 690 bp, Caenorhabditis elegans
  CDS (1)..(690)
atgaaaaacactctgaaattgccgctcctcatcggtgtggctggaggaacatcttgtggaaagtcaacaattgtggagagaataatcgagaatctcaatgcaaacgcgaagcaaagtggaagacaaatcgacattgtccacttgtcacttcactcattctacagagaactgtcagcagaagagaagattcttgcgagagaaggaaaattcaatttcgatcatcctgatcagatcaactttgatcttctcgccgagactcttcaaaatatgattgatggaaaaactgtggaaattccaaagtacgatatgatcacaagctctatgaacggaacagtgactgtggagccagcaaaagtgatcataatcgaaggaatacttcttctttacgatgaacgtgttcgtaagctgctctccactaagcttttcgttgagaaaaacgctgaaagccgtctcagaaaccggctggccacttatattcgtgactatcatcgtgctccgctctcgatcatccggcaatacacggagttcgtgaagcctgctttcgaagaattctgccgaccaaccaagaagtacgctgacgtcattattccacgtggagccgacaatcacgtggcaactgatctcattgcaaagaatcttcaggttagattcaaacgacaaaacaatgcattgtttgatttcgaattgtag

SEQ ID NO: 3748 - protein, 229 aa, Caenorhabditis elegans
MKNTLKLPLLIGVAGGTSCGKSTIVERIIENLNANAKQSGRQIDIVHLSLHSFYRELSAEEKILAREGKFNFDHPDQINFDLLAETLQNMIDGKTVEIPKYDMITSSMNGTVTVEPAKVIIIEGILLLYDERVRKLLSTKLFVEKNAESRLRNRLATYIRDYHRAPLSIIRQYTEFVKPAFEEFCRPTKKYADVIIPRGADNHVATDLIAKNLQVRFKRQNNALFDFEL

SEQ ID NO: 3749 - DNA, 1668 bp, Caenorhabditis elegans
  CDS (1)..(1668)
atggtcgcagaaaagcgtgatgctaatgtggctgcttcgaaaggggatgccaaccgaaaaagcgtgaagatcgaggactgtcccacgtatagtcattcctcaggttcgtctgtcaacgagatggtcaaccaaagtggtggagattctgaggattcgacttcaccaagagccgctggatgtcgtacgagaagacgaacgatgagtggaggacgtgctgaacatcatcttcttaccactaagaccggcaagaaaatatatacgaaaggacgtccaccatggtatgacaagaagggaaagtcactgaaacatccgttcgtaattggagtttgtggaggatctgccagtgggaaaactactgtcgccgagaaaatcgtcgaacgactcggaataccatgggtcacgattctttcaatggacagcttttataaagttctgacgccggaagaaatcaaagcagcacatgaatcaagatataattttgatgggccaaatgcttttgactttgatttgctctacgaagttttgaaacgacttcgtgagggaaagagtgttgatgttccggtttatgattttaatactcattcaagagatccgaattcgaagatgatgtatggagctgacgttttgattttcgaaggaatcctcgcgttccatgatgagcgtatcaagaatttaatggacatgaaagtgttcgtcgacacggatggagatcttcgtctagctcgtcgtatcgttcgggatgtcactgatcgtgggcgtgacatcgacggcatcatggagcagtactttacatttgtaaaaccggcgttcgacaaatacattgcaccatgcatggattcggctgatctcatcgttccgcgcggtggagagaacgacgtcgccatcgacatgatcgtgcagaacgtgatggcacagctcgttgaacgcggatacgatcgcaatcagaacaaccgtgatcgtcacgatttggttcgcgacgatctaccggattgtttgccggaaaacctgttcattttaaaagaaactccacaggtcaaaggtcttgtcacgtttgttcgtgatcgagaaacgagtagagacaatcatattttctattctgatcgattaatgcgtattcttattgaagaatgcatgaatcatatgccttacaaagatgttgagattgagatggccggcggtagaaaaactattggcaaacgaaaggacgctcagatttgtggtcttccaatcatgcgagccggcgaatgtatggagactgctcttcgctcaatcgtcaaggactgcgtgatcggaaaaattttgattcaaaccaacgagacgacgtttgatccagaacttcattatatacgtttgccaccacacataactcgatacaaagttatcattatggacgccaccgtaactactgggagtgctgcgatgatggcaattcgtgtacttcttgatcatgatgttaaagaggaagacatatttgttgcatctctgcttatgggtcaacaaggtgcacatgcactggcttatgccttcccgaaggttaaattaatcaccaccgcaatggaccaccaaatgacggaaaattgctatctgattcccggaatgggcaattttggtgatcgatattacggaaccgggctcgaacaagacatggacgagccattcgatatgtga

SEQ ID NO: 3750 - protein, 555 aa, Caenorhabditis elegans
MVAEKRDANVAASKGDANRKSVKIEDCPTYSHSSGSSVNEMVNQSGGDSEDSTSPRAAGCRTRRRTMSGGRAEHHLLTTKTGKKIYTKGRPPWYDKKGKSLKHPFVIGVCGGSASGKTTVAEKIVERLGIPWVTILSMDSFYKVLTPEEIKAAHESRYNFDGPNAFDFDLLYEVLKRLREGKSVDVPVYDFNTHSRDPNSKMMYGADVLIFEGILAFHDERIKNLMDMKVFVDTDGDLRLARRIVRDVTDRGRDIDGIMEQYFTFVKPAFDKYIAPCMDSADLIVPRGGENDVAIDMIVQNVMAQLVERGYDRNQNNRDRHDLVRDDLPDCLPENLFILKETPQVKGLVTFVRDRETSRDNHIFYSDRLMRILIEECMNHMPYKDVEIEMAGGRKTIGKRKDAQICGLPIMRAGECMETALRSIVKDCVIGKILIQTNETTFDPELHYIRLPPHITRYKVIIMDATVTTGSAAMMAIRVLLDHDVKEEDIFVASLLMGQQGAHALAYAFPKVKLITTAMDHQMTENCYLIPGMGNFGDRYYGTGLEQDMDEPFDM

SEQ ID NO: 3751 - DNA, 1365 bp, Schizosaccharomyces pombe
  CDS (1)..(1365)
atgcctgaagcttttgagcgttattcaagcaacccaacttatgaacccccatggcgtaaagtgcgatttattggaattgcaggaccatcgggtagtgggaaaacctcggtggcccaattgattgtaaaggcgttaaatcttccacatgttgttattttatcccttgactcgttttacaaatctttgaatgcagagcagaagaagagagcatttaacaacgactatgactttgattcccccgaagccattgattgggacttgctcttcgtaaaactgctagaacttaaacaaggccgtaaagttgacattcctatatatagcttcaatgagcataatcggcttcctgagaccaacacgttattcggagcaagtatcattattctcgaagggatttttgctttatacgatgaaaagattcgctctctccttgacgtctcggtctttctagatacagattcggacgtgtgtctctctcgtcgactgaatcgcgatatcaactatcgaggaagggacatagttggcgttttggaacaatataataaatttgtcaagccaagttatgagaacttcgttaggcgtcaactatcttacactgatcttatcgttcctcgtggccgggacaataaattggcaattgatatggtgattaattttattcgtagaacactttctatacaaagtgaaactcatgttaagaacattgatagtttacagcaaattgtaccaaccattccccatttacccttaaatttagttcagcttaaaattacgcctgaaatatctgccatcaggactattcttataaacaaaaatacacaccctgatgatttacaattttttttgagcagaattggcaccatgttgatgaatttggcaggtgattcgcttgcatatgaaaagaaaacgattactttgcataacggaaaccagtgggaaggtctacaaatggcaaaagagctttgtggtgtttcagttttgcgatccggcggaactcttgaaacagctttatgtcgtcaatttccaacagtgtgtttgggtaagattttggtgcaaatcaataaagttactcaagaaccaactttacattaccataaattgccccgtggcattgctaccatgaatgttgttttgatggcttcacatttaactacacatgcagatgtcttaatggccacgcaaattttagtggatttcggggtcccagaggaaaacattataattgtggtctatgtttgttactctgaaagtattaaagcgctggcttatattttcccaaaggttaccattgttacagcatttctagaaagtgttgctgaacccgtagtcggtagattggatatcgaaaaagtgtattatggatgctga

SEQ ID NO: 3752 - protein, 454 aa, Schizosaccharomyces pombe
MPEAFERYSSNPTYEPPWRKVRFIGIAGPSGSGKTSVAQLIVKALNLPHVVILSLDSFYKSLNAEQKKRAFNNDYDFDSPEAIDWDLLFVKLLELKQGRKVDIPIYSFNEHNRLPETNTLFGASIIILEGIFALYDEKIRSLLDVSVFLDTDSDVCLSRRLNRDINYRGRDIVGVLEQYNKFVKPSYENFVRRQLSYTDLIVPRGRDNKLAIDMVINFIRRTLSIQSETHVKNIDSLQQIVPTIPHLPLNLVQLKITPEISAIRTILINKNTHPDDLQFFLSRIGTMLMNLAGDSLAYEKKTITLHNGNQWEGLQMAKELCGVSVLRSGGTLETALCRQFPTVCLGKILVQINKVTQEPTLHYHKLPRGIATMNVVLMASHLTTHADVLMATQILVDFGVPEENIIIVVYVCYSESIKALAYIFPKVTIVTAFLESVAEPVVGRLDIEKVYYGC

SEQ ID NO: 3753 - DNA, 1647 bp, Homo sapiens
  CDS (1)..(1647)
atggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttag

SEQ ID NO: 3754 - protein, 548 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 3755 - DNA, 738 bp, Debaryomyces hansenii
  CDS (1)..(738)
atgtctgaaggaggacccattattatattaattggaggtggacatgctgccggtaagaaaaccactgccaatttattgaaagaagaacttcgtttttctcttccagatgttgatcttaatatagaaataattgatctagatgactataaggaggatgaagctaaacgagaatattccacttcaaagtcagcagctatcacgctaccagataattctgatgttaactatcctcctttaaaaccttctcggttcaattttgacaaattaagggaatatttgttaagtggtgctaaggttactctgaagtcacaacaaaagattcttattgttcatgggttatacgctttgtatgataagcaagtacgtgatatatcacacataaaggtttttcttacaagtgatcctgatacaaggttaattcgttggattagaagagatgttttggacctaaacaaaaataaatcactagaatcggtcatcaatgcttaccttcagggtgctagggcagagatgagtgacttcatctttccaactaaggaatttgccgatgttattatgccaaaaggagcagaaaaaaatgctattgggctaatagttgatggcgtaatgctgttattgccagaagaagatcaacctcagaatatattcttacctcgtaccaataaccttagacccacagtcagttttgatagtgaaaaatttgatggtcagaaaggaaagttctacgagataagctaa

SEQ ID NO: 3756 - protein, 245 aa, Debaryomyces hansenii
MSEGGPIIILIGGGHAAGKKTTANLLKEELRFSLPDVDLNIEIIDLDDYKEDEAKREYSTSKSAAITLPDNSDVNYPPLKPSRFNFDKLREYLLSGAKVTLKSQQKILIVHGLYALYDKQVRDISHIKVFLTSDPDTRLIRWIRRDVLDLNKNKSLESVINAYLQGARAEMSDFIFPTKEFADVIMPKGAEKNAIGLIVDGVMLLLPEEDQPQNIFLPRTNNLRPTVSFDSEKFDGQKGKFYEIS

SEQ ID NO: 3757 - DNA, 1521 bp, Debaryomyces hansenii
  CDS (1)..(1521)
atgccaaacgaaacaaccaaggcaagaaggtcatcaagaatatcaccatatcatgaagactcatcgtctttttttaacattgcttctgtattagataaacaaaaagatacccaacagataaatacagatctggaaaaatgttcatatattccaccctggacggagccatatattattggtatagctggtaattcaggatccgggaagacttctttatctcaaaagattatacaagaaatcaatcaaccttggacagtcttattatcatttgataatttttataatccgttgagtcaagaagaaagacagaaagcatttagtaatgaatttgattttgatacaccagattcacttgatttagatctattatataatgtggtgaaatctttgaaaagtggtgaaaagactgaaattccaatctattcatttactaagcatgatagaacagacaaaacgactacaatatacggagctaatgttattgtaatagagggaatttatgctttgtatgatcaaagactactcgacttaatggatattaagatctatgtcgatacagatcttgatatttgtcttgccagacgattaacaagagatattttatatagaggaagagacttatctggtgctatgaagcagtgggaaacatttgtgaagccaaatgcagtaaggtatgttaatcctaccatggataatgcgaatttagttattcctagaggtttggacaattctattgcaatcaacttaatgatcaaacacattcaaaagcaattagcgttaaaatcatcattacatttacaaagtttgaagagtttgggtgtgaatgaatttaatattggaaattatggaaaccttaatttgttaccgaataataaccatacaagagggatcaattccgccttattcaatatgtccactgagagatcagattttatattttattttgatagaattgcaattttaattatagagaatgctattgaaacatttgaaaattacaggtcgaagatagtaaataccgcaggcaattaccagtatcaaggattggaccacgttgatgaaatttttgcaattaatattattagatctggggattgttttatgaattctattaagaaaacatttcctgagatatctattggtaaattattgatccaatctgcagcattgacaggagaacctcagttacatttcgagaccttaccaccaaatttggacaagatcgaacataagacgatattgttatttgacgcacaaattataagtggagcagcagcgataatggcaattcaagtattacttgatcataaggtaaggatggaagatatagtattttgcacgtatttgtcaacagaaattggattgaggagaattttaaacgtgtttcctagggttaggattgtgattgggaaattaagtactattgatgacagtactaaatcgtataacccagaaaatttcaaagacaccgattggtgtttcagaaatagattcattgattctctctactttggtacataa

SEQ ID NO: 3758 - protein, 506 aa, Debaryomyces hansenii
MPNETTKARRSSRISPYHEDSSSFFNIASVLDKQKDTQQINTDLEKCSYIPPWTEPYIIGIAGNSGSGKTSLSQKIIQEINQPWTVLLSFDNFYNPLSQEERQKAFSNEFDFDTPDSLDLDLLYNVVKSLKSGEKTEIPIYSFTKHDRTDKTTTIYGANVIVIEGIYALYDQRLLDLMDIKIYVDTDLDICLARRLTRDILYRGRDLSGAMKQWETFVKPNAVRYVNPTMDNANLVIPRGLDNSIAINLMIKHIQKQLALKSSLHLQSLKSLGVNEFNIGNYGNLNLLPNNNHTRGINSALFNMSTERSDFIFYFDRIAILIIENAIETFENYRSKIVNTAGNYQYQGLDHVDEIFAINIIRSGDCFMNSIKKTFPEISIGKLLIQSAALTGEPQLHFETLPPNLDKIEHKTILLFDAQIISGAAAIMAIQVLLDHKVRMEDIVFCTYLSTEIGLRRILNVFPRVRIVIGKLSTIDDSTKSYNPENFKDTDWCFRNRFIDSLYFGT

SEQ ID NO: 3759 - DNA, 1353 bp, Yarrowia lipolytica
  CDS (1)..(1353)
atgaaagccaaacagtacgtcccgccatggaaacagccctacattattgccgtggcggggtcttcgggatcgggaaagacttcggtggctcaactcatcatcaagcagttgaatgtgccttggaccgttcttttgtccatggacaacttctacaagacgctgacacctgaggaatctgctgctgcccatcgaaacgagcacgacttcgacacgcctaccgcatacgataccgacgatctggtcaagtgtcttcgagatatcaaggcaggtcatcgagtcaacattcctacgtactcctttgtcgagcacgctcgaaccgacaaaactgtcagcatttacggcgccaacattgtgatccttgagggaatctatgtgctctatgaccaccccggcttactggatctcatcgacatgaagatctttgtcgacactgatctggatacttgtctggctcgacgactcacgagagatatgcttcatcgaggacgagaaatgtccggtattataaaccagtggcgtaagacggtcaagcccaactttgagcgatacgtgcgacctacaatggccaatgctgatgttctgattcctcgaggacgggacaatgtcgtagcgattgatatggtggcccaacatatcactaaaattcttacagacaagagtgaacgacacttggccgatctgtgctcgttgatcgacgacgacgagctggctgccgaggaagctacctggaacaaacagattcatgaactgaaacagtcgccccagcttatcggcattcacacaattctatgttcagatgataccaagcgagctgatttcgtgttctactttgatagaatcgccactctactggtcgagaatgcactgcagcactccaagtttgaaaacattaacgtcgagactcccacaggaaacacctttgagggagtccgacgtctgggaattgacaatacctgtgctgtagctataatccgagcaggtgagtgtttcgaccgttctgtcaagcgaaccatcccttcagtccgaatgggaaagctgctgatccagagtgacatttctaccggagagcccaaattgcatcatctgaaccttccttcccgcatttcagagcctgacgcctttgttctactatgtgacgctcagctctcgtctggagctgccgctatcatggctaccacagtcctggttgaccacggcgtcaaggaggagaacattgtcttcgtttgctatcttgcatctaaacgaggtcttcagcggtacctcaacgcctatcctaatgtgcatactgtggtcggtaagattctcgacggcagtcatggcagattcatcgacaccaagtactacggtacctag

SEQ ID NO: 3760 - protein, 450 aa, Yarrowia lipolytica
MKAKQYVPPWKQPYIIAVAGSSGSGKTSVAQLIIKQLNVPWTVLLSMDNFYKTLTPEESAAAHRNEHDFDTPTAYDTDDLVKCLRDIKAGHRVNIPTYSFVEHARTDKTVSIYGANIVILEGIYVLYDHPGLLDLIDMKIFVDTDLDTCLARRLTRDMLHRGREMSGIINQWRKTVKPNFERYVRPTMANADVLIPRGRDNVVAIDMVAQHITKILTDKSERHLADLCSLIDDDELAAEEATWNKQIHELKQSPQLIGIHTILCSDDTKRADFVFYFDRIATLLVENALQHSKFENINVETPTGNTFEGVRRLGIDNTCAVAIIRAGECFDRSVKRTIPSVRMGKLLIQSDISTGEPKLHHLNLPSRISEPDAFVLLCDAQLSSGAAAIMATTVLVDHGVKEENIVFVCYLASKRGLQRYLNAYPNVHTVVGKILDGSHGRFIDTKYYGT

SEQ ID NO: 3761 - DNA, 1380 bp, Kluyveromyces lactis
  CDS (1)..(1380)
atgaactcttctggctatataccaccttggacaacaccgtatgttattggtattggagggagttcaggttctggaaagacgagtgttgctaccaaactcgtgacaagaatcaacactccatggacagtattaatatcgttggacaatttctataaaccgttaaccgtcgaagaacgaaagcaggctttcgaaaataactacgatttcgataaaccggattcaatagatttggatctagcttatcaatgtatcctgtctttgaaagaaggtaagaaggtgaaaatcccaacctattcgttcacagatcatgatagaattccaaataagtttttaaccatctatggtgcgagtgttattgttattgaaggaatttacgcattatatgaccaaagacttcttgatttaatggatttgaaggtttacgtggatgcagatttagatatatgtttagctagaagattgacaagggatatcatctctcgtgggagagacttgcatggttgcataagacaatgggagaagtttgttaaaccaaatgcggataggttcgtgaaaccaaccatgaaggcagcagatgcaatcatcccatccatgtcagataacagcattgcgactgagatgttacttaatcacattcagtctaaattgcagctcaaatcgcagcagcatttagcagaacttcaaaagctcgagtcatacgctgtgtcgattgattctttaaatataattcataagttgagacaaactaatcaggtgaaggctctacagactatattgttagacaaaagcgtttcaagagatgactgggtattctattttgacaggttagcaacaatacttttatcctttgcattggacgatatacctacgaaattgaaaacgactaaagttattacgccgacaggaaaacagttggataatccagtttttgttgactttgaccgtgtcacagctataaatattgttagatctggcgactgtttcatgagatctctaagaaagacaattcctagcgtcgcagttggtaagctacttattcaatccgattccagaacaggggaaccacaattgcacagtttatttattccaccaatgatcgaaaattataaccaagtgctactgatggatgcgcagataatttcaggtgcagcgataatcatggcaatccaagttcttactgaccacaatgttgatctcaagaagattaaggttgtagtttatctagcgacagaaaccggtattagaaggatagttaatgctactaataatcaagttgaaatatacgctggagaaattatttccgatgacaaaatcagaactaatcaatgtaattgggccagaaagcggttcgttgcctcaaattactttgggtgcaagtag

SEQ ID NO: 3762 - protein, 459 aa, Kluyveromyces lactis
MNSSGYIPPWTTPYVIGIGGSSGSGKTSVATKLVTRINTPWTVLISLDNFYKPLTVEERKQAFENNYDFDKPDSIDLDLAYQCILSLKEGKKVKIPTYSFTDHDRIPNKFLTIYGASVIVIEGIYALYDQRLLDLMDLKVYVDADLDICLARRLTRDIISRGRDLHGCIRQWEKFVKPNADRFVKPTMKAADAIIPSMSDNSIATEMLLNHIQSKLQLKSQQHLAELQKLESYAVSIDSLNIIHKLRQTNQVKALQTILLDKSVSRDDWVFYFDRLATILLSFALDDIPTKLKTTKVITPTGKQLDNPVFVDFDRVTAINIVRSGDCFMRSLRKTIPSVAVGKLLIQSDSRTGEPQLHSLFIPPMIENYNQVLLMDAQIISGAAIIMAIQVLTDHNVDLKKIKVVVYLATETGIRRIVNATNNQVEIYAGEIISDDKIRTNQCNWARKRFVASNYFGCK

SEQ ID NO: 3763 - DNA, 642 bp, Erwinia carotovora subsp
  CDS (1)..(642)
atgactgatcagtctcaccagtgcgtcatcatcgggatctcaggagcgtccgcttcgggtaaaagtcttatttccagcaccttgtatcgtgaattgcgcgatcaggttggtgatcagcatatcggggtgatatctgaggacagttattataaagaccaaagccacctgaccatggaagagcgggtaaaaactaactatgaccacccaagctcgatggatcacagcctgctaatcaaacatttgcagatgctgaaatccggtcaggccatcgaagtcccgcagtacagctatgtcgagcacacccgtaaacaggaaacagtgcatattgaactgaaaaaggtcattatcctggaaggtattctgctgctgacggatgcgcgcctgcgcaatgagatgaatttctctatttttgtcgatactccactggatatttgcctgctgcgccgtatgcgtcgcgacgttaatgagcgtggccgttcaatggactccgtgatggaacagtatcaaaagaccgtgcgcccgatgttcctgcaattcattgaaccctctaagcagtatgccgatattatcgtgccgcgtggcgggaaaaaccgcattgcgattgatattttgaaagcgaagataagccagttttttgagtag

SEQ ID NO: 3764 - protein, 213 aa, Erwinia carotovora subsp
MTDQSHQCVIIGISGASASGKSLISSTLYRELRDQVGDQHIGVISEDSYYKDQSHLTMEERVKTNYDHPSSMDHSLLIKHLQMLKSGQAIEVPQYSYVEHTRKQETVHIELKKVIILEGILLLTDARLRNEMNFSIFVDTPLDICLLRRMRRDVNERGRSMDSVMEQYQKTVRPMFLQFIEPSKQYADIIVPRGGKNRIAIDILKAKISQFFE

SEQ ID NO: 3765 - DNA, 627 bp, Mesoplasma florum L1
  CDS (1)..(627)
atgtcaaaaaatgtaactttaatacttatagctggtggaacagcatcaggaaaaacaactgttgctgatagaatagctaatgaaattttaaaaggtaaatcggtaactcatatttcaatggataattattataaagattttggtgaattgactttagaagaaagaaggaaaataaactttgatcatccaaatagtgtggatactgaactacttttaaatgacttgcaagctttaaaagactatcaaccaatcaaggtgccggtttatgattttaaaacttcttcaagaaccaaagaaacaattacagttaaacctagtgatgttgtaatacttgatggaatttttgcactagctattaaagagattagaaaacttggagatatcaaaatttttataaaaacagctaatgatttaaggtttattagacgtttacaaagagatgtaaatgaaagagggagaactttagaaagtgttgttgaacaatacttaaatgaagttaaaccaatgcatgatgcatttattgggccaagtattgaatacgctgatttaataattccttataaagaggggaatgaagttgcagttgatttagtagcaactaaaatattaacattgttaacagagtaa

SEQ ID NO: 3766 - protein, 208 aa, Mesoplasma florum L1
MSKNVTLILIAGGTASGKTTVADRIANEILKGKSVTHISMDNYYKDFGELTLEERRKINFDHPNSVDTELLLNDLQALKDYQPIKVPVYDFKTSSRTKETITVKPSDVVILDGIFALAIKEIRKLGDIKIFIKTANDLRFIRRLQRDVNERGRTLESVVEQYLNEVKPMHDAFIGPSIEYADLIIPYKEGNEVAVDLVATKILTLLTE

SEQ ID NO: 3767 - DNA, 1431 bp, Candida glabrata
  CDS (1)..(1431)
atgcatgatatgaccgggaactctactgaggctagacgtagtagtgttcatttgaatgaccaacacaaatatattccgccatggactactccttatatcatcggtgttggtggtacgtctgggtcaggtaagaccagtgtggccaataagattgtctcatctattaatgttccatggactgtgctaatctccttggataatttctataaaccactcaatgaagcagaacgggagcgtgcgtttaataacgagtacgactttgatgaacctaatgcaatcgatttggatttggcatatgactgtattttgagcttgaaagaaggtaagaaaacctctattcccgtctatagttttacccaccataatagagatccacacaagcagatccctatatatggtgccagtgttatcgtcttagaaggtatttatgcattatatgatcaaagattacttgatttgatggatttaaaggtgtatgttgacgctgatttagacatttgtttggctagaagattatcgagagatattgttgcaagaggaagagatttgcaaggctgtttattacaatgggaaagatatgtcaaacccgatgctgtcaagtacgttaagccaacaatggcgaaagctgatgctattataccttcaatgtctgataacacagttgctgtaaagctgctaattaagcacatagaatcaaaactagaactgaaatctgaagagcacatgacagaacttgtcaaattaggccaatctggaactggtccattatcagattataagaatttggaggttcttccacagacaaatcaaattaaggccatacacactattttattggacagaaatgtcgatagggatgagttctccttccaatttgataggattgcaactttgttactagccaatacactcaatgatatccctgttcagaaaccagaaactattatcactccagatggattcagtgtaccaggccaacgtaggtgctgctttgatgaagttacagctatcagcacaattagatcaggcgattgttttatgaaagctgttaaaaaggctttcccagccatggcaattggtaagctattaattcaatctgattccctgacaggtgagccacaactgcactgtgagtttatccccgaggacatctcaaaatacaggaaaatactaataatggattctcagatcattagtggtgctgctatgattatggccgtacaagttcttctagaccacaaagtcgatatagaaaacatccatattttagtatacatggccacagaactaggtattagaagaattataaacgcgtttggcaataggatcaaaattacagcaggtattgtcgtcgagagaaatgaaataaaaaacaagaaggcaagttgggccctaacaagatttgtcgacaacaaatattttggttgctaa

SEQ ID NO: 3768 - protein, 476 aa, Candida glabrata
MHDMTGNSTEARRSSVHLNDQHKYIPPWTTPYIIGVGGTSGSGKTSVANKIVSSINVPWTVLISLDNFYKPLNEAERERAFNNEYDFDEPNAIDLDLAYDCILSLKEGKKTSIPVYSFTHHNRDPHKQIPIYGASVIVLEGIYALYDQRLLDLMDLKVYVDADLDICLARRLSRDIVARGRDLQGCLLQWERYVKPDAVKYVKPTMAKADAIIPSMSDNTVAVKLLIKHIESKLELKSEEHMTELVKLGQSGTGPLSDYKNLEVLPQTNQIKAIHTILLDRNVDRDEFSFQFDRIATLLLANTLNDIPVQKPETIITPDGFSVPGQRRCCFDEVTAISTIRSGDCFMKAVKKAFPAMAIGKLLIQSDSLTGEPQLHCEFIPEDISKYRKILIMDSQIISGAAMIMAVQVLLDHKVDIENIHILVYMATELGIRRIINAFGNRIKITAGIVVERNEIKNKKASWALTRFVDNKYFGC

SEQ ID NO: 3769 - DNA, 639 bp, Bacillus thuringiensis serovar konkukian str
  CDS (1)..(639)
atggggacgaataagcctgttgtaattggaattgctggtggttcagggtcaggtaagacaagtgtaacgaaagcgatttttgaccattttaaaggtcattccattttaatcttagagcaagattattattacaaagatcaaagccatttaccaatggaagaacgtttaaaaacaaattatgatcatccattagcgtttgataatgatttgttaattgaacatttgcagcagttgcttgcatataaacaagtagataaacctgtatatgactatacattgcatacgcgttcagaagaaattattccagttgagccgaaagatgtaatcattttagaaggaattcttattttagaagacccacgtctttgtgagttaatggacattaagctattcgttgatacagatgcggaccttcgtatcctgcgccgcatgcagcgtgatattaaagaacgcggtcgtacgatggattcagttattgatcaatatgtaaatgttgtacgtccaatgcacaatcaatttattgagccttctaagaagtttgcggatattattatccctgaaggtggacaaaaccacgttgcaattgatattatggttacaaaaattgcaacaattcttgaacaaaaagtaaatttgtaa

SEQ ID NO: 3770 - protein, 212 aa, Bacillus thuringiensis serovar konkukian str
MGTNKPVVIGIAGGSGSGKTSVTKAIFDHFKGHSILILEQDYYYKDQSHLPMEERLKTNYDHPLAFDNDLLIEHLQQLLAYKQVDKPVYDYTLHTRSEEIIPVEPKDVIILEGILILEDPRLCELMDIKLFVDTDADLRILRRMQRDIKERGRTMDSVIDQYVNVVRPMHNQFIEPSKKFADIIIPEGGQNHVAIDIMVTKIATILEQKVNL

SEQ ID NO: 3771 - DNA, 834 bp, Homo sapiens
  CDS (1)..(834)
atggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcaccgagggagggacctggagcagattctgacgcagtacaccaccttcgtgaagccggccttcgaggagttctgcctgccgacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccattaa

SEQ ID NO: 3772 - protein, 277 aa, Homo sapiens [sequence omitted]

SEQ ID NO: 3773 - DNA, 1965 bp, Oryza sativa
  CDS (257)..(1726)
gggcttcttcctccacctctcccccccactctctctctctcctctctcttctctctctcctccaccgactcgccaacccctctctctctccctcctctcccatttcgtccccctcccgctcccctccccgtccgtcccccgtatctgccgccaccggggctgggcacggttctggttgatctcccccggccaacttcttgcggcggcggcgatctccgtgcgtggcttcgcgccccgcaggttcttggaacaatatatgggttcaagaccagttgatgaggttcttgatgctgccgcggctggggtccactactccacgctccgtttggatgagcttaacatcaatggctccatgacaggggaggaacaaccaacgacctcaggggtggagaatgggcaccaggagccatttgtcattggtgttgccgggggtgcatcttcaggcaaaagtactgtatgcaaaatgataatcgatcagctacgtgatcagcgtgtagttgttgttactcaggagtctttttattatgggttgtctgatgaggaattggtccatgttcatgattataactttgatcatccagatgcatttgatacggagttactactctcttgtatggagaacttgaaacatggcaaggctgtggacattcctaattacaacttcaaaacatataagagtgttgcaagtgcaagaaaggtcaatccttcagatgtaattattttggaaggaattctggttttccatgattcacgtgtccgggatttgatgaacatgaagatctttgttgacacagatgctgatgtgcgattaacaaggaggattcgacgtgacaccattgagaagggtagagatatcaaaactgtgctagatcagtactcaaagtttgttaagcctgcttttgaagacttcatcctcccaaccaagaagtatgctgatattatcatcccacgaggtggcgataatgatgttgcaattgacttaatagttcagcatattcgtactaagcttggtcaacatgatctctgtaaagtacaccccaatttgtatgtcattcagactacttatcagatacgaggtatgcacacaataatacgggatgctgccacaacaacacatgatttcatattctatgctgatcggttgattcgattggttgttgagcatggtcttggtcatcttccattcaaggaaaagcaggtcataactccaactggatcggtttacactggggtagagttctccaaaagattgtgtggtatctcagtgattagaagtggtgagagtatggagaatgcattgcgggcatgctgcaaaggtataaaaattgggaagattcttattcacagggaaggagacaatggcaaacagctaatctatcacaatttaccgaaagatattgcaaacaggcatgtgctgttgttggatcccatactgggaacaggaaattcagctgttcaagctatatctctactcttgaaaaagggtgtacaggaaacaaatattatttttctgaatcttatatcagctccccaaggagtgcatgtggtcagcaagagatttccaagagtgaagatcgtgacatcagaaatcgagtttggtctgaatgatgatttccgcgtcatccctgggatgggtgagtttggggataggtactttgggacagatgattatcagtcatcaacaccattcttttgtgatgagaaaaatcgtgtcaggcttttgtgagcatttaaatagacaaagtcctggcggcggcggcggcatcatctccatttttgagaaacttaaattttacatttggaaattcagatgcccatattgatgtattcattaccagaaactgtgtatcggttgaacattacaggccgatcttgcctaatgacataaacggagcaaattcctttatgttttttcttatgtcttctccagctttttagtcaggaagatgctgtgatctcatttcg

SEQ ID NO: 3774 - protein, 489 aa, Oryza sativa
MGSRPVDEVLDAAAAGVHYSTLRLDELNINGSMTGEEQPTTSGVENGHQEPFVIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIILEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNLPKDIANRHVLLLDPILGTGNSAVQAISLLLKKGVQETNIIFLNLISAPQGVHVVSKRFPRVKIVTSEIEFGLNDDFRVIPGMGEFGDRYFGTDDYQSSTPFFCDEKNRVRLL

SEQ ID NO: 3775 - DNA, 747 bp, Photobacterium profundum
  CDS (1)..(747)
atgctggaagtcacgttttctctggcttctggcgctgcaagtgcctataataatgcggttaatttttcgcctcgtcacgttgtcttacaggtgctttctgatatgtctgaaaactcacaccaatgcgtcattattggtatcgcaggtgcttctgcgtccggtaaaagcttgattgccagtactgtttataaagaattaaaagaaaaagtaggcgatcatcagatcggtgttatcacggaagattgttactacaataatcaaagccacctgaccatggatgagcgggttaaaacgaattatgatcaccctaatgcgcttgaccacaatttactttgtgaccatctgcaacggttgatcgaaggcaaagcggttgaagtgcctcaatacagctacagcgaacacacacgtttaaaagaaaccacaccaatgacacctaaaaaagtgatcattcttgaaggtatccttttattaaccgatccacgtttacgtgaactcatgcatgcaagtgtgttcatggatacgccattagatatttgtttacttcgccgtttgcagcgtgatgttgctgaacgtggtcgtacaatggaatctgtgcttgtgcagtatcaaaagacggtacgtcctatgttcatgcagtttattgaaccgtctaaacaatatgccgatatcattgtaccgcgagggggtaaaaaccgaatcgcgattgatgtactgaaggcgcatattgccaagttgctaaaatcataa

SEQ ID NO: 3776 - protein, 248 aa, Photobacterium profundum
MLEVTFSLASGAASAYNNAVNFSPRHVVLQVLSDMSENSHQCVIIGIAGASASGKSLIASTVYKELKEKVGDHQIGVITEDCYYNNQSHLTMDERVKTNYDHPNALDHNLLCDHLQRLIEGKAVEVPQYSYSEHTRLKETTPMTPKKVIILEGILLLTDPRLRELMHASVFMDTPLDICLLRRLQRDVAERGRTMESVLVQYQKTVRPMFMQFIEPSKQYADIIVPRGGKNRIAIDVLKAHIAKLLKS

SEQ ID NO: 3777 - DNA, 621 bp, Bdellovibrio bacteriovorus
  CDS (1)..(621)
atgcaaagacctcacatcatcggtgttgctggtggcagtggctccggcaaaacacacttcgccaaagagctgcaacaactgctgggcgaagacaactgctccatcatctaccaggacaactactacatcgaccaatccgcaaaatttgacggcgatggcggttcggtgaactttgatcatccctccagtcttgatttcactttgctcgcacagggcttgcgtgccctgaagtccggccaaagcctgaacatcccgatttatgattttgtcactcattcccgcaaaaaagagacccttccaggcgaacccaaaaaagtcattatcatcgacggaatcctgatcctacactctgaagaagtccgccaggaactggatgaggccatcttctttgacacccccgaatccctgcgctttgagcgccgtctgaaacgtgatgttcacgaacgcggcagaacgccagagggagtgcgcaagcagtttgaactgcaagtgcgccccatgcacaatcagtttgtcgagccctccaaagaccacgctcacaccatcatcaaggatctgggcgactacagccaggccctgaaacagtatcagcagaaactttcaaaagccttcctgcagtaa

SEQ ID NO: 3778 - protein, 206 aa, Bdellovibrio bacteriovorus
MQRPHIIGVAGGSGSGKTHFAKELQQLLGEDNCSIIYQDNYYIDQSAKFDGDGGSVNFDHPSSLDFTLLAQGLRALKSGQSLNIPIYDFVTHSRKKETLPGEPKKVIIIDGILILHSEEVRQELDEAIFFDTPESLRFERRLKRDVHERGRTPEGVRKQFELQVRPMHNQFVEPSKDHAHTIIKDLGDYSQALKQYQQKLSKAFLQ

SEQ ID NO: 3779 - DNA, 624 bp, Bdellovibrio bacteriovorus
  CDS (1)..(624)
atgagccgtccccacattatcggagtcgctggcggcagcggctctggcaaaacatacttcgccaaagaactgcaaaagatgctgggttcagaaaactgcagcatcctttatcaggacaattactatatcgaccagtccgctcgctttgatggagatgggggctcggtgaactttgatcatccccaggccttggatttcacgctactcgcacgcgggcttcagacccttaaaatgggtcagccgctgcaggtgccaatttacgactttgtcacccactcgcgtaaaacggaaacccttctggaaaaccctaaaaaagtcattatcgtggatgggatcttgatcctgcattcaaaagaagttcgagccgagctggatgaagccgtcttttttgacacccccgaagacctgcgctttcaacgccgtctgcaccgcgatgtgcatgaacgcgggcgcaccccagagggagtaaaaaagcagtttgaacttcaggttcgtcccatgcatgacgaatttgtggagccttcaaaacgtcatgcccaaaccatagtgacggactcaggggactatcatgcggtactttcacaattcacccatcgcctgcaaaacaccctgcccgtgcggtaa

SEQ ID NO: 3780 - protein, 207 aa, Bdellovibrio bacteriovorus
MSRPHIIGVAGGSGSGKTYFAKELQKMLGSENCSILYQDNYYIDQSARFDGDGGSVNFDHPQALDFTLLARGLQTLKMGQPLQVPIYDFVTHSRKTETLLENPKKVIIVDGILILHSKEVRAELDEAVFFDTPEDLRFQRRLHRDVHERGRTPEGVKKQFELQVRPMHDEFVEPSKRHAQTIVTDSGDYHAVLSQFTHRLQNTLPVR

SEQ ID NO: 3781 - DNA, 618 bp, Mycoplasma mycoides
  CDS (1)..(618)
atgagtaaaaaagttagcattattttaatagctggcggtagtgctagtggaaaaacaactattgctagtaaaatagctaatgagattttaaaagataaatctgtagaacatatttcaatggataattactataaagattttactaatttatctttagagcagagaaaccatattaattttgatcacccaaattcaattgatattgatcttttaattaaagatttaaaacaacttttaaaaagacatgatatttttgttccaacttatgattataaaaaacatattagaacaaataaagaaaaactaattaaagctagtgatgttattatagttgatggcatcttttcattacattttgaaaaattacgcgaacttggagatattaaaatatttgtaaaaactcctgatgatttaagatttattagaagattagtcagagatataaaagaacgtaatagaactattgaaagtgttattgatcaatacttaactgatgttaaacctatgcatgatctttttatagaacaaactattgattatgcagatattgtatttaaaaaaggaaatgatgtagctattgatatagttgcttcaaaaattaaagacttattaaattaa

SEQ ID NO: 3782 - protein, 205 aa, Mycoplasma mycoides
MSKKVSIILIAGGSASGKTTIASKIANEILKDKSVEHISMDNYYKDFTNLSLEQRNHINFDHPNSIDIDLLIKDLKQLLKRHDIFVPTYDYKKHIRTNKEKLIKASDVIIVDGIFSLHFEKLRELGDIKIFVKTPDDLRFIRRLVRDIKERNRTIESVIDQYLTDVKPMHDLFIEQTIDYADIVFKKGNDVAIDIVASKIKDLLN

SEQ ID NO: 3783 - DNA, 2638 bp, Oryza sativa
  CDS (248)..(2206)
ggctttttggatcgacggcgacgccgccctctccatctccagagagagccctcttctccgtttcttcctactaggctactactactcctcctcggctcaaccctcccgtcccctcacccccacgcgcgccgccttctccccagaacgcgccgcggcgaagcgccgccgaagcagcccccactcctccgcgcgcggcggcggcggcgcagtctccagacgcttcctcctccggggatctcgcctttgaatggaccgaagtgattccatggctgattcgccaaggaggcgtaatggccttctgcgggaccaggtccagttggtgaaaaggaaggacacaaatcgctacgaaatcgtccgctttcctgatccattgtcatttgagaaaggcttctttgttatgatccgtgcctgccagcttctggtgcagcacaatgaagggatgatttttgttggcgttgctggaccctctggggccgggaagactgtgtttactgagaaggtgctcaatttcatgcccggtgttgctgtgatatcaatggataactacaatgatgcaagtcgcatagttgatggcaattttgatgatccacgcctaacagactacgacacactgttggaaaatattcatggtctgaaggagggaagatcagttcaggttccaatatatgatttcaagatgagctgccggactggatacagaacagttgatgtccctagctctaggattgttatcattgaaggcatctatgcattgagtgaaaagttacgatctgtattggacctacgtgtttctgtcactggtggtgttcattttgacctggtgaagagggtcctgagggacatacagagagctggccaggagcctgaggaaataattcatcagatatctgaaacggtttatccgatgtataaggctttcattgagccagacttgcagacagcacatataaaaataatcaacaagttcaacccattctcagggttccaaaatcctatgtacattctaaagtctccacgaactataacacctactgacatcaaagttgctcttggtgaagatcatacagaaagcattgaagaaacttatgatatatatttgcttcctccaggcgaagatccagaatcatgccaatcttatttgagaatgaggaatagggaagggaaatataatctgatgtttgaggagtgggtgaccgataatccttttatcatatcaccaaggattacgtttgaagtcagtgttcgtcttcttggaggtttgatggcattgggatatactatagcagctatactgaagagaaagagtcgtgtgttttctgatggcaaggcaactgttaaaattgattggttggagcaacttaaccgaaattatatacaggtgcaaggaagagatagaaatcatgtcaaatttgtagcggagaagttaggtctggatggctcttatattccacgcacatatattgaacaaattcagctggagaaactgataaacgatgttatggcattaccagaagatctcaagacaaagctcagcattgatgatgagctggtttcaagtccaaaagaggccctttctcgggtttctgctgataagagaaacaaacacctgaaaagtggtctatctcattcatattcaactcatggagataaaaatattgtgaaattgagtaaattgacagaaaccaacagaaggtttggaagtgggcgagcccctgaacctcctgcaattaatcagggtgctatcactcagctatccgaacagatttcaacgttgaatgagaggatggacgagttcacctctcgagttgaagaactcaactgtaaatttgcaataaagaaatcatcgaccagtcagcaaaatttagctcttccaaatgaaacttgcaatggttctgcacctacaaatctctttgtttctcatttgggcaatggtaccctgatacctcattcgtcatcatcgaaccaacttttgaaggagtcccccattgtggatgagattaatgccatatcaagaggtcagcgccaagtgatacatcagcttgacaatctgaccagcttgcttcatgagcatttggccttgacccgccaaggaaatgcagtccgcagaaacgggatcctggaaatggacatgtccatctgcccactcattgccctgacaattggcggtttcggctatttggtgttcaagagcctcaaccggagctaaccgaagcgaatcaggcagcgacatgctgctttaaaaagctcaccaccaagttcaaccaagaaccagagaaagccaagaagtctcaaaacggatcttcactcttcagtactcagtccagacaccaaaccgatgttctcctgcgagctatagacggtcctcactcagatcattggtctcatggggaccatatctgatagattttacaatttcaagatagataaactcatataccagcacaagcaacagagcagtcttgatactcgggccaagttacttggaagcttaaaaactgtgtactaaagagcgtagagttatacaatatcgtctgtaatggatactggaaagcccccagtatcaataaattttggagacgctagtaatcccgatataatgtcgaacaagtcgtgggaaaagagcatagtcattttaccg

SEQ ID NO: 3784 - protein, 652 aa, Oryza sativa
MDRSDSMADSPRRRNGLLRDQVQLVKRKDTNRYEIVRFPDPLSFEKGFFVMIRACQLLVQHNEGMIFVGVAGPSGAGKTVFTEKVLNFMPGVAVISMDNYNDASRIVDGNFDDPRLTDYDTLLENIHGLKEGRSVQVPIYDFKMSCRTGYRTVDVPSSRIVIIEGIYALSEKLRSVLDLRVSVTGGVHFDLVKRVLRDIQRAGQEPEEIIHQISETVYPMYKAFIEPDLQTAHIKIINKFNPFSGFQNPMYILKSPRTITPTDIKVALGEDHTESIEETYDIYLLPPGEDPESCQSYLRMRNREGKYNLMFEEWVTDNPFIISPRITFEVSVRLLGGLMALGYTIAAILKRKSRVFSDGKATVKIDWLEQLNRNYIQVQGRDRNHVKFVAEKLGLDGSYIPRTYIEQIQLEKLINDVMALPEDLKTKLSIDDELVSSPKEALSRVSADKRNKHLKSGLSHSYSTHGDKNIVKLSKLTETNRRFGSGRAPEPPAINQGAITQLSEQISTLNERMDEFTSRVEELNCKFAIKKSSTSQQNLALPNETCNGSAPTNLFVSHLGNGTLIPHSSSSNQLLKESPIVDEINAISRGQRQVIHQLDNLTSLLHEHLALTRQGNAVRRNGILEMDMSICPLIALTIGGFGYLVFKSLNRS

SEQ ID NO: 3785 - DNA, 1494 bp, Oryza sativa
  CDS (20)..(1231)
agaaaggccagaagcaaagatggcgatctccagcctacatgccaccacctccctgcactccccatgcaccaccaacacaagcttcaggcagaatcaggtcatcttcttcaccaccagaagcaacaggaggggtagcacaaggtacggaggagcaagaacctttcaggtttcatgctcagtcgacaagccagtggtgattggccttgcagcagactcaggatgcgggaagagcacctttatgcgccggctcaccagtgtgtttggcggtgctgcagagccacccaagggtggcaacccagactcaaacacactcatcagtgacacgacaacggtgatatgcctcgatgactaccattccttggacaggactggcaggaaggagaaaggtgtgactgccctggaccctagggcaaacgattttgatctcatgtatgagcaggtgaaggcaatcaaagaaggcaaggcaattgagaagccaatctacaaccatgttactggtctcctagacccaccggagcttatccagccccccaagatttttgtcattgagggcttacatcccatgtttgatgaacgtgtgagggacctcctagatttcagcatctacctggacatcagtgacgaggttaaatttgcatggaaaattcagagggatatggcagagcgcggtcacagccttgaaagcatcaaggctagtatcgaagccaggaaaccagattttgatgccttcattgatccccagaagcaatatgctgatgcagtgattgaagttctgccaacccagcttattcctgatgacaatgaaggaaaggtgctacgtgttaaattgatcatgaaagaaggtgtaaagaacttcaacccagtttacctcttcgacgaaggatcaagcatcacctgggtcccttgtggaagaaaactcacatgttcttatcctggcatcaaatttgcctatggcccagacacttactttgggcatgaggtatcagtgctggagatggatggccaatttgacagactagatgagcttatctatgttgagagccatttaagcaacctctcaaccaaattttatggagaggtgacacagcaaatgctaaagcatgcagacttccccggcagcaacaatggaacaggtctcttccaaactatcgtaggactgaagattagagatctctatgagcagattattgctgagagggccggtgcacctactgaagcggcaaaagtttaatgagctccacattcatatttcgtgaatctcttcatcaccataccatatcaatgacaatgggcatcctcgcattccttgtaactagttttggaaatattacagctagaagaaagtaggatggtcattgcataacttgtgaaaccatgcaatggaacttctaaaaatccctctccatgagggtgctcctacatctcttcttgacacatttcaatgtacatcttctatatttcaatgtagaaagaaatacggttgctttctactat

SEQ ID NO: 3786 - protein, 403 aa, Oryza sativa
MAISSLHATTSLHSPCTTNTSFRQNQVIFFTTRSNRRGSTRYGGARTFQVSCSVDKPVVIGLAADSGCGKSTFMRRLTSVFGGAAEPPKGGNPDSNTLISDTTTVICLDDYHSLDRTGRKEKGVTALDPRANDFDLMYEQVKAIKEGKAIEKPIYNHVTGLLDPPELIQPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSSITWVPCGRKLTCSYPGIKFAYGPDTYFGHEVSVLEMDGQFDRLDELIYVESHLSNLSTKFYGEVTQQMLKHADFPGSNNGTGLFQTIVGLKIRDLYEQIIAERAGAPTEAAKV

SEQ ID NO: 3787 - DNA, 1824 bp, Homo sapiens
  CDS (45)..(1232)
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcaacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcggatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgttgaatacaaagatgttaatttttaaaatgttactagtataatttattctatgcattttataaaataaataaagctttagaaaaaaaaaaaaaaaaaa

SEQ ID NO: 3788 - protein, 395 aa, Homo sapiens [sequence omitted]

SEQ ID NO: 3789 - DNA, 630 bp, Listeria monocytogenes
  CDS (1)..(630)
atgacaaaaaaaccaatcgtagtcggcgtaactggcggttcaggttctggtaaaactagtgtaacgaaagccatttgtgatcattttagcggacactcgattttgatgattgctcaagatgtctattatcacgatcaagccaatattagttttgaagatagattaaaagtaaattatgatcatccactagcttttgatacggacttactcatttcacatattgccgcactgcgtcgctatgaaaccatagaaaagccgatttatgattatgccaaatatacgcgaaaaaaagaagtagaaatccaagaacctagagaggttattattttagaaggaattttaattttagaagataaacgccttagggatttgatggatattaaagtatatgtggataccgatgatgatattcgttttattcgcagacttttacgcgatatgaaagaacgtggtcggacaatggattctgttatcgagcaatatctttctgttgttaaaccaatgcacaatgaatttatagaaccaacgaaaaaatttgccgatattattattccagaaggcggagagaatcacgttgcaatcgacttaatgacaacaaaaattgaatccattttgcaaaaacatgtataa

SEQ ID NO: 3790 - protein, 209 aa, Listeria monocytogenes
MTKKPIVVGVTGGSGSGKTSVTKAICDHFSGHSILMIAQDVYYHDQANISFEDRLKVNYDHPLAFDTDLLISHIAALRRYETIEKPIYDYAKYTRKKEVEIQEPREVIILEGILILEDKRLRDLMDIKVYVDTDDDIRFIRRLLRDMKERGRTMDSVIEQYLSVVKPMHNEFIEPTKKFADIIIPEGGENHVAIDLMTTKIESILQKHV

SEQ ID NO: 3791 - DNA, 636 bp, Thermus thermophilus
  CDS (1)..(636)
atgagcgcgcccaagcccttcgtcatcgggatcgccgggggaacggcgagcggcaagaccaccctcgcccaggccctggcccggaccctgggggagcgggtcgccctcctccccatggaccactactacaaggacctgggccacctccccctggaggagcgcctccgggtaaactacgaccacccggacgcctttgacctcgccctctacctggagcacgcccaggccctcctccggggccttcccgtggagatgcccgtctacgacttccgggcctacacccgaagccccagaagaacgccggtccggcccgcccccgtggtgatcctggaaggcatcctggtcctctaccccaaggagctccgggacctcatggacctcaaggtcttcgtggacgccgacgccgacgagcgcttcatccgcaggctcaagcgagacgtcctggaaaggggcaggagcctggaaggggtggtggcccagtacctggagcaggtcaagcccatgcacctccacttcgtggagcccaccaagcggtacgccgacgtgatcgtgcccaggggcggccagaaccccgtggccctggagatgctcgcggccaaggccctcgcccgcctggcccggatgggggcagcgtga

SEQ ID NO: 3792 - protein, 211 aa, Thermus thermophilus
MSAPKPFVIGIAGGTASGKTTLAQALARTLGERVALLPMDHYYKDLGHLPLEERLRVNYDHPDAFDLALYLEHAQALLRGLPVEMPVYDFRAYTRSPRRTPVRPAPVVILEGILVLYPKELRDLMDLKVFVDADADERFIRRLKRDVLERGRSLEGVVAQYLEQVKPMHLHFVEPTKRYADVIVPRGGQNPVALEMLAAKALARLARMGAA

SEQ ID NO: 3793 - DNA, 1653 bp, Treponema denticola
  CDS (1)..(1653)
atggcttcatttaaaataacttttcctgacggaactcaaaaagaatttgttaatccggtgtcggcgcgtgagctggtacaatattttccggcctgccctgctcctatagtaggcataaaggtaaacaatttggtagtacccttaaataaaaccatcgatgtacaatccaatatagaaccggtaaccttagccgaccgagaaggctcaaatttttaccgaagaactctctgcctgattttagctgctgcagcaaaagaactctaccccggcttaaggcttttaatgggacacagcctggattacggctattattacacccttgaaggaaaaaattcaagtaaggtggattttaaggctataaaggcaaaaatggatgaaatggtagctcaagacatgcctatcgatacccgctggctttcctacgaggaagccttggaaaaattcgaacactcaaatcaacccgaaacccatagacttttaaactacacgagtaaaccccgaattttaataaaccgtttaggcagctatgaagatctctattttcaaccccttatggatagaataggtgaagtcaaggtctttgatgtaatgccctatgaagacggctttttactcaggtttccgaggacatcatctcctacaaagctctcggaatttaaagacattccccatctttttgaaatttataaagaatataaacaatggggaaaacttgtaggcgtttcatcggtgggtcagttgaacgacttaattacctcaagaaaaataaaagactatgtagaaattaccgagatacttcaaaacaataaacttgccgaaatagcaaaaaaaataacggctaaaaaaaccgcaagggtaatactgatagcaggcccttcaagttccggaaaaaccacttcggctaaaaaactttcaatgcagcttaaggttcttgggtatgtacctaaggttataagccttgacgatttttatctgggtattgctaaagcaccgaaaaaagaagacggaaggcccgactttgaatgtgttgaggctctggacattgagctcttaaacgatgtccttctccgtctattcaatggtgaaacagtcgaaatgccttcctacgattttaaggtaagtgcccgcagacctgaaggtaagatgtttacccctgaacaaaacacaatctttatacttgaaggaatccatgctctgaacaataagcttacggcaaaaatagacgagtcattaaaatttaaggtctacctttcggctctcacccagcttaatttggatgaccataaccgcatccctacatcggataacagacttataagacgcatagtccgagatgcccagtttagaggaagccctgcagcaagaacaataggaatgtggggcgacgtaagaagcggagaatcaaaatatattttcccattccaaggaaatgccgatgctgtctttaacacggccctggactatgagctttcagtcttaaaggtttatgcagaaccgcttttaaaggcggtaaagccgaaccaaaaggaatacaacgaagcgtcgaggctgttaacctttttaggaaactttctaccgcttccggccagctttgtacacggacaatccatattgcgcgaatttatcggagacagcgacttttcgtacagctaa

SEQ ID NO: 3794 - protein, 550 aa, Treponema denticola
MASFKITFPDGTQKEFVNPVSARELVQYFPACPAPIVGIKVNNLVVPLNKTIDVQSNIEPVTLADREGSNFYRRTLCLILAAAAKELYPGLRLLMGHSLDYGYYYTLEGKNSSKVDFKAIKAKMDEMVAQDMPIDTRWLSYEEALEKFEHSNQPETHRLLNYTSKPRILINRLGSYEDLYFQPLMDRIGEVKVFDVMPYEDGFLLRFPRTSSPTKLSEFKDIPHLFEIYKEYKQWGKLVGVSSVGQLNDLITSRKIKDYVEITEILQNNKLAEIAKKITAKKTARVILIAGPSSSGKTTSAKKLSMQLKVLGYVPKVISLDDFYLGIAKAPKKEDGRPDFECVEALDIELLNDVLLRLFNGETVEMPSYDFKVSARRPEGKMFTPEQNTIFILEGIHALNNKLTAKIDESLKFKVYLSALTQLNLDDHNRIPTSDNRLIRRIVRDAQFRGSPAARTIGMWGDVRSGESKYIFPFQGNADAVFNTALDYELSVLKVYAEPLLKAVKPNQKEYNEASRLLTFLGNFLPLPASFVHGQSILREFIGDSDFSYS

SEQ ID NO: 3795 - DNA, 636 bp, Lactobacillus johnsonii
  CDS (1)..(636)
atgcaaagtaaacgccctattatcattggaattgctggtggttctggtagtggtaaaacaaccatcgctcatgaaatttatgaccaattacaacaagacgaccatatcttaattatgacgcaagattcttactacaagaacaacgacaacttatcaatggcagaccgtaaaaaaatcaactacgaccatcctgatgcctttgacatgccccttcttgttgaacaattacgtcaattaatggactataaggcagttgaaatgccagtttatgactttaccgctcatacaagaagtgaaaagacaattcacactgaaccggctgatattattatcttagaaggtatcctagttttaggcgaagaaaatttacgtgatttaatgagtattaaagtctttgtagatactgatgatgatattcgttttatcagaagattagagcgtgatacacaagaacgtggacgttctgtagaatcagtaattaatcaatacttagcaacggttaagcccatgtataatcaattcattgaaccaactaagcgttatgctgatatcattgttccagaaggtggagaaaatgatgttgctatcgatatgcttactacgaagattcgttcagttttaagtacagtcaaataa

SEQ ID NO: 3796 - protein, 211 aa, Lactobacillus johnsonii
MQSKRPIIIGIAGGSGSGKTTIAHEIYDQLQQDDHILIMTQDSYYKNNDNLSMADRKKINYDHPDAFDMPLLVEQLRQLMDYKAVEMPVYDFTAHTRSEKTIHTEPADIIILEGILVLGEENLRDLMSIKVFVDTDDDIRFIRRLERDTQERGRSVESVINQYLATVKPMYNQFIEPTKRYADIIVPEGGENDVAIDMLTTKIRSVLSTVK

SEQ ID NO: 3797 - DNA, 1497 bp, Ashbya gossypii
  CDS (1)..(1497)
atgaaacgggaagatagtacggaagaagagatacgtcctcgtagcgttggcccaccgttgaaacagcgcaatgctcggagctccagcaatatgcacttagtggcggacgaggaggaaagcacgccatcgtacatgccaccttggactacgccatacatcattggagttgggggcacgtcgggttccggtaaaaccagtgtggcgtcgaagattgttgcgtcgattaacacgccatggacagtattgatctcactggacaacttctacaagccactgtcggcggaggagcgcgcgagggcgtttaggaatgagtacgacttcgacgagccgcaagcactggacctggaccttgcataccagtgtctgttggcgctcaaggagggcaagaagatgacaatgccggtgtatagcttcgtgcaccacaaccgggtccctgacaagagcataacaatctacggtgcgtccgtagtggttctggagggcatatatgcgttacatgacaagagaattacagacctgatggacttgaaagtgtacgtggacgcggacctcgacatctgcttggcgcgcaggctatcgcgcgacataatctcgcgtggacgcaatctggaaagctgcatcagccagtgggagaagtttgtgaaaccaaacgcagacaagttcgtgaaaccgaccatgaagaatgcagatgccatcttcccatcgatgtcggataacagtattgcgactaagatgctgatcaaccacataaagtccaaattgcagaggaagtcccaggaccacattgataagcttgttcagcttggccatgaaaccatcccattggagactttggacactattcatcaactggagcgtaccaaccaggcctgttcgctgaagactatgattttggatagttcgttggatcgtgacgactttgtgttttacttcaaccgtattgcaacgatcttggtttcgcgggctttggatgacattgctatcgtgcgggatgaactgccattggtgactgcatccggatatcaactggagaagcctgttcatgtgaattttgacaagattacggctgtgaatattgtgcgctctggcgactgtttcatggcttccctacgcaaaacagtgccaaatatatccatcggtaaattgctcattcagtctgactctcaaacaggtgagccgcagttacattgcgagttcttaccagtgaacattggcggctctttcgaccaggtcctattgatggatgcacaaataatctcaggcgcagcaattatcatggctattcaagtgctagttgaccatggtgttgaactatcaaaaataaaggttattgtctacttagccactgaaattggaataagaaggataataaatgcctttaacaacaaagtagtcatatatgcgggcgaaattatatcagacgaaagtatgacagatggccaatgtaactgggcgaggttgagattcatcgactccagatactttggctgtgactga

SEQ ID NO: 3798 - protein, 498 aa, Ashbya gossypii
MKREDSTEEEIRPRSVGPPLKQRNARSSSNMHLVADEEESTPSYMPPWTTPYIIGVGGTSGSGKTSVASKIVASINTPWTVLISLDNFYKPLSAEERARAFRNEYDFDEPQALDLDLAYQCLLALKEGKKMTMPVYSFVHHNRVPDKSITIYGASVVVLEGIYALHDKRITDLMDLKVYVDADLDICLARRLSRDIISRGRNLESCISQWEKFVKPNADKFVKPTMKNADAIFPSMSDNSIATKMLINHIKSKLQRKSQDHIDKLVQLGHETIPLETLDTIHQLERTNQACSLKTMILDSSLDRDDFVFYFNRIATILVSRALDDIAIVRDELPLVTASGYQLEKPVHVNFDKITAVNIVRSGDCFMASLRKTVPNISIGKLLIQSDSQTGEPQLHCEFLPVNIGGSFDQVLLMDAQIISGAAIIMAIQVLVDHGVELSKIKVIVYLATEIGIRRIINAFNNKVVIYAGEIISDESMTDGQCNWARLRFIDSRYFGCD

SEQ ID NO: 3799 - DNA, 651 bp, Vibrio vulnificus
  CDS (1)..(651)
atgcaactaatgtctgaaaaaagtcaatgcgtcatcgtcggtattgctggcgcttctgcttctggtaaaagcctcatcgccagtacgatttataacgaactacgtgcaaaggtgggagaccatcaaatcggtgtgattacggaagattgctactataacgaccaaagccatctgagtatggaagagcgcgttaaaacgaactatgaccacccaaatgcacttgatcacgatcttctttgtgaacacttagaaaagttaatgaaaggcgagtcggttgaagtacctgaatacagctacacggagcacactcgtactgaaaacaccaccactatgacaccaaagaaggtgatcattcttgaaggcatcctgcttctgacggatcctcgtctgcgtgatttgatgcatgcgacagtgtttatggacacgccactggatatctgtctacttcgccgtgtgaaacgcgatgtggaagagcgtggtcgtacgatggaatcggtactcaaacagtatcaaaaaacagttcgcccaatgtttatgcagtttattgaaccgtctaaacagtacgcagatatcatcgttcctcgtggtggtaaaaaccgcatcgcgattgacgtactgaaagcgcacattgcaaaactattgaaagcttaa

SEQ ID NO: 3800 - protein, 216 aa, Vibrio vulnificus
MQLMSEKSQCVIVGIAGASASGKSLIASTIYNELRAKVGDHQIGVITEDCYYNDQSHLSMEERVKTNYDHPNALDHDLLCEHLEKLMKGESVEVPEYSYTEHTRTENTTTMTPKKVIILEGILLLTDPRLRDLMHATVFMDTPLDICLLRRVKRDVEERGRTMESVLKQYQKTVRPMFMQFIEPSKQYADIIVPRGGKNRIAIDVLKAHIAKLLKA

SEQ ID NO: 3801 - DNA, 630 bp, Porphyromonas gingivalis
  CDS (1)..(630)
atggtaatgaatacaacgataataggagtagcaggcggaagtgcttccggcaagagtacattggtgaaaaagctctgtgaggctttcgtcgaagaagatgtgcttgtactctgtcacgattactattacaaggccaatgaccacctctcccttgaggaaagaaagaagctgaactacgaccatcccaatgctttcgacacggatatgttcgtcagggatattctctctctgaaggcaggcaaaacgatagagcgtccggtctattctttcgtagagcacaatcgtttgcaagaaaaagtaaccgttcgtcctgccaaagtgatcgtactggatggaatcctgatattcgagaacaaagagctgcgggatctgatgaatgtgaaagtattcgtcgataccgatgcggatattcgattggcgcgccgccttgtgcgcgatgtccaggaacggggacgcaatatggattcggtattggcacaatacttcagtacggttcggcctatgcacgaggattttgtggaaccatccaagcggtacgccgatctgatcattccggaaggtggattcaattcggtggcgctctcactccttgtcgaaaaaatccgatcggtgattcgtaaggaagaataa

SEQ ID NO: 3802 - protein, 209 aa, Porphyromonas gingivalis
MVMNTTIIGVAGGSASGKSTLVKKLCEAFVEEDVLVLCHDYYYKANDHLSLEERKKLNYDHPNAFDTDMFVRDILSLKAGKTIERPVYSFVEHNRLQEKVTVRPAKVIVLDGILIFENKELRDLMNVKVFVDTDADIRLARRLVRDVQERGRNMDSVLAQYFSTVRPMHEDFVEPSKRYADLIIPEGGFNSVALSLLVEKIRSVIRKEE

SEQ ID NO: 3803 - DNA, 642 bp, Photorhabdus luminescens
  CDS (1)..(642)
atggctgacgaagcatatcagtgcacaattgtaggaatttctggtgcatctgcctcaggtaaaagtctcattgctaatacactttatcgtgaattacgcgctcaggttggtgatcacaatatcggtattatacccgaggattgctattataaagatcagagcgatctatcaatggaagagcgttataagactaattatgaccatccaagctcaatggatcacaatctgctcttttctcacctacaagcgctgaaaatgggtgaatcaattgaattaccacaatacgattatgttgctcatactcgtaaaccagaagcgattcattttgcaccgaaaagggttattattctggaaggtattctattattgaccgataagcgcttgcgccaggagatggacttctctatttttgttgatacgccactggatatttgccttatgcgtcgtattaagcgggatgtgcatgaacgggggcgttctctggattcggtgattgagcaatatcataaaactgtgcgtccaatgttcctgcaatttattgaaccatcaaagcaatatgcagatattattgtgccgcgcgggggtaaaaaccgagtagcaattgatatattgaaagccaaaattggtcagttctgcgaataa

SEQ ID NO: 3804 - protein, 213 aa, Photorhabdus luminescens
MADEAYQCTIVGISGASASGKSLIANTLYRELRAQVGDHNIGIIPEDCYYKDQSDLSMEERYKTNYDHPSSMDHNLLFSHLQALKMGESIELPQYDYVAHTRKPEAIHFAPKRVIILEGILLLTDKRLRQEMDFSIFVDTPLDICLMRRIKRDVHERGRSLDSVIEQYHKTVRPMFLQFIEPSKQYADIIVPRGGKNRVAIDILKAKIGQFCE

SEQ ID NO: 3805 - DNA, 645 bp, Mycoplasma gallisepticum
  CDS (1)..(645): transl_table=4
atgaaaaacgtgcagccaatgatcattgcaatagctggtggtagcggttctggtaaaacaacaatcacccaatcaattattgccaagattaaaagtgataccaacctaaaagtggcaactgtttgtttagataattattataaaccgtttagtgatctaaatcttgaagctagaaaaaagctgaactatgatgatcccaatagttttgactttgatcaagtttattatgatctgttagctttaagcaataaccaaacaatcaagatgccaatctatgattataaaaactacactagatcagatcagtttactgagattgatccatctgatgtaatcttatatgaagggatcttatctttatatgattcaaggatcttggatctatcaaaatttaagttatttattgataccccttcagatgaacgattagctagacggatcgaacgtgactgtttagagcgtgctagagatatcaaacaagtcttaaaccaatgacgttcacaagtcagagtaatgcatcgtaaatacgtgcaaaaacaaaaagagggcgctaatctcatcttaccttggtacaccttaaaccacgaggggatgagtattattcaaaacgcaattattaagatcgcacaaggcaatgaattttaa

SEQ ID NO: 3806 - protein, 214 aa, Mycoplasma gallisepticum
MKNVQPMIIAIAGGSGSGKTTITQSIIAKIKSDTNLKVATVCLDNYYKPFSDLNLEARKKLNYDDPNSFDFDQVYYDLLALSNNQTIKMPIYDYKNYTRSDQFTEIDPSDVILYEGILSLYDSRILDLSKFKLFIDTPSDERLARRIERDCLERARDIKQVLNQWRSQVRVMHRKYVQKQKEGANLILPWYTLNHEGMSIIQNAIIKIAQGNEF

SEQ ID NO: 3807 - DNA, 930 bp, Gloeobacter violaceus
  CDS (1)..(930)
atggcacaacgtccgatcattctcggcatcgtcggcgacagcgcggcgggcaagaccaccctgacgcgaggcctcgcccagatcctcggccccgacaatgtcacgatcatctgcaccgacgattaccatcgctacgaccgcaagcagcgcgccgaactggggatcactgccctgcaccccgattgcaactacctcgacatcatccagcagcacctcgctttgctgcgcaccggccagccgatcttaaagcccatctacaaccacaaaaccggtaccttcgatccgcccgagtacatcaaaccgcgcaattttgtggtggtcgaggggctattgggtttctcgacgcgggggatgcgcgattgctacgacgtcaaagcctacctggctcccccggagtcgctgcgtacccgctggaaaatcaggcgtgacaccgccaagcgcgggtactccgaggagcaggtgctgggcgaaatggccaagcgcgaacccgactcggagcagtttatccggccccagcgcagcacagcggacctggtggtgagcttctacccgggccagaacggccccgatacccagctcaacgtgcggctggtgctcagaccgaccattccccacccggacttcgtggatgtcatcgagcgcagcggcgcccacacccgctcggcggtgcgcgtcgaactggaccgcgacatgggcaagcccgtcgatgtgctcgaagtggacggccatgccaccgacgagcaggtcaaagaactccaggatgtgctctgcgaagagatggccaacggctcgcagctgtgcaatatccccgcggacctgggcaaggtgaccggcaccaccggcgaaacgctgcagagccatccactcgccatctcgcagttgctgatcacctaccacatgctcaaagcctcgcggggcgtctacgtttag

SEQ ID NO: 3808 - protein, 309 aa, Gloeobacter violaceus
MAQRPIILGIVGDSAAGKTTLTRGLAQILGPDNVTIICTDDYHRYDRKQRAELGITALHPDCNYLDIIQQHLALLRTGQPILKPIYNHKTGTFDPPEYIKPRNFVVVEGLLGFSTRGMRDCYDVKAYLAPPESLRTRWKIRRDTAKRGYSEEQVLGEMAKREPDSEQFIRPQRSTADLVVSFYPGQNGPDTQLNVRLVLRPTIPHPDFVDVIERSGAHTRSAVRVELDRDMGKPVDVLEVDGHATDEQVKELQDVLCEEMANGSQLCNIPADLGKVTGTTGETLQSHPLAISQLLITYHMLKASRGVYV

SEQ ID NO: 3809 - DNA, 996 bp, Gloeobacter violaceus
  CDS (1)..(996)
atggtcagtacgttggaccgagtggtcctgatcggtgtcggtggggattcgggttgcggcaagtcgacattcctcaggcggcttaaagatctgttcagcaaggagcttgtcacggtcatctgcctcgatgactaccactcgctcgaccgcaagcagcgcaaagaaacgggtattaccgccctcgacccgcgcgccaacaattttgatctaatggccgagcaggcgaccgccctcaaggtcggccagtcgatcatgaagcccatctacaaccacgagacgggcaaaatcgacccgcccgagctgatcgagcccactccgatcgtcattctcgaagggctgcatcctttttacgacgcgcgcgtgcgcaacctatttgacttcaagatctacttcgacctatccgatccgatcaagattcagtggaagatccagcgcgacatggccgagcgcggccacacctacgaagatgtcctcaagcagatcgaatcgcgccgcccggacttttcggcctacatcgacccgcagaagcagtacgccgatgtggtgctgcagattctgcccagtgagcttcctgaaaaagcaggcggtatcaagcgcgtcaaagcctgcatggtgcaggtggacggcatccccaactacgacgcgccctacctgttcgaccgggccatttccgatgtgtgctggaagcccaattttcccaactcggatgaagagctgaccttctgctacggcacccaggattacttcggccgcccggcgtcctacctgtcgatcgacggcgagtttgctccggaggattctcccgaactggaggagaagctgcgcaacaccagcgagacgcgctacggcgaactcgcctcgctcatcctcaagcacaccgattaccccggctcccgcgacggcaccggctttttccaggtgctcatgagcctcaagttccgcgccatctacgaagcgcttaccgcccaattgctgacggcttccaaggccaagtag

SEQ ID NO: 3810 - protein, 331 aa, Gloeobacter violaceus
MVSTLDRVVLIGVGGDSGCGKSTFLRRLKDLFSKELVTVICLDDYHSLDRKQRKETGITALDPRANNFDLMAEQATALKVGQSIMKPIYNHETGKIDPPELIEPTPIVILEGLHPFYDARVRNLFDFKIYFDLSDPIKIQWKIQRDMAERGHTYEDVLKQIESRRPDFSAYIDPQKQYADVVLQILPSELPEKAGGIKRVKACMVQVDGIPNYDAPYLFDRAISDVCWKPNFPNSDEELTFCYGTQDYFGRPASYLSIDGEFAPEDSPELEEKLRNTSETRYGELASLILKHTDYPGSRDGTGFFQVLMSLKFRAIYEALTAQLLTASKAK

SEQ ID NO: 3811 - DNA, 1038 bp, Gloeobacter violaceus
  CDS (1)..(1038)
atggaaacccttaccgcaacagagacgcagcctatgaccaactctgtgcaatttgtctgcgccacggcgcgtcaacaactcaaacagttgcgatctccgattattgttggtgttgcaggcgacagcggcagcggcaaaaccacctacagcaacggcattcgtcgcctgctgggaagcgatctggtttcgacgctctgcacggacggctaccacaaagaggaccgcgaacagcgccagatcagcggccgtctgcccctggacccggcggccaaccacctggaccggttggccgagcacctcaaagccctcaaacagggaaaggccgtgcccatccccgtctataaccacggctcgggcaagtttgagcagcccgagaattttgtgccgacgccgattgtcgtcgtggaaggcttgcatacgctgtacccggaattgatcccgtacctcgatttcagcctctacgtcgatccggatcatcccgtcaagtggcagtggaaatgggagcgcgacctcaagcgccgcggtcacaaagccgaacagctcgagcaggagatgctgcagcgcgaagccgccttcaagcgttggatcgattttcaaaagattgacgccaacgtggtgatcaaaatttttcatagccaactgcagtgccttgccccccaccagttcaccggcatcctgcccaacccgtgctacaaagtggaactgatcctgcagccggctcctgtgccgctgccgacgttgcccctgccatttgatctcgcggcgatgctcgccgtcgaccagcccccttttatgctggcggcggtcccctaccgctactgggggcgctcggcgattgccattcacctcgacggtgtgctgtcgcaaaagaccatcgccgggctcgaagactatatcgttaactacacaggcattcccacggatgaggccattccggaggagcagtacgagctgacatcggctacccgcttcgcccaactgttgattacctggcgctttttggagcaaatcaactatttgcttcaaaaaaaccgatag

SEQ ID NO: 3812 - protein, 345 aa, Gloeobacter violaceus
METLTATETQPMTNSVQFVCATARQQLKQLRSPIIVGVAGDSGSGKTTYSNGIRRLLGSDLVSTLCTDGYHKEDREQRQISGRLPLDPAANHLDRLAEHLKALKQGKAVPIPVYNHGSGKFEQPENFVPTPIVVVEGLHTLYPELIPYLDFSLYVDPDHPVKWQWKWERDLKRRGHKAEQLEQEMLQREAAFKRWIDFQKIDANVVIKIFHSQLQCLAPHQFTGILPNPCYKVELILQPAPVPLPTLPLPFDLAAMLAVDQPPFMLAAVPYRYWGRSAIAIHLDGVLSQKTIAGLEDYIVNYTGIPTDEAIPEEQYELTSATRFAQLLITWRFLEQINYLLQKNR

SEQ ID NO: 3813 - DNA, 615 bp, Chromobacterium violaceum
  CDS (1)..(615)
atgagcaccccgttcatcattggcgttgccggcggcagcggcagcggtaaaaccacggtaaccaacaaggtgctggaaaccattggttccgagatggcggcggtgatcatccaggactactactatcgcgaccagagccacctgaccttcgagcagcgcctgggcaccaactacgaccacccgcaggccttcgactggccgctcttgatctcccacatcgacgacctgcgcaacggccgcgcgatcgagatgccggtgtacgacttcgccaaccacacccgttccgaccagaccgtcaccgtgcagcccgcgccggtgatcgtgatcgagggcctgttcccgctgtacgacgccgccttgcgcgagatgatgtcgctgaagatcttcgtcgacactgactccgacgtccgcttcatccgccgcctcaagcgcgacatcgccgagcgcggccgcacgatggagagcgtgatcgagcaatacctgtccaccgtgcgcccgatgcacaaccagttcatcgagccgaccaagcgcttcgccgacgtgatcctgccgcacggcgccaacgatccggcggtggacatcatcaccaccaaggtcgccagtctgatggtgtga

SEQ ID NO: 3814 - protein, 204 aa, Chromobacterium violaceum
MSTPFIIGVAGGSGSGKTTVTNKVLETIGSEMAAVIIQDYYYRDQSHLTFEQRLGTNYDHPQAFDWPLLISHIDDLRNGRAIEMPVYDFANHTRSDQTVTVQPAPVIVIEGLFPLYDAALREMMSLKIFVDTDSDVRFIRRLKRDIAERGRTMESVIEQYLSTVRPMHNQFIEPTKRFADVILPHGANDPAVDIITTKVASLMV

SEQ ID NO: 3815 - DNA, 2049 bp, Giardia lamblia ATCC 50803
  CDS (1)..(2049)
atgcgcacggttcaggtcaccactcccaccgggcataccattacggtccttgcgcgcatgcatatctacgacatcatacgcatgtacccagacgaattccctagtgatgggcatccgttcatcgtctgcacggtcaacaacgaacttacctcgctttccgaaaaggtgggcgttaattgcacccttgtcccatactctgtggccacaacggatggcgcggagtgctatcgcaggtcgctgatcttcgctttgggcaaggtctggtctgagttgttcccccaagactcacttcagatttctcactcgcagggccactcctactatctatacgttgataatagctccaagaatcttcagatggaggatataaagaccacggacatctgtgcacatggcccaaaggaagatgctaatcacgacgtctgcataacaaatgcttcatcgatgtttttcagcaatgacaaacatattacggaagagatcgttaccaatttgcgacaggagctgaacttgttgatcaaggctaaccgccctatctctagcaacattcccatgaatgctaatgacttggagacagccttggagagcgtctcggactataactctgtcgccctcctcaagtccctcaatgaggttcgtgtgatgaccgtaaggtgcgacgactatgtgcaaatttatcacactcctctggcacctgtcacaggtcttcttaagtactacgatcttcatacttacaaagatgggtttgtcataagcttcccatctaaacgctcccctactgagctcattcccttcaagcccaatgaactgttacacgacgtatatagcgaatacacgcagtggatccgcgtcttgaaagttcggactatcgggcacttgaacaatttgtgctacaagggcatgattaagagtttcatccaaatctgcgaaaccatgcagaacaagaagcttgctgagctttgtgacgtaattgccaacaatagagagtatcttcagcaataccagaaggctacgcgagccgccaactacactctcgggatgagtctccgaatcgacggagacagtggtgtgaactcccgtagcatcaaggtagactctaaaacgatgtcacaggagctagtggacgcaagggtgtctactagctctactggcacatcggattctgaagtggagcccggtatgctgacctctgccgaagtgtctaattgctatgcacccgtctctaacattgaggacaaggagatcaaggttgtattcatatcaggtccaagctctagcggcaagacgaccttcgccaagaagctcgcatataatctcaaggttatgggccgcgaacctcttatcatttcgcttgacaactatttcgttgaccgggagaagaccccactggcagaggatgggagctatgacttcgaacatgttaacgccctggatcttgatctctttaacgatcatctcgaggcacttatcagcggaaagaagattctcagcccaatctttgatttcaggacaggtacaagaaagcaatccaccatagaaatgataatgcctttcagggggatcatcatcatcgagggcatccacgctctcaatcctctcctcagcaggagaatccctctgcctaacaagatcttggtctttattgctcccttcactgccatcaacatggacgaccgcatgcggatctcctccagggattgtcgccttatcagacgcattgtgcgcgacaacaatttccgcggtttcacggctgaaaagacaatcgagctactgaagaatttgcgtgtaggagaagataggtggatctatccccatcagcacagggccgatatcatgttcaatacggcgttggactatgagctatgtgtccttaacacgcatgcctacccattgctttgtgagatcaagcccgacagctctgcatacaaggaggcacgacaacttatcgccctcctagaaaaagttgcttccattaatagcgagtttgttcctaaattcagcctattaagagagtttatcggcggaagcggcatgccagataaggactag

SEQ ID NO: 3816 - protein, 682 aa, Giardia lamblia ATCC 50803
MRTVQVTTPTGHTITVLARMHIYDIIRMYPDEFPSDGHPFIVCTVNNELTSLSEKVGVNCTLVPYSVATTDGAECYRRSLIFALGKVWSELFPQDSLQISHSQGHSYYLYVDNSSKNLQMEDIKTTDICAHGPKEDANHDVCITNASSMFFSNDKHITEEIVTNLRQELNLLIKANRPISSNIPMNANDLETALESVSDYNSVALLKSLNEVRVMTVRCDDYVQIYHTPLAPVTGLLKYYDLHTYKDGFVISFPSKRSPTELIPFKPNELLHDVYSEYTQWIRVLKVRTIGHLNNLCYKGMIKSFIQICETMQNKKLAELCDVIANNREYLQQYQKATRAANYTLGMSLRIDGDSGVNSRSIKVDSKTMSQELVDARVSTSSTGTSDSEVEPGMLTSAEVSNCYAPVSNIEDKEIKVVFISGPSSSGKTTFAKKLAYNLKVMGREPLIISLDNYFVDREKTPLAEDGSYDFEHVNALDLDLFNDHLEALISGKKILSPIFDFRTGTRKQSTIEMIMPFRGIIIIEGIHALNPLLSRRIPLPNKILVFIAPFTAINMDDRMRISSRDCRLIRRIVRDNNFRGFTAEKTIELLKNLRVGEDRWIYPHQHRADIMFNTALDYELCVLNTHAYPLLCEIKPDSSAYKEARQLIALLEKVASINSEFVPKFSLLREFIGGSGMPDKD

SEQ ID NO: 3817 - DNA, 1425 bp, Neurospora crassa
  CDS (1)..(1425)
atgcgcggcgacaccccccgcgacctcgtcgacagcctcacagacggcatcaagggcctcgacgtgcgcgtggtcgagaacccggacagcaccattgccaagcgggcgcactacgcgcctccgtgggccgatgtcagcatcatcggcatcgctggtagttcggggtcgggcaagtcgacgctgtcgcaggcgattgtgaagaagctgaacctgccgtgggtggtgattttgtccatcgactcgttctacaagagtttggatgccgagtcgagcaggaaggcgtttatgaatgagtatgattttgattcgcccgaggcactggattttgatgtcctggtagatcggttgcaggacctcaaggctggcaagcgtgcagagattccggtttactcgtttgagaaacatgctcgtctcgaccggactaccgccatttactcgccacacgtcctcattcttgagggtatctttgctctctacgatcctcgagttcttgaactgctggatatgaagatcttctgtgaggctgatgccgacacttgcctttcccgaagaattttgcgtgatgtgaaggatcgtggtcgcgacgttgatggcatcatcaagcaatggttcaactatgtcaagcccaactttgaaaagtttgtcgacccccaaagaaaggtggccgacattatcgtcccccgcggtgtcgagaaccacgtggctatgaccatggtaacccaattcatccaacaaaaactgctcgaaaagtccaaacgccaccgcgccgccctgacccggttggaatcgcaagcgcgccaccagcccttatccaacaaggtcgtccagctcgaccagaccccgcagctgcgcggcatgaacacgctcatccacgacatcgacacgtccaaggaggactttatcttttacttcaaccgcttcacgaccttactgatcgaaaaggccatggacaacatcccctttgcatccaccaccatcacgaccccgctcaaccgcgaatacgccggtctgcgaccgcgaggccaagtctcggccgtggtcgtgctgcgcggcggcgccgctctggaggccggactgaaacgggtgttgcccgactgcaagacgggccgggtgctgatccagagtaacatgcgcacgggcgaaccggaactgcattacctggcgctgcccaaggacattgaccagcacgaggcggtgttgctgctggatgcgcagatgagcagtggcggatcggcgctgatggcggtgcaggtcctggtggatcacggcgtcaagatggaccggattgtgctggcgacgtatagcgcgggcaggttggggctgcataggctgacgacggtgtttccggaggtgacggtggtggtggggaatgtgattcaggatgtggaggagcggtgggtggaaaagaggtatttcaggtgttaa

SEQ ID NO: 3818 - protein, 474 aa, Neurospora crassa
MRGDTPRDLVDSLTDGIKGLDVRVVENPDSTIAKRAHYAPPWADVSIIGIAGSSGSGKSTLSQAIVKKLNLPWVVILSIDSFYKSLDAESSRKAFMNEYDFDSPEALDFDVLVDRLQDLKAGKRAEIPVYSFEKHARLDRTTAIYSPHVLILEGIFALYDPRVLELLDMKIFCEADADTCLSRRILRDVKDRGRDVDGIIKQWFNYVKPNFEKFVDPQRKVADIIVPRGVENHVAMTMVTQFIQQKLLEKSKRHRAALTRLESQARHQPLSNKVVQLDQTPQLRGMNTLIHDIDTSKEDFIFYFNRFTTLLIEKAMDNIPFASTTITTPLNREYAGLRPRGQVSAVVVLRGGAALEAGLKRVLPDCKTGRVLIQSNMRTGEPELHYLALPKDIDQHEAVLLLDAQMSSGGSALMAVQVLVDHGVKMDRIVLATYSAGRLGLHRLTTVFPEVTVVVGNVIQDVEERWVEKRYFRC

SEQ ID NO: 3819 - DNA, 612 bp, Synechococcus sp
  CDS (1)..(612)
atgaccccgctatggcctgttctttgcatctgtgggccttccgcggccggcaaaaccacctttgcggcgtccctttcgcaagccctgcaggcccgcggtcgtcagcctctgcagatcgcctgcgacgactactaccgccaggattggagtccccatccgctgttcggcttcgacaccgccgatgccatcgatgatcaggccctgcgcgttgatctttcagcggcacgtcaggggcaggcccagaccttgcgcacgtacgacatgcgcacccgccgcgttcagcgtcggtcgatcacaactccctacgacgtgatccttctggaaggtgcctacggacctcagcacctggtgagcgatttccctttctttttggtgatttacctggaggagtccgtgccccggcgactgtggcgtcgtttgcggcgggacgtccgcgatcgccatcgttccccccgctatgtgatccgtcagatgtttcgagagatgctgcctggggaacggcatttcatcgaacccctcaaacagaacgccagtgttgtgatccgcgatcagtccaaggggcttgaccaggttctggctctgttgggatctgttgcttcagacgacgtctga

SEQ ID NO: 3820 - protein, 203 aa, Synechococcus sp
MTPLWPVLCICGPSAAGKTTFAASLSQALQARGRQPLQIACDDYYRQDWSPHPLFGFDTADAIDDQALRVDLSAARQGQAQTLRTYDMRTRRVQRRSITTPYDVILLEGAYGPQHLVSDFPFFLVIYLEESVPRRLWRRLRRDVRDRHRSPRYVIRQMFREMLPGERHFIEPLKQNASVVIRDQSKGLDQVLALLGSVASDDV

SEQ ID NO: 3821 - DNA, 654 bp, Haemophilus ducreyi
  CDS (1)..(654)
atgccagaaaccattgaaaatcaagcttgtatcgttattgctattgcaggtgcttctgcttcaggtaaaagccttattgcttctaccatttataaagaactgaaagaagaattagattccaatgatatcgatattatttctgaagatgcttattataaagatcaaacgcatttaacgatggatgaacgtgagcaaaccaattacgatcatcccgattcaatggttcactatctattagttgaacaccttcgccaactaaagcaaggaaagcccattcaaattcctgaatatgattatgctaagcacaatcgaaaaacatctagtaagcattttgaacccaaaaaaattattattttagaaggcattttattgttaacgcatgaaacaatccgcaatgaaattaatgtttcaatctttgttgacgcgccattagatatttgtttcattcgccgtttacagcgtgatttaatcgaacgtggtcgctcaatggattcggtcatatcgcaatgccgaaaaactgtccgcccaatgtttttaaaatttattgagccatctaaacaatatgccgatattattatacccaaaggcggtaaaaaccggattgcgatcgatatattaaaagcccaaatcaaacaattattatcaaaaaaatag

SEQ ID NO: 3822 - protein, 217 aa, Haemophilus ducreyi
MPETIENQACIVIAIAGASASGKSLIASTIYKELKEELDSNDIDIISEDAYYKDQTHLTMDEREQTNYDHPDSMVHYLLVEHLRQLKQGKPIQIPEYDYAKHNRKTSSKHFEPKKIIILEGILLLTHETIRNEINVSIFVDAPLDICFIRRLQRDLIERGRSMDSVISQCRKTVRPMFLKFIEPSKQYADIIIPKGGKNRIAIDILKAQIKQLLSKK

SEQ ID NO: 3823 - DNA, 1609 bp, Chlorarachnion sp
  CDS (10)..(1464)
tcatacggcatgctgcctgagactgcgagggtcgttcagccaaagaagaccaatgtctacgcaatcgcttccgtcgttgccaacgttgctctagtcggagctctcctctacacccaaacgggcgaagttggagcttcagttgcagcatcgtctcgcgtacacgttgctcctcgcatggttgctcctaagttttccatgtctggacttcgccctgctcaacgcgaagctcgcgttgctgcacacggaaagggagttgtttcaactgtagcccttgatgctcctgtcgcaacttctgaggatagcatgacctggagctcagcaaagggtaatgaagttgacgctggaatgggacaagttcacatcgaggctgctatctccaacgaagtctctcctgtcatggctcagaagaacatccagcgccctgttatcttcggtgttgctgctgactctggatgcggaaaatccaccttccttcgtcgtgtgaatgcaatcttcggaaccaccacctccaaggctcacactcctactggagatcttattactaccatttgcctcgatgacttccacactctcgaccgtaccggaagagccgacactggtatctccgcgcttgatgttcgcgctaacaacttcgcgcttatggccgaccagttgaaggctttgaagcaaggacgtgctatcaagaagccaatctacaaccacgacaccggagctatcgatcctgttgaaactatccaccctaaccacatcatcattgttgagggtcttcaccctatgcttgacaaggatgtgattgaatcccttgacttcaccttctacatcgatgtttccgatcctgtcaagaaggcttggaagatcgaacgtgatatggtcgagcgcggacacaagaaggaggacatcattgcttccatcgaatctcgcaagcctgacttcgagaagtttgttgagcctcaaaaggcaaacgctgatgtcattatttccattgagcctaccaagctggatgttgctcctggcgaggagactaaatacctcaacacccgtctcattcagagggagaaccagcacggtatccgccctgtgtacatgttcgaggaggaaggatccaccgtcgactgggacccatgtgcgggccctggtgctatggcttgcccttaccctggaacacgcgttcgttactacaacgagatgtctggtgagaagcacgctcacgtccttgaggttgatggagttttcggagaaaccgaggagctcttcttcatcgaggaacgcctctcgaatactaacacgaagtacttcggagagcttactaagcagatgcttaagaacaaggctgcccctggttccggtgatggatccggtcttatacaggccctcgttgctcttaaaatgcgtgaatcttacgagagattcactggacgtaccatccagattccaaagtggggacttttcctcgatgattattagatcatcaaggtagtctcagtcgcaaccccagtgatcctgctttcttttaagctttactctgcttctaggcaaatatgcatttgttgaaaagttgacgaaattcctaaatgaaaacaaaataacaggaaagctatttacttttaaa

SEQ ID NO: 3824 - protein, 484 aa, Chlorarachnion sp
MLPETARVVQPKKTNVYAIASVVANVALVGALLYTQTGEVGASVAASSRVHVAPRMVAPKFSMSGLRPAQREARVAAHGKGVVSTVALDAPVATSEDSMTWSSAKGNEVDAGMGQVHIEAAISNEVSPVMAQKNIQRPVIFGVAADSGCGKSTFLRRVNAIFGTTTSKAHTPTGDLITTICLDDFHTLDRTGRADTGISALDVRANNFALMADQLKALKQGRAIKKPIYNHDTGAIDPVETIHPNHIIIVEGLHPMLDKDVIESLDFTFYIDVSDPVKKAWKIERDMVERGHKKEDIIASIESRKPDFEKFVEPQKANADVIISIEPTKLDVAPGEETKYLNTRLIQRENQHGIRPVYMFEEEGSTVDWDPCAGPGAMACPYPGTRVRYYNEMSGEKHAHVLEVDGVFGETEELFFIEERLSNTNTKYFGELTKQMLKNKAAPGSGDGSGLIQALVALKMRESYERFTGRTIQIPKWGLFLDDY

SEQ ID NO: 3825 - DNA, 630 bp, Enterococcus faecalis
  CDS (1)..(630)
atgaaagatagtcagccaattatcattggtgttactggcggatcaggaagcggaaaaaccagtgttagccgtgcgatttttaataattttcccgatcattcaattatgatgttagaacaggattcttattataaagatcagagccatttgagttttgaagaacgtttaaataccaattatgatcatccttttgcgtttgatacagatttattgattcaacatgttgaacaactgttaaattatcaagccattgaaaagccagtttatgactacgttgcgcatacaagaagtacagaaacggtgatacaagaaccgaaagaagtaattattcttgaagggattttaattttagaagatcgccgcttaagggatttaatggatattaaagtgtatgtggatacagatgatgacatccgtattattcgtcgaatcaagcgtgatatggaagaacgtggccgtacgttggattctgtgattgaacaatatttgacagtcgtcaagcccatgtatcaccaatttattgaacctacgaaacgttatgcagatatcattgtgccagaaggtggcgaaaaccacgtcgctattgatttaattaatacaaaagtggatagtattttaacaaaaatgtaa

SEQ ID NO: 3826 - protein, 209 aa, Enterococcus faecalis
MKDSQPIIIGVTGGSGSGKTSVSRAIFNNFPDHSIMMLEQDSYYKDQSHLSFEERLNTNYDHPFAFDTDLLIQHVEQLLNYQAIEKPVYDYVAHTRSTETVIQEPKEVIILEGILILEDRRLRDLMDIKVYVDTDDDIRIIRRIKRDMEERGRTLDSVIEQYLTVVKPMYHQFIEPTKRYADIIVPEGGENHVAIDLINTKVDSILTKM

SEQ ID NO: 3827 - DNA, 648 bp, Coxiella burnetii
  CDS (1)..(648)
atgaaaaataatgtcattattattggtatctctggaccttctgcttcggggaaaagcttgttagcgaataccatcgttaatgaactcggctctgatcaagtcgtcgttatttcagaagattcttattataaagatttaggagatatgccttttgaagagcgagcaaaaatcaattacgaccaccccgactctcttgaccatgaactattgtatcaacatttattacaactgcagcaaggcaatgccatcgcggtgccttgttacgatcacagccggcacaggcgattggaaaaaacaaaaaccgtaggtcggcatcgcattattgttttggaaggtattttattattcgtagaggctcaattgcgtgaaattatggatattcgaatattcatggacactccattagatatttgtctattgcggcgattgcaaagggatatcgtcgagcgagaacgctcgttggaaggcgtgctcacccaataccaagaaacggttcgacccatgtatttgcaatttacggaaccttccaaacgctacgccgatattatcgtgccgcggggcggcgagaaccgaattgctatcgaaatgattcaagccaaaatgcgggagctgttaggcgtcaatggggccttgaaaaggcacgcctga

SEQ ID NO: 3828 - protein, 215 aa, Coxiella burnetii
MKNNVIIIGISGPSASGKSLLANTIVNELGSDQVVVISEDSYYKDLGDMPFEERAKINYDHPDSLDHELLYQHLLQLQQGNAIAVPCYDHSRHRRLEKTKTVGRHRIIVLEGILLFVEAQLREIMDIRIFMDTPLDICLLRRLQRDIVERERSLEGVLTQYQETVRPMYLQFTEPSKRYADIIVPRGGENRIAIEMIQAKMRELLGVNGALKRHA

SEQ ID NO: 3829 - DNA, 1659 bp, Clostridium tetani
  CDS (1)..(1659)
atggaaaaattaaaaataaacttagaggggaaaaaagaagttttaatagaaaaaggaaaaactttgagggatatattagaaaatattcatgttgaaaataagtttcctatagtgttaggagaaatgaatggaaaagtatacgaattaaattcaccaattgtcgaagagggacaattagaatttatagacttaggtagtgatactgggaatagagcatatataagaacacttcaatttatacttataaaagctactttagaagagttccctggagcaaatatttcaatacaacattcattaagtaagggattatattgtgaaataagcaaagggaagattttaactgaaaaagagcttgagaaaataaaagcaagaatgaaagaaataatatataaggatatgcctataaaagaagaatactttacaaaagaagaaactatggaaatgcttaaaaaatacaatatgaatgatagaataaaacttcttagcaatttgcagttagataaaataaaattgtatgaactagatggagtatatgagtatttttatggacctatgggagaaagtactggtattataagagaatttgatttaatgtattatgaaccaggatttatattaagatatcctactaaagaagaaccagatagattacctgttttcctagaacatagaaaacttgctaatatatttagagaaacagagatatggggagatatattagaggtgccaaatgtaggatcattaaacgaaaaggtaaacagtggagagataattgacataatcagggtatctgaagcattacatgagaaaaaagctgctaatatagcggatataataaaagatagagagaatataaggttaatattaatagctggtccatcctcatcaggaaaaactacttttgcaagaagacttgcaatacaacttagagtaaacggtctaatacccattcctataggtttagatgattattttgtggaaagggacgatactccaaaggatgaaaatggggagtatgattttgaatccatacatgctgtggacttagaacttttcaatgaacatttaactaggatattaaaaggagaagaagtgcacatacctaaatacaattttataacaggaaaaagagactggaatggtacaaaagtaaaattaccgttaaacggaatattaattgtagaaggaatacatggattaaataatttattaacttcttctatagctgatgaaaataaatttaaagtatatataagtgctttaacacagttaaatttagataatcacaacaggatagctactacagatgtaagaatgattaggagaatagtaagggataatatgtcaaggggatatagtgcagaagaaactttaaaaatgtggccttctataagaagaggtgaggaaaaaaatatatttgtatttcaagagaatgcagatattatgtttaactctactttagtttatgagttgtgtgtattaaagaaatttgccctaagagaactacaaaaaatagagcctacaagtccagtatatttagaagcttacagattaaaaagtattttaaatttctttaaggaagttgatacgtcgcacatacctgaaaattcaatattgagagagtttataggtggaagttggtttcatgatcattaa

SEQ ID NO: 3830 - protein, 552 aa, Clostridium tetani
MEKLKINLEGKKEVLIEKGKTLRDILENIHVENKFPIVLGEMNGKVYELNSPIVEEGQLEFIDLGSDTGNRAYIRTLQFILIKATLEEFPGANISIQHSLSKGLYCEISKGKILTEKELEKIKARMKEIIYKDMPIKEEYFTKEETMEMLKKYNMNDRIKLLSNLQLDKIKLYELDGVYEYFYGPMGESTGIIREFDLMYYEPGFILRYPTKEEPDRLPVFLEHRKLANIFRETEIWGDILEVPNVGSLNEKVNSGEIIDIIRVSEALHEKKAANIADIIKDRENIRLILIAGPSSSGKTTFARRLAIQLRVNGLIPIPIGLDDYFVERDDTPKDENGEYDFESIHAVDLELFNEHLTRILKGEEVHIPKYNFITGKRDWNGTKVKLPLNGILIVEGIHGLNNLLTSSIADENKFKVYISALTQLNLDNHNRIATTDVRMIRRIVRDNMSRGYSAEETLKMWPSIRRGEEKNIFVFQENADIMFNSTLVYELCVLKKFALRELQKIEPTSPVYLEAYRLKSILNFFKEVDTSHIPENSILREFIGGSWFHDH

SEQ ID NO: 3831 - DNA, 1674 bp, Bacteroides thetaiotaomicron
  CDS (1)..(1674)
atgaaacagatgttacaaatatgttgcaaaaataataatatttataaagaattccctatcggaagctcacttttggatatttattacggttttaatcttaattttccttatcaggtagtcagtgccaaggtgaataaccgttccgaaggtctcaatttcaaagtatataataacaaggatatagagtttctggatgtgcgcgattcatccggtatgcgtacgtatgtgcggtcactctgctttgtcttgttcaaggctgtcagtgaactttttcccgaagggaagctgtttgtggaacacccggtatccaaaggttatttctgtaatctgcggatcggccgccccattacattggaagatgtgacgcgtatcaaacagcgtatgcaggagattatcgcagaaaatatctcttatcaccgcatcgaatgccatacggctgaggccgtgcgtgtgttcagcgaacgcgggatgaatgataaggtgaggctgctcgaaacttccggttcgctatatacctattattatacgctgggcgatacggtcgattattattatggcaatctgctccccagtaccggatatatcaagttgttcgacatcgtgaaatactatgatggcctgctgctgcgcattcccaataaagagaatccggatgtgctggaggaagtggtgaagcaggagaagatgctggatgtatttaaggagtatctcaactggagttatatcatgggacttaataacgccggcgactttaacctcgcctgcgaagaagggcacgctacggatttaatcaatgtagcggaagcgttgcaggaaaagaaaatagcccagattgccgatacgatcttccatcgtggggaaaacggtgaccgggtgaaactgattttgatttccggtccgtcctcttcgggtaagaccactttcagcaaacgtctttccatccagttgatgacgaacgggctcaaacccttcccgatctccttggacaattatttcgtagaccgtgaagagacacctctggatgaaaacggtaactatgattatgagtctctgtatgcgctcgatctggaattgtttaaccagcagttgcaggctttgctgcgcggtgaggaagtggagcttccgcgctttaacttctctctggggaagaaggaatataaaggtgataaactgaaaattgaagataatacgattctcattctggaaggtattcatgcgttgaatccggaactgacaccgcatatcccggatgaaaagaagttcaagatttatgtctcggcattgaccactatttctttggacgatcataactggattcctacgacagacaatcgtttgcttcgccgcattatccgcgactttaattaccggggatattcggcccgcgagactatctcccgctggcctagtgtgcgtgccggcgaagataaatggatattcccttatcaggagaatgcggatgtgatgttcaactcggcgctgttgtttgaatttgcagtccttcgcctgcacgcggaacctattttgatgggcgttccgcgcaattgtccggaatattgtgaggcgtaccggttgctgaaatttattaaatatttcgttccggtgcaggataaggaaattcccccgacgtctttactcagggagtttttgggaggaagtagcttcaaatattag

SEQ ID NO: 3832 - protein, 557 aa, Bacteroides thetaiotaomicron
MKQMLQICCKNNNIYKEFPIGSSLLDIYYGFNLNFPYQVVSAKVNNRSEGLNFKVYNNKDIEFLDVRDSSGMRTYVRSLCFVLFKAVSELFPEGKLFVEHPVSKGYFCNLRIGRPITLEDVTRIKQRMQEIIAENISYHRIECHTAEAVRVFSERGMNDKVRLLETSGSLYTYYYTLGDTVDYYYGNLLPSTGYIKLFDIVKYYDGLLLRIPNKENPDVLEEVVKQEKMLDVFKEYLNWSYIMGLNNAGDFNLACEEGHATDLINVAEALQEKKIAQIADTIFHRGENGDRVKLILISGPSSSGKTTFSKRLSIQLMTNGLKPFPISLDNYFVDREETPLDENGNYDYESLYALDLELFNQQLQALLRGEEVELPRFNFSLGKKEYKGDKLKIEDNTILILEGIHALNPELTPHIPDEKKFKIYVSALTTISLDDHNWIPTTDNRLLRRIIRDFNYRGYSARETISRWPSVRAGEDKWIFPYQENADVMFNSALLFEFAVLRLHAEPILMGVPRNCPEYCEAYRLLKFIKYFVPVQDKEIPPTSLLREFLGGSSFKY

SEQ ID NO: 3833 - DNA, 618 bp, Bacteroides thetaiotaomicron
  CDS (1)..(618)
atgttaataataggaatagcaggtggaacgggctccggaaaaaccaccgtcgtacgaaaaatgatagaaagcctccccgttggagaagtagtactattacctcaggattcatactacaaagacagtagtcacgtgccggttgaagaacgtcagaatatcaactttgaccatccggatgcttttgaatggagcttgctttccaaacatgtgatgatgctgaaagaaggaaaaagcatcgagcagccgacctattcttatctgacttgtacccgccaaccggaaaccatccacatcgagcctcgtgaagtcgtcattattgaaggtatccttgccttgtgcgacaagaagctacgcaatatgatggatctaaagatatttgtagatgccgatcccgatgaacgcctgatacgtgtcatccaaagggatgtcatcgaaagaggacggacagcggaagctgtcatggaacgctatacccgtgttctgaaaccgatgcacctgcaattcatagaaccctgcaaacgctatgcggaccttatcgttccagaaggcggcagcaatgcagtagctatcgatatattaacaatgtatatcaagaaacatttgaaaaatgaagaatga

SEQ ID NO: 3834 - protein, 205 aa, Bacteroides thetaiotaomicron
MLIIGIAGGTGSGKTTVVRKMIESLPVGEVVLLPQDSYYKDSSHVPVEERQNINFDHPDAFEWSLLSKHVMMLKEGKSIEQPTYSYLTCTRQPETIHIEPREVVIIEGILALCDKKLRNMMDLKIFVDADPDERLIRVIQRDVIERGRTAEAVMERYTRVLKPMHLQFIEPCKRYADLIVPEGGSNAVAIDILTMYIKKHLKNEE

SEQ ID NO: 3835 - DNA, 630 bp, Streptococcus agalactiae
  CDS (1)..(630)
atgcgtaaaaaacctattattattggtgttacaggtggatctggtggtggtaaaaccagtgtttctcgggcgattttatcaaatttcccagatcaaaaaattaccatgattgaacatgattcttactataaagatcaaagtcatttgacttttgaagaacgtgtaaaaaccaattatgatcatccccttgcttttgataccaatttgatgattgagcaattgaacgaattgattgagggacgtccggtcgatattccggtttatgattacacaaaacatacccgtagtgatagaactatccgccaagacccccaggatgtcattattgttgagggaattttagtattagaagatcagcgtttgcgtgatttaatggatatcaaattatttgttgatacagatgatgatattcgtattattcgtcgtattaagcgtgatatggaagagcgcgatagaagtttagatagtattattgaacagtatacagaagttgtaaaacctatgtatcatcaatttatcgaaccaacaaagcgttatgcggatattgtaattccagaaggagtaagtaatattgtcgctattgatttaatcaataccaaagtggctagcatcttaaatgaagcaaaataa

SEQ ID NO: 3836 - protein, 209 aa, Streptococcus agalactiae
MRKKPIIIGVTGGSGGGKTSVSRAILSNFPDQKITMIEHDSYYKDQSHLTFEERVKTNYDHPLAFDTNLMIEQLNELIEGRPVDIPVYDYTKHTRSDRTIRQDPQDVIIVEGILVLEDQRLRDLMDIKLFVDTDDDIRIIRRIKRDMEERDRSLDSIIEQYTEVVKPMYHQFIEPTKRYADIVIPEGVSNIVAIDLINTKVASILNEAK

SEQ ID NO: 3837 - DNA, 1524 bp, Galdieria sulphuraria
  CDS (77)..(1423)
gcggccgctctagaactagtggatcccccgggctgcaggaattcggcacgaggagctcagagattcactttctactatggggtttgttcttccttccaccacatcatacgttgtttataaatcttcttcaacgataaaaagcaaaaagtacaacaaaagaaactatagttcagtttcaagagttcaagttggaggcagcaaaatatcctcctggttatccaatcgtctattattccaaggaaaggaaataaatacgacaagaaaaacaaccacaaagtattggattataactgtttcttctcaaactgctctagaggaatttgtcaactgcagtggatccaaaggtgttcatgaaagtgctggtatctcaagatcaaaatcgaaagtacttagaaacaaaggaatagagcgaccagttattatcggagttgctgcagactcaggttgtggcaagtcaacatttctccgcagagtaaatgagatattcggtactaaagtttctcagtcacatacacctcaaggggaactggtgacagttatctgtctcgatgactttcataccttggatagaaaaggaagagctgaaaaaaaggtgactgctctcaatcccgaagcaaacaactttgagttgatgtatcaacaaatagcagcattaaaagaaggatatgatattatgaagccaatttataatcatcaaactggtttgatagatccaccagagcttattcaacccaaccatattattgtaatagaaggactgcatccttggtatgatgcaagaatgaagcaactcctagattttactgtttatcttgatataagtgacgaagttaaagttgcctggaaaattcagagggacatggcagaaagaggtcataaactcgaaaatattttggcttctatcgagtctcgtaagccagacttccaacaatacattgatcctcaaaaaaaagatgctgtagccgtcattcaagtacttcctactcgattgattcccgatgacacggaaaagaaagtcttgagggttcgtcttatacaacgagagggtatccagggctttcaatctgtctatctttatgatgaaggttcaacaatagactggattccttgtggaagaaaacttacttgcagctatccgggcatcaaattccactatggaccagataactggtacaatcatgatgtttctgttctagaagttgacggaaactttgagaaactagaggaacttatctatatagagtcccatcttaataatacttccaccaaattttatggagaaataacccaacaactcttgcgaaattcttctgctccaggttcaaataatggaactggactctttcaagttctaacggcactcaaaatgagacaactttatgaggagcttacgggaaagagtattgcacctgtcctagtttagccgaaaattaagttttgctccactggctagctggttttctcttccagtatattagtaaactctatgtgcgtatctttgtgtaaaaaaaaaaaaaaaaaaaa

SEQ ID NO: 3838 - protein, 448 aa, Galdieria sulphuraria
MGFVLPSTTSYVVYKSSSTIKSKKYNKRNYSSVSRVQVGGSKISSWLSNRLLFQGKEINTTRKTTTKYWIITVSSQTALEEFVNCSGSKGVHESAGISRSKSKVLRNKGIERPVIIGVAADSGCGKSTFLRRVNEIFGTKVSQSHTPQGELVTVICLDDFHTLDRKGRAEKKVTALNPEANNFELMYQQIAALKEGYDIMKPIYNHQTGLIDPPELIQPNHIIVIEGLHPWYDARMKQLLDFTVYLDISDEVKVAWKIQRDMAERGHKLENILASIESRKPDFQQYIDPQKKDAVAVIQVLPTRLIPDDTEKKVLRVRLIQREGIQGFQSVYLYDEGSTIDWIPCGRKLTCSYPGIKFHYGPDNWYNHDVSVLEVDGNFEKLEELIYIESHLNNTSTKFYGEITQQLLRNSSAPGSNNGTGLFQVLTALKMRQLYEELTGKSIAPVLV

SEQ ID NO: 3839 - DNA, 1005 bp, Synechococcus vulcanus
  CDS (1)..(1005)
atgagcagtaagccagaccgtgtggttctcatcggcgttgctggagactccggctgtggtaaatcaacgtttttgcgccgactggccgatctgtttggcgaagactttatgactgtgatttgtttggatgactatcacagtctggatcgcaagcagcggaaagaaatggggattacagcgcttgatccccgcgccaacaactttgatctgatgtatgagcagatcaaggctctcaaaaatggcgaatcaatcatgaaacccatctacaaccacgaaacggggacgattgatccgccggagaaggtggatcccaaccacgtgattgtgattgaaggcctgcatcccctctatgatgaacgggtgcgatcgctcattgatttcagtgtttatctcgacatcagtgacgatgtaaaaattgcttggaagatcaagcgcgacatggctgagcggggccatagctatgaagacgtcattgcctccatcaacgcccgtcgccctgacttcatggcctatatcgatccccaaaagcagtacgctgacgtggttttgcagattctgccaagccagttggccaaagaggaaaaagtcggcaatatcctgcgggtacggatgctgcaacgggaaggcatccccggctttgagccagtctatctctttgatgaaggctcaacgattacttggattccctgcggtcgtaagctcacctgctcctatccgggcatccgcctcagctacggacctgatgaatactatggtcaccccgtttcggtcttagaagtggacggtcgctttgaaaaactcgatgaactcatctacattgaaagccacctgagtaatacctccaccaagcactacggcgaagtgacggaactcctgctgaagcaccgtgactatccgggttccgataatgggtcgggcctattccaagtgctaacggggctgaaaatgcgggctacctatgagcgcttgacctcgcgggacgcggccactgtcaccaaccgctaa

SEQ ID NO: 3840 - protein, 334 aa, Synechococcus vulcanus
MSSKPDRVVLIGVAGDSGCGKSTFLRRLADLFGEDFMTVICLDDYHSLDRKQRKEMGITALDPRANNFDLMYEQIKALKNGESIMKPIYNHETGTIDPPEKVDPNHVIVIEGLHPLYDERVRSLIDFSVYLDISDDVKIAWKIKRDMAERGHSYEDVIASINARRPDFMAYIDPQKQYADVVLQILPSQLAKEEKVGNILRVRMLQREGIPGFEPVYLFDEGSTITWIPCGRKLTCSYPGIRLSYGPDEYYGHPVSVLEVDGRFEKLDELIYIESHLSNTSTKHYGEVTELLLKHRDYPGSDNGSGLFQVLTGLKMRATYERLTSRDAATVTNR

SEQ ID NO: 3841 - DNA, 1831 bp, Arabidopsis thaliana
  CDS (116)..(1525)
gatttgaggctttccttagatccttgagagcaaaactgaatctgggtaattttaaaaatctcatttttacgacttatctcttttgaacgatctttttttcataattgtcgtcgggatgggttctaagtccgttgttgacatgatcgaagctgcctcgcgggcacatttttctggtttacacgtgaatgggcacatgaatgggttggaaccaagtgcacttaaggaaaccacttctgcatcagaagatatccaaagacagccttttgtaataggtgttgctggaggcgcagcatcgggaaagactactgtttgtgatatgataatccagcaactgcacgatcagcgtgttgtacttattaacctggactcgttctatcataatctgactgaagaagaacttgctagagttcatgaatacaactttgatcatccagacgcatttgacacagagcatttattgtcttgtatggagaaattgaggcaagggcaagctgtagatattccaaaatatgattttaaaacttacaggagcagtgttttcagaagggtaaatcctacagatgtaataattcttgaagggatacttttgttccatgatccacgcgtccgaaagttgatgaacatgaagatttttgtttgcacagatgctgacgttcgtttggcaagaaggataaaaagagatactgtcgagaatggtagagatatcggcacagtacttgaccagtactcaaagtttgtgaagcctgcttttgatgacttcattcttccaacgaagaaatatgcagatattataatccctcgtggtggggataatcatgtagctattgacttaattgtgcaacatatttgcaccaagctgggtcaacatgatctctgtaaaatatatcctaatctctacgttatacactcgacatttcagataagagggatgcacacccttatacgagattctcagacaaccaaacatgattttgtcttctattctgatcgattgattaggctggttgtagaacatggtcttggacatctgccttttactgaaaagcaagtgattactccaaccggatgtgtgtattctggtgtggatttctgtaaacggttatgtggtgtctcggtgattaggagtggtgagagcatggagaatgcgttacgagcatgttgcaaaggtatcaagatcgggaagatcctaattcacagagaaggtgacaatggtcaacagcttgtttatgagaaattgccaaatgatatctcagagaggcatgtcctattgttggatcctattctcgggacaggaaactcagcggttgaagctatcaacctccttataagcaagggcgtacctgagggaaacatcatatttctaaaccttatctcagcacctcaaggtgttcatgtggtctgcaaaaaattcccaagaataaagatagtgacatctgaaatcgataatgggttaaacgaagagtttcgtgttattcctggtatgggggagtttggggacagatattttggcacagacgatgactaggccactgtgttcctgcagcattagttgtcccatccatgtcctgcatagcagtttactgatgcattcaccatcctattctctacaacggctacacaaactatcaaaggaatcacctttaactttgttggttttcccatttaaaccccctcaaggtgttgggaacagttttgtttacttataaatgcccaagtgaggggttgatcgatcccgggacttgggattcggtgtaccatatataattacccttggaactcttgataattcatctacaactcttgtgtaccatatataaatatccttggaacc

SEQ ID NO: 3842 - protein, 469 aa, Arabidopsis thaliana
MGSKSVVDMIEAASRAHFSGLHVNGHMNGLEPSALKETTSASEDIQRQPFVIGVAGGAASGKTTVCDMIIQQLHDQRVVLINLDSFYHNLTEEELARVHEYNFDHPDAFDTEHLLSCMEKLRQGQAVDIPKYDFKTYRSSVFRRVNPTDVIILEGILLFHDPRVRKLMNMKIFVCTDADVRLARRIKRDTVENGRDIGTVLDQYSKFVKPAFDDFILPTKKYADIIIPRGGDNHVAIDLIVQHICTKLGQHDLCKIYPNLYVIHSTFQIRGMHTLIRDSQTTKHDFVFYSDRLIRLVVEHGLGHLPFTEKQVITPTGCVYSGVDFCKRLCGVSVIRSGESMENALRACCKGIKIGKILIHREGDNGQQLVYEKLPNDISERHVLLLDPILGTGNSAVEAINLLISKGVPEGNIIFLNLISAPQGVHVVCKKFPRIKIVTSEIDNGLNEEFRVIPGMGEFGDRYFGTDDD

SEQ ID NO: 3843 - DNA, 1875 bp, Homo sapiens
  CDS (14)..(1273)
gcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtcgccatcgacctgattgtgcagcacgtgcacagccagctggaggagggctgcgctggcctcggcacaccagtgccacccgctgccccggacgctgagcgtcctgaagagcacgccgcaggtacggggcatgcacaccatcatcaggtgagggcccacctggggacggggcggccccgggcgcgtgctcccgctcaactgttggccccacagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaaaaaaaaaaaaaaaaaaaaa

SEQ ID NO: 3844 - protein, 419 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEEGCAGLGTPVPPAAPDAERPEEHAAGTGHAHHHQVRAHLGTGRPRARAPAQLLAPQGQGDQSRRVHLLLQETDAAAHRARALLPALSGLRRTDPAGAGLCGQVLCGEADHRCVHSARR

SEQ ID NO: 3845 - DNA, 1644 bp, Thermoanaerobacter tengcongensis
  CDS (1)..(1644)
atgaaaattatcgtcaaagacagggaatacgaataccctgaaaatactaggttagaagatattgctagagattttgaacacctttataacggaataatagtggcagcgaaagtgaataacgaattgagggatttgaattgtacaatttctgaggatagtgtagtagaatttgtggatactactgtagaagaagggacaagaatatataggagaagtcttacttttgtgtttataaaggctgtaaaagagcttctaccaggtgctactgttacaatagaacattccctcgggaaaggcttgtactgtgaaattcacggttattccataaacaataagatagtagcatcgattaaggataaaatgaaggaaataatagataagaatttgaaaatagagagaaaaatgcttcctagagaagaagccataaggctttttgaaaaagaaggtttaatggaaaaagttaggctttttaaagatactgataaagagaaagtacctgtttattactgtgatggcacagttgactttttctacagtccttgcgttccatcaacagggtatttaaaagtatttgacataagattttatttccctggagtcattttgattgcaccagatatctacaatccacgttctcttcctgtatttgtggatgttccaaaacttgcttctatatttaaagaggcagaagaatgggctcatatattggatataaattatgtggcttctttaaatgacctcataaaaagagggggagcaagagatttaatcctggtttccgaggcttttcatgagaagaaaatttcaaaaatagctgattacatcgcttcaaataaaatgataaaagtagtccttattgctggaccttcttcttcagggaaaacttctttcattcataggcttagcgtacagctcagggtaaacgggttaaagccttttgctatttctctggacaattattttgttccaagagagcttactcctcgggatgagtttggcaattacgacttcgaatctatcgatgccctagatttgccgctttttaatgaacatttgataaaacttatacagggtgaagaagtagaaatccctatttttaattttaaaacaggggagagagagcctgtagggagaaaagttaaacttgagaaaaatcagattatcctcatggagggaattcatggacttaatgaaaagcttactatccaaattccgaaagacaataagtataaaatatatgtaagcgcaataactcagcttaatttagatgaacacaatagaattccaacttctcagacaaggcttataaggcgaatagttagggacagtcaatttaggtctacagatgcggcggagactataaatatgtggcctagggtgaggaaaggagaagaacgctggattttcccatatcaggagcaagcggatgtcatgttcaactccttcttgccctatgaacttcctgtattaaaaaaatacgctgaaccccttttaaagaaggtttccaaagatgaccctgcttactctattgcaaaagagatgctggaatttttaagctatttttatccaatagaagatgaacttgctattccgcctaattcaatcataagagaatttataggtggaagctgtctggatgtgtga

SEQ ID NO: 3846 - protein, 547 aa, Thermoanaerobacter tengcongensis
MKIIVKDREYEYPENTRLEDIARDFEHLYNGIIVAAKVNNELRDLNCTISEDSVVEFVDTTVEEGTRIYRRSLTFVFIKAVKELLPGATVTIEHSLGKGLYCEIHGYSINNKIVASIKDKMKEIIDKNLKIERKMLPREEAIRLFEKEGLMEKVRLFKDTDKEKVPVYYCDGTVDFFYSPCVPSTGYLKVFDIRFYFPGVILIAPDIYNPRSLPVFVDVPKLASIFKEAEEWAHILDINYVASLNDLIKRGGARDLILVSEAFHEKKISKIADYIASNKMIKVVLIAGPSSSGKTSFIHRLSVQLRVNGLKPFAISLDNYFVPRELTPRDEFGNYDFESIDALDLPLFNEHLIKLIQGEEVEIPIFNFKTGEREPVGRKVKLEKNQIILMEGIHGLNEKLTIQIPKDNKYKIYVSAITQLNLDEHNRIPTSQTRLIRRIVRDSQFRSTDAAETINMWPRVRKGEERWIFPYQEQADVMFNSFLPYELPVLKKYAEPLLKKVSKDDPAYSIAKEMLEFLSYFYPIEDELAIPPNSIIREFIGGSCLDV

SEQ ID NO: 3847 - DNA, 1665 bp, Clostridium perfringens
  CDS (1)..(1665)
atggtgtttatgaaaagctttagggttagtgtaaatggggaaagtttactctttaatgagggagaaaaatattcagtaattttaaaaaaggactatataaatgaaaaaatacctattactttagttaaacagaggaataagtattatgagtttactgatttaataaataatgatggggatatagaacttataaatataagtgatccacatggaaaaatagcttatagtagaactttacagtttgtatttataaaagcaactttagacttatttaaggatgctagaataaatatagagcattctataagcaagggaacttttggggaaattcacaaagaaaaggccttagatgaagaggatatactaaaaataaagaaaaaaatgcaagagataataaataaaaatattataatagaaaaaataaagatgcctaagaaagaggctattgatatatttaaatcttataagatgcaggataaagttgatttattacattgggttcaagaagagtatgtaaacttatataaattagaagataggtatgattatttttatggagatatggcatactctacaggagttttaaaatattttgatttattatattataatccaggttttatacttatggtaccaagccataaggagccaacagttgtacctgtctttaaggaacaaaaaaagttatttaatgtatttagagagaatgaaacatggttaaatatattaggaactccagatgtaggttctttagattataaattagagggagaagaatcctcagacataataagggtttctgaggctttacatgagaagaaaatagcacaaattgcagatatgataagtgatagaaaagaggttaaaattgttttagtagcagggccttcctcttcaggtaaaacaacattttcaaaaagactttctatacagcttagagttaatggctatataccaatagctatatccttagatgattattttataaatagaattcatactcctttagatgaagagggaaaacctgattttgaatctataaatgctttagatttagaattatttaataagaatctttatgatattttagaaggggaagaagtagaaataccttcttataattttaaaataggagaaagagaatggctaggcaacaagattaaacttcctgataatggagtgcttgttatagagggaatacatggactaaatccaaaactgacagaaaaaattccttcaaagaataagtttaaggtttatatttctgctttaacacaattaaatttagataatcacaatagaattccaactacagatgtcagaaaaataagacgtatagttagggattctttatcaagaggatatggagcagagcaaactttagaaatgtggagttctataaaaagaggagaggaaaagaacatatttgtttatcaggaagaagcagatgttatgtttaactccactttagtttatgaattagcagctttaaaggaatatgccttaagagagttagaaaaagtagataaaaacagcagtgtttactatgaagctaaaagaataataaatacattaaagttttttgtggaagttaagccagagagagtacctgaaaattcgattttaagagaatttataggtggaagttgcttctataagtattaa

SEQ ID NO: 3848 - protein, 554 aa, Clostridium perfringens
MVFMKSFRVSVNGESLLFNEGEKYSVILKKDYINEKIPITLVKQRNKYYEFTDLINNDGDIELINISDPHGKIAYSRTLQFVFIKATLDLFKDARINIEHSISKGTFGEIHKEKALDEEDILKIKKKMQEIINKNIIIEKIKMPKKEAIDIFKSYKMQDKVDLLHWVQEEYVNLYKLEDRYDYFYGDMAYSTGVLKYFDLLYYNPGFILMVPSHKEPTVVPVFKEQKKLFNVFRENETWLNILGTPDVGSLDYKLEGEESSDIIRVSEALHEKKIAQIADMISDRKEVKIVLVAGPSSSGKTTFSKRLSIQLRVNGYIPIAISLDDYFINRIHTPLDEEGKPDFESINALDLELFNKNLYDILEGEEVEIPSYNFKIGEREWLGNKIKLPDNGVLVIEGIHGLNPKLTEKIPSKNKFKVYISALTQLNLDNHNRIPTTDVRKIRRIVRDSLSRGYGAEQTLEMWSSIKRGEEKNIFVYQEEADVMFNSTLVYELAALKEYALRELEKVDKNSSVYYEAKRIINTLKFFVEVKPERVPENSILREFIGGSCFYKY

SEQ ID NO: 3849 - DNA, 1258 bp, Odontella sinensis
  CDS (23)..(1213)
caagaattacccaagtgaaaccatgaagctgtcccttggcatcgtcgccctcatggccgcctcggcctccgccttcgcccccacggccttcatgccggcgaacaccctccgcgccgccgcccccgcctccccctccgccctcaacatggccctgaaggagggagagaagcccatcgtgatcggcgtcgccgccgattctggctgcggaaagtccaccttcatgcgccgcctcacctccatcttcggcggtgagggcgtcggccccctcggcggcggctttgacaacggcggctgggagaccaactccctcgtgtccgacctcaccaccgtcctgtgcctcgatgactaccacctcaacgaccgcaatggccgcaaggtcacccagcgcactgccctcgacccccttgagaacaacttcgacctcatgtacgagcagatcgccgccctcaagaacggagagagcatcgagaagcccatctacaaccacgtcaacggaaccctcgacactcctgagaccattgtgcccaccccgattgtcatcattgagggtcttcaccccatgtacgatgagcgcgtccgtgaccttctcgacttctccctttaccttgacatctctgacgaggtgaagctcaactggaagatccagcgtgacatggaggagcgtggccactctctcgagtccatccttgcctccatcgaggcccgtaagcccgatttcgatgcctacattgccccccagaaggagttcgccgacctcaccatcgaggtgctccccacccagcttgacgaggaggacaagaagaccctccgcgtgaggtgcatccagaaggagggcgtctccgacttctccccctgctacctcttcgacgagggctccaccatcgcctggactcccgccccctccaagctctccagctccggccccggcctcaccatggcctacggaaccgaggattactacggcaagcccgcccaggtcgtcgagatggatggcaccttcgacaacatccaggagctcgtctacgtcgagtcccagctttccaacacctccaccaagttctacggtgagctcacccaggccatgctcaagctcgctgacgcccccggaagcaacaacggaactggactcatgcagacccttgccgccttcgccatccgggagctttacgagaagaaggccgccgccgccaagcttgccgtgatcgaggcctaagcccgcttttattcttcataataattaaaatgccaatggaaatct

SEQ ID NO: 3850 - protein, 396 aa, Odontella sinensis
MKLSLGIVALMAASASAFAPTAFMPANTLRAAAPASPSALNMALKEGEKPIVIGVAADSGCGKSTFMRRLTSIFGGEGVGPLGGGFDNGGWETNSLVSDLTTVLCLDDYHLNDRNGRKVTQRTALDPLENNFDLMYEQIAALKNGESIEKPIYNHVNGTLDTPETIVPTPIVIIEGLHPMYDERVRDLLDFSLYLDISDEVKLNWKIQRDMEERGHSLESILASIEARKPDFDAYIAPQKEFADLTIEVLPTQLDEEDKKTLRVRCIQKEGVSDFSPCYLFDEGSTIAWTPAPSKLSSSGPGLTMAYGTEDYYGKPAQVVEMDGTFDNIQELVYVESQLSNTSTKFYGELTQAMLKLADAPGSNNGTGLMQTLAAFAIRELYEKKAAAAKLAVIEA

SEQ ID NO: 3851 - DNA, 606 bp, Homo sapiens
  CDS (1)..(606)
atggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagacaaagaagtatgccgatgtgatcatcccacgaggagtggacaatatggttgccatcaacctgatcgtgcagcacatccaggacattctgaatggtag

SEQ ID NO: 3852 - protein, 201 aa, Homo sapiens [sequence omitted]

SEQ ID NO: 3853 - DNA, 1299 bp, Vaucheria litorea
  CDS (8)..(1225)
caacaaaatgctcgtacatagtctaattctactccttgccgccggcgcactgcacgtggagtcatttgtctctacccactcagcgctcagaacttcaacattcacaaataatgcccaaagtcttaacaaagcggcctcgaaattacaggccctggagatgaagctcggcgatcccgatgaaccagtcgtcatcattggcgttgctgctgactctggctgcggtaagtcgacattcatgcgtcggttgactaacattttcggtggttcgagcgtcggaccgctcggcgggggattcggaaacggcggttgggaaacaaatacgctcgtgtcagacctcacgactgtcatttgtttggacgattatcatttgaacgaccgaaacggcagaaaggtgtcgggacgcactgctttgcacaccgacgagcagaaattcgatctgatgactgagcaactttcggctctgaagagaggagagagcgtgatgaagcccatctacaatcacgtgaacggcacactggacacccccgaggaagtcaaacccaccccaatcgtcatcatcgaagggctgcaccccttcgtggacgaaagggtcagggatttgttggacttcaccatttacttggacatctccgacgaaatcaaatttgcttggaagatccaaagggacatgatggagcggggccactccttggaaagcatccaagcttccattgaagccaggaagccggatttcgatgcttacattgccccgcaacgagcacaggctgacgttgtcttgcaggttttgcctacgaagcttgtgccagaagacaaagaggggaagattctccgcactaggctgattcagaaggaaaatgtcaaaaacttcgaaacggcttatttgttcgatgaagggagcaccatcaactggatcccgtgcgggagaaagttgacctgctccttcccaggaatcaagttcgcctacggacctgacacttatttcgacaacgaagtttccgtccttgaaatggatggacagtttgacaatctccaggagcttatttatgtggaggggttcttgagcaatactggaactaaattttacggagagttgacccaaaatattcttaaactgtcggacagtcctggcagtaacaacggaactggcttcttgcagaccgtaattgctttgaaattgcgagaaatctacgaaaaaatcacaacgagccaagccgaggctgcataagcccattttttcctgccaacatttagagaagggaaataatgatgacactgccaattaaaaaaaaaaaaaaaaaa

SEQ ID NO: 3854 - protein, 405 aa, Vaucheria litorea
MLVHSLILLLAAGALHVESFVSTHSALRTSTFTNNAQSLNKAASKLQALEMKLGDPDEPVVIIGVAADSGCGKSTFMRRLTNIFGGSSVGPLGGGFGNGGWETNTLVSDLTTVICLDDYHLNDRNGRKVSGRTALHTDEQKFDLMTEQLSALKRGESVMKPIYNHVNGTLDTPEEVKPTPIVIIEGLHPFVDERVRDLLDFTIYLDISDEIKFAWKIQRDMMERGHSLESIQASIEARKPDFDAYIAPQRAQADVVLQVLPTKLVPEDKEGKILRTRLIQKENVKNFETAYLFDEGSTINWIPCGRKLTCSFPGIKFAYGPDTYFDNEVSVLEMDGQFDNLQELIYVEGFLSNTGTKFYGELTQNILKLSDSPGSNNGTGFLQTVIALKLREIYEKITTSQAEAA

SEQ ID NO: 3855 - DNA, 1711 bp, Cryptosporidium parvum
  CDS (290)..(1549)
ttttatatacaacaacggaccaagttagaatagttattgattgcttttaattgtttcaaattttcaatccaaacctagcaaaactatttttaatcaatgtttaactttcattttcaaaactgttaccgccgatactgttattgatcataattgtttaaaaatttcgacgtcaaatattttgaaacgtttataataagacaataacttctaatttgtttatattaatagctataaatattgccgtagatttacttcattactattttttggttattaatttgaatatataatgtctaatatcagtcttgaaaaattaatttctaaagacatatattatggcgatcaagctttaacgcctagcagcaattcaaatgtttttgttattgcagttgcaggaggaagtgcaagcggaaaaacaagcgtatgtaccagaattttttcagagttaggagataaacgagttacggtaattgagactgatagtttttataaaactcctgtcttagaagaggggcaaactatggcagactacaactttgatcatcctaattctgtggactttgaacttctatacaatgttttactaagtttgaaaaacggggaaggggttcacatccctaactactgttttaaacaacataagagattggaaacaggaaggaaggtttctccagcatctattattattgttgaaggcatatttattcttttccatccaaaaattagacatcttataaatatgtcaatttttgtcgatacggacgatgatattcgtcttgtacgtagaataagaagagatactattgagagaggcagacaaattgacgatattcttaatcaatatgagaaaacggttaagccatcctatgatgaattcatttatccgactagaagatatgcagatatcgtaattccgcattatccaaatgaagttgctgttgaccttgttgtacaacatcttagatacaagttaaaaatggatgatttaagaaaaatttactctaatttgcatattattccttctaattgtcaaatacgccatatgcactctattataaggaataaggatacatcagtggtggactttgtcttttggtcagatagattaattcgactggtcgtcgaaaatgctcttagccatttgtcttttactggtcaaacaattgaaacacctattggagaactttacgacggagtgcaatttaattacaaggataaactctgcgcggtctcaatagttagaggaggagaaagtatggaaataggtttatctgctgtttgtaaagatatcccaataggaaaaattctactggagttccaaaatcctaaaacggaacttgatgcccagtttgataaacctaagattatctattgcaaattacccgatgatattgcctcaaggaatgtatttattttggatcctattcttgggaatggatttggggtattttctgcaattaaatatttgttatcaaagggggttttgcagcgtaaaattattgttcttagtcttattgttgctgcacaatgcaatacacagaatatgtaaagagttcccggaggtaactctaattacgactgaaattgaccgtgatgttaactctgatggttttgtaattccaggattaggttgttttgctgatcgatactttggaactgaataacaaagaactttaattaaggggaataaattaaataatataaaattaaa

SEQ ID NO: 3856 - protein, 419 aa, Cryptosporidium parvum
MSNISLEKLISKDIYYGDQALTPSSNSNVFVIAVAGGSASGKTSVCTRIFSELGDKRVTVIETDSFYKTPVLEEGQTMADYNFDHPNSVDFELLYNVLLSLKNGEGVHIPNYCFKQHKRLETGRKVSPASIIIVEGIFILFHPKIRHLINMSIFVDTDDDIRLVRRIRRDTIERGRQIDDILNQYEKTVKPSYDEFIYPTRRYADIVIPHYPNEVAVDLVVQHLRYKLKMDDLRKIYSNLHIIPSNCQIRHMHSIIRNKDTSVVDFVFWSDRLIRLVVENALSHLSFTGQTIETPIGELYDGVQFNYKDKLCAVSIVRGGESMEIGLSAVCKDIPIGKILLEFQNPKTELDAQFDKPKIIYCKLPDDIASRNVFILDPILGNGFGVFSAIKYLLSKGVLQRKIIVLSLIVAAQCNTQNM

SEQ ID NO: 3857 - DNA, 1492 bp, Arabidopsis thaliana
  CDS (1)..(1461)
atgccggaagattcttcttctttagactacgcgatggagaaggcatcagggcctcacttctccggtcttcgcttcgacggccttctctcttcttctccacccaattcctccgtcgtctcttcactccgatcagctgtttcttcttcttctccgtcttcttccgatcccgaagcgcctaagcagcccttcattatcggggtttctggtggtacggcttctggtaagaccacggtctgtgacatgataatccagcaacttcatgaccatcgtgtcgttttagttaatcaggattccttttatcgtggtttgacatctgaggagttgcagcgtgtgcaagagtataactttgatcatcctgatgcgtttgacactgagcagcttttgcattgtgctgagactctcaagagcgggcaaccctatcaagttccaatctatgactttaagactcatcaacgtagatctgatactttccgccaggtcaatgcttctgatgtaataatattggaagggattctagttttccatgactcacgagttcggaatctgatgaatatgaagatctttgttgatacagatgctgatgtaaggcttgcccgcagaattaggcgtgacacagttgagaggggtagggatgtcaattctgtgcttgaacagtatgcaaagtttgtgaagccggcatttgatgacttcgtgctcccttcaaagaaatatgctgacgtgatcattcctcgaggaggtgataatcacgttgcagtcgatttgattacgcaacatatccacacaaaacttgggcagcatgatctctgcaaaatctacccaaatgtttatgttatccagtcaacatttcagataagaggcatgcatacacttattcgggaaaaggacatatcaaagcatgactttgtgttttattcagatagactcattcgtctggtcgtggagcatggtcttggtcatttgccattcactgagaaacaagtagttactccaacaggagctgtatataccggtgttgatttctgcaagaaactttgtggggtctcaattattagaagtggtgaaagcatggaaaatgcattacgcgcttgctgcaaaggaattaaaatagggaagattctcatccaccgtgatggcgataatggaaaacagcttatttatgagaagcttcctcacgacatatctgaacgccatgtcctgcttctagatcctgtcttagccacaggtaactcggctaatcaagccattgaactactcatacagaaaggtgttcctgaagctcacattatattcctcaaccttatatcggcgccggagggaatccactgtgtctgcaaacgttttccagcattgaaaattgtgacgtctgaaatagaccaatgtctgaaccaagaattcagagttataccgggcttaggcgagtttggcgatcgttacttcggcaccgacgaggaagaccagtagccaccactcaacactgtgactggtttcaaag

SEQ ID NO: 3858 - protein, 486 aa, Arabidopsis thaliana
MPEDSSSLDYAMEKASGPHFSGLRFDGLLSSSPPNSSVVSSLRSAVSSSSPSSSDPEAPKQPFIIGVSGGTASGKTTVCDMIIQQLHDHRVVLVNQDSFYRGLTSEELQRVQEYNFDHPDAFDTEQLLHCAETLKSGQPYQVPIYDFKTHQRRSDTFRQVNASDVIILEGILVFHDSRVRNLMNMKIFVDTDADVRLARRIRRDTVERGRDVNSVLEQYAKFVKPAFDDFVLPSKKYADVIIPRGGDNHVAVDLITQHIHTKLGQHDLCKIYPNVYVIQSTFQIRGMHTLIREKDISKHDFVFYSDRLIRLVVEHGLGHLPFTEKQVVTPTGAVYTGVDFCKKLCGVSIIRSGESMENALRACCKGIKIGKILIHRDGDNGKQLIYEKLPHDISERHVLLLDPVLATGNSANQAIELLIQKGVPEAHIIFLNLISAPEGIHCVCKRFPALKIVTSEIDQCLNQEFRVIPGLGEFGDRYFGTDEEDQ

SEQ ID NO: 3859 - DNA, 1480 bp, Dictyostelium discoideum
  CDS (1)..(1479)
atggaaaatagatacatttccagaatcgaaaccatttcttctcatttgttatcaacaaatgatgtctcctcacaaaatgaaagtgaatcaattacctttgtaaaaccattaccaaagaataaaaaagatcacgaccagtccatcgaatccgattcatcatttacaagagaaaaacaatttgaagaagaattagatattttaggagagattaattcaaagacaggtttatttgaaattaaacaagtaccatatcaattatcatttgatcaaggattttttcatgcatgtagggcaattgaaatattaacagaaaaagatccaaaaagaattatatgtttaggtattgctggcccagttggtgctggaaaaacaacattagctaataaaatcggtagtcttgttaatggtgttataatttcacttcaagatttcgttaaacttgaaaatgttaaagataataattatgatgatcctgtattaattgattttgataaagttatttcaacattaaatgaattaaaagaaaataaaacagttataattccaaagattgtaaatagaaagatggaaagtagaagtatatcattatcaacatcaaaagttattatattagagggtgcatatgcattgagtgcacgtattagaccactattggatattagtgttgcaattacaggtggtgtacatttggatctaataaagagtataatgagaggtattgttacgagtggtaagaattcaagtaaggatgtattggcacaaattaccaatgttgtatttccaatgtttaaagcatttgttgaaccagatttagatcaagcaaagattaaaattcatagtagtttcaatccaatgagtcaagtggttgaaccagtttacgtttgtaaagccaaatacgataataataaacagtttttcgatcaattcctctcatcactcaatgttgtaccagttaaaaagaactttagcgatatgtatctctatccaccaaaatatggtgtcgatggtatctctcaagccgataaaagaaattggattagaattcgtcgttctgagcatggtcaattcaatatcaccttctacaatgaaatgatggatggtgccgtcaatactcgtccatctttaaatttcgaaatctctgtcaaaactttgggtggtctactctctttaggttatcaaattggtgctatcctcaatcgtaccgttgaggtttggtatgataaaaatggtgttgtcatcactaaagaatatatcaaagaattggagaaacatttcattcaaattaaaggtcactctcgtagagaagtattagatagtgctgaaaaattaaaaatcactggtaatcatgtccctcaaacttttctttatctttattttaaaaaattaaaaaaaagtaaaaatccaaattattcaaaattaaaaccaaataatacaaattcaaaaattttaaaaaataataaagataaaaaaaatttataaa

SEQ ID NO: 3860 - protein, 492 aa, Dictyostelium discoideum
MENRYISRIETISSHLLSTNDVSSQNESESITFVKPLPKNKKDHDQSIESDSSFTREKQFEEELDILGEINSKTGLFEIKQVPYQLSFDQGFFHACRAIEILTEKDPKRIICLGIAGPVGAGKTTLANKIGSLVNGVIISLQDFVKLENVKDNNYDDPVLIDFDKVISTLNELKENKTVIIPKIVNRKMESRSISLSTSKVIILEGAYALSARIRPLLDISVAITGGVHLDLIKSIMRGIVTSGKNSSKDVLAQITNVVFPMFKAFVEPDLDQAKIKIHSSFNPMSQVVEPVYVCKAKYDNNKQFFDQFLSSLNVVPVKKNFSDMYLYPPKYGVDGISQADKRNWIRIRRSEHGQFNITFYNEMMDGAVNTRPSLNFEISVKTLGGLLSLGYQIGAILNRTVEVWYDKNGVVITKEYIKELEKHFIQIKGHSRREVLDSAEKLKITGNHVPQTFLYLYFKKLKKSKNPNYSKLKPNNTNSKILKNNKDKKNL

SEQ ID NO: 3861 - DNA, 1545 bp, Synechococcus sp
  CDS (267)..(1268)
aagcttaccctgagccgcgatcgccggttgtagcgatttcagcgtttcttgttagactcctcagcctgtctggtaagattccgcataaacggatacagtccgcttcgactcgccggtatcgatctcaacccgatagtgactactgacttgggaggtcaatgtcggtccgccgtagcgatgctgtcttagaacagcaagcgggcgtccagacgtggccttgtgccggatgctgaccccattatctcgtcactgtctcgagggatcctatgagcaagccagatcgtgttgttctgatcggcgttgccggtgactccggttgcggcaaatcaaccttcctaaatcgccttgccgacttgtttggtacggaattgatgacggtcatctgcttggatgactatcacagtctcgatcgcaagggccggaaggaagcaggcgtaacggctttggatccccgcgccaacaactttgacttgatgtatgaacaggtcaaggcgttgaagaacggcgaaacgatcatgaagccgatctacaaccatgaaaccggcttgatcgatccgcccgaaaaaatcgaacccaatcgcatcattgtgatcgagggtctgcatccgctttacgacgagcgcgtgcgtgaactgctcgatttcagcgtttacctcgacatcgatgacgaagtcaaaatcgcttggaagatccaacgcgatatggcagaacgcggccactcctacgaagatgtcctcgcctcgatcgaagcgcgccgccctgacttcaaggcctacattgagccccagcgtggccatgcggacatcgtcatccgcgtcatgccgacccagctaatccccaatgacaccgagcgcaaggtgctgcgggtgcagttgatccaacgggaaggccgcgatggttttgagccggcttacctgttcgacgaaggttcgaccatccagtggacgccctgcggtcgtaagctgacctgctcctatccgggcattcgcttagcctacggccctggcacctactacggtcacggagtctcagtgcttgaggtcgacggtcagttcgagaacctcgaagagatgatctacgtcgagggccacctcagcaagaccgacacgcagtactacggtgagttgacccacctgctgccgcagcacaaagattacccgggttcgaacaacggcacgggtctgttccaagtgctgaccggcctgaaaatgcgggcggcctatgagcgtttgacctcccaagcagcacccgtcgccgctagcgtctaggttgctcaggtttcacttgttttcagcttgttgactctaagctgctctcctagcgagagcagcttttttgttgctcaggactgactgatggctgaggtctgcaatcgctcattaagggtggggatagcgatcgcgcaaccaatgcagtgcttgctggcgagcagtgtcgtcggttccggccagcaattgcccatctacacccgaaccctgcagagcttcagaatctgcggaattgcggccaggtcatagccaacttttaagatcgtgaccgtcagcg

SEQ ID NO: 3862 - protein, 333 aa, Synechococcus sp
MSKPDRVVLIGVAGDSGCGKSTFLNRLADLFGTELMTVICLDDYHSLDRKGRKEAGVTALDPRANNFDLMYEQVKALKNGETIMKPIYNHETGLIDPPEKIEPNRIIVIEGLHPLYDERVRELLDFSVYLDIDDEVKIAWKIQRDMAERGHSYEDVLASIEARRPDFKAYIEPQRGHADIVIRVMPTQLIPNDTERKVLRVQLIQREGRDGFEPAYLFDEGSTIQWTPCGRKLTCSYPGIRLAYGPGTYYGHGVSVLEVDGQFENLEEMIYVEGHLSKTDTQYYGELTHLLPQHKDYPGSNNGTGLFQVLTGLKMRAAYERLTSQAAPVAASV

SEQ ID NO: 3863 - DNA, 1452 bp, Arabidopsis thaliana
  CDS (1)..(1452)
atgccagaagattcaacggcgattgactatgtcatggagaaggcatcggggcctcacttctccggtcttcgccttgacggtcttctttcttctccgtcgaaatcctccgtctcttctccttctcacttccgtttgagtaattcttctttttcggctaccgacgatcccgccgctcctcatcagcccttcgttatcggagttactggtggtacagcttctggtaagacgacggtatgtgacatgataatccagcaacttcatgatcatcgcattgttttagttaaccaggattcgttttaccgtggtttgacatctgaagaacttgagcatgtacaagaatacaattttgatcatcctgatgcctttgacactgagcagcttttgcattgcgttgacatactcaagagtgggcaaccctatcaaattccaatttatgacttcaagacccatcaacgtaaagtagatgcttttcgccaggtcaatgcttgtgatgtcatcattttggaagggattctagtttttcatgactcacgagttcgggacctaatgaatatgaagatcttcgttgacacagatgctgatgtgaggcttgctcgcagaatcaggcgtgacacggttgagaggggtagggatgttgactctgtgcttgaacagtatgcaaagtttgtgaagcctgcgtttgatgattttgtgctcccctcaaagaaatatgctgatgtgatcattccacgaggaggtgacaatcacgttgcagttgatttgattgtgcaacatatccacacaaaacttgggcaacatgatctctgcaaaatctacccaaatgtttttgttattgaaacaacatttcagataagaggcatgcacactctcattcgagagaaggacatatcaaaacatgacttcgtgttttactcagatcgcctcattcgtttggttgtggagcatggtcttggccatttgcctttcactgagaaacaagtagttactccgacaggatctgtgtatagcggtgttgatttctgcaagaaactctgtggggtctcagtcattcgaagtggtgaaagcatggaaaacgcattgcgcgcatgttgcaaagggattaagatagggaagattctcatccatcgtgacggagacaatggaatgcagcttatatacgagaagcttccaagtgatatctccgagcgtcatgtcctgctattagatcctgttttaggcacaggtaactctgcaaatcaggcgatagaactactcatacagaaaggagtacctgaagcccacattatattcctcaatcttatctcagcgccagaaggaatccattgcgtctgcaaacggttcccaaagttgaagattgtgacgtcagaaatcgatcagtgtctgaacgaagagttcagggttataccaggcttgggtgagtttggtgatcgctactttggtaccgacgagtag

SEQ ID NO: 3864 - protein, 483 aa, Arabidopsis thaliana
MPEDSTAIDYVMEKASGPHFSGLRLDGLLSSPSKSSVSSPSHFRLSNSSFSATDDPAAPHQPFVIGVTGGTASGKTTVCDMIIQQLHDHRIVLVNQDSFYRGLTSEELEHVQEYNFDHPDAFDTEQLLHCVDILKSGQPYQIPIYDFKTHQRKVDAFRQVNACDVIILEGILVFHDSRVRDLMNMKIFVDTDADVRLARRIRRDTVERGRDVDSVLEQYAKFVKPAFDDFVLPSKKYADVIIPRGGDNHVAVDLIVQHIHTKLGQHDLCKIYPNVFVIETTFQIRGMHTLIREKDISKHDFVFYSDRLIRLVVEHGLGHLPFTEKQVVTPTGSVYSGVDFCKKLCGVSVIRSGESMENALRACCKGIKIGKILIHRDGDNGMQLIYEKLPSDISERHVLLLDPVLGTGNSANQAIELLIQKGVPEAHIIFLNLISAPEGIHCVCKRFPKLKIVTSEIDQCLNEEFRVIPGLGEFGDRYFGTDE

SEQ ID NO: 3865 - DNA, 1398 bp, Arabidopsis thaliana
  CDS (1)..(1398)
atggagaaattatctaatggcgttagagatcactgtttgatcagtgactatgtttctccttcagctcctgctcctcttaaacaacctttcgtgatcggtgttgccggaggaaccgcctccgggaagacgacggtttgcaatatgatcatgtctcagttacatgatcaacgtgttgtccttgttaaccaagattcgttttaccactcgcttactaaggagaaattgaacaaggttcatgaatataacttcgatcatcctgatgcattcaacactgaggttttactttcatgtatggagaagttacgatctggacaaccagtgaacattccgagttacgatttcaaaatccatcagagcattgaatcatcaagtccggttaatcctggtgatgtaatcatcttagagggaatcctagttcttaatgatcctcgagttcgtgatctcatgaacatgaagatctttgtcgatacagatgctgatgtacgactctcgagaagaatacagcgtgacaccgtcgagagaggaagaaacatacagaatgtgcttgaacagtatactaagtttgtgaagccgagcttcgatgaatacattcagccgtcgatgaagtatgctgatataatcattccacgaggaggagataatgatgttgcaattgatctcattgtacaacatattcgtacaaagctgtgccaacacaatctctgtaagatatactcaaacatcttcatcatatcttcaacattccagatcaaaggaatgcatactcttatccgtgatatcaacacaaccaagcatgatttcgtcttctacgctgaccgattgattcgactggtcgtggaacatggacttggtcatcttcctttcacagagaaacagatcacaactccaacagggtcagtgtacactggagtcgacttctgcaagagattgtgcggtgtctcagtgatcagaagtggagaaagcatggaaaacgctctaagagcttgctgcaatgggattaagattggtaaaatcctcattcacagagagaataacgatggtcgtcagttaatatatgagaagttgccaaaagatatctcaagcagacatgtcttcctccttgaccctgttctagcatcaggctactctgcagttaaagctataactttgcttctaagcaagggagttccagaatcacatatcatctttctcaatcttatagcagcacctcaaggcatccacgcgctttgcaagaaattcccgatgctaaagattgtgacatcggaaatcgattcatctctcaatgaggactcacgtgtgattccaggcttgggagaatttgcagaccgttactttgggacaaacaacattaattcaaaagtatcaagcttgtctacaaatctcaagttaagaagctaa

SEQ ID NO: 3866 - protein, 465 aa, Arabidopsis thaliana
MEKLSNGVRDHCLISDYVSPSAPAPLKQPFVIGVAGGTASGKTTVCNMIMSQLHDQRVVLVNQDSFYHSLTKEKLNKVHEYNFDHPDAFNTEVLLSCMEKLRSGQPVNIPSYDFKIHQSIESSSPVNPGDVIILEGILVLNDPRVRDLMNMKIFVDTDADVRLSRRIQRDTVERGRNIQNVLEQYTKFVKPSFDEYIQPSMKYADIIIPRGGDNDVAIDLIVQHIRTKLCQHNLCKIYSNIFIISSTFQIKGMHTLIRDINTTKHDFVFYADRLIRLVVEHGLGHLPFTEKQITTPTGSVYTGVDFCKRLCGVSVIRSGESMENALRACCNGIKIGKILIHRENNDGRQLIYEKLPKDISSRHVFLLDPVLASGYSAVKAITLLLSKGVPESHIIFLNLIAAPQGIHALCKKFPMLKIVTSEIDSSLNEDSRVIPGLGEFADRYFGTNNINSKVSSLSTNLKLRS

SEQ ID NO: 3867 - DNA, 1856 bp, Drosophila melanogaster
  CDS (77)..(1762)
cacgacgaagtaaatcaccgcgtgtttttttctaatcgctgcaactggctgctgcaatcactattctcttgtcgaaatgtctgtgacccagacgaaacaaatcaagttctacaacccatcgagttccgctagctccgacagcgatgaccgttcactctcggatgtcacagagcaactctatgtggatccgtatgccgacctaagcaatggcttgcccggggatctcaactgctgtccggcctcgcccaccacagtgcctgctaaagcatcgttggattcgcctcttaaacgttccggtaggagacagcgaaccacatccattggcaaccagaccaccacagcgaatccgtccgaatgcatcatacgcgcaaataaccgcacgatctacacggccggacgaccgccgtggtacaattgtgctgggcaacaggtggagcccttcgtcataggaatctgcggcggtagtgcctctggcaagaccacagtggctgagaaaatcatcgaaagcctagacgttccatgggtaacactgttgtccatggactgtttctacaagatccttaatgagaaacagcatgagcaggccctgatcaacgaatataacttcgatcacccggatgccttcgacatcgagctgctgctggacgtgctcaccaagctgaaggagggccgaaaggtggaagttcctgtctataattttgtgacacatggtcgtgagagccaaacgaaaaccatgtacggggccaatgtgatcatcttcgagggtattcttacctttcatagtcctgaagtacttaaattgctagacatgaagatatttgtggacacagatcccgatattcgtctggccaggcggttaagaagggacatctctcagcgcggacgagacctcaagggcgtgctgaagcaataccttaatatggttaagccctcctattgcaattacatagctccaacaatggcccatgcagatatcattgttcctcgtggaggcgacaacaaggtggccatccatctcattgttcagcacgtgcacacacagctgcaactgcgcggatttaagctgcgcgaaactctggccaactcctacaaggaccagccaatgccacattctctgcacttgctgcatcccacgccccaaataaagggcctgcacacgttcatccgttgccgaaatacgtcccgcgatgagtttattttttactcaaagcgcctgatacggctagtcattgaatatgcgctaagcttatttccctttaagaaaacaacagtggagactccacaaggtgtcctttacgagggcaagcgtatggaatcgcgaaaaatatgcggcgtctcaattctccgagctggtgaaacaatggaacaagccgtttgtgatgtgtgcaaggacattcgcatcggaaagatcctcatccagaccaatcttaagaccggcgagccggagctttactacctgaggctgcctaaagacataaaagactacaaggtgatactaatggatgccaccgtggccacaggagcagcggccatgatggccattcgggtgctgctggatcacgatgtacccgaggacaacattatcttggcctcgcttttgatggctgagatcggtgtgcactccattgcctatgccttcccaaaggtgaaaattgttacttccgctctggatccggagattaatagtaagttttatgttatacccggcattggtaactttggcgatcgctactttggcacggaaccctctgatgagtactaaggagatctgggccaatccatacctatatggaaccatcaagtttctaatgtatcttaggttaagttcaaaacgttacttaaattatgaatttgga

SEQ ID NO: 3868 - protein, 561 aa, Drosophila melanogaster
MSVTQTKQIKFYNPSSSASSDSDDRSLSDVTEQLYVDPYADLSNGLPGDLNCCPASPTTVPAKASLDSPLKRSGRRQRTTSIGNQTTTANPSECIIRANNRTIYTAGRPPWYNCAGQQVEPFVIGICGGSASGKTTVAEKIIESLDVPWVTLLSMDCFYKILNEKQHEQALINEYNFDHPDAFDIELLLDVLTKLKEGRKVEVPVYNFVTHGRESQTKTMYGANVIIFEGILTFHSPEVLKLLDMKIFVDTDPDIRLARRLRRDISQRGRDLKGVLKQYLNMVKPSYCNYIAPTMAHADIIVPRGGDNKVAIHLIVQHVHTQLQLRGFKLRETLANSYKDQPMPHSLHLLHPTPQIKGLHTFIRCRNTSRDEFIFYSKRLIRLVIEYALSLFPFKKTTVETPQGVLYEGKRMESRKICGVSILRAGETMEQAVCDVCKDIRIGKILIQTNLKTGEPELYYLRLPKDIKDYKVILMDATVATGAAAMMAIRVLLDHDVPEDNIILASLLMAEIGVHSIAYAFPKVKIVTSALDPEINSKFYVIPGIGNFGDRYFGTEPSDEY

SEQ ID NO: 3869 - DNA, 1869 bp, Synechocystis sp
  CDS (233)..(1231)
gaattcatactcagtattcagagggtcaggctatatctctggctagaaccgaagagcgttatctggggttgaccaggatgactagatctcaggattagttttccttcggcccttgacagggggttaacaagcccataggctctggtttgtctctccaacacgccatctggggtgaggagaaattttctaggaaaccgggttaacaatcagttttgcatttttgagggatgttatgaccacacagctagaccgcgtggttcttattggtgttgccggggattccggttgcggtaagtctactttcttacgtcgtttaacggatttattcggcgaagagttcatgacggtaatttgtttggacgattaccatagtttggatcgccagggtagaaaagccgctggggtcaccgccctggatcccagagccaacaattttgacctcatgtatgagcagattaaaacgctcaaaagtggtcaatccattatgaaacccatttacaaccacgaaacggggctgctggatccaccggaaaaagttgaacccaacaaagtggtggttattgagggtttgcatcccctctacgatgaacgggtgcgggaactggtggatttcggggtctacctggacatcagcgaagaagtgaaaattaactggaaaattcaacgggacatggccgaacggggccacacctatgaagatattttggcttccatcaacgcccgtaagcctgacttcactgcctatatcgagccccaaaagcaatatgcggacgtggtgatccaggtgttgcccacccgcttgattgaggacaaggaaagtaaactcctgcgggttcgtcttgtgcaaaaagaaggggttaaattcttcgagccagcctacctgtttgacgaaggttccaccattgattggcgtccctgtggtcggaagctgacctgtacctatcctggcatcaagatgtactacggccccgataattttatgggcaacgaagtatctttgctggaagtggacggcaggtttgaaaacctagaggaaatggtttatgtggaaaaccacctcagcaagactggtactaagtactacggtgaaatgaccgagttgttgctcaagcataaggattacccaggcactgacaatggtactggcctgttccaggtgttagtgggtctgaaaatgcggaaagtttacgaacagttaacggcggaagctaaggtcccggcctctgtgtaactgcggtaccaataattacctgacctgctggtctgcataacctaatttactatttcgtggtggccatggctgtggttccgccacgatttttgttggggtttgatttaagggagaaatcttctaatatctaaggcggagtcgttgtttgatatcttcacaacatccgggttgagcttatttctggggaggataatgatgccatttttactggtggtggtggtggttttatttgccggagtgcaacttttccaatggctatggggggtaattttgcccctgcctatttacgttatggccggtgcttttttggcgatcgccagcaattatgacaagggcatggcggctttgattaaccggggtcaggagttattaccccatcaccaaaccccaggggcaaccatgacggcggagttggaatcccctagggttagcattgatggagttattaatccgtcagagttgacggaacagaagtccctaaacgatgactaaatccccccttaaactggtaaaactgaggcgttcgtcggtttcatccaccacaatggtctcaccaggtttgtaatccccccgtaaaattcccttggcgatcgccgtttctaggtatttttggacggctcgttttaaaggtcgggccc

SEQ ID NO: 3870 - protein, 332 aa, Synechocystis sp
MTTQLDRVVLIGVAGDSGCGKSTFLRRLTDLFGEEFMTVICLDDYHSLDRQGRKAAGVTALDPRANNFDLMYEQIKTLKSGQSIMKPIYNHETGLLDPPEKVEPNKVVVIEGLHPLYDERVRELVDFGVYLDISEEVKINWKIQRDMAERGHTYEDILASINARKPDFTAYIEPQKQYADVVIQVLPTRLIEDKESKLLRVRLVQKEGVKFFEPAYLFDEGSTIDWRPCGRKLTCTYPGIKMYYGPDNFMGNEVSLLEVDGRFENLEEMVYVENHLSKTGTKYYGEMTELLLKHKDYPGTDNGTGLFQVLVGLKMRKVYEQLTAEAKVPASV

SEQ ID NO: 3871 - DNA, 834 bp, Mus musculus
  CDS (1)..(834)
atggcttcggcgggaggcggcggctcggagagcgccgcgcccgaggccgatcgtccccagccgcggccgttcctcatcggcgtgagcggcggcaccgctagtggcaagtcaacagtgtgtgagaagatcatggagctgctgggacagaacgaagtggaccgccggcagcgcaagttggtcatcctgagccaggactgcttctacaaggttctgacggccgagcagaaggccaaggctttgaagggacagtacaattttgaccacccagatgcttttgataatgatctgatgcacaagaccctgaaaaacattgttgaaggcaaaactgtcgaggtccctacctatgattttgtgacccactcaaggttaccagagaccactgtggtctacccagctgatgtggttctgttcgagggcatcttggtattctacacccaggagatccgggacatgttccacctgcgcctctttgtggacacagactctgatgttaggctgtctcgaagagttctccgggatgtgcaacgaggaagggacctggagcagatcctgactcagtacaccgcctttgtgaaaccagcctttgaggagttctgcctgccgactaagaagtacgctgacgtgatcatccctcgaggagttgataatatggtggccatcaacctgatcgtgcaacacatccaggacatcctcaacggggacctgtgcaagcggcaccgaggcgggcccaacgggcgcaaccacaagaggaccttccccgagccaggagatcaccctggggtgttggccactggcaagcgctcacacctggagtctagcagcagaccccattga

SEQ ID NO: 3872 - protein, 277 aa, Mus musculus
MASAGGGGSESAAPEADRPQPRPFLIGVSGGTASGKSTVCEKIMELLGQNEVDRRQRKLVILSQDCFYKVLTAEQKAKALKGQYNFDHPDAFDNDLMHKTLKNIVEGKTVEVPTYDFVTHSRLPETTVVYPADVVLFEGILVFYTQEIRDMFHLRLFVDTDSDVRLSRRVLRDVQRGRDLEQILTQYTAFVKPAFEEFCLPTKKYADVIIPRGVDNMVAINLIVQHIQDILNGDLCKRHRGGPNGRNHKRTFPEPGDHPGVLATGKRSHLESSSRPH

SEQ ID NO: 3873 - DNA, 1200 bp, Homo sapiens
  CDS (180)..(965)
ctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactaaaaaaaaaaaaaaaaaaa

SEQ ID NO: 3874 - protein, 261 aa, Homo sapiens
MAGDSEQTLQNHQQPNGGEPFLIGVSGGTASGKSSVCAKIVQLLGQNEVDYRQKQVVILSQDSFYRVLTSEQKAKALKGQFNFDHPDAFDNELILKTLKEITEGKTVQIPVYDFVSHSRKEETVTVYPADVVLFEGILAFYSQEVRDLFQMKLFVDTDADTRLSRRVLRDISERGRDLEQILSQYITFVKPAFEEFCLPTKKYADVIIPRGADNLVAINLIVQHIQDILNGGPSKRQTNGCLNGYTPSRKRQASESSSRPH

SEQ ID NO: 3875 - DNA, 822 bp, Drosophila melanogaster
  CDS (40)..(822)
tgaagtagaagcatttgattttactagtgtaagagaaaaatgcaagatttgaggaacgccgacacgctgcgactgccaaatggcgacggagcagcagccaacgacgaggtcaagtcgccgtttctaatcggcgtcgccggcggaacggccagcggcaagtccaccgtgtgcaaaaagatcatggagcaacttgggcaggcggaaatggatcacacgcagcgccaggtggtgtccatcagtcaggacagcttctaccgcgaactgacgcccgccgagaaggccaaggcccagaagggcctcttcaacttcgatcatccggatgccttcaacgaggagctcatgtacagcacgcttcagaacatcttaaagggccacaaagtggagatacccagctatgactaccgcaccaactctctcgactttgaaaacgttctggttatctacccagccgacgtggtcttgttcgagggcatcttggtattttacttccccaagatacgagaactgttccacatgaagctgttcgtggacacagactccgataccaggttggccaggagagtgccacgtgatatcaatgagcgtggtcgggacttggatgcggtgctcacccagtatatgaccttcgtaaagccggctttcgaggagttctgctcgcccacgaaaaagtttgctgacgttattataccacgaggcgccgacaacacagttgccattgatcttattgtacaccatatcggggagattctcgccactaccaacagcgcacagcacagcaacacagtcagggtagcggcgtctagcatgaagcgagatcactaa

SEQ ID NO: 3876 - protein, 260 aa, Drosophila melanogaster
MQDLRNADTLRLPNGDGAAANDEVKSPFLIGVAGGTASGKSTVCKKIMEQLGQAEMDHTQRQVVSISQDSFYRELTPAEKAKAQKGLFNFDHPDAFNEELMYSTLQNILKGHKVEIPSYDYRTNSLDFENVLVIYPADVVLFEGILVFYFPKIRELFHMKLFVDTDSDTRLARRVPRDINERGRDLDAVLTQYMTFVKPAFEEFCSPTKKFADVIIPRGADNTVAIDLIVHHIGEILATTNSAQHSNTVRVAASSMKRDH

SEQ ID NO: 3877 - DNA, 1823 bp, Mus musculus
  CDS (6)..(1652)
acgccatggctgcgccgccggcctcaatgagcgccgccccttcgcccctgcagtctgctgtggccccagacgtgcctggccgccaggccgagcagaatgaaacggcgtgcgaggaccgcagcaatgcagggaccttggacagacttctcccaccagtgggtactgggcgctcaccccggaagcgcaccaccagccagtgcaagtcagaaccacccctgcttcgcacaagcaaacgtaccatctacacagctgggcggccaccatggtacaatgaacatggtacacagtccaaggaggcctttgctattggcttaggaggtggcagtgcatctgggaagaccactgtggccagaatgatcattgaggcactagatgtgccctgggtggtcctgttgtccatggactccttctataaggttctgacgcagcagcagcaggaacaggctgcctgtaacaatttcaactttgaccaccctgatgcctttgacttcgatctcatcatttccacccttaagaagctaaaacagggcaggagtgtccaagtgcccatctatgatttcactacccatagccggaaaaaggactggaaaaccctgtatggtgcgaatgtcatcatctttgagggtatcatggcctttgctgataagacactgctggagctcctggacatgaagatctttgtggacacggactctgatatccgactggttcggcgtctgcgcagggacatcagcgaacgaggccgggacattgagggtgtcattaagcagtacaacaagtttgtcaaacctgcatttgatcagtatatccagcctaccatgcggctggcagatattgtggtgcccagagggagcgggaacacagtagccattgacctgattgtgcagcatgttcacagccagctggaagagcgcgaactcagcgtcagggccgcgttggcctccgctcaccagtgccatcccctcccccagacactgagtgtcctcaagagtacaccgcaggtccgaggcatgcacaccatcatcagggacaaggagactagccgggatgaattcatcttctactccaaaagactgatgcggctgcttattgaacatgcactgtccttcctaccctttcaggactgcactgtacagactccacaggggcaggactacgtgggaaagtgctacgctggaaaacagatcaccggcgtgtcaattctgcgtgcaggagaaaccatggagcctgcactgcgtgccgtgtgcaaggatgtgcgcatcggcactatcctcatccagaccaaccagctcacaggggagcctgagctccattacctgaggcttcccaaggatatcagtgatgaccatgtgatcctgatggactgcacagtatccacaggtgctgcggccatgatggctgtacgtgtactcctggaccatgatgtgcctgaggacaagatctttttgctgtccctgctcatggcagagatgggtgtgcattctgtggcctacgctttcccacgcgtgagaatcatcaccacagctgtggacaagcgtgtcaatgaccttttccgtatcatcccaggcattgggaactttggtgatcgctactttgggacagatgcagtccctgatggcagtgatgatgatgaggcagccactgtgggttagtgcaatgaccgagctactcttatttctacccagccttctgtcttctggtctggaattgcagggacaacacattaacttattttgagtttaaaaatgttaccgaaataaaaataatcagtttacacattttataaaataaataaagctttatttagaaaaaaaaaaaaaaaa

SEQ ID NO: 3878 - protein, 548 aa, Mus musculus
MAAPPASMSAAPSPLQSAVAPDVPGRQAEQNETACEDRSNAGTLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTQQQQEQAACNNFNFDHPDAFDFDLIISTLKKLKQGRSVQVPIYDFTTHSRKKDWKTLYGANVIIFEGIMAFADKTLLELLDMKIFVDTDSDIRLVRRLRRDISERGRDIEGVIKQYNKFVKPAFDQYIQPTMRLADIVVPRGSGNTVAIDLIVQHVHSQLEERELSVRAALASAHQCHPLPQTLSVLKSTPQVRGMHTIIRDKETSRDEFIFYSKRLMRLLIEHALSFLPFQDCTVQTPQGQDYVGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDDDEAATVG

SEQ ID NO: 3879 - DNA, 627 bp, Clostridium perfringens
  CDS (1)..(627)
atgaagagaccaatttttataggaataacaggaggcactggctcaggtaaaagtacaatagctaaggagatatatagacaatttggtgaagattgtatagcaatgatagagcaagattcatattataaggatcaaagccatttatcaatggaggatagagttaaaactaactacgatcatccaaatgcttttgataacaatcttttagtttcacatttagaatcacttttaaatggacattctatacaaaaacctagttatgacttctctatacataatagaattgaagatacaactaaggttgagccaaaagaaattgttattgtagaaggaatattaatactagaagatccaagaataagagaacttctagatataaagatttacgttgatacagatgctgatgttagaatcataagaagaatggtcagagacataaatgaaagaggaagaactatggagtctgttataaatcagtacttaaatgtagtaaagcctatgcataatcaatttacagaacctacaaagaaatttgctgatataataataccagaaggtggacataataaagttgctatagatattattgttgcaaaaataaaagaggttttaggaaaatacgaataa

SEQ ID NO: 3880 - protein, 208 aa, Clostridium perfringens
MKRPIFIGITGGTGSGKSTIAKEIYRQFGEDCIAMIEQDSYYKDQSHLSMEDRVKTNYDHPNAFDNNLLVSHLESLLNGHSIQKPSYDFSIHNRIEDTTKVEPKEIVIVEGILILEDPRIRELLDIKIYVDTDADVRIIRRMVRDINERGRTMESVINQYLNVVKPMHNQFTEPTKKFADIIIPEGGHNKVAIDIIVAKIKEVLGKYE

SEQ ID NO: 3881 - DNA, 630 bp, Clostridium tetani
  CDS (1)..(630)
atgagtaaaagaccgatattaataggtataactggtggaacgggctcaggaaagagcactgtaagtaaagaaatttgtagaagatttgataaagagcttatagttatgatagagcaagattcctattacaaggaccaaagtcatttatccattgaagaaagagttaaaactaattatgatcaccctaatgcttttgatacagagcttttagtaaagcatttaaaagagctttcatattggagtaaagtggaaaaacctatatatgattttgaattacataatagaaaaaatgaaacagaaattgtagaacctactgaaattataatagtagaaggaatattagtattagaagaaaaagaaataagagatctattagatataaagatttatgtggatacagatgcagatgtaagaataataagaagacttgttagagatataaaggaaagaggaaggtctttagattccgtaataaatcaatatttaaatgttgtaagacctatgcatatgcaatttatagaaccaagtaaaagatatgcagatataataatccctgagggaggacataataaagtcgccatagatataatcgtaggaaatataaaacagatggttcaaaaatcagaataa

SEQ ID NO: 3882 - protein, 209 aa, Clostridium tetani
MSKRPILIGITGGTGSGKSTVSKEICRRFDKELIVMIEQDSYYKDQSHLSIEERVKTNYDHPNAFDTELLVKHLKELSYWSKVEKPIYDFELHNRKNETEIVEPTEIIIVEGILVLEEKEIRDLLDIKIYVDTDADVRIIRRLVRDIKERGRSLDSVINQYLNVVRPMHMQFIEPSKRYADIIIPEGGHNKVAIDIIVGNIKQMVQKSE

SEQ ID NO: 3883 - DNA, 678 bp, Halobacterium sp
  CDS (1)..(678)
atgaccatcccgtcgttcgcgatcggcatcgccggaggcacgggtgccggcaaaaccacggtcgcccgcgagatcaccgacaacgtgggcgagtcggcgacgctgattccgctggacaactactacgaggacctctcggaccgccccttcgaggagcgcgcgaacgccaactacgaccacccgtcggcgttcgagtgggagctgcttcgcacacacatcgacgccttgctgtccgggcagtcgatcgagatgccccagtacgacttcgagagacacgtccggaaggccgaccgggttgttgtcgaacccacggacgtgatcgtgctggaggggattctggcgctctccgacgagacggtcaacgacatgcttgatctccacatctacgtggaaacggacgccgacgttcgcatcctgcgccgcatcgagcgcgacgtcgtcgagcgcggccgcgaactggaaggcgtgatggaccagtatctctcgacggtgaagccgatgcacgagcagttcatcgaaccgacgaaacgacacgccgacatcatcatcccggagggcgcaaactcggtcgcggtgaacctgctcgaagagaaagtgcaggccgaaacctccgagatgacggcgtgggccgcccgcgacgacaccgccttcgaagacgccacctacaatccacagtag

SEQ ID NO: 3884 - protein, 225 aa, Halobacterium sp
MTIPSFAIGIAGGTGAGKTTVAREITDNVGESATLIPLDNYYEDLSDRPFEERANANYDHPSAFEWELLRTHIDALLSGQSIEMPQYDFERHVRKADRVVVEPTDVIVLEGILALSDETVNDMLDLHIYVETDADVRILRRIERDVVERGRELEGVMDQYLSTVKPMHEQFIEPTKRHADIIIPEGANSVAVNLLEEKVQAETSEMTAWAARDDTAFEDATYNPQ

SEQ ID NO: 3885 - DNA, 630 bp, Lactobacillus plantarum
  CDS (1)..(630)
atgactgaaaataaacatcgccgaccagtagtcatcggggtaactggtggttccggtagtggtaaaactacggtcagcaatgcaatttacaaccaattatctggtcaatcattgttgatcttacaacaggattcctattacaatgatcaaagtgaaatgacaatggctgagcgccatgccgttaattacgaccacccactggctttcgatacagatttgatgattaagcaaatcaagcagttgctggcctatcaaccaattgaaaagccggtctatgattacgagcagtatacgcgtagcgacaagaccattcatcaagaaccgcgtgatgtgatcattgtcgaaggggtattgatcctagatgatcagcgtttacgcgacctgatggatattaaggtgttcgtcgataccgacgatgatattcgaatcattcggcgcattcagcgtgatatcaaagagcggggccggacactagactctgtgattggtcaatatttggcgacggtcaaaccaatgtatcatcagtttgtggaaccaacgaaacgttatgccgatctaattgtgccagaaggtggcgaaaatgaagttgccattgatttattgacaactaaagttcgttcaattttataa

SEQ ID NO: 3886 - protein, 209 aa, Lactobacillus plantarum
MTENKHRRPVVIGVTGGSGSGKTTVSNAIYNQLSGQSLLILQQDSYYNDQSEMTMAERHAVNYDHPLAFDTDLMIKQIKQLLAYQPIEKPVYDYEQYTRSDKTIHQEPRDVIIVEGVLILDDQRLRDLMDIKVFVDTDDDIRIIRRIQRDIKERGRTLDSVIGQYLATVKPMYHQFVEPTKRYADLIVPEGGENEVAIDLLTTKVRSIL

SEQ ID NO: 3887 - DNA, 633 bp, Oceanobacillus iheyensis
  CDS (1)..(633)
atgacaaagcaaaaaccagttgtaattggagtagcaggaggaagtggatcaggaaaaacatctgtgactcgctccatttgtcaacgatttacagaaacatcgattttggtaatcgagcaggattattattataaagatcaaagtcacttaccattcgaggaaagattaaataccaattatgatcatccattggcgtttgataatgatttattaatagaacatttacagcaattaatgcataatgaaccaattgaaaaacctgtatatgattataaaattcatactcggtcaaaagacgttattcatgtagaaccaaaagaagttattattgtagaaggtatattaatacttgaagatccacgcttagttgatttaatggatattaaggtttatgttgatacggatgcagatttacgaataattcgccgcttaatgcgagatatcaaagagcgcggtaggacgttagattctgtaatcgatcaatatatccagaatgttcgcccatcacacctgcaatttattgaaccaacaaagcgttatgccgatataatcatacctgaaggtggacaaaatcatgtcgcaattgatatcatggcttctaaaatagaaaaaatattatctagagggttataa

SEQ ID NO: 3888 - protein, 210 aa, Oceanobacillus iheyensis
MTKQKPVVIGVAGGSGSGKTSVTRSICQRFTETSILVIEQDYYYKDQSHLPFEERLNTNYDHPLAFDNDLLIEHLQQLMHNEPIEKPVYDYKIHTRSKDVIHVEPKEVIIVEGILILEDPRLVDLMDIKVYVDTDADLRIIRRLMRDIKERGRTLDSVIDQYIQNVRPSHLQFIEPTKRYADIIIPEGGQNHVAIDIMASKIEKILSRGL

SEQ ID NO: 3889 - DNA, 651 bp, Pasteurella multocida
  CDS (1)..(651)
atgtcaaactcatcaacaccatcttgtattattattgccatcgctggggcttcagcatcaggaaaaagcttaattgcctcaactgttcatcgagagttgtgtgatgagctaggttgcgaagaaattggcattatttccgaagactcttattataaagatcaaagtcatttggatatggaagatcgaattaaaaccaactatgatcatcctaattctatggatagacaccttttaattgaacacctcaaagcactcaaatctggtcaaccggttgatattcccgtctatagctacgttgagcatactcgaaccaatcaagtccaacactttgaacctaaaaaagtgatcattctggaagggattttattgcttactgatgaaaaattgcgtgatgaagtcagtgtctctgtttttgtcgatacaccactggatatttgttttattcgtcgcttacaacgtgacatgaaagaacgtggtcgaagtttagaatcggtagtggagcagtatcgtaaaacagtgcgtcccatgtttttacagtttattgagccctctaaacaatatgctgatatcgtgatcccgcgaggtggtaaaaatcgaattgccattaatatgttaaaagcacagattagacaacttttgggaaaacgttaa

SEQ ID NO: 3890 - protein, 216 aa, Pasteurella multocida
MSNSSTPSCIIIAIAGASASGKSLIASTVHRELCDELGCEEIGIISEDSYYKDQSHLDMEDRIKTNYDHPNSMDRHLLIEHLKALKSGQPVDIPVYSYVEHTRTNQVQHFEPKKVIILEGILLLTDEKLRDEVSVSVFVDTPLDICFIRRLQRDMKERGRSLESVVEQYRKTVRPMFLQFIEPSKQYADIVIPRGGKNRIAINMLKAQIRQLLGKR

SEQ ID NO: 3891 - DNA, 639 bp, Shewanella oneidensis
  CDS (1)..(639)
atgaattctcagcagtgtgtcattatagcaattgctggcgcgtcagcatctggcaagagtttaattgccaagacgatttttgacgaacttcgccgcgatttaggcacagatcagattggggtaattaacgaagacgcgtactatcgcgatcagagtcatttatccatggatgagcgggtgttaacaaactacgaccatcccaaagcgttagaccatcaactgttatgcacgcacttgcagttacttaagtctggcgaagctgttgatattccttgctatagctataccgaacatacgcgtatggccgaaaccgttaaaatgacaccgaaaaaagtgatcattttagagggcattctgctgttaactgatcctaaattgcgtgaattgatggatgccagcgtgtttatggatacgccgctggacatttgtttcctgcgccgtttaacccgcgatgtggctgaacgtggccgtacgatggaatcggtgatttcacagtacaagaaaaccgtccgtcctatgttcctgcaatttattgaaccttcaaaacaatacgctgatattatcgtgccccgcggtggcaaaaaccgtatcgcgaccgatattttgaagactcgaatccaacatctactggcaaaataa

SEQ ID NO: 3892 - protein, 212 aa, Shewanella oneidensis
MNSQQCVIIAIAGASASGKSLIAKTIFDELRRDLGTDQIGVINEDAYYRDQSHLSMDERVLTNYDHPKALDHQLLCTHLQLLKSGEAVDIPCYSYTEHTRMAETVKMTPKKVIILEGILLLTDPKLRELMDASVFMDTPLDICFLRRLTRDVAERGRTMESVISQYKKTVRPMFLQFIEPSKQYADIIVPRGGKNRIATDILKTRIQHLLAK

SEQ ID NO: 3893 - DNA, 624 bp, Staphylococcus epidermidis
  CDS (1)..(624)
atgaatcagacaacgattattggcattgcagggggttcaggctctgggaaaaccacagttactaatgcaatcatgaagaatttagaaggtcatagtgtcgcactcttagcacaagattattactataaagatcaatcacatttaacttttgaagaacggcttgaaacaaattatgaccacccatttgcatttgataatgatttacttattcataatttaaaagatttaagaaatggaaaaccagtagaggtacctacgtacgattattctcaacatacacgtagtaaagaaacaattgcatttgatccaaaagatgttattatcgtagaaggtatctttgctttagaaaacaacacattacgagacatgatggatgtgaaaatttatgtcgatactgatgctgatttacgaattttacgtaggcttacaagagatactaaagagcgtggtcgtacaatggaatcagtaattaatcaatatcttaatgtagtaagacctatgcatgagcaatttattgaacctacaaaaaagcatgctgacatcataattcctgaaggaggcagcaataaagttgccatagatattatgactactaaaatccagtcactcgtaagcaaaaaatag

SEQ ID NO: 3894 - protein, 207 aa, Staphylococcus epidermidis
MNQTTIIGIAGGSGSGKTTVTNAIMKNLEGHSVALLAQDYYYKDQSHLTFEERLETNYDHPFAFDNDLLIHNLKDLRNGKPVEVPTYDYSQHTRSKETIAFDPKDVIIVEGIFALENNTLRDMMDVKIYVDTDADLRILRRLTRDTKERGRTMESVINQYLNVVRPMHEQFIEPTKKHADIIIPEGGSNKVAIDIMTTKIQSLVSKK

SEQ ID NO: 3895 - DNA, 627 bp, Streptococcus pyogenes
  CDS (1)..(627)
atgcttaaaaaaccgattattattggtgtaactggtggttcaggtggcggtaaaacaagtgtgtcacgcgctattttggacagttttccaaatgctcgtattgcaatgattcaacacgattcttactataaagatcagtctcacatgagttttgaagaaagggtcaagaccaattatgaccatcctctagcttttgatacagattttatgattcagcaactaaaagaattattagctggtagacctgtagatattcctatctatgattacaaaaagcatacccgcagtaatacgacctttcgtcaggatcctcaggatgttattattgttgaaggtattcttgtcctagaagatgagcgtttgcgagatttgatggatatcaagctctttgtagacacagatgacgatattcgtattattcgtcgtattaagcgtgacatgatggaacgtggcagaagcttagaaagtattattgatcagtacacaagcgtggtaaagcctatgtatcatcagtttattgagccaagtaaacgctatgctgatattgttattccagagggagttagtaatgtcgttgctattgatgttattaatagtaaaattgcgagtattcttggagaagtatag

SEQ ID NO: 3896 - protein, 208 aa, Streptococcus pyogenes
MLKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 3897 - DNA, 642 bp, Vibrio cholerae
  CDS (1)..(642)
atgtctgagaataatcaatgtgtcatcgtcggtattgctggcgcttctgcttctggtaagagtctcattgcgagcacgatttataatgagctacgcgccaaagtgggtgaccatcaaatcggtgtgattacggaagattgctactacaaagatcagagccatctgagcatggaagaacgtgttaaaaccaactacgaccacccaagtgcgctagaccacgatctcctttgccaacatttgcaaatgctggcgcgtggcgaagcggttgaagtgccagaatacagctacactgagcacacgcgtaccgagcaaaccaccaccatgacgccgaagaaagtgatcattctggaaggcatcctgcttctgactgacccacgtctacgtgatttgatgcacgcgaccgtatttatggatacgccgctggatatctgcttgctgcgccgtgtgaagcgtgatgttcaagagcgtggtcgcaccatggaatctgtactgaagcagtaccaagagacggtgcgccctatgtttatgcaatttattgagccgtctaaacagtacgcagacatcattgtgccgcgtggtggtaaaaaccgtatcgcgattgatgttctcaaagcgcatatcgcaaaattgctcaaatcgtaa

SEQ ID NO: 3898 - protein, 213 aa, Vibrio cholerae
MSENNQCVIVGIAGASASGKSLIASTIYNELRAKVGDHQIGVITEDCYYKDQSHLSMEERVKTNYDHPSALDHDLLCQHLQMLARGEAVEVPEYSYTEHTRTEQTTTMTPKKVIILEGILLLTDPRLRDLMHATVFMDTPLDICLLRRVKRDVQERGRTMESVLKQYQETVRPMFMQFIEPSKQYADIIVPRGGKNRIAIDVLKAHIAKLLKS

SEQ ID NO: 3899 - DNA, 642 bp, Vibrio parahaemolyticus
  CDS (1)..(642)
atgtctgataataatcaatgcgtcatcgtaggtattgctggcgcttctgcttctggaaaaagtctgatcgcgagcacaatttacaatgagcttcgcgcgaaagtaggcgatcatcaaatcggtgtcatcacggaagattgctactacaacgaccaaagccacctaagcatggaagagcgagtaaagacgaactacgatcacccgagtgcgttggaccacgacctattgtgcgagcacctagagaagcttgtacgtggtgaggccgtggaagtgcctgagtacagctacacagagcacacaagaacaagtaacaccaccacaatgacccctaaaaaggtaatcattttagaaggtatccttcttcttactgaccctcgtcttcgtgacctgatgcacgcgactgtatttatggatacgcctctggatatctgcctacttcgccgtgttaagcgtgacgttgaagagcgtggccgtacaatggaatccgttcttaagcaatatcagcaaactgttcgtccgatgttcatgcagtttatcgaaccttctaagcaatatgcggacatcatcgtacctcgtggcggtaagaaccgtatcgcgatcgatgtactaaaagctcacattgcaaaacttttgaaagcttaa

SEQ ID NO: 3900 - protein, 213 aa, Vibrio parahaemolyticus
MSDNNQCVIVGIAGASASGKSLIASTIYNELRAKVGDHQIGVITEDCYYNDQSHLSMEERVKTNYDHPSALDHDLLCEHLEKLVRGEAVEVPEYSYTEHTRTSNTTTMTPKKVIILEGILLLTDPRLRDLMHATVFMDTPLDICLLRRVKRDVEERGRTMESVLKQYQQTVRPMFMQFIEPSKQYADIIVPRGGKNRIAIDVLKAHIAKLLKA

SEQ ID NO: 3901 - DNA, 816 bp, Xenopus laevis
  CDS (1)..(816)
atggcttccgcggggagcctggatgtaccagagcggggacaccagcggcctttccttatcggagtgagcggcggcactgccagcggcaagtctacagtatgtgagaagatcatggagctgctggggcagaatgaggtggatcaccggcagaggaaagtggtcatcctgagccaggaccggttttacaaggtgctcacccccgagcagaaaaccagagctctgaaaggccagtataacttcgaccaccctgatgcctttgataatgagctgatgcacaggactctgacccagatcttggaggggcagatagtggatgtgcctatgtacgacttcatcactcattcaaggcttccggagaccacaactgtgtatcctgcagacgtgttgctgtttgaggggatcctggcattttataaccaggagataagagacatgttccagctgaagctcttcgtggatacggactccgatgtcaggctctcccggcgagttctgcgtgacatgaagcgcggccgagacctggaacagatcctcactcaatacaccacctttgtgaaacctgcatttgaggagttctccctgccgaccaagaaatacgctgacgtcattattccgcggggggtggataatatggtggcaattaacctgatcgtgcagcacatccaggacatcctgaacggcgacatctgcaagtggcagcgaggggtactgaatggccgcagtcagaagaggacgttcccagggcaaggagaatctggagggctcatcctaccagggaaacgtacccaccttgagtccagcagtcggccccactga

SEQ ID NO: 3902 - protein, 271 aa, Xenopus laevis
MASAGSLDVPERGHQRPFLIGVSGGTASGKSTVCEKIMELLGQNEVDHRQRKVVILSQDRFYKVLTPEQKTRALKGQYNFDHPDAFDNELMHRTLTQILEGQIVDVPMYDFITHSRLPETTTVYPADVLLFEGILAFYNQEIRDMFQLKLFVDTDSDVRLSRRVLRDMKRGRDLEQILTQYTTFVKPAFEEFSLPTKKYADVIIPRGVDNMVAINLIVQHIQDILNGDICKWQRGVLNGRSQKRTFPGQGESGGLILPGKRTHLESSSRPH

SEQ ID NO: 3903 - DNA, 21 bp, artificial sequence
  primer
atggcgcttcgtcgccccctt

SEQ ID NO: 3904 - DNA, 27 bp, artificial sequence
  primer
ttattcaaagaactgacttattttcgc

SEQ ID NO: 3905 - DNA, 1299 bp, Escherichia coli K12
  CDS (1)..(1299)
atgtccaaaatcgtaaaaatcatcggtcgtgaaatcatcgactcccgtggtaacccgactgttgaagccgaagtacatctggagggtggtttcgtcggtatggcagctgctccgtcaggtgcttctactggttcccgtgaagctctggaactgcgcgatggcgacaaatcccgtttcctgggtaaaggcgtaaccaaagctgttgctgcggtaaacggcccgatcgctcaggcgctgattggcaaagatgctaaagatcaggctggcattgacaagatcatgatcgacctggacggcaccgaaaacaaatccaaattcggcgcgaacgcaatcctggctgtatctctggctaacgccaaagctgctgcagctgctaaaggtatgccgctgtacgagcacatcgctgaactgaacggtactccgggcaaatactctatgccggttccgatgatgaacatcatcaacggtggtgagcacgctgacaacaacgttgatatccaggaattcatgattcagccggttggcgcgaaaactgtgaaagaagccatccgcatgggttctgaagttttccatcacctggcaaaagttctgaaagcgaaaggcatgaacactgctgttggtgacgaaggtggctatgcgccgaacctgggttccaacgctgaagctctggctgttatcgctgaagctgttaaagctgctggttatgaactgggcaaagacatcactttggcgatggactgcgcagcttctgaattctacaaagatggtaaatacgttctggctggcgaaggcaacaaagcgttcacctctgaagaattcactcacttcctggaagaactgaccaaacagtacccgatcgtttctatcgaagacggtctggacgaatctgactgggacggtttcgcataccagaccaaagttctgggcgacaaaatccagctggttggtgacgacctgttcgtaaccaacaccaagatcctgaaagaaggtatcgaaaaaggtatcgctaactccatcctgatcaaattcaaccagatcggttctctgaccgaaactctggctgcaatcaagatggcgaaagatgctggctacactgcagttatctctcaccgttctggcgaaactgaagacgctaccatcgctgacctggctgttggtactgctgcaggccagatcaaaactggttctatgagccgttctgaccgtgttgctaaatacaaccagctgattcgtatcgaagaagctctgggcgaaaaagcaccgtacaacggtcgtaaagagatcaaaggccaggcataa

SEQ ID NO: 3906 - protein, 432 aa, Escherichia coli K12
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 3907 - DNA, 1458 bp, Oryza sativa
  CDS (1)..(1458)
atgtcggtgcaggagtacctggagaagcacctgctgtcgcgcaagatcgaggaggccgtgaacgcggcggtccgcgccaaggcccccgacccggtgctcttcatctccaaccacatgcgccgggcggcgccggccgtgatcacgagcgtgcgggcgcgccagatcctcgacggccgcggggagcccgccgtggaggtcagcctccacaccaacaaggccgtgcaccgcgcctccgcggccgccgcggacgcccccgagggcgccgccgccgacgccgtcagggacgccgagaagcggaagctgctcgccagggcggtcgccgatgcggtgcgggtgatcaacgacaaggtgtcggaggcgcttgtgggaatggatccgcagcagcagtcgcagatcgaccaggccatcatggacttggacaaggcgcatcacaaggctgagattggagtgaattctatgttggctgtatcaattgcagcttgtaaagcaggtgctgctgaaaaagaggttccattgtacaagcatatagcagaacttgttgggaaaagcgctacgacacttcccatccctgcaattacagtcattaatggaggaacacatgctggaaacagtctccctattcaagaaattatgatccttcctgttggtgccaaaaactttgaagaagcaatgcagatgggttctgagacatatcatcatctgaaggatatcatcttggagaaatatggttcaaacagctgcaacataggtgatgatggtggatttgctccaaatatttccaggcaatggaattatgccattcagtattgctggtcagccgtcaacctaatggcttatattaaccgtacaactttgaaccatagaagcagagaacttgaacagcaattagaatgtgttgtatgctatggaaataagtatgacatggagttcaagtttgcagagaaatcagggcagggcttcaaaactgcagatgatttgattgagatttatagccagctttgttcagagtacccacttgtctcaatcgaacagccctttgataaagatgactgggagcattcgaagaagtttaccaccctagagctgtgccaggttgtaggtgatgacttattgatgtcagatcccgaacgcattaagcgggcagtaaatgagtatacctgcaatgctcttgttctcaaggctaatcaagtaggcactgtcacggaagccatagaggttgtgagacaggcaaaggatgctcattggggcgtaatggtgtcacataggtccggggacactgatgattctttcattgctgacttggctgttggtgctgctgctggacagatcaaagcgggtgctccttgccgtggagaatgtctcagtaaatacaatcagctgcttagaatagaggaagaacttggaagtgacggtgtttatgcaggggaaaattggagaaccaccgcaagcacaagctga

SEQ ID NO: 3908 - protein, 485 aa, Oryza sativa
MSVQEYLEKHLLSRKIEEAVNAAVRAKAPDPVLFISNHMRRAAPAVITSVRARQILDGRGEPAVEVSLHTNKAVHRASAAAADAPEGAAADAVRDAEKRKLLARAVADAVRVINDKVSEALVGMDPQQQSQIDQAIMDLDKAHHKAEIGVNSMLAVSIAACKAGAAEKEVPLYKHIAELVGKSATTLPIPAITVINGGTHAGNSLPIQEIMILPVGAKNFEEAMQMGSETYHHLKDIILEKYGSNSCNIGDDGGFAPNISRQWNYAIQYCWSAVNLMAYINRTTLNHRSRELEQQLECVVCYGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 3909 - DNA, 1287 bp, Oryza sativa
  CDS (1)..(1287)
atggcggcgacgatcgtgtccgtcaaggcgcgccagatcttcgacagcaggggcaaccccaccgtcgaggtcgatgtgtgctgctcagatggaacctttgcaagggctgcagttcccagtggtgcatcaactggtgtctatgaagctctcgaattgagggacggtggatctgattacttgggaaagggtgtttccaaggctgtcgacaatgtgaactcggttattgccccagctctgattggcaaggaccctacgtcacaggctgagcttgataacttcatggttcagcagcttgatggaaccaaaaatgagtgggggtggtgcaagcagaagcttggtgctaatgcaatcctggctgtgtcactggccatttgcaaagctggagctatcatcaagaagattcctctgtaccagcacattgccaaccttgctggaaacaagcaactggttttgcccgtacctgcattcaacgtcattaacggtggatcacatgctggaaacaagcttgccatgcaggcagagttcatgatccttcctactggggccgcttcattcaaggaggccatgaagatgggtgttgaagtgtaccacaacctgaagtctgttatcaagaagaagtatggtcaggatgccaccaatgttggtgatgaaggtggttttgctcctaacattcaggaaaacaaggagggtcttgagctcttgaagactgcaattgaaaaggctggatacactggcaaggttgtcattggaatggatgttgctgcttcggaattctacaatgacaaggacaaaacctatgaccttaacttcaaggaggagaacaatgatggttcacaaaagatatctggtgatagcctgaagaatgtatacaagtcatttgtcagtgaataccccattgtctcgattgaggatccgtttgaccaggatgactgggaacactatgctaagatgaccgctgaaattggagagcaagtgcagattgtcggtgatgacctccttgtcaccaacccaacaagggtggcaaaggcaatccaggagaagtcatgcaatgctcttctgctgaaggttaaccaaattggatctgtcactgagagtattgaggccgtgaagatgtcaaagcgtgctggctggggtgtgatgaccagccacaggagtggtgagactgaggataccttcattgctgatttggctgttggtttggccacgcttcttaggattgaggaggagcttggtgcggctgctgtctacgctggtgccaagttccgcgcacccgtggagccctactaa

SEQ ID NO: 3910 - protein, 428 aa, Oryza sativa
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATLLRIEEELGAAAVYAGAKFRAPVEPY

SEQ ID NO: 3911 - DNA, 1725 bp, Rattus norvegicus (Norway rat)
  CDS (111)..(1415)
agtgctgctccggtaccgagtcgcgctcacgtttgtccttaagactcccttcggtgtctccaggaccctctttccttcctccgcagcgatcctactgccagaacttcaccatgtccattctcaagatccatgccagagagatctttgactcccgcgggaatcccaccgttgaggtggatctctacaccgcaaaaggtctcttccgtgctgcggtgcccagcggtgcgtccactggcatctacgaggccctagaactccgagacaatgataagacccgcttcatggggaagggtgtctcaaaggctgttgagcacatcaataaaactattgcacctgctctggttagcaagaaactgaatgttgtggagcaggagaagattgaccagctgatgatcgagatggacggcacagagaataaatctaagtttggtgcaaatgccatcctgggagtgtccctggctgtctgcaaggctggtgccgtggggaagggggtgcccctttaccgtcacattgccgacttggccggcaaccctgaagtcactctgccggtcccagctttcaatgtgatcaacggcggttctcatgctggcaacaagttggccatgcaagagttcatgatcctgcctgtgggggcatcctctttccgggaagccatgcgcattggagcagaggtttaccacaacctgaagaacgtcatcaaagagaagtacgggaaagacgccaccaatgtgggtgatgagggtggattcgcacctaacatcctggagaacaaagaagcactggagctgctcaagtctgccattgcaaaggccggctacactgaccaggttgtcatcggcatggatgtggctgcctccgagttctacagggctggcaagtatgacctggacttcaagtctccagatgatgccagccggtacatcacacccgaccagctggccgacctgtacaagtccttcatcaaggactacccagtggtgtccattgaagatccctttgaccaggacgactgggatgcttggcagaagttcacagctactgcaggcatccaggtggtgggggatgacctcacagtgaccaaccctaagcggatcgccaaggctgcaggcgaaaagtcctgcaactgcctcctgctcaaagtgaaccagattggctctgtgaccgagtctctgcaggcgtgtaagctggcccagtccaatggctggggtgtcatggtgtcccatcgatctgaggagactgaggacactttcattgccgacctggtggtggggctctgcactgggcagatcaagactggtgccccctgccgatctgagcgcctggccaagtacaatcagatccttagaatcgaggaggaactgggcagcaaagccaagtttgccggcaggtccttcaggaaccccctggccaagtaaggcatggaccggagatccctggagctaccagatcctctgtctccgtcatccaggcggctcaaggctggcccagtgcttgcccctcccatgtcactgcttccttagatgtccaccccgaccacctggagccctgctggagcccccagctttgtaatcatgtgatcagtctgaatcattgtttctgtcacctgactttccagctagtgtctggagccctctgaactccagcgtaatctctagagtgcccacaccatcaagactccccccagtggtttacttgcaaaaataaaagctgcagaagctcaaaaaa

SEQ ID NO: 3912 - protein, 434 aa, Rattus norvegicus (Norway rat)
MSILKIHAREIFDSRGNPTVEVDLYTAKGLFRAAVPSGASTGIYEALELRDNDKTRFMGKGVSKAVEHINKTIAPALVSKKLNVVEQEKIDQLMIEMDGTENKSKFGANAILGVSLAVCKAGAVGKGVPLYRHIADLAGNPEVTLPVPAFNVINGGSHAGNKLAMQEFMILPVGASSFREAMRIGAEVYHNLKNVIKEKYGKDATNVGDEGGFAPNILENKEALELLKSAIAKAGYTDQVVIGMDVAASEFYRAGKYDLDFKSPDDASRYITPDQLADLYKSFIKDYPVVSIEDPFDQDDWDAWQKFTATAGIQVVGDDLTVTNPKRIAKAAGEKSCNCLLLKVNQIGSVTESLQACKLAQSNGWGVMVSHRSEETEDTFIADLVVGLCTGQIKTGAPCRSERLAKYNQILRIEEELGSKAKFAGRSFRNPLAK

SEQ ID NO: 3913 - DNA, 1636 bp, Rattus norvegicus (Norway rat)
  CDS (60)..(1364)
ggggaccaccgccaccgccaccggctgagtctgcagtcctcgaggagatcccagccatcatgtctatacagaagatctgggcccgagagatcttggactcccgtgggaatcccaccgtggaggtggatctccatactgccaaaggtcttttccgggctgcagtccccagtggggcctccactggcatctatgaggccctggagctaagggatggggacaaacagcgttacttaggcaaaggtgtcctgaaggctgtggaccacatcaacagcaccatcgcaccggccctcatcagctcaggcctctctgtggtggagcaggagaagctggacaacctgatgctggagttggatgggactgagaacaaatccaagtttggggccaatgccatcctgggtgtgtccctggccgtgtgcaaggctggggcagccgagaaggacttgcccctctatcgccacattgctcaactggctgggaactccgacctcatcctgcccgtgccggcctttaatgtgatcaacggtggctctcatgctgggaacaagttggccatgcaggagttcatgatcctcccagtgggtgctgagagctttcgggatgccatgcgacttggggccgaggtgtaccacacactcaagggggtcatcaaggacaagtacggcaaggatgccactaatgtgggggatgaaggcggctttgcccccaatatcctggagaacagcgaagctttggagctggtgaaggaagccattgacaaggctggctacacggaaaagatggtgattggtatggatgtggctgcctctgagttttaccgcgatggcaaatacgacttggatttcaagtctcctgctgacccttcccgatgcatcactggggaccagcttggggcactctaccaggactttgtccggaactatcctgtggtctccattgaagacccattcgaccaggatgactgggcagcttggtccaagttcacagccaatgtcggcatccagatagtgggtgatgacctgacggtgaccaaccccaagcgcatcgagcgggcagtggaggagaaggcctgcaactgtttgctgctcaaggtcaaccagatcggctcagtcacagaagccatccaagcgtgcaagctggcccaggagaacggctggggggttatggtgagtcatcgctctggagaaaccgaggacacgttcattgcagacctcgtagtgggactgtgtacaggtcagatcaagactggtgccccatgcagatctgaacgtctggcgaagtacaaccagctcatgaggattgaagaggagctgggggaggaggctcgcttcgcgggacacaacttccggaatcccagtgtgctgtgaccccctgcttgcctgaacaccggaacatcatctcattctcctggagcctctttcttgctgtcccgacctgccatagttaccttgataccttgagccccaagtcacccagaacacctcgactcacctgctctggctgttcttggcttccacaaccccttgctgtctctactcttcctcctctctgggccccatttttggggggattccagtctgcccactttcccttctattctctctaatcgaaaaaaaaaaaaaaaaaaaaaaaaaaaaaa

SEQ ID NO: 3914 - protein, 434 aa, Rattus norvegicus (Norway rat)
MSIQKIWAREILDSRGNPTVEVDLHTAKGLFRAAVPSGASTGIYEALELRDGDKQRYLGKGVLKAVDHINSTIAPALISSGLSVVEQEKLDNLMLELDGTENKSKFGANAILGVSLAVCKAGAAEKDLPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKMVIGMDVAASEFYRDGKYDLDFKSPADPSRCITGDQLGALYQDFVRNYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGEEARFAGHNFRNPSVL

SEQ ID NO: 3915 - DNA, 1898 bp, Homo sapiens (man)
  CDS (166)..(1470)
ctgggttcaagcagttctcctgcctcagcctcccaagtggctgggcatggtggcggacgccggacgcgtgggcggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaaaaaaaaaaaaaaaaaaaaaaaaaaaaaaaaaaaaaaaaaaaaaaaaaaaaaaaaaaaaaaaaaaaaaaaa

SEQ ID NO: 3916 - protein, 434 aa, Homo sapiens (man)
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 3917 - DNA, 1441 bp, Oryctolagus cuniculus (domestic rabbit)
  CDS (53)..(1357)
aattcccctagactcagagctccatccaaactccagcgaagacatcccagccatggccatgcagaaaatcttcgcccgggaaatcctggactccaggggcaaccccacggtggaggtggacctgcacacagccaagggccgattccgagcagcggtgcccagcggagcttccacggggatctatgaagctctggagctgagagatggagacaaatcccgctacctggggaaaggtgtcctgaaggctgtggaacacatcaacaagaccctaggccctgctctgctggaaaagaaactaagcgttgtggatcaagaaaaagtggacaagtttatgattgagctggatgggaccgagaataagtccaagtttggggccaatgccatcctgggcgtgtccttggccgtgtgtaaggctggagcggcagagaagggggtcccgctctaccgacacatcgcagacctcgctgggaaccatgacctcgtgctcccagtgcctgccttcaacgtgatcaacgggggctcccacgcaggcaacaagctggccatgcaggagttcatgatcctgcccgtgggggccagctccttcagggaggccatgcgcatcggcgccgaggtctaccaccacctcaagggggtcatcaaagccaagtacggaaaggacgccaccaatgtgggggacgagggtggcttcgcgcccaacatcctggagaacaatgaggccctggagctgctgaagaccgccatccaggcggccggctacccagacaaggtggtgatcggcatggacgtggcggcctccgagttccaccgcaacgggaagtacgacctggacttcaagtcgccggatgatcccgcgcggcacatcactgggcagaagcttggggagctgtacaagagcttcatcaagaactaccctgtggtctccatcgaggacccctttgaccaggatgactgggccacctggacttcattcctttcgggggtggacatccagatcgtgggggatgacctcacagtcactaaccccaagaggatcgcccaggccgtggagaagaaggcctgcaactgcctgctgctgaaggtcaaccagatcggctcagtgacggaatccatccaggcttgcaaactggcccagtctaacggctggggggtgatggtgagccaccgctccggggagacggaggacaccttcatcgccgacctcgtggtggggctctgcacgggacagatcaagactggcgccccctgccgctcggagcggctggccaagtacaaccaactcatgaggatcgaggaggctcttggggacaaggctgtcttcgctggacgcaagttccgtaacccgaaggccaagtgagaagcaggaggccctgggactccacttgacacaccctggcctttgagccttttcccctgaaataaacactggtgccagtcacgg

SEQ ID NO: 3918 - protein, 434 aa, Oryctolagus cuniculus (domestic rabbit)
MAMQKIFAREILDSRGNPTVEVDLHTAKGRFRAAVPSGASTGIYEALELRDGDKSRYLGKGVLKAVEHINKTLGPALLEKKLSVVDQEKVDKFMIELDGTENKSKFGANAILGVSLAVCKAGAAEKGVPLYRHIADLAGNHDLVLPVPAFNVINGGSHAGNKLAMQEFMILPVGASSFREAMRIGAEVYHHLKGVIKAKYGKDATNVGDEGGFAPNILENNEALELLKTAIQAAGYPDKVVIGMDVAASEFHRNGKYDLDFKSPDDPARHITGQKLGELYKSFIKNYPVVSIEDPFDQDDWATWTSFLSGVDIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAVFAGRKFRNPKAK

SEQ ID NO: 3919 - DNA, 1323 bp, Candida albicans
  CDS (1)..(1323)
atgtcttacgccactaaaatccacgccagatacgtctacgactccagaggtaacccaaccgttgaagttgatttcaccaccgacaaaggtttattcagatcaattgtcccatctggtgcctctactggtgtccacgaagctttggaattgagagatggtgacaaatccaaatggttaggtaaaggtgttttgaaagccgttgccaatgttaatgacatcattgccccagctttaataaaagccaagatcgatgttgtcgaccaagctaagattgatgaattcttgttgtccttggacggtactccaaacaaatccaaattgggtgccaatgctatcttgggtgtttctttggctgctgccaatgctgccgctgctgctcaaggcattccattgtacaaacacattgccaacatttccaatgccaagaaaggtaaattcgttttgccagttccattccaaaacgttttgaacggtggttcccatgctggtggtgctttagctttccaagaatttatgattgccccaactggtgtctccactttctctgaagctttgagaattggttcagaagtttaccacaacttgaaatctttgaccaagaagaaatacggtcaatccgctggtaacgtcggtgacgaaggtggtgttgctccagatatcaaaactccaaaggaagctttggacttgatcatggatgccattgacaaagccggttacaaaggtaaggttggtattgccatggatgttgcttcatctgaattctacaaggacggtaaatacgacttggactttaaaaacccagaatccgacccatctaaatggttgtctggcccacaattggctgacttatatgaacaattgatttccgaatacccaattgtttctattgaagatccattcgctgaagatgactgggatgcttgggtccacttctttgaaagagttggtgacaagatccaaattgtcggtgatgatttgactgtcactaaccctaccagaatcaagactgccattgaaaagaaagccgctaatgctttgttgttgaaggttaaccaaattggtactttgactgaatctatacaagctgctaacgattcttacgctgctggttggggtgtcatggtttcccacagatccggtgaaaccgaagatactttcattgctgacttgtcagttggtttaagatctggtcaaatcaagactggtgctccagctagatctgaaagattggccaaattgaaccaaatcttgagaatcgaagaagaattaggttctgaagctatctacgctggtaaagatttccaaaaggcttctcaattgtaa

SEQ ID NO: 3920 - protein, 440 aa, Candida albicans [sequence omitted]

SEQ ID NO: 3921 - DNA, 1287 bp, Zymomonas mobilis
  CDS (1)..(1287)
atgacagctattgtcagtatccatggccgtcaggttgtcgacagccgcggtaacccgaccgttgaagttgatgttacgcttgaagatggcagcttcggccgcgctgcagtgccgtcaggtgcttctaccggcgttcatgaagctgttgaacttcgtgatggcgacaaaacccgttggggtggtaaaggcgtcaccaaagctgttcacgctgtaaacaacgaaattgctaacgcaattattggtctggaagccgaagatcaggaactgatcgaccagacgatgatcaagctcgatggcaccccgaacaagggtaaattcggtgctaacgctatcctcggtgtcagcttggctgttgctaaagctgctgctgaagctcgcggtctcccgctttaccgttatgttggtggtacggcagctcacgttcttccggttccgatgatgaacatcgttaacggtggtatgcacgctgacaaccccatcgatttccaggaattcatgattgctccggttggcgccagctccatcaatgaagctgtccgcatcggtaccgaagttttccataccctgaaaaaagaactgtctgctaaaggcatgaacaccaacgtcggtgacgaaggtggtttcgctcctagccttgacagtgcttcttctgctctggacttcatcgtcgattccatctccaaagccggttacaagccgggcgaagatgtgttcatcgctctcgatgcagcttcctccgagttctacaacaaagatcagaacatctacgatcttaagggtgaaggccgtaaactgacctccgctcagctcgttgattactatgtcgaactctgcggcaaatatccgatctattccatcgaagatctggccgaagatgacttcgaattctggaagatccttaccgaaaagctcggtgacaaagttcagttggtcggtgacgatctgttcgtgaccaacgtgaagcgtctttctgatggtatcgaacgcggtatcgccaactcgctgctcgtgaagttcaaccagatcggttctttgtctgaaacgctcgcagccgttaacatggctaacgacgcttcttacacgcctgttatgtctcaccgttccgtggaaaccgaagacaccacgattgctgacctcgctgttgccaccaactgcggtcagatcaagaccggtagcctttgccgttccgaacgtatcgctaaatacaatcagctgatgcgcatcgaagaagaactgggttcggttgctaaatatgctggccgttcggttcttagaaaagccaaataa

SEQ ID NO: 3922 - protein, 428 aa, Zymomonas mobilis [sequence omitted]

SEQ ID NO: 3923 - DNA, 1296 bp, Fasciola hepatica (liver fluke)
  CDS (1)..(1296): n means a or g or c or t/u, r means g or a, w means a or t/u
atggcaataaaagcgatccacgcccgacaaatatttgacagccgcggaaatcccaccgttgaagttgatgtcacgaccgcgaaaggtttattccgwgcggcagttccaagcggtgcttccactggtgttcatgaagctctggaattgcgtgatggccctcccggctatatgggcaaaggtgttctaaaagcggttgcaaacgtgaacagccaaatcgctcccaacctcatcaaaagcggaataaatgttactgatcaagctgcggttgacaaattcatgcttgacctggacggaactcccaacaaagaaaaactcggtgcgaatgcaatccttggtgtgtctctcgctrtctgtaaagcgggtgccgctgaaaagggtctccctttgtacaagtacatcgccactcttgcgggaaataaagaggttataatgccggtgccgtctttcaacgtcatcaatggcggtagtcacgctggaaacaaactagcgatgcaggagtttatgataatgccaacgggtgctagttctttcactgaagctatgaagatcggaagtgaggtttaccataacctcagagctgttatcaaaagcaagtacggtttggacgcctgcaatgtgggtgacgagggtggtttcgctccaagtattcaagataatttggaaggacttgagctgcttcgtaccgcaatagacaaagctggatatacgggaaaagtcwagattgccatggattgcgctgcttcggaattttacaaggaagggaaatacgatttggatttcaaaaaccccaagtctcaggccagttcttggatcacttcggatgccatggctgatgtctacaagaaaatgatgtctacttacccgatcgttagcatcgaggacccgttcgaccaagacgattggccagcttggactaaactgacgggtgaatgtaaaatccagatcgttggtgatgacttaactgtcaccaacccccttcgtgtgcaaaaagctatcgaccaaaaggcatgcaattgcctgttgctaaaagtcaaccagattggttcggtgtcagagtccattaaggcttgcaagatggcccaagaagctggttggggtgtgatggtatcacatcgttcaggagaaactgaagataacttcatcgctgatttggtggttggactgcgtactggccagattaaaacaggtgcaccttgtcgttcagaacgtcttgcgaaatacaaccagttgctgcgtattgaagaggatctgggaggtgccgcaaagtatgctggggagaacttccgccgaccataa

SEQ ID NO: 3924 - protein, 431 aa, Fasciola hepatica (liver fluke) [sequence omitted]

SEQ ID NO: 3925 - DNA, 1377 bp, Mycoplasma genitalium
  CDS (1)..(1377): trans_table=4
atgggaagttcaaatctaaacatcaattcaaaaataaccgatatttttgcttatcaagtttttgattctcggggtgttccaacagtagcttgtgttgttaaattggcatctggtcatgtaggtgaagcgatggttccatcaggtgcttctacaggtgagaaagaagcaattgaattacgtgataatgatccaaaaaattattttggtaaaggcgttaacgaagccgttgataacgttaataaagttattgcccctaagcttattggcttaaatgcatttgatcaattaacagtggatcaagcaatgattaaactagacaatactcccaacaaagcaaaattaggagcaaatgctatattatctgtttcacttgcagtatcaaaagcagcagcaaaagcacaaaacagctcattatttcaatacatttcaaataaattaattggattaaatacaacaaattttgttttacctgtgccaatgttaaatgtaattaatggtggtgctcatgctgataactatattgattttcaagagttcatgatcatgcctttaggtgctaaaaagatgcatgaagctttaaaaatggctagtgaaacttttcatgctttacaaaatcttttaaaaaagcgtggattaaacacaaataaaggagatgaaggtggatttgcgcctaacttaaaacttgcagaagatgcacttgacatcatggttgaagccattaaattagctggatataagccttgagatgatattgctattgccattgatgttgctgctagtgagttttatgacgaagataaaaaactttatgttttcaagaaaggaataaaagctaatatccttaatgcaaaggattggagtttaacaagcaaagaaatgattgcttacttagaaaaattaacaaaaaaatatccaattatttcaatagaagatggtttgagtgaaaatgattgagaagggatgaaccaattaactaaaaccataggtagccatattcaaattgttggtgatgacacttactgtactaatgcagaacttgctaaaaaaggtgttgcacaaaatacaacaaactcgatattgattaaattaaatcaaattggttctattagtgaaacgattcaaacaattgaagttgcaaaaaaagctaactggagtcaagtaatttcacatcgcagtggtgaaacagaagatacaactattgctgatttggcagttgctgcccaaactggtcaaattaaaaccggttcaatgtcacgctcagaaagaatagctaaatacaatcgtttgttgtacatagaaattgaacttggtgataaaggaaaatacttaggttgaaatacctttacaaacattaaacctaaaaactttaacatctaa

SEQ ID NO: 3926 - protein, 458 aa, Mycoplasma genitalium [sequence omitted]

SEQ ID NO: 3927 - DNA, 1287 bp, Neisseria meningitidis
  CDS (1)..(1287)
atgagcgcaatcgttgatattttcgcccgcgaaattttggactcacgcggcaaccccacagtcgagtgtgatgtattgctcgaatccggcgtaatgggacgcgcagccgtaccgagcggcgcgtccaccggtcaaaaagaggctttggaacttcgcgacggcgacaaatcccgttattcgggcaagggcgtattgaaggcggtcgaacacgtcaacaaccaaatcgcccaagccctcattggtatcgatgccaacgagcaatcttatatcgaccaaatcatgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcgtccagcgagttctacaaagacggcaaataccacttggaagccgaaggccgctcctacaccaacgcggaatttgccgaatatctggaaggcctggtcaacgagttccccatcatctccatcgaagacgggatggatgaaaacgactgggaaggctggaaactgctgaccgaaaaactgggcggcaaagtccaactcgttggcgacgacctcttcgttaccaacccgaaaatccttgccgaaggcattgaaaaaggcgtggcaaacgcactattggtcaaagtcaaccaaatcggtactttgagtgaaaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 3928 - protein, 428 aa, Neisseria meningitidis [sequence omitted]

SEQ ID NO: 3929 - DNA, 1305 bp, Staphylococcus aureus
  CDS (1)..(1305)
atgccaattattacagatgtttacgctcgcgaagtcttagactctcgtggtaacccaactgttgaagtagaagtattaactgaaagtggcgcatttggtcgtgcattagtaccatcaggtgcttcaactggtgaacacgaagctgttgaattacgtgatggagacaaatcacgttatttaggtaaaggtgttactaaagcagttgaaaacgttaatgaaatcatcgcaccagaaattattgaaggtgaattttcagtattagatcaagtatctattgataaaatgatgatcgcattagacggtactccaaacaaaggtaaattaggtgcaaatgctattttaggtgtatctatcgcagtagcacgtgcagcagctgacttattaggtcaaccactttacaaatatttaggtggatttaatggtaagcagttaccagtaccaatgatgaacatcgttaatggtggttctcactcagatgctccaattgcattccaagaattcatgattttacctgtaggtgctacaacgttcaaagaatcattacgttggggtactgaaattttccacaacttaaaatcaattttaagcaaacgtggtttagaaactgcagtaggtgacgaaggtggtttcgctcctaaatttgaaggtactgaagatgctgttgaaacaattatccaagcaatcgaagcagctggttacaaaccaggtgaagaagtattcttaggatttgactgtgcatcatcagaattctatgaaaatggtgtatatgactacagtaagttcgaaggcgaacacggtgcaaaacgtacagctgcagaacaagttgactacttagaacaattagtagacaaatatcctatcattacaattgaagacggtatggacgaaaacgactgggatggttggaaacaacttacagaacgtatcggtgaccgtgtacaattagtaggtgacgatttattcgtaacaaacactgaaattttagcaaaaggtattgaaaacggaattggtaactcaatcttaattaaagttaaccaaatcggtacattaactgaaacatttgatgcaatcgaaatggctcaaaaagctggttacacagcagtagtttctcaccgttcaggtgaaacagaagatacaacaattgctgatattgctgttgctacaaacgctggtcaaattaaaactggttcattatcacgtactgaccgtattgctaaatacaatcaattattacgtatcgaagatgaattatttgaaactgctaaatatgacggtatcaaatcattctataacttagataaataa

SEQ ID NO: 3930 - protein, 434 aa, Staphylococcus aureus [sequence omitted]

SEQ ID NO: 3931 - DNA, 1275 bp, Agrobacterium tumefaciens
  CDS (1)..(1275)
atgactgccattaccgatatcatcgcgcgcgaaattctcgacagccgcggcaatccgaccgttgaagtcgatgtttacctcgaagacggctccatgggccgtgcggccgttccgtccggcgcctccactggcgcgcatgaggcggttgagctgcgcgatggcggcaagcgttatctcggcaagggcgtggaaaaggcggtcgaagccgtcaataccgaaatcttcgacgccatcggcggtttcgacgctgaaaaccagatccagatcgatcagatgatgatcgcgcttgacggcacgccgaacaagtcgcgcctcggcgccaacgccatcctcggcgtctcgcttgccatcgccaaggctgcggctgaagcctccggcctgccgctttaccgttatgttggcggtccgaacgcccatctgcttccggttccgatgatgaacatcatcaacggcggcgcgcatgccgataaccccatcgacttccaggaattcatgatcctgccggttggcgcggaaaacatccgcgaagccgtgcgtatgggttcggaagtgttccacacgctgaaaaaagaactgtccgcacagggccacaacaccaatgtcggtgatgagggcggttttgcaccgggcctcgagagcgcgccggcagccctcgatttcatcatgaagtcgatcgaaaaggctggctaccgtccgggcgaagacatgtatgtcggcctcgactgcgcatcgaccgagttctttaaggacggtaagtacgttctggaaggtgaaggccgcacgctggagcccggcgccatggccgaatatctggccgagcttgtcaataaatacccgatcatctcggttgaagacggcatggccgaagatgactgggaaggctggaagacgctgactgatctcgtcggcaacaaatgccagctcgtcggcgacgatctcttcgtcaccaactccgcgcgtcttcgcgacggcatcaagatgggcgtcgccaactccattctcgtcaaggttaaccagatcggttcgctttccgagacgctggatgcagtcgaaacggcacacaaggccggttacaccgccgtcatgtcgcaccgctctggcgagacggaagattctaccatcgccgatctcgctgtcgccaccaactgcggtcagatcaagaccggttcgcttgcccgttctgaccggctcgcaaagtacaaccagctgatccgcattgaggaaatgctgggtccgcaggctgcctacgccggccgttcgatcctgcgcgggtaa

SEQ ID NO: 3932 - protein, 424 aa, Agrobacterium tumefaciens [sequence omitted]

SEQ ID NO: 3933 - DNA, 1296 bp, Yersinia pestis
  CDS (1)..(1296)
atgtccaaaattgttaaagtcatcggtcgtgaaatcatcgactcccgtggtaatccaactgtagaagccgaagttcatttagaaggcggtttcgttggtttggctgcggcaccatcaggtgcttctactggttcccgtgaagcactggaactgcgtgacggtgacaaatcccgtttcttgggcaaaggcgtactgaaagccgttgctgcagtaaatggcccaattgctcaggcagttatcggtaaagatgccaaagatcaggccaacatcgataaaatcatgatcgatctggacggtactgagaacaaatcccagtttggtgctaacgccattctggctgtttctttggcagcagcgaaagcagcagcagcgtctaaaggcatgcctttgtacgagcacattgctgaattgaacggcaccccaggcaaattctctatgccactgccaatgatgaacatcatcaacggcggcgaacatgctgacaacaacgttgatattcaagagtttatgattcagccagtcggcgctaaaacgttgaaagaagcggttcgcatcggttctgaagtgttccaccacctggctaaagtactgaaagccaaaggcctgaacacggctgttggtgatgaaggcggctatgcaccaaacctgggttctaacgctgaagcactggctgttatcgctgaagcagtaaaagcagcaggctacgagctgggcaaagacattactctggctatggactgtgcggcttctgagttctacaaagacggcaaatatgttctggctggcgaaggtaacaaagccttcacttccgaagaatttactcacttcctggaagacttgaccaagcagtatccaattgtctccattgaagatggtctggacgaatctgactgggctggcttcaaataccagactgaagtcctgggtgacaaaatccagttggtgggtgatgacctgttcgtaaccaacaccaagatcctgaaagaaggtatcgagaaaggtgttgctaactctatcttgatcaaattcaaccagatcggttctctgaccgaaactctggctgcgattaagatggcaaaagacgcaggttacaccgcggttatctctcaccgttcaggtgaaaccgaagatgcgactatcgctgacttggcagtcggtaccgcagcaggccaaatcaaaaccggttctatgagccgttctgaccgtgttgctaaatacaaccaactgatccgtattgaagaagcgctgggcgaccgcgcaccattcaacggtctgaaagaagttaaaggccagtaa

SEQ ID NO: 3934 - protein, 431 aa, Yersinia pestis
MSKIVKVIGREIIDSRGNPTVEAEVHLEGGFVGLAAAPSGASTGSREALELRDGDKSRFLGKGVLKAVAAVNGPIAQAVIGKDAKDQANIDKIMIDLDGTENKSQFGANAILAVSLAAAKAAAASKGMPLYEHIAELNGTPGKFSMPLPMMNIINGGEHADNNVDIQEFMIQPVGAKTLKEAVRIGSEVFHHLAKVLKAKGLNTAVGDEGGYAPNLGSNAEALAVIAEAVKAAGYELGKDITLAMDCAASEFYKDGKYVLAGEGNKAFTSEEFTHFLEDLTKQYPIVSIEDGLDESDWAGFKYQTEVLGDKIQLVGDDLFVTNTKILKEGIEKGVANSILIKFNQIGSLTETLAAIKMAKDAGYTAVISHRSGETEDATIADLAVGTAAGQIKTGSMSRSDRVAKYNQLIRIEEALGDRAPFNGLKEVKGQ

SEQ ID NO: 3935 - DNA, 1290 bp, Nostoc sp. PCC 7120
  CDS (1)..(1290)
atgaataatattgtcgatacagccattgaggcgattgtcgcccgcgaaattctcgactcacgcggtagaccaacaatagaagcggaagtacatttattaagcggtgcggtaggcttggcacaagttcctagcggcgcttctacaggcacatttgaagcccatgaactgagagacaaggataaaagccgttacggcggtaaaggggtactcaaggctgtacacaacgttaatgagatactagccccaaagttaatagatttggatgctctcaaccaagaactcatcgaccggacgatgattgcccttgatggttctggtaacaaatcaaatttgggtgcaaatgcgattttagctgtttctttggcagccgctagagccggggctgagtctttggggattcccctatatcgttacttaggcggccctttggcgaatttgttgcctgtgcctttaatgaacgtaattaatggtggggcgcacgcttctaataacgtggatttccaagagtttatgatcgttcctgtgggtgcaacttccttccgtgaagccctgcgctggggtgcggaggtatttgctaccctcagtgaagtgctgcatgacaaaggcttgctgactggtgtaggcgatgaaggtggttttgcacctaacttggaatctaatcaggtagccttggaattgctagttgcagccattgaaaaagcaggatacaaaccaggggaacaagtagcactggcgctagatgtggcggctagtgaattttacaaggaagggcagtatgtctatgatggtagacctcatgcaccgacggagtttatcgattacttagggcagttagttgatcaatacccaattgtgtccattgaagatggtttacacgaagaagattggcaacattggcaattactcacccaaaaagttggttcacgggtgcagttggttggtgatgacttgtttgtaacaaacgctactcgcttacaaaaaggcatccaagaaaaagcaggtaacgccattctgattaaactcaatcaaattggttccctgactgaaaccctagaaaccatcgacttaggaactcgtaatggtttccgttcagtcattagccatcgttctggtgaaacagaagacaccaccattgctgatttagccgttgctacccgtgcaggtcaaatcaaaactggttccctctgtcgtagtgaacgggtagccaaatacaaccgcttgctacgtattgaagatgaattaggcgatcgcgccgtttatgctggggctgtgggtttagggccgaaatag

SEQ ID NO: 3936 - protein, 429 aa, Nostoc sp. PCC 7120 [sequence omitted]

SEQ ID NO: 3937 - DNA, 1278 bp, Brucella melitensis
  CDS (1)..(1278)
atgactgcaatcatcgacatcgtcggccgcgaaattctcgacagccgcggcaacccgaccgtcgaagtggatgtcgtgcttgaagatggctctttcggacgcgcggctgttccgtccggcgcatcgactggcgcgcatgaagccgttgaactgcgtgatggcggcagccgttatcttggcaagggcgtggaaaaggcagttgaagtagtcaatggcaagattttcgacgccattgcaggcatggacgcggagagccagcttctcatcgaccagacgctgatcgatcttgatggctcggccaacaagggcaacctcggcgccaatgctattctcggcgtttccctggcggttgccaaggcggctgcgcaagccagcggcctgccgctttatcgctatgtgggcggcaccaatgcgcatgtgcttcccgttccgatgatgaacatcatcaatggcggcgcccatgccgataatccgatcgattttcaggaattcatgatccttccggttggcgcgacttccattcgcgaagctgtgcgctatggctcggaagtcttccacacactgaagaagcgcctcaaggatgccggacataacaccaatgtcggcgacgaaggcggctttgcgccaaacctcaagaatgcacaggccgcactcgatttcatcatggaatcgattgagaaggctggtttcaagccgggcgaagatattgctcttggcctggactgcgcggcgaccgagttcttcaaggacggcaactacgtctatgaaggcgagcgcaagacccgcgatccgaaggcgcaggccaagtatctcgccaagcttgccagcgactatcctatcgtcaccattgaagacggtatggctgaagacgattgggaaggctggaaatatctgaccgatctgatcggcaataagtgccagcttgtcggcgacgatctgttcgtgacgaattcggctcgtctgcgtgacggtatccgtctgggcgtcgccaactcaattctcgtcaaggtgaaccagatcggttcgctgtcggaaacgctggacgcggtcgaaaccgcccacaaggctggttacaccgccgttatgtcgcatcgctcgggcgaaacggaagattccaccattgccgatcttgccgtggctaccaattgcggccagatcaaaaccggctcgctcgcgcgttcggatcgcacggcgaagtacaaccagctcatccgcattgaggaagagctggacaagcaggcccgctatgctggtcgcagtgcactgaagttgctctaa

SEQ ID NO: 3938 - protein, 425 aa, Brucella melitensis
MTAIIDIVGREILDSRGNPTVEVDVVLEDGSFGRAAVPSGASTGAHEAVELRDGGSRYLGKGVEKAVEVVNGKIFDAIAGMDAESQLLIDQTLIDLDGSANKGNLGANAILGVSLAVAKAAAQASGLPLYRYVGGTNAHVLPVPMMNIINGGAHADNPIDFQEFMILPVGATSIREAVRYGSEVFHTLKKRLKDAGHNTNVGDEGGFAPNLKNAQAALDFIMESIEKAGFKPGEDIALGLDCAATEFFKDGNYVYEGERKTRDPKAQAKYLAKLASDYPIVTIEDGMAEDDWEGWKYLTDLIGNKCQLVGDDLFVTNSARLRDGIRLGVANSILVKVNQIGSLSETLDAVETAHKAGYTAVMSHRSGETEDSTIADLAVATNCGQIKTGSLARSDRTAKYNQLIRIEEELDKQARYAGRSALKLL

SEQ ID NO: 3939 - DNA, 1293 bp, Bacillus subtilis
  CDS (1)..(1293)
atgccatacattgttgatgtttatgcacgcgaagtattagactcccgcggcaacccaacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaacagctgttaacaacgtaaacgaaatcattgctccagagcttcttggctttgatgtaactgaacaaaacgcaatcgatcagcttttaatcgagcttgacggtactgaaaacaaaggcaaacttggtgcgaacgcaatccttggcgtatctatggcttgtgcgcgtgctgctgctgatttcttacagattcctctttaccaataccttggaggattcaactcaaaaacgcttcctgtaccgatgatgaacatcgtaaacggcggagagcatgctgataacaacgtggatattcaagaattcatgatcatgcctgtaggtgctcctaacttccgtgaagcacttcgcatgggcgctcaaatcttccacagcctgaaatcagtattaagcgcaaaaggcttaaacactgctgtaggtgacgaaggcggattcgctccaaaccttggttctaacgaagaagcgcttcaaacaatcgttgaagcaatcgaaaaagccggcttcaaacctggcgaagaagttaaacttgctatggatgctgcatcttctgagttctacaacaaagaagacggcaaataccatctgtctggcgaaggcgttgtgaaaacatctgctgaaatggttgactggtatgaagagcttgtttctaaatacccaatcatctcgatcgaagacggacttgacgaaaacgactgggaaggccacaagcttcttactgagcgtcttggcaaaaaagttcagcttgttggtgacgacctcttcgttacaaacacgaaaaaactttctgaaggtattaaaaacggcgtaggcaactctatcctgatcaaagtaaaccaaatcggtacattgactgaaacattcgatgcgatcgaaatggcgaaacgcgcaggctacacagctgttatctctcaccgttctggtgaaactgaagacagcacaatcgctgacatcgctgtggcaacaaacgcaggacaaatcaaaacaggtgctccgtctcgtacggaccgtgttgcgaaatacaaccagcttcttcgcatcgaagatcagttggctgaaactgctcaataccacggtatcaactctttctacaacttaaacaagtaa

SEQ ID NO: 3940 - protein, 430 aa, Bacillus subtilis
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 3941 - DNA, 1465 bp, Arabidopsis thaliana (mouse-ear cress)
  CDS (1)..(1434)
atggctttgactacaaaacctcaccatcttcagagatctttcctctctccgtcgcgtgtttccggcgaacgatatttggaatctgcgccatcatgtctgagattccgtcgcagcggtgtccaatgctcggtggtggctaaggagtgcagagtgaaaggagtgaaagcgagacagattattgatagtagagggaatccgacggtggaggttgatctgattaccgatgatctgtatcgttcggctgttccaagtggtgcatctaccgggatctacgaagcgcttgagcttagagatggagacaagagcgtctatggtggtaaaggtgtattacaggctattaaaaacatcaatgaacttgtggctccaaaactcattggagttgacgttaggaaccaagctgatgtcgatgctcttatgctggaactggatgggaccccaaacaagtcgaaactcggggctaatgcgatattaggagtgtcattgagcgtttgcagggcaggtgctggagctaaaggagtgcctttgtacaaacacatccaggaaacatcaggaacaaaggagcttgtcatgccagttcctgcattcaatgtgatcaatggaggcagtcatgctgggaatagtttggctatgcaagagtttatgatactacctgtaggagctacctcattctcggaggccttccagatgggaagtgaagtttatcatacattgaaggggataatcaaaactaagtatggtcaagatgcttgtaatgtcggagatgaaggagggtttgcgccgaatgttcaagataacagagagggactagttctgctcatagatgcaattgaaaaggccggttacactggaaagatcaaaataggaatggatgttgctgcatcagaatttttcatgaaagatggtagatacgatttgaacttcaagaaacagccaaacgatggagctcacgtactgtcagccgagagtcttgctgacctctacagagaattcatcaaggatttcccaattgtctctatcgaagatccttttgaccaggatgattggagctcatgggcttcattgcaatcctctgtggatatccaactcgtgggagatgacttgttagtcactaacccgaagaggatagctgaagctattaagaaacagtcttgcaatgctctactcttgaaggttaaccagattgggacagtcactgagtcaattcaagcagcacttgactcaaaagctgcaggctggggtgtgatggttagtcacaggagtggcgagacagaggataacttcatcgcagatctctctgttggtttagcaagcggacagatcaaaactggtgctccatgccgaagtgaacgattgtcaaaatacaaccagcttctccgtatcgaagaggaactcggcaatgtgcgctacgccggtgaagctttccgatcaccatgagaaattcgagaaaggcactcattggcggctt

SEQ ID NO: 3942 - protein, 477 aa, Arabidopsis thaliana (mouse-ear cress)
MALTTKPHHLQRSFLSPSRVSGERYLESAPSCLRFRRSGVQCSVVAKECRVKGVKARQIIDSRGNPTVEVDLITDDLYRSAVPSGASTGIYEALELRDGDKSVYGGKGVLQAIKNINELVAPKLIGVDVRNQADVDALMLELDGTPNKSKLGANAILGVSLSVCRAGAGAKGVPLYKHIQETSGTKELVMPVPAFNVINGGSHAGNSLAMQEFMILPVGATSFSEAFQMGSEVYHTLKGIIKTKYGQDACNVGDEGGFAPNVQDNREGLVLLIDAIEKAGYTGKIKIGMDVAASEFFMKDGRYDLNFKKQPNDGAHVLSAESLADLYREFIKDFPIVSIEDPFDQDDWSSWASLQSSVDIQLVGDDLLVTNPKRIAEAIKKQSCNALLLKVNQIGTVTESIQAALDSKAAGWGVMVSHRSGETEDNFIADLSVGLASGQIKTGAPCRSERLSKYNQLLRIEEELGNVRYAGEAFRSP

SEQ ID NO: 3943 - DNA, 1305 bp, Buchnera sp
  CDS (1)..(1305)
atgtctaaaattacaaaaatcatagctcgtgaaattatagattcacgaggcaatcctactgttgaatctgaagttcatttagaaggcggatttgtcggactagcttcttctccttccggagcctctaccggttctttagaagctttagaattaagggatgaaaataaagacagattcatggggaaaggagtggaaaaagctgtttcgttaataaacgaaaaaatatctattgcattaaaaaataaaaatgctagaaatcaaagtgatattgatcatattatgattgatttagacggaacaatcaataaatccaaattaggtgctaatgcgattttatctgtatctttagctgttgctaaagcagctgctgcatctaagagaatgcctttatatgcgcatattgcagaaataaatgagactcctggtgttttttctatgccattgcctatgataaatattattaatggtggaaaacatgctaataataatatagatattcaggagtttatgattcaaccaatcagcgcaaaaacagtaaaagaatctatacgtataggatgtgaaatatttcatgcattaggtgaattattaaaagaaaaaggaatgagtacaactgtaggagatgaaggaggttatgcaccaaacttgaagtctaatgaagaagcattaaatattattcaagatgcaatacaaaaaactaaatataaattaggacaagatatacgattagcaatagattgtgctgcttcagaattatataataaaaacgaaaaaaaatataatcttaaaggagaaaatattagtttttcttcaaaggaattcactcattatttagaaaaattatctcaaaaatatccgatagtttcaatcgaagatggacaagatgagtcagattgggaaggatttttatatcaaacacatgtactaggtaataaaatacagttagtaggagatgatttatttgttacaaataaaaatattttaaaaaaaggtataaaaaaaggaattgcaaattcaatattaataaagttaaatcaaattggaacattaactgaaactctagaagcaataaaaacagcaaaacaagcaaactatggagtaattatttctcatcgttcaggtgaaacagaagacgcttctatagcagatttatctgtaggaacatcatcaggacaaattaaaacaggttctatgagtcgttctgatagaacttcaaagtataatcaattgattagaattgaagaaaatttaggaacaaaatacgctccgtttcatggtttacgagaaattaaatcagcattttaa

SEQ ID NO: 3944 - protein, 434 aa, Buchnera sp [sequence omitted]

SEQ ID NO: 3945 - DNA, 1275 bp, Chlamydia trachomatis
  CDS (1)..(1275)
atgtttgatgtcgtcatctccgatatagaagcgagagaaattttagattctcgaggctatcccacattatgtgttaaagtcatcactaatacaggaacctttggtgaagcgtgcgttccttctggagcatctacaggcatcaaggaagctttggaactgcgtgacaaagatcctaaacgttaccaagggaaaggggtcttacaagccatttctaatgtcgaaaaagtgctgatgcccgctttacaaggattcagcgtatttgaccaaattacagctgatgcgattatgattgatgctgatggaactccgaacaaagaaaagttaggagctaatgcgattcttggagtctccctagcattagcaaaagctgctgcaaatactttacagagacctttatatcggtatcttggtggatctttctcgcatgtgcttccttgccctatgatgaatcttatcaatggcggtatgcatgctacaaatggtctccaattccaagaatttatgattcgtccaattagcgctccttctctaacagaggctgtgcggatgggagcagaagtcttcaacgccttaaaaaaaatcttacagaatcgacagctggctacaggtgttggtgatgaaggcggatttgctcctaatcttgcctctaatgccgaagctctggatctactcttaacagcaatcgaaactgcaggattcacacctagagaagatatttctttagctctcgactgcgctgcttcttctttctataatacccaagataaaacctatgatgggaaatcgtatgcagatcaagtgggtatacttgcagaactctgtgagcactatcctatagattctatcgaagatgggctagccgaagaagattttgagggctggaaactcctatccgagactttaggagatcgtgtgcaactagttggagacgacctatttgtgacgaattctgcattgattgctgaaggaatcgctcaaggacttgccaatgccgttctcatcaaaccaaaccaaattggaacacttacagaaactgcagaagctattcgtttagcaactatacaaggctacgctaccattctttcgcatagatcaggagaaacagaagatactaccatagcagaccttgctgtcgcttttaatacaggtcagattaaaacagggtctctttcccgttctgagcgtatcgctaagtataaccgtctaatggcaattgaagaagagatgggtccagaagctctattccaagattcaaatcccttttctaaagcatag

SEQ ID NO: 3946 - protein, 424 aa, Chlamydia trachomatis [sequence omitted]

SEQ ID NO: 3947 - DNA, 1269 bp, Deinococcus radiodurans
  CDS (1)..(1269)
atgaacatcgagaaagtcatcgcccgtgaagtgctggattcgcgtgggaaccccaccgtcgaagccgaagtccacctcgacagcggtttttcgggccgggccatcgtgccttcgggagcgagtaccggcagccacgaggcgctcgaactgcgtgacggcggcgagcggtacatgggcaagggcgtggaacgtgccgtgcagaacgtgcgtgaggccctcggcccggccctcatcggcatggacgccagtgagcaggccgccatcgacaaggcgctgatggacgtggacggcacctccaacaagggcaacatgggcggcaacgcgattctggcggtgagcctcgcgactgcccgcgccgccgctgccgagctcgacatcccgctctaccgctacctcggcggctccaacgccaagaccctgcctgtgcccatgatgaacgtcatcaacggcggcgcccacgccgacaacagcgtggattttcaggagttcatggtgatgccggtcggcgctccgagcttccgtgaagcactgcgctacggcgccgagacctttcaccacctgaaaaaagtcctcagcgggcgcggctacaacaccaacgtcggcgacgaaggcggttttgcgccggacctcaagagcaacgaggaagccctcgaagtgctgcttgaagccattcagcaggcgggctacgaacccggcaaggacatctgcatcgcgctcgaccccgccgtgaccgagctgtacaaggacggccagtaccacctggagagcgagggccgcgtgctgagcagcgacgagatgatcgacttctgggccgactggaccagccgctacccgattgtcagcatcgaagacggcctcgctgaagacgactgggacggctgggaacgcctgaccgccaaggtgggcgccaagacccagctggtgggcgacgacctgttcgtgaccaaccccgagcgcttgcagcagggcatcgaccgcaaggtgggcaacgcgattctggtcaaggtgaaccagatcggctccctcaccgagagcatggacgccatcgaactcgccaagcgccaccactacggcaccatcatcagccaccgctcgggcgagtccgaagacgcctttatcgccgacctcgctgtggcgaccaacgccgggcagatcaagaccggctcggccagccgctcggaccgtatcgccaagtacaaccagctgctgcgcatcgaagaccagctcggcgaccgagccgtgttcccgggccgcaaggcgctgcgctaa

SEQ ID NO: 3948 - protein, 422 aa, Deinococcus radiodurans [sequence omitted]

SEQ ID NO: 3949 - DNA, 1290 bp, Bacillus halodurans
  CDS (1)..(1290)
atgacaatcattactgatgtatacgctcgtgaagtattagattcacgtggaaacccgacggttgaagtggaggtttacttagaatctggtgcaatgggacgtgcccttgtcccaagtggtgcttcgactggtgaatatgaagccgttgagcttcgcgatggtggcgagcgctttttaggaaaaggtgtcttgaaagccgttgagaacgtgaacgaagtcattgcccctgagcttattggcttcgacgctcttgatcaaatcgggatcgatcaacatatgattgagcttgatggaacagaaaataaaggaaaacttggcgcgaatgccattcttggagtatccatggcggttgctcgtgcggcagcgaatgctcttgaccttccgctttatgtatacctcggcggatttaacgcaaaacagcttcctgtgccaatgatgaacatcatcaatggtggagagcacgcagataacaacgtcgatattcaagaatttatgatcatgccagtcggtgcggaaagctttaaagaagcgcttcgtacagggacggaaattttccacagcttgaaaaaagttcttaagtcaaaaggctacaacacagctgttggtgacgaaggtggtttcgcgccaaacctttcatcgaatgaagaagcgttgcaaacgatcatcgaagcgatcgagcaagctggttacactccaggggagcaagtgaagcttgcaatggacgttgcctcttctgagctttacaacaaagaagatggaaagtaccacctttctggcgaaggaaaagttctttcttctgaagaaatggttgccttctatgaagagcttgtagctaaatatccaatcatctccatcgaagacggccttgatgagaacgattgggaaggacataaaatgcttacagaccgtcttggcgacaaagtccagcttgtcggtgacgacttgttcgtaacaaacacgaaaaagcttgcccaaggaatcgagcaaggggtcggcaactcgatcctaatcaaagtgaatcaaatcggtacattaacggaaacgttcgatgcgatcgaaatggcaaaacgcgcgggttacacagctgttatctctcaccgctctggtgaaacagaagatagcacgatcgctgacattgctgttgcgacaaacgcaggccaaatcaaaacaggtgctccgtcccgtacagaccgtgtggcgaagtacaatcaacttctacgcattgaagatgagcttggcaatttagcacaatataacggtcttcaatcgttctacaaccttaaaaagtaa

SEQ ID NO: 3950 - protein, 429 aa, Bacillus halodurans [sequence omitted]

SEQ ID NO: 3951 - DNA, 1269 bp, Lactococcus lactis subsp. lactis
  CDS (1)..(1269)
atgacagtcacaatcgaaaacatccacgcaagagaaatttttgattctagaggaaatccaaccgttgaggtagatgttagattaacagatggaacattaggacgcgcagcagtaccctcaggagcatcaactggagaccgtgaagcagttgaattaagagatggtggagaccgtcttcaagggaaaggcgtttctaaagccgtcgcaaatgtcaatggcgaaatttatgaagccttgaaaggacaatcaccatttaatcaagcaaaattagatcatttgatgattgagcttgacgggacaaaaaataaatctcgtttaggggctaatgcaattttaggggtttcaatggccatttctcgtgcggcagcgaatagtgaaaaaattccactctatcgctatcttggtggagttgatttggaacttccacaaccatttttcaatgtcattaatggtggagtacatgccgattcaggaattgacgttcaagaatttttgattacaccagtcaaacgggaaagttttcgcgatggtttagaaaaaattgcaaatatctaccatactctgaagaaaattttagctgacaaagggctagaaacagccgtaggtgatgaaggtggctttgcccctaaacttggttctactgaaaatgcaattgctacactttatcaagcaattgaaagtgcaggatatgttcctggtgaagaaattgcgattgccattgacccagcttcaagtgaattttatgatgataaagaaaaagtttatcgttttgaagggcaaaaattgacttctaaagaactattgacttactatgaaaatttagttgaaaaatatccagcacttatttctattgaagatggattttctgaacatgactgggagggctttgcagctcaaacgaaagctcaaggtcaaaaaattcaattagtaggtgatgatatttttgtgacaaatcctgaaattttcaaagaaggaattaaaaaaggtgtagcaaatgctattttgattaaacttaatcaaatcggaacagtaactgaagcgattgaagccattagtttagcgagaaaagcaggctataagacaatgatttctcatcgttcaggtgaaacagttgatagctacattgccgattttgcggtagccatgcatgctggccaaataaaaacaggttcaatggctcgaagtgaacgggttgaaaaatataatcaattcttgcgaattgaagaagaattaggaaaagatgtagctcttgctagttttccaggatag

SEQ ID NO: 3952 - protein, 422 aa, Lactococcus lactis subsp. lactis [sequence omitted]

SEQ ID NO: 3953 - DNA, 1302 bp, Lactococcus lactis subsp. lactis
  CDS (1)..(1302)
atgtcaattattactgatatttatgctcgcgaagtccttgactcacgcggtaacccaacacttgaagttgaagtttacactgaagacggtgcattcggtcgcggtatggtaccttcaggtgcttctactggtgaacatgaagcggttgaacttcgtgatggcgacaaatctcgctacaacggacttggtactcaaaaagctgttgacaacgtaaacaacatcatcgctgaagctatcatcggttatgaagttactgaccaacaagctattgaccgtgcaatgatcgctcttgacggtactgaaaacaaaggtaaattgggagctaacgctatccttggtgtttctatcgctgctgctcgtgctgctgctgatgaacttggtgttccactttacaactaccttggcggattcaacgctaaagtattgccaactccaatgatgaacatcatcaatggtggttctcactcagacgctccaatcgctttccaagaattcatgatcgtaccagttggtgcacctacattcaaagaagcgcttcgttggggtgctgaaatcttccacgctcttaagaaaattcttaaagctcgtggacttgaaacagctgtcggtgacgaaggtggattcgctcctaaattcgacggaactgaagacggtgtagaaactatccttaaagcaatcgaagcagctggttacaaagctggtgaagatggcgttatgatcggtttcgactgtgcatcatcagaattctacgaaaacggtgtttacgactacactaaattcgaaggtgaaggcggtaaaaaactttcagcttctgaacaagttgactaccttgaagaactcgtttctaaatacccaatcatcactattgaagatggtatggacgaaaacgactgggatggatggaaaatccttactgaacgtcttggtaaaaaagttcaactcgttggtgacgacttcttcgttacaaacactaaataccttgaacgtggtatccgtgaaaatgcttcaaacgctatcttgatcaaagttaaccaaatcggtactttgacagaaactttcgaagctattgaaatggctaaagaagctggtttcacagcaatcgtttctcaccgttctggtgaaactgaagattcaacaatctcagatatcgctgttgcaactaacgctggtcaaatcaaaactggttcactttcacgtacagaccgtatggctaaatacaaccaattgcttcgtatcgaagaccaattggctgaagtggctcaatacaaaggtcttaaagcattctacaaccttaaaaaataa

SEQ ID NO: 3954 - protein, 433 aa, Lactococcus lactis subsp. lactis [sequence omitted]

SEQ ID NO: 3955 - DNA, 1311 bp, Haemophilus influenzae
  CDS (1)..(1311): n means a or g or c or t/u, k means g or t/u
atggcaaaaatcgttaaagtgattggtcgcgaaatcatcgactcacgcggtaatccaactgttgaagctgaagttcatcttgakggtggttttgtnggtttagcagcagctccatctggtgcatcaactggttctcgtgaagcattagaattacgtgacggcgacaaatctcgtttcttaggtaaaggcgtattaaaagctgtggcggcagtgaacaacgaaattgcacaagctatcgttggtaaagatgcaacaaaccaagctgaaatcgaccaaatcatgatcgatttagacggaaccgaaaacaaatctaactttggtgcaaatgcaatcttggcggtatctttagcaaacgcaaaagcagctgcagcatctaaaggtttaccactttacgcttacattgcagaattaaatggcactgctggtgtttattctatgccattaccaatgatgaacatcattaacggtggcgaacatgcagataacaacgttgatatccaagaattcatgattcaaccagttggtgcgaaaacattacgtgaagcacttcgtatcggtgctgaagtattccacaacttggcgaaagtattaaaagctaaaggcatgagcactgcagttggtgacgaaggtggtttcgcaccaaacttagcctctaacgcagacgctttagcctgtatcaaagaagcagtagaaaaagcaggttacgtattaggtaaagacgttactttagcgatggactgcgcatcttctgagttctataacaaagaaaatggtatgtacgaaatgaaaggtgaaggtaaatcattcacttctcaagaattcactcactacttagaagaattatgcaaagagtacccaatcgtgtctatcgaagatggtcaagatgagtcagactgggaaggttttgcataccaaactaaagtgttaggcgaccgcgttcaattagtgggcgatgatttattcgtcactaacaccaaaatcttaaaagaaggtatcgaaaaaggtatcgcaaactctatcttaatcaaattcaatcaaatcggttctttaactgaaactttagcagcaattaaaatggcgaaagatgcaggttacaccgctgtaatctctcaccgttcaggcgaaactgaagatgcaactatcgctgatttagcggtgggtacagcagcaggtcaaatcaaaactggttctatgagccgttctgaccgtattgcgaaatacaaccaattaatccgtatcgaagaagcattagaacgcgctggtactccagcagcattcccaggcttaaaagcggttaaaggtcaagcgtaa

SEQ ID NO: 3956 - protein, 436 aa, Haemophilus influenzae
  Xaa in position 28 is unknown
MAKIVKVIGREIIDSRGNPTVEAEVHLXGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKAKGMSTAVGDEGGFAPNLASNADALACIKEAVEKAGYVLGKDVTLAMDCASSEFYNKENGMYEMKGEGKSFTSQEFTHYLEELCKEYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 3957 - DNA, 1245 bp, Campylobacter jejuni
  CDS (1)..(1245)
atgttagtaattgaagatgttagagcctatgaagttcttgatagtagaggaaatccaaccgtaaaagccgaagttacgctaagcgatggaagtgtaggtgcggccatagttccaagtggtgcaagtacaggttcaaaagaagccttagaattgcgtgataatgatgaaagatttggcggaaaaggcgttttaaaagctgttgcaaatgtcaatgagaccattgcagatgaaattttaggactagatgcttttaatcaaactcaacttgatgatactttgcgtgagctcgatggaacaaataattactcaaatttaggtgcaaatgcgactttaggcgtatctatggcaacagctcgtgcggctgcagctgctttgggaatgcctttatatcgctacttaggtggtgcaaatgcgagcattttacccgtgccaatgtgtaatatcataaatggcggtgctcatgcaaacaacaatgtagattttcaagaatttatgatcatgccttttggttttactagctttaaagaagctttgcgttcagtttgtgaaatttatgcgatattaaaaaaagaactcgcaaattctggacattctacggctttaggtgatgaaggcggttttgctccaaatttagctaacaacacagaacctatcgatcttttaatgacttgtatcaaaaaagcaggttatgaaaatcgtgtaaaaattgctcttgatgtggcaagtacagaatttttcaaagatggtaaataccacatggaaggcaaggctttttcaagcgaggctttgatcgaacgctatgtagaactttgtgcaaaatatccaatttgcagtatcgaagatggcttagctgaaaatgactttgaaggctggatcaagctgactgaaaaattaggcaataaaattcagcttgtaggcgatgatttgtttgtgaccaatgaagatattttaagagaaggtatcatcaaaaaaatggcaaatgctgtacttatcaaaccaaatcaaatcggaactattacccaaactatgagaactgtgcgtttagcgcaaagaaataactataaatgtgtgatgagtcatagaagcggcgaaagtgaagatgcttttatagcggattttgctgtggctttaaatacaggacaaattaaaacaggagccctagcaagaggcgaaagaaccgcaaaatacaatcgcttacttgaaattgaatttgaaagcgatgaatatttaggagaaaagctctga

SEQ ID NO: 3958 - protein, 414 aa, Campylobacter jejuni [sequence omitted]

SEQ ID NO: 3959 - DNA, 1275 bp, Chlamydia muridarum, Chlamydia trachomatis MoPn
  CDS (1)..(1275)
atgtttgatgttgtcatctccgatatagaagctagagaaattttagattcccgagggtatcctaccttgtatgttaaagtcattactaatacaggaatctttggagaagcttgtgttccttctggagcatctacaggcattaaagaagctttagaacttcgtgaccaagatcctaaacgctatcaaggaaaaggagttctacaagcagtcgctaatgtggaaaaagttctattacctgccctacaagggttcagtgtttttgatcaaatcacagcagacgctattatgatcgatgctgatggcacctctaacaaggaaaaattaggcgccaatgcgattcttggggtttctttagcattagcaaaggctgctgctgcaactttagagagacctttataccggtatttgggaggagctttctcgcatgttctcccttgcccaatgatgaacctcattaacggtggcatgcatgcaacaaatggcctccaatttcaagaatttatgatccgtcctattagcgctccttccctaacagaagctgtgcgcatgggagcagaagtttttcacactttgaaaaaaatcttacaaaatcggcaactttctacaggagtcggagatgaaggcggattcgctccccaactcgcttccaattcagaggcgcttgaccttctcttggctgctattgaaaaggctggctttatccctggagaggatatttctttagctcttgattgcgcagcttcctcgttttacaatactcaggataaaacttatgatggcaagtccgctgcagatcaagttgctgtactcacagaattatgcgatcgctatcctatagattctatcgaagatggccttgctgaggaagattttgaaggctggaagcttttatcagaaactttaggagatcgcattcaattagtaggagatgatttatttgtcacgaactctgctttgattgccgaaggaattgcgcaaggcctagctaatgccgttcttatcaaacccaatcagatagggacgcttacagaaacagcggaggctatccgcttagcaactacgcagggctatgcgaccatcctatctcacagatcaggagaaacagaagacaccacaatcgcagatcttgcggttgcctttaacacagggcaaattaaaacaggctctctctctcgttccgagcgtattgctaaatacaaccgcttgattgctattgaagaagaaataggcccagaagctgtatttcaagattccaatcctttttctaaagcataa

SEQ ID NO: 3960 - protein, 424 aa, Chlamydia muridarum, Chlamydia trachomatis MoPn
MFDVVISDIEAREILDSRGYPTLYVKVITNTGIFGEACVPSGASTGIKEALELRDQDPKRYQGKGVLQAVANVEKVLLPALQGFSVFDQITADAIMIDADGTSNKEKLGANAILGVSLALAKAAAATLERPLYRYLGGAFSHVLPCPMMNLINGGMHATNGLQFQEFMIRPISAPSLTEAVRMGAEVFHTLKKILQNRQLSTGVGDEGGFAPQLASNSEALDLLLAAIEKAGFIPGEDISLALDCAASSFYNTQDKTYDGKSAADQVAVLTELCDRYPIDSIEDGLAEEDFEGWKLLSETLGDRIQLVGDDLFVTNSALIAEGIAQGLANAVLIKPNQIGTLTETAEAIRLATTQGYATILSHRSGETEDTTIADLAVAFNTGQIKTGSLSRSERIAKYNRLIAIEEEIGPEAVFQDSNPFSKA

SEQ ID NO: 3961 - DNA, 1302 bp, Vibrio cholerae
  CDS (1)..(1302)
atgtctaagatcgttaaagttctaggtcgtgaaatcatcgactcacgtggtaacccaacggtagaagcagaagttcatctagaaggtggtttcgttggtatggcagcagctccatctggtgcttctactggttctcgtgaagcgcttgaactgcgtgacggtgacaagtctcgtttcctaggtaaaggcgttctgaaagcgctggctgcggttaatggtccaattgcagacgctctggttggcaaagatgcaaaagatcaagcaactattgaccaaatcatgatcgacctagacggtactgagaacaagtcaaacttcggtgcaaacgcgattctagcggtttctctagcaaacgcgaaagcagcagcggcagcaaaaggcatgcctctgtacgagcacatcgctgagctgaacggcactcctggcgtattctcaatgcctctaccaatgatgaacatcatcaacggtggtgagcacgctgacaacaacgtagacatccaagagttcatgatccaacctgttggcgcaaaaactctgaaagaagcagtacgtatgggcgcagaagtgttccataacctagctaaagtactgaagtctaaaggctacaacactgcagtgggtgacgaaggtggtttcgctcctaacctgaaatctaacgcagaagcgctagaagttatcgctgaagcggttgcggctgcaggttacaaactgggtactgacatcacactagcgatggactgtgctgcttctgagttctacgacgcagagaagaaagaatacaacctgaaaggcgaaggtcgtatcttcacttctaacggtttctctgatttcctagaagagctgactgagaagttcccaatcgtttctatcgaagacggtctggacgagtctgactgggaaggtttcgcataccaaactgagaaactgggtaagaaaatccaaatcgttggtgacgatctgttcgtaacaaacaccaagatcctgaagcgtggtatcgacaacggtatcgctaactctatcctgatcaagttcaaccaaatcggttctctgactgaaactctggctgcgatcaagatggcaaaagatgctggctacactgcagttatctctcaccgttcaggcgaaactgaagatgcaactatcgctgacctagcggtaggtactgctgcaggtcaaatcaagacgggttctatgagccgttctgaccgtgttgctaagtacaaccaactgatccgtatcgaagaagcactgggttcacgtgctcctttcaacggtctgaaagaagtgaaaggccaagcttaa

SEQ ID NO: 3962 - protein, 433 aa, Vibrio cholerae
MSKIVKVLGREIIDSRGNPTVEAEVHLEGGFVGMAAAPSGASTGSREALELRDGDKSRFLGKGVLKALAAVNGPIADALVGKDAKDQATIDQIMIDLDGTENKSNFGANAILAVSLANAKAAAAAKGMPLYEHIAELNGTPGVFSMPLPMMNIINGGEHADNNVDIQEFMIQPVGAKTLKEAVRMGAEVFHNLAKVLKSKGYNTAVGDEGGFAPNLKSNAEALEVIAEAVAAAGYKLGTDITLAMDCAASEFYDAEKKEYNLKGEGRIFTSNGFSDFLEELTEKFPIVSIEDGLDESDWEGFAYQTEKLGKKIQIVGDDLFVTNTKILKRGIDNGIANSILIKFNQIGSLTETLAAIKMAKDAGYTAVISHRSGETEDATIADLAVGTAAGQIKTGSMSRSDRVAKYNQLIRIEEALGSRAPFNGLKEVKGQA

SEQ ID NO: 3963 - DNA, 1281 bp, Aquifex aeolicus
  CDS (1)..(1281)
atgtcaaggataaaaagggttcacggaagagaagttcttgactccagaggaaaccctaccgttgaggtggaggtggaattagagagcggagccctcggaagggctatagtcccgagcggtgcttcaacgggtgaaagggaggctttagagctcagggacggagaccccaaaaggtatctggggaagggagttttaaaggcggttgacaacgtaaacggagttatagcaaaggcactggtgggacttgagccctacaaccagagggagatagaccagatacttatagaacttgacggaacggagaataaaagcaaacttggggcgaacgccatcctcggaacgagcatggccgtggcaagggctgcggcaaacgaactgggaattcccctatacgaatacctcggagggaagttcggttacagacttcccgttcccttgatgaacgttataaatggtggagcccacgcggataacaacctagacattcaggagttcatgatcgttccggtgtgcggaggagctttcagggaagccctgagggcaggagtggagaccttccaccatctcaagaaaatactgaaggagaagggatactcaacgaatgtgggagacgagggcggatttgctccgaacctaaattcctccgaggaagctttagatatactaatgcaggctatagaaaaggcgggctacaaacctggtgaggacattctcctcgcacttgacgttgcatcttcagagttttacgaaaacggagtttacaagtttgaaggaaaggaaagaagtgctgaagaaatgatagagttctacgaaaagttaatacagaagtacccgataatttcaatagaagacccgatgagtgaaaacgactgggagggctggaaggagataacaaaaagactcggggataaagttcagctcgtgggagacgacctcttcactacaaacccgaaaatcttgaggaagggtatagaggaaggagttgcaaacgcaatcttagtgaaactgaaccagatagggactgtttctgaaaccctggacacggtaatgctcgcaaaggaaagaaattactcagcaataatctcccaccgttccggagaaacagaagacaccttcatctctcaccttgcggtggcgacgaacgcgggtcagataaaaacgggttctgcttccagaacggacaggatagcgaagtacaacgaactgttaaggatagaggagagactgggaaatggagcagtcttctggggaagggaagagttctacaggttcacttcctaa

SEQ ID NO: 3964 - protein, 426 aa, Aquifex aeolicus [sequence omitted]

SEQ ID NO: 3965 - DNA, 1287 bp, Pyrococcus horikoshii
  CDS (1)..(1287)
atggaaaacccatatgaaattactgctatcgttgcaagggagatacttgacagtagggggaacccaacggtagaggttgatgtccatactcctattgcaatgggaagggccgcagtcccaagtggtgcttcaactggaactcatgaagccgttgaacttagagatgggggaaagaggtatcatggaaagggagttaggcgagcagtagaaaatgtaaacaagataatagctcctgaattaataggaatggacgttagatggcagagagaaatagataagctgctaatagagcttgatggtactgaaaacaaaagcaatctaggagcaaatgcaattcttgcagtttccttagccgttgcaaaagcagctgccaattcgctagaattaccgctgtatcaatatctcggaggcgttaacgcttatgttcttccagtaccgctgagcaacgtaataaatggcggggttcatgccgggaacgaattagacttccaggagtttatgataatgcccataggagctagctcatttagggaagctataaggtgggtttcagaaacatatcatgtcctaaagagggtgatcatggggaagtatggaaagaatgcggtaaacgttggagatgaaggtggatttgcaccaccgatgaaggaagttacggaacccttggatgcactaataaaggcaatagaggaggccggctacaaacctggagatgaaatagcccttgcaattgatgcagcatccagcgagttcttcaaggatggaaagtacattgtaggaggaaaggaatacacgagggaggagttacttgacctatacaaagagctcgtatcgacatatccaatagtctcaatagaagatccgttccacgaggaagattgggaaggattcgtgatgataaccaatgaactcggaaagaagatccagatagttggtgatgacctcttcgttacaaatccaagaagacttaagaaaggtatagaactaggagctgcaaacgccctattgctaaaggtgaatcagatcggtacattaacagaagctatggatgcagcttacacagcatttagagctggatacagtgtaatagtttcccatagaagtggagaaactgaagatactacgatagctgacttagcggttgccctcaacgctggacaaattaaaactggagctccggcaagaagcgataggaacgctaagtacaatcagctcataaggatcgaagaggagcttgaaggaatagcagtttacgccggcaagaactttaggaaggttttcttctga

SEQ ID NO: 3966 - protein, 428 aa, Pyrococcus horikoshii
MENPYEITAIVAREILDSRGNPTVEVDVHTPIAMGRAAVPSGASTGTHEAVELRDGGKRYHGKGVRRAVENVNKIIAPELIGMDVRWQREIDKLLIELDGTENKSNLGANAILAVSLAVAKAAANSLELPLYQYLGGVNAYVLPVPLSNVINGGVHAGNELDFQEFMIMPIGASSFREAIRWVSETYHVLKRVIMGKYGKNAVNVGDEGGFAPPMKEVTEPLDALIKAIEEAGYKPGDEIALAIDAASSEFFKDGKYIVGGKEYTREELLDLYKELVSTYPIVSIEDPFHEEDWEGFVMITNELGKKIQIVGDDLFVTNPRRLKKGIELGAANALLLKVNQIGTLTEAMDAAYTAFRAGYSVIVSHRSGETEDTTIADLAVALNAGQIKTGAPARSDRNAKYNQLIRIEEELEGIAVYAGKNFRKVFF

SEQ ID NO: 3967 - DNA, 1681 bp, Treponema pallidum subsp. pallidum (syphilis spirochete)
  CDS (207)..(1505)
attgatggttcccattgcgtatcgagaatagatataacgcgccgttgcaatactccgttggaataccgaggcggttggtacagttactttctctgtggtgttctcagtgggaagggagcgcggcgtgcgggggcgatagagagagtggaaaacctttacgcattttttttcgcgtgttaccatgcgcccacatcaggaggtcttaaatgagtgacattgcatgcattgaagcgcgcgagatcatcgattctcggggaaaccccactgtcgaagtggatgtctcgctcagtgacggtagctttggccgtgcgtgtgttccttcaggggcgtctaccggagagttcgaggcgctcgaaatgcgtgatggagacaaggagcgctataacggtaagggtgttctcaaggccgttggaactgtcaacacgctcattgctgatacgctcgaaggtatggatgcgctcaaccagggtgagatagatcacgcgatgcggaatctggacggcactgacaataagtcaaagcttggtgcgaatgctatgcttggcgtctccatggcttgtgcgcgtgctgctgcagactttctgggtgttcctctctaccgttacctcggtggtgtgcacacttttcgcatgccggtccctatggccaacattatcaatggggggaagcattctgataataaaattgactttcaagagtttatggttatgcccatcggcgctgcgtccatgcgcgaagcggtgcgcatgaccgcagaggtgttccacgcgttaaagggcctgcttgccgccgacggcaaagctacgtcagttggtgatgaaggtggttttgcgcctgatttggataacgagcaagcccttgagtacattatgaaagcgatcgcaaaagccggccttgcgccgcggaaggatgtgtgtattgcgcttgactgtgcgtcttctgagttattcgatgaaggagatcggagagggtacaagttttggaagtcgaatccggggaagctgttcacagcacaggaaatgattgatctgtacaagaagtggattgctacgtatccgattgtgtctatcgaggatccgcttgaccaaaacgactgggcaggttacgtgcagctcacgaaagagttgggagacaaagtccaaattgtgggagatgatttttttgtaaccaacactgggcgtctggcccgaggtatcaaagaaggatcgtgcaattcgattctgataaaacttaatcagattggcacggtcacagaaactgtcgacgcggtgcgtatggctcagaacgcaggctacgcggcggtgatttcacatcgctcgggtgagacagaggatgcgtttatcgcagacttagcagtggcacttgagacaggtcaaatcaaaaccggctcgatgagtcgcagtgaccgggtggcgaagtataaccagttgatgcgcattgaggaagagttgggtgcacaggcgcgctactacggggcaaagacctttgagcggtttggttgttagcttgtaaggtgcgaggaactctataagaagttggggtacggggcagagaacgcaggactccgtgtcgtttcttctttacttcctggcggaatggttgctggtctttctgctgtgaggacgcttttatcttcgccaggatgtgttttatactcccgcgtatgggcgcgggagttttc

SEQ ID NO: 3968 - protein, 432 aa, Treponema pallidum subsp. pallidum (syphilis spirochete) [sequence omitted]

SEQ ID NO: 3969 - DNA, 1371 bp, Mycoplasma pulmonis
  CDS (1)..(1371): transl_table=4
atgtcagaaatcgttaaaattaaagcacttgaagttctagactcaagaggaaatccaacaatccaagttgaagttcatactatttcaggggcctatggaaaagcccttgttccttcaggagcctctactggttcaagagaggctcttgaactaagagatgaatcaacaaaatacaaagataattgatatgcttctaaaggtgtacaaaaagcagttgataatgttaataacaaaatcgcagatttacttattgggcaaaatgttcttgatcaaagaaacattgacaacataatgattgaagctgatggaacagaaaataaatcaaaatttggagcaaatgctattttaggtgtttctttagcagctgctcatgcaggggctaattttttacaaatccctctttatagatacattggaggaattaatgccaacatgcttcctcttccaatgttaaatgttatcaatggaggagagcatgcttcaaataccattgatttccaggaatttatgattatgccaatgggggcaaaaacttttaaagaatcccttcaaatggcaaacaaagttttccataatttagctaaattactaaaaaaagcaggtcatggaactcaagtaggtgatgaaggtggttttgcacctaatttaaaaaaccatgaggaagttttagactttttaatgcaagccattgaagttgcaggttttgttgcttcaacttcaaaagaaaaaggaatagcaatagccatcgatgcagctagttctgagttatatgatcaaagcacaggaaaatatacattcaaaaaattaaaacaagctattaaaacaaaacaaccaggttttgaaaatgttgaaaaaacaaaattagattttacaagtgatgaacttattgcttattatggagagttaatttctaaatatccaataatttcaattgaagatggttttgcagaaagtgattgacaaggttttgctaaatttacaaaaatatatggtgaaaaactacaaattgtcggagatgatttaacagttacaaattcaaaaattcttgaaagagctattaaagaaaaatcaatgaattcaattttagttaaactaaaccaaattggaagtctttctgaaacccttgatactatcaacatggctcataaagcaggttttagcgctgttatttcacatcgttcaggagaaacagaagatactaccatagcagatcttgctgttgctttaaatactggtcaaattaaaacaggatcactttcaagaactgatagaattgcaaaatacaatcgccttcttgaaatagaagatcaacttgaagaagcagctgttttccctggaaaaaaagcattttgaaatttaaaaaatagataa

SEQ ID NO: 3970 - protein, 456 aa, Mycoplasma pulmonis [sequence omitted]

SEQ ID NO: 3971 - DNA, 1290 bp, Thermotoga maritima
  CDS (1)..(1290)
atgtacgtggaaatcgtggatgtaagagcaagagaggttctggattcgagaggaaaccccaccgttgaagcggaagtcgtgcttgaagacggaacaatgggaagagccatcgtaccctctggtgcctcaacgggaaaattcgaagccctggaaatcagagacaaagacaagaagagatacctcgggaaaggtgttctgaaagcagtagagaacgtgaacgaaaccatagctcctgcactgatcgggatgaacgcattcgaccagccactcgttgacaagacattgatagaactggacggcaccgaaaacaaatctaaactgggtgccaacgccatactcgccgtttctatggcagttgccagagcagcagcgaattaccttggattgcccctctacaaataccttggaggagtcaacgcgaaggttctgccagtacctctgatgaacgtgatcaacggtggacagcacgcagacaacaatcttgaccttcaggaattcatgattgttcccgccggatttgacagcttcagagaagctttgagggcaggagcggaaatattccacacgttgaaaaagatactccacgaagccggtcacgtgacagcggtcggagacgagggtggattcgctcccaatttgtcttccaacgaggaagccataaaagttctgattgaagccatagagaaagcaggctacaaacccggagaagaagttttcatagctctcgactgtgcggcatcttccttttacgatgaggaaaagggagtttactacgtcgatggtgaggaaaaatccagcgaagttctcatgggatactacgaagaactggtggcgaagtaccccatcatatccatcgaagatccgttcgcggaggaagactgggatgcatttgtggaattcacaaagagagtaggaaacaaggttcagatcgttggagatgacctttacgtgaccaacgtgaaaagactttccaaaggaatagaactcaaagcgaccaactccatactcatcaaactcaatcagataggcaccgtcacggaaactctcgacgcggtggagatggcacagaagaacaacatgacagccatcatttcccacagatccggagagagtgaagacacgttcatcgcagaccttgccgtggcaacgaacgctggtttcatcaagacaggttccctctccaggagcgaaaggatagccaagtacaaccagcttttgagaatcgaggaagaactcggaaaagtggcagaattcagaggtttgaaatctttctactctataaagagataa

SEQ ID NO: 3972 - protein, 429 aa, Thermotoga maritima [sequence omitted]

SEQ ID NO: 3973 - DNA, 1287 bp, Chlamydophila pneumoniae, Chlamydia pneumoniae
  CDS (1)..(1287)
atgtttgaagctgtcattgccgatatccaggctagggaaatcttggattctcgcgggtatcccactttacatgttaaagtaaccactagcacaggttctgttggagaagctcgggttccttcaggagcatccacagggaaaaaagaagccttagagtttcgtgatacagattctcctcgttatcaaggcaaaggggttttgcaagctgtaaaaaacgtaaaagaaattctttttcccctcgtcaagggatgtagtgtttatgagcaatccttaattgattctctgatgatggattctgacggctctccgaacaaagaaactctaggggccaatgctattttaggagtctctctagctacagcacatgcagcagcagcaacactacgcagacctctgtatcgttatttaggagggtgttttgcctgcagtcttccctgtcctatgatgaatctgatcaatggaggcatgcatgccgataacggcttggggttccaagaatttatgatccgtcctattggagcctcttccatcaaagaagctgtcaacatgggtgctgacgtttttcatactttgaaaaaattactccatgaaagaggcttatctactggagtgggtgacgaaggaggcttcgccccgaatcttgcttctaatgaagaagctctagagctcctattgctggctattgaaaaagcaggctttactccaggaaaagatatatcgctagccttagactgcgcagcatcctcattctataacgtaaaaacaggcacgtatgatgggaggcactatgaagagcaaatcgcaatcctttctaatttatgtgatcgctatcctatagactccatagaagatggtcttgctgaagaagactatgacgggtgggccttgttaactgaagttcttggagaaaaagtacagattgtgggtgatgacctatttgttacaaatccggaattaatattagagggtattagcaatggattagcgaactctgtgttgattaaaccaaatcagatagggacgcttactgaaacagtgtatgctatcaagcttgcgcaaatggctggctatactacaattatttctcatcgctcaggagaaactacggacactacgattgcagatcttgctgttgccttcaacgctggtcaaatcaaaacaggctctttatcacgttctgagcgtgttgcaaaatacaatagactcatggaaattgaagaagagcttggatccgaagcaattttcacagattctaatgtattttcttacgaggattctgaggaatag

SEQ ID NO: 3974 - protein, 428 aa, Chlamydophila pneumoniae, Chlamydia pneumoniae [sequence omitted]

SEQ ID NO: 3975 - DNA, 1459 bp, Arabidopsis thaliana (mouse-ear cress)
  CDS (1)..(1428)
atgtctgtgcaagagtatttagacaagcatatgctttctcggaaaatcgaagacgccgttaatgccgccgtaagggctaaaacctcagatcccgttctcttcatcgctaatcatctgaagaaagctgtatcatctgtgataacgaaggttaaagcacgacagatccttgacagcagaggaattccaacagttgaagttgatctgcacacgaacaaaggcgtttttcgtgcttctgttcccagtggtgattcttctggaacgtatgaagctattgagctacgtgatggagacaaaggaatgtatcttggaaacagtgtggctaaagctgttaagaacataaatgaaaaaatttctgaggcgttgattggtatggacccaaaacttcagggtcagatagatcaggctatgatagatttggataaaactgaaaagaagagtgaacttggtgctaatgctatacttgctgtgtcaattgcggcatgcaaggctggagctgctgagaaagaggtccctttgtgcaagcatctttctgatcttagtggcagagcaaacatggtgttacctgtacctgcgttcactgttttgagtggtgggaagcatgcttcgaatacttttgccattcaggaaattatgattctcccaattggagcaagtagatttgaggaggccctgcaatggggatctgagacatatcatcatttaaaggctgtcatttcagaaaagaatggtggtttgggatgtaatgttggtgaagatggtggtcttgctccagatatctcgagcctcaaggaaggtttggagcttgtaaaagaagctatcaaccgaacagggtacaatgataagataaagatagccattgatattgccgccactaatttttgtttaggtaccaagtatgatttagatatcaagtctccaaataaatctgggcaaaatttcaagtcagcggaagatatgatagatatgtacaaagaaatttgtaatgattatccaattgtgtctatagaggacccttttgacaaggaggactgggaacacaccaagtatttttcgagtcttggaatatgtcaggtggtaggtgacgatttgttgatgtcaaattcaaaacgagttgagcgtgccatacaggagtcttcttgtaatgctcttcttctcaaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccagttgctacggatagaggaagagcttggggatcaagcagtgtatgctggagaagattggaagctatctctctaaacaaaatgcacatgtgatattaattgttaca

SEQ ID NO: 3976 - protein, 475 aa, Arabidopsis thaliana (mouse-ear cress)
MSVQEYLDKHMLSRKIEDAVNAAVRAKTSDPVLFIANHLKKAVSSVITKVKARQILDSRGIPTVEVDLHTNKGVFRASVPSGDSSGTYEAIELRDGDKGMYLGNSVAKAVKNINEKISEALIGMDPKLQGQIDQAMIDLDKTEKKSELGANAILAVSIAACKAGAAEKEVPLCKHLSDLSGRANMVLPVPAFTVLSGGKHASNTFAIQEIMILPIGASRFEEALQWGSETYHHLKAVISEKNGGLGCNVGEDGGLAPDISSLKEGLELVKEAINRTGYNDKIKIAIDIAATNFCLGTKYDLDIKSPNKSGQNFKSAEDMIDMYKEICNDYPIVSIEDPFDKEDWEHTKYFSSLGICQVVGDDLLMSNSKRVERAIQESSCNALLLKVNQIGTVTEAIEVVKMARDAQWGVVTSHRCGETEDSFISDLSVGLATGVIKAGAPCRGERTMKYNQLLRIEEELGDQAVYAGEDWKLSL

SEQ ID NO: 3977 - DNA, 1296 bp, Clostridium acetobutylicum
  CDS (1)..(1296)
atgaaatcatatgttgaaattgttgacgtaatggcaagacaaatcttggattcaagggctaatcctactgtcgaagtagaggttgttcttgaagacggaacagtaggaagagcgtcagtaccttcaggagcatccacaggacagtttgaagctgtcgaacttagagacaacgataaagctcagtacttaggaaaaagtgttctcaatgctgttgacaatgtaaatgagacaatagcaacagagcttataggaatgaatgtatttgaccagacattaattgatcagacaatgcttgaaattgatggaacggaaaataagtcaaagcttggtgcaaatgcaatgcttggagtatcacttgcagtagctagagcagcagctgaatacctaggaattagtctttatcaatatcttggaggagttaatgctaaagttcttccagttccaatgatgaatattgtaaatggaggaaagcatgcagataacaatgttgatttccaagaatttatgataatgccagcaggagctccaagctttagcgaagcccttagatcatgcgcagaggtttatcacactttaaaatctttactacaatcaaaaggacttgaaacagctgttggagatgaaggcggatttgcaccaaatcttaatagtaatgaagaagcaatacaaattattttggaagctgtaactaaggcgggatatgagccaggaaaagatatgtttatagcaatggaccctgcttcaacagaattttatgagaacggaaaatacaatcttaagggcgaaggtaaggtttatacttcagaagaaatggttgaagtttacgcaaatttagtggaaaaatatcctataatatcacttgaagatggtatggctgaagaagattgggatggatggaagctgttaactgacagaatcggagataaagttcaattagtaggagacgatttatttgttacaaatactaagagactttcaaagggaatacagcttggagtagctaattcaatactcataaagttaaaccaaataggaactcttacagaaactttaaatgcaatagaaatggcacaaagagctggatatacagcagtagtttctcatagatcaggagaaacagaagatactacaatttcagatcttgttgtagctgtaaacgcaggacagataaaaacaggagcaccagcaagaacagaaagagttgcaaaatataaccaacttcttagaatagaagaggaacttggcgaagttgctgaatttagaggtttaaatgccttctacaatataaaaaaataa

SEQ ID NO: 3978 - protein, 431 aa, Clostridium acetobutylicum [sequence omitted]

SEQ ID NO: 3979 - DNA, 1302 bp, Borrelia burgdorferi (Lyme disease spirochete)
  CDS (1)..(1302)
atgggttttcacatttatgaaatcaaagccagacaaatcattgattctagagggaatccaacagttgaagctgatgtcattttagaagatggaacttacggaagagctgccgtaccatcaggtgcatcaacaggaattaacgaggctgttgagcttagagatggtgataagtctgtatatatgggaaaaggggttttaaaggcaattgaaaatataaaaaacataattgccccagaacttgaaggtatgagtgccttaaatcaggttgcaatcgacagaaaaatgcttgaacttgatggcacccctacaaaagaaaagcttggtgctaatgcaattttagcagtttcaatggctacagctaaagctgctgcaaagtaccttggacttaggccttatcaatatcttggagcgtacaaagccaacattttgcctacacctatgtgtaatattattaatggcggtgcacactctgacaactctgttgactttcaggagttcatgataatgccaataggagcaaaaacattcagtgaagcaataagaatggcagcagaggtttttcatacgctaaagggcattctaagtggcaaagggtatgcaacttctgttggagatgaagggggatttgctccaaatttgaaatcaaatgaagaagcttgtgaagtgattatagaggcaataaagaaggcaggatatgaacctggaaaagacattgcaatagctcttgatcccgcaacatctgagctttatgatccaaaaacaaaaaaatacgtacttaaatggtcaacaaaagaaaaacttacttccgaacaaatggttgaatattgggcaaagtgggtagaaaaatatccaatcatttcaattgaagatggaatggctgaagaagattgggatggatggaaaaaacttacagacaaaattggaaacaaaatacaacttgttggagatgatttatttgtaacaaatacctcgtttcttaaaaaaggaattgaaatgggagttgccaattcaatccttattaaggtcaatcaaattggaacactaacagaaacatttgaggctgtagaaatggctaaaaaagcgggttacacagcaatagtctctcacagatcgggagaaacagaagatacaacaatagctgatcttgtagtagctcttggaacaggacaaatcaaaactggttcactctcaagaacagatagaatagcaaaatacaatcaactcataagaatagaggaagaattggaaacaactgctgaataccacggtaagagcgtcttttattctattaaacaaaaataa

SEQ ID NO: 3980 - protein, 433 aa, Borrelia burgdorferi (Lyme disease spirochete) [sequence omitted]

SEQ ID NO: 3981 - DNA, 1281 bp, Helicobacter pylori
  CDS (1)..(1281)
atgctaaccattaaagatattcatgctttagaagtgatggatagtaggggcaatcctaccattcaagccagcgtgattttaagcgataacactaaggcgagcgcgattgtgcctagcggggcgagcaccggtaaaagagaagcgttagaattaagggataatgacaaaacccgttttttgggtaaaggggttttaagggcatgcgaaaatgtcaatagcgtgatcaaacaccatttgatagggcttgaagcgactaatcaggcctttgtagatgagaggttaagggctttagacggcacgcctaattacgctaatttaggggcgaacgctgttttgggcgtttctatggcgttagcaagggctagcgcgaaggctttaaatctgccattataccgctatttagggggggctaacgctttgactttgccggtgccgatgctcaatatcatcaacggcggaacgcatgcgaacaattccatagacttccaagaatacatgatcatgcctttagggtttgagagttttaaagaagctttaagagcgagtgcggaagtctatcacacgcttaaaaaacttttagatgaaaagaatcagctcacaagcgtgggcgatgaggggggctttgcgcctaattttaacaacaatgtagaacctcttgaaatcatttctcaagccattgaaaaagccggctataaattaggtgaagaaatagcgctcgctttagatgtggcgagcagtgagttagtggatgaacatttcaattaccatttaaagggcgaaaataagattttagattcgcatgaattagtggcttattataaagagttggtggcaaaatacccgattgtgtccattgaagatggtttgagcgaagacgattgggagggttgggcgtttttaagcaaggaattagggcgtcaaatccaattagtgggcgatgatttgtttgtaacgaacgcgagcatcttgcaaaaaggcattgaaaaaaacgttgcaaacgccattttgatcaaacccaatcaaatcggcaccattagtgaaactttagagaccataagattggccaaacaccatgcctatcaatgcgtgataagccatagaagcggggagagtgaagacagctttatcgctgattttgcggtcgcattgaatacgggagagattaaaaccggatccaccgcaaggagtgaaaggatcgctaaatacaaccgccttttggagattgagcatgaattaaaaggggggatttatatcggcaaagagttgtttaagcatggctag

SEQ ID NO: 3982 - protein, 426 aa, Helicobacter pylori [sequence omitted]

SEQ ID NO: 3983 - DNA, 1323 bp, Ureaplasma urealyticum
  CDS (1)..(1323): transl_table=4
atgaaaataattaatttattagcttatcaaattcttgattcgcgcggccaaccaacagtagctgttaaattatttttagagaacgatcaaagtgtaattgcaatggttccatcaggcgcttccactggagcaaaggaagcattagaattaagagatggtgatgtaaattatttttttaataagtctgttaaattagcaattcaaaatattaataatattattcgccctcatctaattaataaaaatgttttaaatttttttgaattagataatttattaattaatctagatggtactgaaaataaaagtaaattaggtgctaatgctttattaggtgtttctatagcgattgttaaagcgggagcaatagccgcttctaaacctttatatcaatatattaaagaagacttaatgcataattatgatgtaaactattatgctccaattccgttaatgaattttattaatggtggggctcacgcagataatgatttagatattcaagaatttatgattgttccattaaatgcaatttcattttctcaagcgattcaaattggatcagaaatttttcatcaattagataaacttttaaaaagcaatcatttaagtacaacaaagggtgatgaaggcggttttgctccaatgttaaaaaataattatgtgactttagaactattagttcatgctattaaaaaagcacattaccttccttcaaaaacacaaggagtttgtcttgccttagatgtcgcagcttctgaattgtatgaaaacggaaaatatttttttaaaaagtcttcatctcataacattactcttgaacaaacatcattcagtagtgatgaatgaataaagtattgaagtaaattagtatctatgtttcctatcatttcgatcgaggattgttttgaggaaaacgattgaaatagttttgcgttatttttaaaaaataacccacacattcaagtggttggtgatgatttatattgcacaaacttaaagtatctacaaaaaggaattgattttaaagcaacaaatgctattttaattaaacctaatcaaattggtacaattagtgaaacgttagatgttattaaatttgcacaaaaaaacaatattaatactatcatttcgcatcgctctggcgaaactgaagacacttttattgcagatttagcgattggtgtaggtgctgggcaaattaaaacaggttcattatcacgttctgaacggatagcgaagtataatcgtattttagaaatcgaacaagaattaaaggataaattaatttatgaaccaagtaaattttttaaatttagataa

SEQ ID NO: 3984 - protein, 440 aa, Ureaplasma urealyticum [sequence omitted]

SEQ ID NO: 3985 - DNA, 1290 bp, Pseudomonas aeruginosa
  CDS (1)..(1290)
atggcaaagatcgtcgacatcaagggccgtgaggtcctggactcccgcggcaaccctaccgttgaagcggacgtgatcctggacaacggcatcgtcggcagcgcctgcgcgccttccggtgcttccaccggttcccgcgaggccctcgagctgcgcgatggcgacaagagccgttacctgggcaagggcgtgctgaaagccgtggccaacatcaacggcccgatccgcgacctgctgctgggcaaggacgcggccgaccagaaagccctcgaccacgcgatgatcgagctggacggcaccgagaacaaggccaagctgggcgccaacgcgatcctcgcggtgtccctggctgccgccaaggccgccgcacaggccaagggcgtaccgctgtacgcgcacatcgccgacctcaacggcactcccggccagtactccatgccggtgccgatgatgaacatcatcaacggcggcgagcatgcggacaacaacgtcgatatccaggaattcatggtccagccggtcggcgcgaagaacttcgccgaggcgctgcgcatgggcgccgagatcttccatcacctcaaggccgtgctgaaggcccgtggcctgaacaccgccgtcggtgacgaaggcggcttcgcgccgaacctgtcgtccaacgaagacgccctggccgccatcgccgaggccgtcgagaaggccggctacaagctgggcgacgacgtgaccctggccctggactgcgcctccagcgagttcttcaaggacggcaagtacgacctggaaggcgaaggcaaggtattcgacgccgccggtttcgccgactacctggccggcctgacccagcgctacccgatcatctccatcgaggacggcatggacgagtccgactgggccggctggaaaggcctgaccgacaagatcggcgccaaggtccaactggtcggcgacgacctgttcgtgaccaacaccaagatcctcaaggaaggcatcgagaagggcatcggcaattcgatcctgatcaagttcaaccagatcggttcgctcaccgagaccctggaggccatccagatggccaaggccgccggctataccgcggtgatctcgcaccgctccggcgaaaccgaggactcgaccatcgccgacctggccgtgggtaccgccgccggtcagatcaagaccggttcgctgtgccgctccgaccgcgtgtccaagtacaaccagttgctgcgcatcgaagagcaactgggcgccaaggcgccgtaccgtggtcgcgcggaattccgcggctga

SEQ ID NO: 3986 - protein, 429 aa, Pseudomonas aeruginosa
MAKIVDIKGREVLDSRGNPTVEADVILDNGIVGSACAPSGASTGSREALELRDGDKSRYLGKGVLKAVANINGPIRDLLLGKDAADQKALDHAMIELDGTENKAKLGANAILAVSLAAAKAAAQAKGVPLYAHIADLNGTPGQYSMPVPMMNIINGGEHADNNVDIQEFMVQPVGAKNFAEALRMGAEIFHHLKAVLKARGLNTAVGDEGGFAPNLSSNEDALAAIAEAVEKAGYKLGDDVTLALDCASSEFFKDGKYDLEGEGKVFDAAGFADYLAGLTQRYPIISIEDGMDESDWAGWKGLTDKIGAKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAPYRGRAEFRG

SEQ ID NO: 3987 - DNA, 1281 bp, Caulobacter crescentus
  CDS (1)..(1281)
atgaccgagatcgtcgacatcatcgcccgcgaaattctcgacagccgggggaacccgaccgtcgaagtcgacgtcattctcgaggacggcgcgttcggtcgcgccgcagtgccctcgggcgcctcgacgggcgctcacgaagccaacgaaaagcgtgatggcgacaaggctcgctatctgggcaagggcgtccagcaggcggtcgacgccgtcaatggcgagatcttcgacgcgctgtcgggcgtcgacgccgaagaccagcgtcgggtcgacaacctgatgatcgagctcgacggtacgccgaacaaggcccgcctgggcgccaacgccatcctcggcgtctcgctggccaccgccaaggccgccgccgagtccgccggcctgccgctctacaagtatgtcggcggcgtcaacgcccgcgtgctgccgaccccgatgatgaacatcatcaacggcggcgctcacgccgacaatccgatcgacatccaggagttcatgatcctgccgaccggcgccaaggacttccgcgaaggcctgcggatgggcgcagagatcttccacgccctgaagaaggctctgaaggacgcgggtcacaacaccaatgtcggcgacgaaggcggctttgcgccgaacctggcgtcggctgaagccgcactcgacttcatcgtcaaggcgggtgagaaggcgggctacaaggccggtgacgactttgtcctgggcctcgacgtcgcctcgaccgagttcttcaagaacggcaagtacgagcttgaaggcgagggcaagtcgctggatccggccgccatggtcgactacctggctggtctggtcgccaagttcccgatcctgacgatcgaggacggcatggccgaagacgacttcgacggctggaagctgctgaccgacacccttggcaagaaggtgcagctggtcggcgacgacctgttcgtcaccaaccccaagcgcctgcagatgggcctggacaagggtctggccaactcgatcctggtgaaggtcaaccagatcggcacgctctcggaaaccatcgacgcggtcgagctggcgcatcgtcacggttacaccagtgtgatgagccaccgttcgggcgagaccgaagacagcacgatcgcggacctggcggtcgctctgaactgcggtcagatcaagacgggctcgctggcgcggtcggaccggacggccaagtacaaccaactgcttcgcatccaggaaatgctggatgatcagggcgtctacgccggccgagcggccctcaagggtcgctaa

SEQ ID NO: 3988 - protein, 426 aa, Caulobacter crescentus [sequence omitted]

SEQ ID NO: 3989 - DNA, 1445 bp, Schizosaccharomyces pombe
  CDS (32)..(1351)
aattagtattctacagtaaacatcgttaatcatggccattcagaaagtctttgctcgtcaaatctacgctctcggtggtaaccccactgtcgaggtcgacctcaccaccgagaccggtatccaccgtgctatcgtcccctctggtgcctccactggtatatgggaggctcttgagatgcgtgatggtgacaagaccaagtggggtggtaagggtgttttgaaggctgttggcaatgtcaacaacatcattgcccctgccgtcgttaaggccaaccttgacgttaccgaccaaaaggccgccgacgagttcttgcttaagctcgacggtactgagaacaagtccaagttgggtgctaacgccatcttgggtgtctccatggctatctgccgtgccggtgctgcccaaaagaagctccctctctggaagtacattgccgagaactttggcaccaagggaccctatgtcctccccgttccctctttcaacgtcttgaacggtggttcccacgctggtggtgacttggctttccaagaattcatgatcctccccaccggtgctccctctttctccgaggctatgcgttggggtgctgagacctaccagactctcaagtccattgccaagaagcgttatggttcttctgccggcaatgtcggtgatgagggtggtattgctcccgatttgcaaacccctcaagaggctcttgaccttattgttgaggccatcaacaaggctggttacgagggtaagatcaagattggtcttgatgttacctcctccgagttctacgttgacggcaagtacgaccttgacatcaaggccgccaagcccaagcccgagaacaagcttacctaccaacaacttaccgacctttacgtcgagctctccaagaagtaccccattgtctccattgaggaccccttcgaccaagatgactggtctgcctggactcacatgaaggctgagaccgacttccaaattgtcggtgacgatttgactgttaccaacgtcaagcgtcttcgtaccgccatcgacaagaagtgcgctaacgctcttcttttgaaggtcaaccaaatcggttccgtcaccgagtctttgaacgtcgtccgcatgtcctacgaggctggttggggtgttatggtttctcaccgttccggtggaaccgctgacaccttcatctcccacttgactgttggtattggtgccggtcaacttaagtctggtgctccttgccgttccgagcgtttggccaagtacaacgagcttctccgtatcgaggaggaactcggttccaggggtgtttacgctggtgcccatgctggcaagtacatcaaggctgctaagttttaaactctgagcatacattaaattttactaatgtttacaatacatgtttatttttatagaatgcaatgaaatttttatcctttttgcgttttggatt

SEQ ID NO: 3990 - protein, 439 aa, Schizosaccharomyces pombe
MAIQKVFARQIYALGGNPTVEVDLTTETGIHRAIVPSGASTGIWEALEMRDGDKTKWGGKGVLKAVGNVNNIIAPAVVKANLDVTDQKAADEFLLKLDGTENKSKLGANAILGVSMAICRAGAAQKKLPLWKYIAENFGTKGPYVLPVPSFNVLNGGSHAGGDLAFQEFMILPTGAPSFSEAMRWGAETYQTLKSIAKKRYGSSAGNVGDEGGIAPDLQTPQEALDLIVEAINKAGYEGKIKIGLDVTSSEFYVDGKYDLDIKAAKPKPENKLTYQQLTDLYVELSKKYPIVSIEDPFDQDDWSAWTHMKAETDFQIVGDDLTVTNVKRLRTAIDKKCANALLLKVNQIGSVTESLNVVRMSYEAGWGVMVSHRSGGTADTFISHLTVGIGAGQLKSGAPCRSERLAKYNELLRIEEELGSRGVYAGAHAGKYIKAAKF

SEQ ID NO: 3991 - DNA, 1535 bp, Aspergillus oryzae
  CDS (21)..(1337)
caattccgcagctcgtcaaaatgcctatcaccaagatccacgcccgctctgtttacgactcccgcggtaaccctaccgttgaggtggacgttgtcaccgagactggtttgcaccgcgctatcgttccctctggtgcttccactggtcagcacgaggcccacgagctccgtgacggtgacaagacccactggggtggaaagggtgttctcaaggctgtcgagaacgtcaataagaccattgcccccgccgtcatcgaggagaaccttgatgtcaaggaccagtccaaggtcgatgagttcctcaaaaagcttgatggatctgctaacaagtctaacctcggtgctaacgccatcctcggtgtcagcttggccattgccaaggctggtgctgctgagaagggtgtccctctctatgctcacatctccgaccttgctggtactaagaagccctatgtgcttcctgtccccttccagaacgtcctgaacggtggctctcacgctggtggccgtctggctttccaggagttcatgattgttccttccgctgccccctctttctccgaggctcttcgccagggtgctgaggtctaccagaagctcaagactctcgccaagaagaagtacggccagtctgctggcaatgttggtgacgagggtggtgttgctcccgatatccagactgctgaggaggcacttgacctcatcaccgaggccattgagcaggccggttacactggcaagatgaagattgccatggacgttgcttccagcgaattctacaaggctgatgtcaagaagtacgaccttgacttcaagaaccccgacagcgactcctccaagtggctcacctacgagcaactggccgacctttacaagactcttgccagcaagtaccccattgtcagcattgaggaccccttcgctgaggatgactgggaggcctggagctacttctacaagacttctgacttccagattgttggtgatgacttgaccgtcaccaaccccctgcgtatcaagaaggccatcgagaccaaggcttgcaacgcccttctgctcaaggtcaaccagatcggtactcttaccgagtccatccaggctgccaaggactcctacgctgacaactggggtgtcatggtttcccaccgttccggtgagactgaggatgtcaccattgccgatatcgctgtcggtctccgctctggccagatcaagaccggtgctcctgcccgctctgagcgtctggccaagctgaaccagatcctccgtatcgaggaggagctgggcaacaacgccatctatgctggcgaaaagttccgcacttctgtcaacctgtaaatgaaccgtatgattatatgacgtctaccagccaacctgacacattatcgaaagatggttggactcgggaccacactgcatacccgggttcccgctacttgcaacctctgagctgcacaaagcactacagatgatattctcttaagatttatgatgacgattcgattaggccagatatagtggcagtaatgcaataaa

SEQ ID NO: 3992 - protein, 438 aa, Aspergillus oryzae
MPITKIHARSVYDSRGNPTVEVDVVTETGLHRAIVPSGASTGQHEAHELRDGDKTHWGGKGVLKAVENVNKTIAPAVIEENLDVKDQSKVDEFLKKLDGSANKSNLGANAILGVSLAIAKAGAAEKGVPLYAHISDLAGTKKPYVLPVPFQNVLNGGSHAGGRLAFQEFMIVPSAAPSFSEALRQGAEVYQKLKTLAKKKYGQSAGNVGDEGGVAPDIQTAEEALDLITEAIEQAGYTGKMKIAMDVASSEFYKADVKKYDLDFKNPDSDSSKWLTYEQLADLYKTLASKYPIVSIEDPFAEDDWEAWSYFYKTSDFQIVGDDLTVTNPLRIKKAIETKACNALLLKVNQIGTLTESIQAAKDSYADNWGVMVSHRSGETEDVTIADIAVGLRSGQIKTGAPARSERLAKLNQILRIEEELGNNAIYAGEKFRTSVNL

SEQ ID NO: 3993 - DNA, 1553 bp, Lycopersicon esculentum (tomato)
  CDS (61)..(1395)
caaaaactataaacttttttctcttcactcttttctactatttctctgttcatagatctaatggcaactatcaaatccattaaagctcgtcagatctttgacagccgtggtaaccccacagtcgaggttgatgtacatatctcaaatggtgtgtttgccagagctgctgttccaagtggtgcatccaccggaatttacgaagcccttgaattgagggatggaggatctgactacctcggaaagggtgtttcgaaggctgttaacaatgtcaactcaattattggccctgctcttgttggcaaggacccaactgatcagactggtcttgataacttcatggttcatcagttagatggaactcaaaatgagtggggttggtgcaaagaaaagcttggtgcaaatgccatccttgctgtgtcacttgctgtgtgtaaagctggcgctgctgtcaggaatgtgccattgtacaagcacattgctgatttggctggtaacaagaagttggtattaccagttcctgccttcaatgtgattaatggtggatctcatgccggaaacaaactcgcaatgcaggaatttatgatccttcctgttggagctgctaatttcaaggaggccatgaagatgggctgtgaagtctatcaccatttgaaggctgtgattaagaagaaatatggtcaggatgccacaaatgtcggtgatgagggtggttttgctcctaatatccaggagaacaaggaaggtcttgaattgctcaagacagccattgagaaagcaggttacactggaaaggtggtcattggaatggatgttgcagcatctgaattttacggaaaggacaaatcttatgacctgaacttcaaagaagagagcaatgacggctcacaaaagatatcaggtgaccaactcaaggacttatacaagtcatttgtgtccgagtaccctattgtttcaattgaagatccatttgaccaagatgactgggagacctatgctaagctcactgctgagattggggagcaagtacagattgtcggtgatgaccttcttgtcaccaaccctaagagggtcgccaaggcaattgcagagaagacttgcaatgctcttcttctcaaggttaaccaaatcggtagtgtgaccgagagtattgaagctgtgaagatgtccaagaaggcaggttggggtgtaatgaccagtcaccgcagtggagaaacagaagataccttcattgctgatcttgctgtcggtttgtcaacgggacaaatcaagactggagctccttgcaggtcagagcgtctcgccaagtacaaccagctgttgaggatcgaagaggaactcggatcagaggctgtttatgcaggagcaagcttccgcaagcccgttgagccctactaaatttcagcagttccaagtgttgagattgttgagttgttgatctgccaaaaataaattcctcttagattggtcattttaggattatattatatgaccttggtgaaataacaagcagactcaaaaacaagttttgttttctgaggttttattagtatttt

SEQ ID NO: 3994 - protein, 444 aa, Lycopersicon esculentum (tomato)
MATIKSIKARQIFDSRGNPTVEVDVHISNGVFARAAVPSGASTGIYEALELRDGGSDYLGKGVSKAVNNVNSIIGPALVGKDPTDQTGLDNFMVHQLDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKAVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTAEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 3995 - DNA, 1366 bp, Arabidopsis thaliana (mouse-ear cress)
  CDS (1)..(1335)
atggctactatcaccgttgttaaggctagacagatcttcgacagtcgtggtaatcccaccgttgaggttgatatccacacgtcaaatggtattaaggttacagcagctgttccaagtggagcttccactggtatctatgaggctcttgagctgagggatggaggatctgactaccttggaaagggtgtatctaaggctgttggcaatgtgaacaacatcatcgggccagcacttattggaaaggacccaactcagcagactgctattgacaacttcatggtccatgaacttgacggaacccaaaacgagtgggggtggtgcaagcaaaagcttggagccaatgcgattcttgctgtgtctcttgctgtctgcaaagctggggctgttgtcagcggcattcctctatacaagcacattgccaaccttgctggtaaccccaagattgtgctaccagttcctgccttcaacgtcatcaatggtggatcccatgccggaaacaagcttgctatgcaggagtttatgatcctccctgttggagctgcttctttcaaggaagccatgaagatgggtgtggaagtttaccaccacttgaagtctgtgattaagaagaagtacggccaggatgccacaaatgttggtgatgaaggtgggtttgcaccaaacattcaggagaacaaggagggtcttgaattgctcaagactgctatcgagaaggctggatacactggaaaggttgtcattggaatggatgttgccgcttcagagttctactcagaagacaagacctacgacttgaacttcaaagaagagaacaacaatggctctcagaagatttctggtgatgctctaaaggacctgtacaagtcctttgtcgctgagtacccaatcgtgtccattgaggacccatttgaccaagatgactgggagcactatgctaagatgaccactgagtgtggaaccgaggttcagattgtcggtgatgatttgttggtcactaaccccaagagagttgctaaggcaatcgcagagaagtcttgcaatgctcttcttttgaaggttaaccaaatcggatctgtaaccgagagtatcgaggcagttaagatgtcgaagaaagcaggttggggagtgatgaccagccacagaagtggtgaaaccgaggacacattcattgctgacttagccgttggcttgtccactggacaaatcaaaaccggtgctccttgcagatccgagcgtcttgccaagtacaaccagcttttgcgtattgaggaggagttgggatcagaggcaatttacgctggagtcaacttccgcaaacctgtggaaccctactaaatggagcttttagaagcaaagtggtcttctt

SEQ ID NO: 3996 - protein, 444 aa, Arabidopsis thaliana (mouse-ear cress)
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 3997 - DNA, 1314 bp, Saccharomyces cerevisiae
  CDS (1)..(1314)
atggctgtctctaaagtttacgctagatccgtctacgactcccgtggtaacccaaccgtcgaagtcgaattaaccaccgaaaagggtgttttcagatccattgtcccatctggtgcttctaccggtgtccacgaagctttggaaatgagagatggtgacaaatccaagtggatgggtaagggtgttttgcacgctgttaagaacgtcaacgatgtcattgctccagctttcgttaaggctaacattgatgttaaggaccaaaaggccgtcgatgacttcttgatttctttggacggtactgccaacaaatccaagttgggtgctaacgctatcttgggtgtttctttggctgcttccagagctgccgctgctgaaaagaatgtcccattatacaagcacttggctgacttgtctaagtccaagacctctccatacgttttgccagttccattcttgaacgttttgaacggtggttcccacgctggtggtgctttggctttgcaagaatttatgattgctccaactggtgctaagaccttcgctgaagctttgagaattggttccgaagtttaccacaacttgaagtctttgaccaagaagagatacggtgcttctgccggtaacgtcggtgacgaaggtggtgttgctccaaacattcaaactgctgaagaagctttggacttgattgttgacgctatcaaggctgctggtcacgacggtaagatcaagatcggtttggactgtgcttcctctgaattcttcaaggacggtaagtacgacttggacttcaagaatccaaactctgacaaatccaagtggttgactggtcctcaattggctgacttgtaccactccttgatgaagagatacccaattgtctccatcgaagatccatttgctgaagatgactgggaagcttggtctcacttcttcaagaccgctggtattcaaattgttgctgatgacttgactgtcaccaacccaaagagaattgctaccgctatcgaaaagaaggctgccgacgctttgttgttgaaggtcaaccaaatcggtaccttgtctgaatccatcaaggctgctcaagactctttcgctgccggttggggtgttatggtttcccacagatctggtgaaactgaagacactttcattgctgacttggtcgtcggtttgagaactggtcaaatcaagactggtgctccagctagatccgaaagattggctaaattgaaccaattgttgagaatcgaagaagaattaggtgacaacgctgttttcgctggtgaaaacttccaccacggtgacaaattataa

SEQ ID NO: 3998 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKIKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 3999 - DNA, 1305 bp, Homo sapiens (man)
  CDS (1)..(1305)
atgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtga

SEQ ID NO: 4000 - protein, 434 aa, Homo sapiens (man)
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 4001 - DNA, 1720 bp, Xenopus laevis (African clawed frog)
  CDS (35)..(1339)
ggaagagaacggttgcacccacaagaaagtgaaaatgtctatcaagaacatccgtgcacgtgaaatatttgattctcgtgggaaccctacagtggaggttgacctatacacttgcaaaggactgttccgtgctgctgttccaagtggagcttccactggtatttatgaagcactagaactccgggacaatgacaagactcgctacctgggaaagggtgtcggcagagctgtcaaatatgtaaatgagtttctgggacctgcattatgcacccagaatctaaatgttgttgagcaggaaaagattgacaagctcatgattgaaatggatggaactgaaaacaaatccaaatttggtgctaatgcactcctgggagtgtccctggcagtgtgtaaagctggagctgcagagaagggagtcccactgtaccgtcacattgctgacctggctgggaaccctgaggtcatacttcctgtaccggcatttaatgttatcaatggtggctctcatgctggcaacaagctggctatgcaagaattcatgatcttgcctgtgggtgcagacagctttaaggaggccatgcgcataggggcagaggtgtatcacaatctgaagaatgtcatcaaggagaaatatggaaaggatgccacaaatgttggtgatgaagggggtttcgctcccaatatcttggagaacaaagaagccttggagcttctgaaaactgccattaacaaggcaggatacccagataagattgtcattgggatggacgtggcagcatctgaattctaccgtgatggaaaatatgatctggacttcaagtcccccgatgaccccagcaggtacatctcacctgacaagctggctgaactgtacatgagctttgtcaaaaattatccagtggtatccattgaagatccctttgaccaggatcattgggaagcctggacaaagttcacagcagcttctggtatccaggtagttggtgatgacttgactgtgaccaaccctaagcgtattgccaaggctgtggaggagaaggcttgtaactgtctgcttctgaaagtcaatcagattggcacagtgacagaatccctggaggcgtgtaagctggctcagtcaaacggctggggtgtgatggtcagccatcgttctggggagacagaagatactttcattgctgacctagtggttggtctttgcactggacagataaagactggggctccatgcagatctgagcgacttgcaaagtacaaccaattgctcaggattgaagaagaacttggcagcaaggcccgctttgctggaaaaaacttcagaaaaccagttttcaactaattggcgacttccctaggcaatcacccaactgatgtagtagctgtgcacccaggagagactacaagaggtggcttacttgtcactgctgagccctcgcttaatttcaggcacttccagcgatgttagatgttacggagcctctcccagcataaccctgccatctttccaattcaaaagctttgcgctgctgctgtttaggattactcctaattcagtgtcactctggtgcctgcatgtcgtacttgtcttttctattgtggctgtggtcctggtcacgtcttctttgtagtcctgtgttctcatcctgttgcagtttcacaatagataatggtttgtgttacactgtagagattaagaggcaataaaactctttcgaaggtg

SEQ ID NO: 4002 - protein, 434 aa, Xenopus laevis (African clawed frog)
MSIKNIRAREIFDSRGNPTVEVDLYTCKGLFRAAVPSGASTGIYEALELRDNDKTRYLGKGVGRAVKYVNEFLGPALCTQNLNVVEQEKIDKLMIEMDGTENKSKFGANALLGVSLAVCKAGAAEKGVPLYRHIADLAGNPEVILPVPAFNVINGGSHAGNKLAMQEFMILPVGADSFKEAMRIGAEVYHNLKNVIKEKYGKDATNVGDEGGFAPNILENKEALELLKTAINKAGYPDKIVIGMDVAASEFYRDGKYDLDFKSPDDPSRYISPDKLAELYMSFVKNYPVVSIEDPFDQDHWEAWTKFTAASGIQVVGDDLTVTNPKRIAKAVEEKACNCLLLKVNQIGTVTESLEACKLAQSNGWGVMVSHRSGETEDTFIADLVVGLCTGQIKTGAPCRSERLAKYNQLLRIEEELGSKARFAGKNFRKPVFN

SEQ ID NO: 4003 - DNA, 1390 bp, Homo sapiens (man)
  CDS (1)..(1305)
atggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgttgatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaacttggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctcaggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagac

SEQ ID NO: 4004 - protein, 434 aa, Homo sapiens (man) [sequence omitted]

SEQ ID NO: 4005 - DNA, 2341 bp, Mus musculus (house mouse)
  CDS (114)..(1418)
ccaccgccactcctgctctctctgcgccgccgccgtcaccaccgccactgccaccgccaccgccgccaacgccaccgactgagtctgcagtcctcgaggagatcccagccatcatgtctatagagaagatttgggcccgagagatcttggactcccgtgggaatcccaccgtggaggtggatctctatactgccaaaggtcttttccgggctgcagtccccagtggagcctccaccggcatctatgaggccctggaactaagggatggggacaaacagcgttacttaggcaaaggtgtcctgaaggcagtggaccacatcaacagcaggattgcaccagccctcatcagctcaggtatctccgtggtggagcaggagaaactggacaacctgatgttggaactggatgggactgagaataaatccaagtttggggccaatgccatcctgggtgtgtccctggccgtgtgtaaggctggggcagctgagagggacttgcccctctatcgccacattgctcagctagctgggaactccgacctcatcctgcctgtgccggcctttaatgtgatcaatggtggctctcatgctgggaacaagttggccatgcaggagttcatgatcctcccagtgggtgctgagagctttcgggatgccatgcgacttggggcagaggtgtaccacaccctcaagggggtcatcaaggacaagtatggcaaggatgccactaacgtgggggatgaaggcggctttgcccccaatatcctggagaacagcgaagccttggagctggtgaaggaagccatcgacaaggctggctacacggaaaagatggtgatcggtatggatgtggctgcctctgagttttaccgcgatggcaaatacgacttggatttcaagtctcccgctgatccttcccgatacatcactggggaccagctgggggcactctaccaggactttgtccggaactatcctgtggtctccattgaagacccatttgaccaggacgactgggcagcttggtccaagttcacagccaacgtcggcatccagatagtgggcgatgacctgacggtgaccaaccccaagcgcatcgagcgggcagtggaggagaaggcctgcaactgtttgctgctcaaggtcaatcagatcggctcggtcacagaagccatccaagcgtgcaagctggcccaggagaatggctggggggttatggtgagccatcgctctggagaaacggaggacacgttcattgctgatcttgtcgtcggactgtgtacaggccagatcaagactggcgccccatgcagatctgaacgtctggcgaagtacaaccagctcatgagaattgaggaagagctgggggacgaagctcgcttcgcgggacataatttccgaaatcccagtgtgctgtgatccccttcccccaaccccgcttgcctgaacgcgggaacatctcattctcctggagcctctttcttgctgccctgacctgccatagtcactctgataccctgagccccaagtcacccagaacacctcgactcaccgctcctgctgttcttggcttccacaaccccccttgctctctctgctcttcctcctctctgggccccatttttgggggattcagtcttcccactttcccttctattctctcttctctttaaaaaaaaattatgaagattagaagggggtccacagaagaatcctcagtgtctgacaggagcttcaggattggtgtgttggggtgtttaaagtggggtcacgggcatgagtgtttcagtgcttaccatggtgtgtataagccttgaactatgcatagaactggagtttggggagtgctggatgtgtggtcatgcttggttgaggctttagtgtatgtgtttacatacacaagcacagtttgtttgtttgcttatttatttatttatttatttatttatttatttatttatttctcagctggtcagtcagccatctcctgtaactctccagtctgaaagtgacctaacttgacaggactaggcacccctattccatgtggcttcattccaagatgacccaggatggggattttgctagcatgggaaggggaacagaaaagggccttagcaattgcttcattcggtgcactaaccgaagctcggaactttacagaatggggctgtggacctggggaggcttttctcctctaaccctctccccagccctaggctcctccgtctttctccggctgcaccagagcgctgcctcactcccctgcgccatgtcccacagttgccaccatctccgtggctttgaaatgaccaccaccattaaagtctgaatcacagcgc

SEQ ID NO: 4006 - protein, 434 aa, Mus musculus (house mouse)
MSIEKIWAREILDSRGNPTVEVDLYTAKGLFRAAVPSGASTGIYEALELRDGDKQRYLGKGVLKAVDHINSRIAPALISSGISVVEQEKLDNLMLELDGTENKSKFGANAILGVSLAVCKAGAAERDLPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKMVIGMDVAASEFYRDGKYDLDFKSPADPSRYITGDQLGALYQDFVRNYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 4007 - DNA, 1699 bp, Zea mays (maize)
  CDS (55)..(1395)
acagcgcgcgcttcaaggcctttttttttgagataacaaggaggagaggaggagatggcggtcacgatcacgtgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaatgtaaacaacattattggaccagcgattgttggaaaggaccccactgagcaggttgagattgacaacttcatggtccaacagcttgacggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttttcaatctctctagattctgacgagtggtggtctgcactcgtcgtaatgtcgtttgcctaaactgattttgatggaacaggaaatcttgctggtcttgccaaaaaaaaaaaaaaaaaaaaaaaaaaaaaaaaaaaaaa

SEQ ID NO: 4008 - protein, 446 aa, Zea mays (maize)
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 4009 - DNA, 1776 bp, Ricinus communis (castor bean)
  CDS (74)..(1411)
ctaacacgttgttgctgtcgattttttctatctcaaaacaactttcactctctccagatctaaacaaaaacctatggcgattactatcgtctccgtcagggctaggcagatcttcgacagccgtggtaatccaacggtcgaggctgatataaaattatcggatggtcacttggctagagccgccgttcctagtggtgcatccactggtatttatgaggctcttgagttaagagatggaggatcagattacttaggaaaaggtgtttctaaggctgttgagaatgttaattcaattattggccctgcattgattggcaaggacccaactgagcagactgctcttgataactttatggttcaagaattggatggaactgtaaatgagtggggttggtgcaaacaaaagctcggagcaaacgccatcttggctgtgtctctcgctctttgcaaggctggtgctcatgtcaagggtattcccctttacaagcacattgctaaccttgctggtaacaagaacttggtgttgcctgtccctgctttcaatgtcattaatggtggatcacatgctggaaataaacttgctatgcaggagttcatgattcttcctgttggagcttcttcattcaaggaggccatgaagatgggtgctgaagtataccatcacttgaagtctgtgataaaaaagaagtatggtcaggatgcaaccaatgttggtgatgaaggtggttttgctcctaacattcaggaaaacaaggaaggactggaattgctcaagactgccatcgctaaagctggttacacaggcaaagtggttattggaatggacgttgctgcttctgaattttatggttcagataaaacatatgatttgaacttcaaagaagagaacaatgatggttcgcagaagatatcaggtgaagctctcaaggacctgtacaagtcatttgcatctgagtatcccattgtatcaattgaagatccatttgaccaagatgactgggagcactactcaaagctaactagtgaaattggagagaaagtacaaattgtaggagatgatcttttagtcaccaatcctaagagggtggagaaggctattcaagagaaggcttgcaatgctcttctcctcaaggttaatcagattggatctgtaactgagagcattgaagcagtgaggatgtccaagcgagctggatggggtgtgatggccagtcaccgcagtggtgaaactgaggatactttcattgctgacttgtcagtgggtttggccacgggtcagattaagactggagcgccatgcaggtcagagcgccttgcaaaatataatcagctcctgcgtattgaggaagagcttggtgcagaagcagtttatgctggagccaaattcaggacacctgttgaaccctattagaatctgaaaggggtacttgttggaggtcagatccgagcagcggacttttacttgaaatgaataaatttgtgtgaaatgggttaaccctggaccctttttcaaataattttgacagaagttttgttatgaggttgcaatagtggtgtagggagtagtgttttttttcttctaaagtcagaatatgttccacaaaaagcttacattgagtttgctttttataatcgggaaatgaaatgttggattacattataaatctttgcgaaatggttttgacccggctggtttgttgacttcctttcaaaaaaaaaaaaaaaaaaaaaaaaaaaaaaaaaaaaaaaaaaaaaaaaaaaaaaaaaaaaaaaaaa

SEQ ID NO: 4010 - protein, 445 aa, Ricinus communis (castor bean)
MAITIVSVRARQIFDSRGNPTVEADIKLSDGHLARAAVPSGASTGIYEALELRDGGSDYLGKGVSKAVENVNSIIGPALIGKDPTEQTALDNFMVQELDGTVNEWGWCKQKLGANAILAVSLALCKAGAHVKGIPLYKHIANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNDGSQKISGEALKDLYKSFASEYPIVSIEDPFDQDDWEHYSKLTSEIGEKVQIVGDDLLVTNPKRVEKAIQEKACNALLLKVNQIGSVTESIEAVRMSKRAGWGVMASHRSGETEDTFIADLSVGLATGQIKTGAPCRSERLAKYNQLLRIEEELGAEAVYAGAKFRTPVEPY

SEQ ID NO: 4011 - DNA, 1341 bp, Plasmodium falciparum
  CDS (1)..(1341)
atggctcatgtaataactcgtattaatgcccgtgaaattttagattctagaggaaacccaactgtagaagttgacttagagaccaacttaggtattttcagagctgccgtaccatctggtgcctccactggtatttatgaagccttagaattaagagataatgacaagagcaggtacttaggaaagggtgttcaaaaagctatcaagaacattaatgaaattattgctccaaaattgattggaatgaattgtactgaacaaaagaaaattgacaatttaatggttgaagaattagatggaagtaaaaatgaatggggatggtcaaaaagtaaattaggagctaatgctattttagctatatccatggctgtatgtagagctggtgcagctcctaataaagtatctttatacaaatatttggcacaattagctggaaagaaaagtgaccaaatggtattaccagtaccttgtttaaacgttatcaatggaggatcccatgcaggaaacaaattatctttccaagaatttatgatagtgccagttggtgctccatcatttaaagaagccttaagatatggtgctgaagtatatcataccttaaaatcagaaattaaaaagaaatatggtattgatgcaaccaatgtaggtgatgaaggtggatttgctccaaatatattaaacgctaatgaagctcttgatttattagtaactgccattaaatcagctggttatgaaggaaaggttaaaattgctatggatgttgcagcttctgaattttacaacagtgaaaacaaaacatacgatttagatttcaaaactccaaataatgacaaatcattagttaagactggagctcaattagttgacttatacattgatttagtaaagaaatatccaattgtttctattgaagatccatttgatcaagatgattgggaaaattatgctaaattaacagcagctattggaaaggatgttcaaattgttggtgatgatttattagttacaaacccaaccagaattactaaagctcttgaaaaaaatgcttgcaatgctttacttcttaaagttaaccaaatcggttctattactgaagctattgaagcttgcttattatctcaaaaaaataactggggtgttatggtttctcacagatctggtgaaaccgaagatgtttttattgctgatttagttgttgctttaagaaccggacaaatcaaaacaggagcaccatgcagaagtgaaagaaacgccaaatataaccaattattaagaattgaagaatctttaggaaacaatgctgtttttgctggagaaaaatttagattacaattaaattaa

SEQ ID NO: 4012 - protein, 446 aa, Plasmodium falciparum [sequence omitted]

SEQ ID NO: 4013 - DNA, 1450 bp, Cladosporium herbarum
  CDS (19)..(1341)
gcacgagaaaccgccaacatgcctatctccaagatccactcccgctacgtctacgactcccgtggaaaccccaccgtcgaggtcgacattgtcaccgagaccggtcttcaccgcgccattgtcccctctgttgcctctaccggctcccacgaggcttgcgagctccgtgatggtgacaagagcaagtgggctggcaagggtgtgaccaaggctgttgccaacgtcaacgagatcattgctcccgctctcatcaaggagaacctcgacgtcaaggaccaggccgccgttgacgctttcctcaacaagctcgatggcaccaccaacaagaccaagattggtgccaacgccatcctcggtgtctccatggctgtggccaaggctgccgccgccgagaagcgtgtccctctctacgcccacatcagcgacctttccggcaccaagaagcccttcgttctccccgttcccttcatgaacgtcgtcaacggtggctcccacgcgggtggccgtcttgccttccaggagttcatgatcgttcccagcggggctccctccttcaccgaggccatgcgccagggtgctgaggtctaccagaagctgaagtccctcaccaagaagaggtacggccagtctgccggcaacgtcggtgacgagggtggtgtcgctcccgatattcagaccgctgaggaggctcttgacctcatcaccgacgccattgaggaggccggctacactggccagatcaagatcgccatggacgttgcctcctccgagttctacaaggccgacgagaagaagtacgaccttgacttcaagaaccccgactctgacaagagcaagtggatcacctacgagcagcttgccgaccagtacaacgagctcgctgccaagtaccccattgtctccattgaggaccccttcgctgaggatgactgggaggcctggagctacttctacaagacctctggctctgacttccagatcgtcggtgatgaccttaccgtcaccaaccccgagttcatcaagaaggccatcgagaccaaggcctgcaacgccctcctcctcaaggtcaaccagatcggtaccatcaccgaggccatcaacgccgccaaggactccttcgccgctggctggggtgtcatggtctctcaccgttccggtgagaccgaggacgtcaccatcgccgacatcgttgtcggtctccgtgccggccagatcaagaccggtgcccctgcccgttccgagcgtctcgccaagctcaaccagatcctccgtatcgaggaggagctcggtgacaagaggctctacgccggtgacaacttccgcactgccatcaacttgtaagctatctcatagcttgatggctacgagagtagtaatttctttatcatgaggatgacgagacggatgcatggctagcgtttagtcggatgaacaaaaagtattcaaatgt

SEQ ID NO: 4014 - protein, 440 aa, Cladosporium herbarum
MPISKIHSRYVYDSRGNPTVEVDIVTETGLHRAIVPSVASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYNELAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKRLYAGDNFRTAINL

SEQ ID NO: 4015 - DNA, 1314 bp, Saccharomyces cerevisiae
  CDS (1)..(1314)
atgtccatcacgaaggtacatgctagaacggtgtatgattctcgcggtaatccgactgttgaggttgaaattacaacagagaatggtctcttcagagcgatcgtcccatctggtgcctccaccggcattcacgaagctgttgaacttagagacgggaacaagtccgaatggatgggaaaaggggtgaccaaggcagtcagtaacgtcaatagtatcatagggcctgctttaatcaagtccgacttatgtgtaaccaatcagaagggcatagacgagctcatgatatcgttagacggaacttctaacaagtcaaggttgggcgccaatgctatccttggtgtttccttgtgcgttgctcgagctgctgccgcacaaaagggaattactctctacaagtatatagccgagttagcggatgctagacaggacccctttgttattcctgttccttttttcaatgttttgaatggtggagcccacgccggtggctctttagctatgcaagaattcaagatcgcgccagtcggggctcagagctttgcagaagccatgaggatgggttcggaggtttaccatcatttgaagatattggcgaaggagcaatatggaccttccgctggaaatgttggtgacgagggtggagtcgcccccgatatcgacactgccgaggacgccttggacatgattgtgaaagccattaacatatgcggttacgagggtagagtgaaagtaggaatcgatagtgctccttctgttttttataaggacgggaaatacgacctaaatttcaaggaaccgaactctgacccatctcactggctcagtccagctcagttagcagaatattatcattcattgctaaagaaatacccaatcatttccctggaagacccctacgccgaagatgattggtcctcgtggtctgccttcctaaagactgtcaatgttcagataattgcagatgacctgacatgcaccaacaagaccaggatcgcccgtgctatagaggagaaatgtgcgaatactctgttgctgaaactcaaccagatcggtactctgactgagtctattgaagccgccaatcaggctttcgatgctggatggggtgtaatgatatcacatagatcaggtgaaaccgaagatccgtttatcgctgatttggtcgttggtttaagatgtggtcaaattaaatcgggcgctttgtcgagatcagaaagactggccaagtataatgaacttttgcgtatcgaagaggaactgggggacgattgtatatatgctggtcataggtttcatgatggaaacaaactataa

SEQ ID NO: 4016 - protein, 437 aa, Saccharomyces cerevisiae [sequence omitted]

SEQ ID NO: 4017 - DNA, 1371 bp, Mycoplasma pneumoniae
  CDS (1)..(1371): transl_table=4
atgagtgcacaaactggaaccgatcttttcaagattgctgatctttttgcttaccaagtttttgattcacggggttttcccactgttgcttgtgttgtgaagttagctagtggtcatactggagaagcgatggttccatctggggcttctactggggaaaaagaagcgattgaactacgcgatggtgatcccaaagcttactttggcaaaggggtgagccaagctgtgcaaaacgttaaccaaactattgcccctaaactaattggtttaaatgcgactgatcaagcagccattgatgctttaatgatccaactggatggtacccccaataaggctaagttaggtgctaatgccattttggcagtttctctagctgtggctaaagcagctgctagcgcccaaaagacttccttgtttaagtaccttgctaaccaggtcatgggtctaaataaaaccgagtttatcctcaccgtaccaatgctaaacgtcattaacggtggagcacatgctgacaataacattgacttccaggagttcatgattatgccattgggtgctaactcgatgcaccaagcattgaagatggcgagtgaaaccttccatgctttacaaaagctgttaaagcaacggggtttaaacaccaataagggtgatgaaggtggttttgcgcctaacttaaagttagcggaagaagcgcttgatttaatggtcgaagcaattaaggcagctgggtaccaaccaggtagtgacattgcgattgcactggatgtagcagcgagtgagttttatgatgacaccaccaagcgctatgtcttcaaaaaaggaattaaggccaaaattcttgacgagaaggaatggagtttaactactgcccaaatgatcgcttacctcaagaagcttactgagcagtaccctattatttccatagaagatggtcttagcgaacacgactgggaaggtatggaaacattaactaaaacactgggtcaacacattcaaatagttggtgatgatctgtactgcaccaatccagcaattgctgaaaaaggtgttgctcacaaagctaccaactcgatcttaattaaactcaaccaaattggtacccttacagaaacaattaaagcgattaacattgccaaggacgctaactggagtcaggtaatttcccaccgtagtggggaaaccgaagacacgacaattgctgatctagcagtagcggcttgcactggtcaaattaaaactggttcgatgtcccgctccgaacgaattgccaaatacaatcgcttattgcaaattgaactggaattgggcaataatgctaagtacttaggttgaaacacctttaaaaacattaaaccgcaaaaagcttaa

SEQ ID NO: 4018 - protein, 456 aa, Mycoplasma pneumoniae [sequence omitted]

SEQ ID NO: 4019 - DNA, 1299 bp, Synechocystis sp
  CDS (1)..(1299)
atgttaagtaaagtccccgccaccattgaagaaatcgccgcccgggaaattttagactccaggggtcgccccaccatcgaagcggaagtccggctggaaagtggggcccacggcattgcccaggtgcccagtggtgcttccacaggcagttttgaagcccatgaattgcgggacggagaccccaaacgctatgacgggaaaggggtagaaaaagcagtacggaacgtgacagaaaaaattgccccggtggtggaaggcctggatgccttcgatcaaatggcggtggatcaggccatgattgaccgggatggaacggacaataaaaaagaattgggggccaatgccattttgggggtttctttagccaccgctaaggccgccgccgctgagctagccattcccctctaccgctacctgggaggccccctggctaacgtactgccggtaccgatgatgaacgtgattaacggtggggcccatgccgacaataacgtcgattttcaggaattcatgatcatgccggtgggggcagaaacctttaaagaagctctgcgctggggggcggaagttttcgctgtgttgggcaaagtgttgaaagaacgaaaactgctctccggtggggtgggggacgaagggggttatgctcccaatttgacctcgaatcaacaggccctagatattctcatcgaggcgattgaacaagctggttacaaacccggtagtcaaattgccttggccatggacattgccgccagtgaatttttcaaaaatggtcagtatgaatacgacggtggttcccattctccccaggaattcatcgactatcaggccaagctagtgagtcaatatcccattgtctccattgaagacggtttgcacgaagacgattgggaaagttggaagggtttaaccacttccctgggcaccaaaacccagttggtgggggatgacttgatggtgaccaacccggtgcgtctgcaaaaatccattgatttgggagttgccaacgccattttgatcaaactcaatcaaatcggcactttgagcgaaactttagagaccatttccctagctactcgccatagttaccgttctgttatttcccatcgctccggtgaaacggaggacaccacgatcgccgacttggccgtggccaccagggtagggcaaattaaaaccggttccctttgtcgttctgagcgggttgctaaatataaccgtttactccgcattgaagatgaacttggcgatcgggccgtttatgcccctaaaattggcctgggtcccaaacattcttaa

SEQ ID NO: 4020 - protein, 432 aa, Synechocystis sp [sequence omitted]

SEQ ID NO: 4021 - DNA, 1575 bp, Zea mays (maize)
  CDS (47)..(1387)
ccgggctgcaggaattcggcacgaggttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctcttactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaactgttacggacatgtacccaaacgtgatccagttttagttaatgtgccccatgcttgacgtttaaaaa

SEQ ID NO: 4022 - protein, 446 aa, Zea mays (maize)
MAATIQSVKARQIFDSRGNPTVEVDVFCSDGTFARAAVPSGASTGVYEALELRDGGSYYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 4023 - DNA, 1687 bp, Oryza sativa (rice)
  CDS (81)..(1421)
ccactttattagcaccaaccccgtctccttcctccattcctccgccgctagaaccttctagaagctctcctcctcctcccatggcggcgacgatcgtgtccgtcaaggcgcgccagatcttcgacagcaggggcaaccccaccgtcgaggtcgatgtgtgctgctcagatggaacctttgcaagggctgcagttcccagtggtgcatcaactggtgtctatgaagctctcgaattgagggacggtggatctgattacttgggaaagggtgtttccaaggctgtcgacaatgtgaactcggttattgccccagctctgattggcaaggaccctacgtcacaggctgagcttgataacttcatggttcagcagcttgatggaaccaaaaatgagtgggggtggtgcaagcagaagcttggtgctaatgcaatcctggctgtgtcactggccatttgcaaagctggagctatcatcaagaagattcctctgtaccagcacattgccaaccttgctggaaacaagcaactggttttgcccgtacctgcattcaacgtcattaacggtggatcacatgctggaaacaagcttgccatgcaggagttcatgatccttcctactggggccgcttcattcaaggaggccatgaagatgggtgttgaagtgtaccacaacctgaagtctgttatcaagaagaagtatggtcaggatgccaccaatgttggtgatgaaggtggttttgctcctaacattcaggaaaacaaggagggtcttgagctcttgaagactgcaattgaaaaggctggatacactggcaaggttgtcattggaatggatgttgctgcttcggaattctacaatgacaaggacaaaacctatgaccttaacttcaaggaggagaacaatgatggttcacaaaagatatctggtgatagcctgaagaatgtatacaagtcatttgtcagtgaataccccattgtctcgattgaggatccgtttgaccaggatgactgggaacactatgctaagatgaccgctgaaattggagagcaagtgcagattgtcggtgatgacctccttgtcaccaacccaacaagggtggcaaaggcaatccaggagaagtcatgcaatgctcttctgctgaaggttaaccaaattggatctgtcactgagagtattgaggccgtgaagatgtcaaagcgtgctggctggggtgtgatgaccagccacaggagtggtgagactgaggataccttcattgctgaattggctgttggtttggccacgggtcagatcaagactggagcaccctgccgatcagagcgccttgccaaatacaaccagcttcttaggattgaggaggagcttggtgcggctgctgtctacgctggtgccaagttccgcgcacccgtggagccctactaaacttgatggtgaatatcatgcggttcatgcccactgttgtgtgcatgggttttgtgaagacaggatgctcatttctatccgtaattgacttcccggtcgaactctagttaaaaagctcgtagaatcgagaaataaatcctccactgtatgagcggatatgtacccccaaacttgctccaattttggtgatgtgtagttctgagcttgcgtgttctctgaacctgttggatctttaatacagagagtatggcttttgttattatggc

SEQ ID NO: 4024 - protein, 446 aa, Oryza sativa (rice)
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIAELAVGLATGQIKTGAPCRSERLAKYNQLLRIEEELGAAAVYAGAKFRAPVEPY

SEQ ID NO: 4025 - DNA, 1628 bp, Mesembryanthemum crystallinum (common ice plant)
  CDS (31)..(1365)
gcacgagacagatctcagattacttcaaccatggttaccattaagtgcgtcaaggcccgacagatctacgacagtcgtggtaaccccactgttgaggctgatattcatcttgatgatggaacttacgctagagctgctgtccccagtggtgcatccaccggagtttacgaagcacttgagctcagggatggaggtaaagactacatgggaaagggtgtttacaaggctgttaagaacgtaaacgagattattggccctgcattggttggcaaggacccaactcagcagaccgctatcgacaacttcatggttcaacaacttgatggaaccgtgaacgagtggggttggtgcaagcaaaaattgggagcaaatgctatcttggctgtttcccttgctgtctgcaaagctggagcccaggtcaagaaaattcctttgtaccagcacatcgcggagattgctggaaacaagaatatggttttgccagtaccagccttcaacgtcatcaatggtggatctcatgctggaaacaagcttgcgatgcaggagttcatgattcttcccaccggagcttcttcattcaaagaagcaatgaagatgggcagcgaagtataccacaatttgaagagtgtgatcaagaagaagtatggtcaagacgcaaccaatgttggagatgagggtggctttgctcccaacatccaggagaacaaggagggtcttgagttgctcaagacagccattgagaaagccggatacaccggcaaagtggttatcggaatggatgttgccgcatccgagttctacaaggaagacaaatcctatgacttgaacttcaaggaagagaacaatgacggttcacagaggatctctggcgaagccctcaaggatctttacaaatcatttgtagccgagtaccccatagtgtccattgaggacccatttgaccaggatgactgggaacactatgccaagatgaccgcagaatgtggagagaaagtacagatcgttggagatgatcttttggtcaccaaccccaagagggtaaaaaaggctatcgacgagaactcctgcaatgcacttcttctcaaggttaaccaaattgggtctgtcacagagagtatcgaagctgtgaagatgtccaagaaagctggatggggtgtgatggctagccaccgcagtggtgaaaccgaggacactttcattgctgacctttcagtgggtttgtctacgggccaaatcaagaccggagctccatgcagatctgagcgtcttgccaaatacaaccagctcttgcgtattgaagaggagctcggtgacaaggctgtttacgctggagcaaacttccgccgccctgttgagccctactaaggcatagatttctcagtccgaggttctactggtttttgaggcgaagcgttttcggaacctttgtttcctgcccttcaataagagacctttttttaggagtcttgcacaataactcttttttgttgaaagttttgtgaaccagtagtactggtacgtactacccaaggccaaaggttttcgcaagtgttggatgttttgagctttagcattattaattatgattccagagaatgaatgtttttttggcttgagttactcttacc

SEQ ID NO: 4026 - protein, 444 aa, Mesembryanthemum crystallinum (common ice plant)
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENSCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 4027 - DNA, 1134 bp, Zymomonas mobilis
  CDS (1)..(1134)
atgacagctattgtcagtatccatggccgtcaggttgtcgacagccgcggtaacccgaccgttgaagttgatgttacgcttgaagatggcagcttcggccgcgccgcagtgccgtcaggtgcttctaccggcgttcatgaagctgttgaacttcgtgatggcgacaaaacccgttggggtggtaaaggcgttaccaaagctgttcacgctgtaaacaacgaaattgctaacgcaattattggtctggaagccgaagatcaggaactgatcgaccagacgatgatcaagctcgatggcaccccgaacaagggtaaattcggtgctaacgctatcctcggtgtcagcttggctgttgctaaagctgctgctgaagctcgcggtctcccgctttaccgttatgttggtggtacggcagctcacgttcttccggttccgatgatgaacatcgttaacggtggtatgcacgctgacaaccccatcgatttccaggaattcatgattgctccggttggcgccagctccatcaatgaagctgtacgcatcggtaccgaagtttcccataccctgaaaaaagaactgtctgctaaaggcatgaacaccaacgtcggtgacgaaggtggtttcgctcctagccttgacagtgcttcttctgctctggacttcatcgtcgattccatctccaaagccggttacaagccgggcgaagatgtgttcatcgctctcgatgcagcttcctccgagttctacaacaaagatcagaacatctacgatcttaagggtgaaggccgtaaactgacctccgctcagctcgttgattactatgtcgaactctgcggcaaatatccgatctattccatcgaagatctggccgaagatgacttcgaattctggaagatccttaccgaaaagctcggtgacaaagttcagttggtcggtgacgatctgttcgtgaccaacgtgaagcgtctttctgatggtatcgaacgcggtatcgccaactcgctgctcgtgaagttcaaccagatcggttctttgtctgaaacgctcgcagccgttaacatggctaacgacgcttcttacacgcctgttatgtctcaccgttccggtggaaaccgaagacaccacgattgctga

SEQ ID NO: 4028 - protein, 377 aa, Zymomonas mobilis
MTAIVSIHGRQVVDSRGNPTVEVDVTLEDGSFGRAAVPSGASTGVHEAVELRDGDKTRWGGKGVTKAVHAVNNEIANAIIGLEAEDQELIDQTMIKLDGTPNKGKFGANAILGVSLAVAKAAAEARGLPLYRYVGGTAAHVLPVPMMNIVNGGMHADNPIDFQEFMIAPVGASSINEAVRIGTEVSHTLKKELSAKGMNTNVGDEGGFAPSLDSASSALDFIVDSISKAGYKPGEDVFIALDAASSEFYNKDQNIYDLKGEGRKLTSAQLVDYYVELCGKYPIYSIEDLAEDDFEFWKILTEKLGDKVQLVGDDLFVTNVKRLSDGIERGIANSLLVKFNQIGSLSETLAAVNMANDASYTPVMSHRSGGNRRHHDC

SEQ ID NO: 4029 - DNA, 1421 bp, Schizosaccharomyces pombe
  CDS (8)..(1327)
gttaatcatggccattcagaaagtctttgctcgtcaaatctacgactctcgtggtaaccccactgtcgaggtcgacctcaccaccgagaccggtatccaccgtgctatcgtcccctctggtgcctccactggtatatgggaggctcttgagatgcgtgatggtgacaagaccaagtggggtggtaagggtgttttgaaggctgttggcaatgtcaacaacatcattgcccctgccgtcgttaaggccaaccttgacgttaccgaccaaaaggccgccgacgagttcttgcttaagctcgacggtactgagaacaagtccaagttgggtgctaacgccatcttgggtgtctccatggctatctgccgtgccggtgctgcccaaaagaagctccctctctggaagtacattgccgagaactttggcaccaagggtccctatgtcctccccgttccctctttcaacgtcttgaacggtggttcccacgctggtggtgacttggctttccaagaattcatgatcctccccaccggtgctccctctttctccgaggctatgcgttggggtgctgagacctaccacactctcaagtccattgccaagaagcgttatggttcttctgccggcaatgtcggtgatgagggtggtattgctcccgatttgcaaacccctcaagaggctcttgaccttattgttgaggccatcaacaaggctggttacgagggtaagatcaagattggtcttgatgttgcctcctccgagttctacgttgacggcaagtacgaccttgacatcaaggccgccaagcccaagcccgagaacaagcttacctaccaacaacttaccgacctttacgtcgagctctccaagaagtaccccattgtctccattgaggaccccttcgaccaagatgactggtctgcctggactcacatgaaggctgagaccgacttccaaattgtcggtgacgatttgactgttaccaacgtcaagcgtcttcgtaccgccatcgacaagaagtgcgctaacgctcttcttttgaaggtcaaccaaatcggttccgtcaccgagtctttgaacgccgtccgcatgtcctacgaggctggttggggtgttatggtttctcaccgttccggtgagaccgctgacaccttcatctcccacttgactgttggtattggtgccggtcaacttaagtctggtgctccttgccgttccgagcgtttggccaagtacaacgagcttctccgtatcgaggaggaactcggttccgagggtgtttacgctggtgcccatgctggcaagtacatcaaggctgctaagttttaaactctgagcatacattaaattttactaatgtttacaatacatgtttatttttatagaatgcaatgaaatttttatcctttttgcgttttggatt

SEQ ID NO: 4030 - protein, 439 aa, Schizosaccharomyces pombe [sequence omitted]

SEQ ID NO: 4031 - DNA, 1245 bp, Drosophila pseudoobscura
  CDS (1)..(1245): n means a or g or c or t/u, m means a or c, y means t/u or c
atggaggttgatctgaccaccgagaatggtctgttccgggccgccgttccgtctggcgcytccaccggtgtccatgaggccctggagctgcgcgacaacgacaaggccaactaccatggcaagtccgtgctgaaggctgtggctcacgtcaacgataccctcggacccgaggtgatcaaagccaatctggatgtggttgatcaggctgctgtcgacaacttcatgatcaagctggacggcaccgagaacaagagcaagttcggcgccaacgccattctgggcatttccctggccgtcgccaaggccggtgccgccaagaagaacgtgcccctgtacaaacacatcgccgatctggccggcaacaaggagatcatcctgcccgtgcccgctttcaacgtgatcaacggtggcagccatgccggcaacaagcttgccatgcaggagttcatgatcctgcccaccggcgccaccaccttcaccgaggccatgaagatgggctccgaggtgtaccatcacctgaagaacgtgatcaaggcaaagttcggtctggatgccaccgctgtcggtgatgagggtggctttgcccccaacattcagtccaacaaggaggctctcgtcctgatcaccgatgccatcgccaaggctggctacactggcaagatcgaaatcggcatggatgttgccgcctctgagttcttcaaggatggtctgtacgatctggacttcaagaaccccgcgagcgacaaggcccagtggctgtcacccgacaagmtggccaatctgtaccaggagttcatcaaggagttccccattacatccattgaggatcccttcgatcaggatcactgggatgcctggaccaacctgacctgcaacaccaagatccagattgtcggcgacgatctgactgtgaccaaccccaagcgcattgccaccgctgtcgagaagggtgcctgcaactgcctgctgctgaaggtaaaccagatcggtaccgtcaccgagtccattgccgctcatctgctggccaagaagaacggctggggcaccatggtctctcaccgttccggcgagaccgaggattcgttcaycggtgatttggttgttggtctgtccaccggccagatcaagaccggtgctccatgccgctcggagcgtctggccaagtacaaccagatcttgcgcattgaggaggagatcggctccggtgtcaagttcgccggcaagaacttcaggaagccccagtag

SEQ ID NO: 4032 - protein, 414 aa, Drosophila pseudoobscura
  Xaa in position 258 and 363 is unknown
MEVDLTTENGLFRAAVPSGASTGVHEALELRDNDKANYHGKSVLKAVAHVNDTLGPEVIKANLDVVDQAAVDNFMIKLDGTENKSKFGANAILGISLAVAKAGAAKKNVPLYKHIADLAGNKEIILPVPAFNVINGGSHAGNKLAMQEFMILPTGATTFTEAMKMGSEVYHHLKNVIKAKFGLDATAVGDEGGFAPNIQSNKEALVLITDAIAKAGYTGKIEIGMDVAASEFFKDGLYDLDFKNPASDKAQWLSPDKXANLYQEFIKEFPITSIEDPFDQDHWDAWTNLTCNTKIQIVGDDLTVTNPKRIATAVEKGACNCLLLKVNQIGTVTESIAAHLLAKKNGWGTMVSHRSGETEDSFXGDLVVGLSTGQIKTGAPCRSERLAKYNQILRIEEEIGSGVKFAGKNFRKPQ

SEQ ID NO: 4033 - DNA, 1450 bp, Pneumocystis carinii f
  CDS (42)..(1343)
gagctcgatattaaaaaaaaatactgttattaaaaaaaattatgggaatttttaaaattcacgcaagatcattttatgattcacgaggtaatcctaccgtagaagtagaagtgactacagaaacaggggttcatcgagcaaatgtaccttcaggtgcttcaacaggaattcatgaagctttggaattacgtgataatggttcttcttggtctggaaaaggagttactcttgcagtttccaacgttaatgatatcattgccccctctcttttatctgcaggcattgatattaaggatcaacgttctatagataaatttcttattgatcttgatggtacttctaataaatcaagacttggagctaatgctattcttggtgtttctattgctatttgtaaggctgctgctgctgaaaagggtgttcctctttatcgacattttgctgatattgctgatattaaagagccatttattcttcctcttccatgttttaatgtacttaatgggggatcacatgccggtggaaggttagcttttcaagagtttatgattcttcctactagtgctgttacatttcatgaagctatgcagcaaggctctgaggtttattctgctttaaaaaagctttctagaaagagatatgggcattccgctggaaatgccggcgatgagggcggcgttgctccagatattcaaacagctgatgaagctcttgatcttattgttactgctattgaagaagctggttatactggaaaaataaaaattgcattagatgttgctgctagtgaattttataagaatggcaaatatgatttagattttaaaaatcctgaaagtgattcttctcaacataaaacttctaaagaacttgctgatatctatttagatctttctaaaaaatatcctatagtttctattgaaaatcctgttgatcgggatgattgggatgcttggatttatgtatctagacgtgcgacgtttcaaatggtcggtgatgatttgactgttacaaatgtttctcgaataaacgaagctgctgataaaaaggcttgtaattgtttgcttttgaaaattaatcagataggaaccatttctgaaagtatcgatgcttttaaaacagcttttgatgctggctggggagttatggtttcccatcgtagcggcgaaactgaagatacagtcattgctgatcttgttgttggtcttggtactggtcaaattaagactggtgctccgtgccgttcagagcgtgtagcaaaatataatcagcttttaaggattgaagaagaacttaaccattctgtttatgcttcaatgaattacattaaaaatattaaataatatatttattatttcctgtgattttgatatgtttttgttaaatcaaatggcttaaatataataaaaaatatttttttattttttgtttaaaaaaaaaaaaaaaaagc

SEQ ID NO: 4034 - protein, 433 aa, Pneumocystis carinii f
MGIFKIHARSFYDSRGNPTVEVEVTTETGVHRANVPSGASTGIHEALELRDNGSSWSGKGVTLAVSNVNDIIAPSLLSAGIDIKDQRSIDKFLIDLDGTSNKSRLGANAILGVSIAICKAAAAEKGVPLYRHFADIADIKEPFILPLPCFNVLNGGSHAGGRLAFQEFMILPTSAVTFHEAMQQGSEVYSALKKLSRKRYGHSAGNAGDEGGVAPDIQTADEALDLIVTAIEEAGYTGKIKIALDVAASEFYKNGKYDLDFKNPESDSSQHKTSKELADIYLDLSKKYPIVSIENPVDRDDWDAWIYVSRRATFQMVGDDLTVTNVSRINEAADKKACNCLLLKINQIGTISESIDAFKTAFDAGWGVMVSHRSGETEDTVIADLVVGLGTGQIKTGAPCRSERVAKYNQLLRIEEELNHSVYASMNYIKNIK

SEQ ID NO: 4035 - DNA, 1320 bp, Debaryomyces hansenii
  CDS (1)..(1320)
atggccgtcactaagttatttgctcgttatgtctacgattctcgtggtaacccaactgttgaagttgatttaaccaccgacaagggattattcagatccattgttccatctggtgcttccactggtatccatgaagctttggaattgagagatggtgacaagtccaaatggttaggtaagggtgttaccaaggctgttgccaatgttaacgaactcattgctccagctttcgtcaaggccaacctcgacgtcaccaaccaaagtgccgttgatgacttcttgaacaagttggacggtaccccaaacaagtctaagttaggtgccaatgccatcttaggtgtttctttagccactgctaaggctgctgctgctgaaaagaacgttccattataccagcacttagctgatatttctggttccaagcaagacaagtttgtcttaccagttccattccaaaacgtcttgaacggtggttcccatgctggtggtgctttagctttccaagaattcatgattgtcccaactgacgctccaaccttctctgaagctttgagaatgggttctgaagtctaccacaacttgaagtccttgaccaagaagaagtacggtcaatccgctggtaacgtcggtgatgaaggtggtgttgctccagatatcggttctccaagagaagctttagacttgatcatggatgctattgacaaggctggttacaagggtaagatcggtattgccttagatgttgccgcttctgaattctacaaagacggtaagtacgatttagacttcaagaatccaaactctgacgaatctaagtggttatctggtgaacaattagcttccttatacgaagaattgatcaacgaatacccaattgtttctattgaagatcctttcggtgaagatgactgggatgcttgggttcacttctactccaaggtttcttccaaggtccaaatcgttggtgatgacttaactgtcactaacccattaagaatcaagaccgccattgaaaagaaggccgccaacgctttgttattaaaggtcaaccaaattggttctttaactgaatccatcaaggctgctcaagactcctttgatgctacctggggtgttatggtttcccacagatctggtgaaaccgaagataccttcattgctgatttatctgttggtttaagagctggtcaaattaagactggtgccccagccagatctgaaagattagccaagttaaaccaaatcttaagaatcgaagaagaattaggtgacaaggctatctacgctggtaagaacttccacgctgcttctcaattataa

SEQ ID NO: 4036 - protein, 439 aa, Debaryomyces hansenii
MAVTKLFARYVYDSRGNPTVEVDLTTDKGLFRSIVPSGASTGIHEALELRDGDKSKWLGKGVTKAVANVNELIAPAFVKANLDVTNQSAVDDFLNKLDGTPNKSKLGANAILGVSLATAKAAAAEKNVPLYQHLADISGSKQDKFVLPVPFQNVLNGGSHAGGALAFQEFMIVPTDAPTFSEALRMGSEVYHNLKSLTKKKYGQSAGNVGDEGGVAPDIGSPREALDLIMDAIDKAGYKGKIGIALDVAASEFYKDGKYDLDFKNPNSDESKWLSGEQLASLYEELINEYPIVSIEDPFGEDDWDAWVHFYSKVSSKVQIVGDDLTVTNPLRIKTAIEKKAANALLLKVNQIGSLTESIKAAQDSFDATWGVMVSHRSGETEDTFIADLSVGLRAGQIKTGAPARSERLAKLNQILRIEEELGDKAIYAGKNFHAASQL

SEQ ID NO: 4037 - DNA, 1320 bp, Debaryomyces hansenii
  CDS (1)..(1320)
atgactatttctaaagttcattcacgttatgtatacgattcccgtggtaatccaactgtagaggttgatgttacaaccgaaaatggcttatttagagcaattgtaccttcaggagcatctactggtatcaatgaagctatggaattaagagatggtgataaatctaaatggcaaggaaaaggtgtaactaaggctgttgataatgtcaacaaaacaattgctccacatttgataaagtcaggtcttgatgaaaagaatcaagaagaaatcgattctttcttgttgaaattggatggcaccccaaataagaggagcttgggtgcaaacgccatacttggagtctctttggctgttgctaaagctggtgctgcagcaaaacaagtcccactatatagacatattgctgatataagcaaatcgaagcaagacaaatatgttttgccagttccattccagaacgttttaaacggtggttctcatgctggcggttcgttagcgttccaagaatttatgatagctccaacaaacgcgccaagtttttccgaggctttgagaattggttccgaagtctatcaccatttaaagtctttaaccaagagtaagtacggacaatctgctggcaatgttggagatgaaggtggtgtagcaccagatattgaaactcctgaagaagcactcgatttgattgttgcttctattgaaaaggctggctacaagggtaaggtatccattgccttagacgtagcatcatccgaattttacaaggatggtaaatatgacttagatttcaaaaatccaaattctgataaatctaaatggttatcgggagaccagttggccgatttatatgaaagcttaattgataattatccaattatatcaattgaagacccattttcagaagaagattgggatgcatggtctaatttttaccctaaggtggcctctaagttacagattgttggtgatgacttaactgtaactaacccaatcttcattaaaaaggctatagagaaaaaggctgcaaacgcgttattgttgaaagtgaatcaaattggtacacttactgagtcaattaaggcagcccaacttgcgttcagcgataaatggggagttatggtttctcacagatctggtgaaacagaagatcatattattgctgatattgtagttggtttaagaactggccaaattaagacgggtgctccttccagatccgaaagattagccaaattaaaccaaattctaagaattgaacaggaattgggagatgatgctgtatattctggtaagggtttccataccgctcagaatttgtaa

SEQ ID NO: 4038 - protein, 439 aa, Debaryomyces hansenii
MTISKVHSRYVYDSRGNPTVEVDVTTENGLFRAIVPSGASTGINEAMELRDGDKSKWQGKGVTKAVDNVNKTIAPHLIKSGLDEKNQEEIDSFLLKLDGTPNKRSLGANAILGVSLAVAKAGAAAKQVPLYRHIADISKSKQDKYVLPVPFQNVLNGGSHAGGSLAFQEFMIAPTNAPSFSEALRIGSEVYHHLKSLTKSKYGQSAGNVGDEGGVAPDIETPEEALDLIVASIEKAGYKGKVSIALDVASSEFYKDGKYDLDFKNPNSDKSKWLSGDQLADLYESLIDNYPIISIEDPFSEEDWDAWSNFYPKVASKLQIVGDDLTVTNPIFIKKAIEKKAANALLLKVNQIGTLTESIKAAQLAFSDKWGVMVSHRSGETEDHIIADIVVGLRTGQIKTGAPSRSERLAKLNQILRIEQELGDDAVYSGKGFHTAQNL

SEQ ID NO: 4039 - DNA, 1296 bp, Erwinia carotovora subsp
  CDS (1)..(1296)
atgtccaaaattgttaaagtcatcggccgtgaaatcatcgactcacgcggaaacccaactgttgaagctgaagttcatctggaaggtggttttgtaggtctggctgctgcgccatcaggagcttctactggctctcgcgaagcgctggaactgcgtgacggtgacaaatcccgttttctgggcaaaggcgtaacgaaagccgttgctgctgttaacggcccgattgctcaggctgtactgggtaaagacgcgaaagatcaggcgaacatcgacaagatcatgatcgacctggatggtactgaaaacaaatctcagttcggtgctaacgccattctggccgtttctctggcagccgctaaagcagcagctgcgtcaaaaggcctgccgctgtacgctcacatcgctgagctgaacggcaccccaggtaaatattctatgccactgccaatgatgaacatcatcaacggcggcgagcacgcggataacaacgttgatatccaagaattcatgattcagcctgttggtgcgaaaaccctgaaagaagccatccgtatgggttctgaagtgttccacactctggcaaaagttctgaaatcaaaaggtatggggactgctgttggtgacgaaggtggctatgcgccaaacctgggttccaacgccgaagcgctggccgttatcgcagaagcggtaaaagcagcaggctacgagctgggcaaagacatcactctggcgatggactgtgcagcatctgaattctacaaagacggtaaatacgttctggctggcgaaggcaacaaatcgttcacctctgaagaattcacccacttcctggaagatctgaccaaacagtacccgatcgtgtctatcgaagacggtctggacgaatctgattgggctggcttcgcttaccagactaaagttctgggcgacaaaatccagctggttggtgacgatctgttcgtaaccaacaccaagatcctgaaagaaggcatcgataaaggcatcgctaactctatcctgatcaaattcaaccagatcggttctctgaccgaaacactggctgcgattaaaatggcgaaagatgcaggctacaccgctgttatctctcaccgttcaggcgaaactgaagatgcaaccatcgctgacctcgcagtaggtacagctgcgggccagatcaaaaccggttctatgagccgttctgaccgtgttgctaaatacaaccagctgattcgtattgaagaagcgctgggtgactctgcgccgttcaacggcctgaaagaagttaaaggccaataa

SEQ ID NO: 4040 - protein, 431 aa, Erwinia carotovora subsp
MSKIVKVIGREIIDSRGNPTVEAEVHLEGGFVGLAAAPSGASTGSREALELRDGDKSRFLGKGVTKAVAAVNGPIAQAVLGKDAKDQANIDKIMIDLDGTENKSQFGANAILAVSLAAAKAAAASKGLPLYAHIAELNGTPGKYSMPLPMMNIINGGEHADNNVDIQEFMIQPVGAKTLKEAIRMGSEVFHTLAKVLKSKGMGTAVGDEGGYAPNLGSNAEALAVIAEAVKAAGYELGKDITLAMDCAASEFYKDGKYVLAGEGNKSFTSEEFTHFLEDLTKQYPIVSIEDGLDESDWAGFAYQTKVLGDKIQLVGDDLFVTNTKILKEGIDKGIANSILIKFNQIGSLTETLAAIKMAKDAGYTAVISHRSGETEDATIADLAVGTAAGQIKTGSMSRSDRVAKYNQLIRIEEALGDSAPFNGLKEVKGQ

SEQ ID NO: 4041 - DNA, 1362 bp, Mesoplasma florum L1
  CDS (1)..(1362): transl_table=4
atgtcaagaattgagaaaattattgcacgtgaagtattagactcacgtggaactccaactgttgaagttgaattatgaactgaatttggtggttatggaattgctaaagcaccatcaggagcatcaactggagaaaacgaagctttagaactaagagatggagacaaagcacgttacaacggtaaaggtgttttaaaagcagttgctaatgtaaacgataaaatcgcaccagctttaattggacacgatgttcaagaccaattaggtttagacagagtaatgattaaattagatggaactgaatttaagaaaaaattaggagcaaacggtatgttagctgtttcattagctgcagctcacgcagcagcaagtgaattagaagttcctttatacagatacattggtggagttcaagcaaaacgtttacctgttccaatgttaaatgttattaatggtggagaacatgctgattcagcaatcgatttccaagaattcatgattatgccagttggagcaccaacatttaaagaagcattaagatgatcatcagaaactttccaagcattaaaatcattattacatgataaaggtgatattactgctgttggagacgaaggtggatttgcacctcatttctcatgagcatatgctaaacaagacttagcttcatttaaagctaaaacacctgctgaaattgcattagacttattagttgaagctattacaaaagctggttacaaagttggtaaagatggaatcatgatcgcaatggactgtgcttcatcagaattatactttgaagacaaaaaataccacttcaaaaaaattgaaaaagttactggtcaagaatgagcattcactacagaagaaatgattgcttacttagaaaaattagtaaacaactacccaattatttcaatcgaagatggattaagtgaaaaagactgagatggatttgttcaattaactgaaaaaattggagacagagttcaaatcgttggagatgacttatttacaacaaacccaagatttattaaagaaggaatcagcaaagatgctgctaactcaactttaattaaattaaaccaaattggaactttatcagaaactgttgaagctattactatgactcaaaaagctggttgaactgcagttgtttcacaccgttcaggagaaacagaagacgcaacaatcgctgacttagctgtagcatttaatgcaggtcaaatcaaaacaggatcaatgtcacgttcagatagaattgcaaaatacaacagattattacaaatcgaagaccaattaggtgaagatgcaatttatgatggatatgcaacattctataacttaaaaattaataaataa

SEQ ID NO: 4042 - protein, 453 aa, Mesoplasma florum L1
MSRIEKIIAREVLDSRGTPTVEVELWTEFGGYGIAKAPSGASTGENEALELRDGDKARYNGKGVLKAVANVNDKIAPALIGHDVQDQLGLDRVMIKLDGTEFKKKLGANGMLAVSLAAAHAAASELEVPLYRYIGGVQAKRLPVPMLNVINGGEHADSAIDFQEFMIMPVGAPTFKEALRWSSETFQALKSLLHDKGDITAVGDEGGFAPHFSWAYAKQDLASFKAKTPAEIALDLLVEAITKAGYKVGKDGIMIAMDCASSELYFEDKKYHFKKIEKVTGQEWAFTTEEMIAYLEKLVNNYPIISIEDGLSEKDWDGFVQLTEKIGDRVQIVGDDLFTTNPRFIKEGISKDAANSTLIKLNQIGTLSETVEAITMTQKAGWTAVVSHRSGETEDATIADLAVAFNAGQIKTGSMSRSDRIAKYNRLLQIEDQLGEDAIYDGYATFYNLKINK

SEQ ID NO: 4043 - DNA, 1296 bp, Acinetobacter sp
  CDS (1)..(1296)
atgttcatgagccaaatcgttgacattcgtgcacgtgaaattttggactctcgtggtaacccgaccatcgaagcagacgtaatcttagcatctggcgtagttggccgtgcatgtgcaccatctggtgcttcaactggttctcgtgaagcgttagaacttcgtgatggcgacaaagcacgctatttgggtaaaggtgttaaaactgcggttaacaatgtcaacaccattatccgcgatgctttagtgggcaaatcagtatttgaacaaaaagacatcgataatacgatgattgagcttgatggtactgaaaataaagaaaaattaggcgcaaatgcaactttagcggtatcgctagctgctgcacgcgctgctgccgatgaaaagaaaattcctcttttccaatacatcgcagacttacgtggtcaaaccattttgacgatgcctgtacctatgatgaacatcatcaatggtggttcgcatgcagataataacgttgatattcaagaatttatgattgagcctgttggcttcacttcattctctgaagcattgcgtgcaggtgctgaaatcttccattctctaaaatcagttttaaacaaaaaaggtttaaacactgctgtaggtgatgaaggtggttttgcgccaaacttgcgttctaacgaagaggcaatcactgttattcttgaagcgattggtcaaactggctataaggcgggttctgacatcatgcttgcacttgactgtgcatcttcagaattctacaaaaatggtcagtacatcttggcaggtgaaggcaataaagcattcacaagcaatcagttctctgactatttagcgggtcttgtaaaccagtatccaattatctcaattgaagatggtttagatgagtctgattgggaaggttggtcttacttgacatctattttaggtgacaaaatccagttggtgggtgatgacttgttcgttaccaacccgaaaatccttcaacgtggtatcaatgagaaagtaggtaactctatcttaatcaagtacaatcaaattggtaccttgactgaaacgcttgatgcaatctatcttgctaaagacaatggttactctacagtgatttcacaccgttcaggtgaaactgaagattcaaccatcgccgatcttgctgtgggtactgctgcaggtcaaatcaaaacaggttcactttgccgttctgatcgtgtagcaaaatataaccaattacttcgtattgaagaattgactaaagcagcttatcgcggtaaagctgaattcaaaggcttaaattaa

SEQ ID NO: 4044 - protein, 431 aa, Acinetobacter sp
MFMSQIVDIRAREILDSRGNPTIEADVILASGVVGRACAPSGASTGSREALELRDGDKARYLGKGVKTAVNNVNTIIRDALVGKSVFEQKDIDNTMIELDGTENKEKLGANATLAVSLAAARAAADEKKIPLFQYIADLRGQTILTMPVPMMNIINGGSHADNNVDIQEFMIEPVGFTSFSEALRAGAEIFHSLKSVLNKKGLNTAVGDEGGFAPNLRSNEEAITVILEAIGQTGYKAGSDIMLALDCASSEFYKNGQYILAGEGNKAFTSNQFSDYLAGLVNQYPIISIEDGLDESDWEGWSYLTSILGDKIQLVGDDLFVTNPKILQRGINEKVGNSILIKYNQIGTLTETLDAIYLAKDNGYSTVISHRSGETEDSTIADLAVGTAAGQIKTGSLCRSDRVAKYNQLLRIEELTKAAYRGKAEFKGLN

SEQ ID NO: 4045 - DNA, 1314 bp, Candida glabrata
  CDS (1)..(1314)
atggctgtctctaaggtttacgctagatccgtctacgactcccgtggtaacccaactgtcgaagttgaattgaccaccgaaaagggtgtcttcagatccattgtcccatctggtgcttctactggtatccacgaagctttggaaatgagagatggtgacaagtccaagtggttgggtaagggtgtcgaaaacgctgtcaagaacgttaacgacgtcattgctccagctttcgtcaaggctaacgttgacatcaaggaccaaaaggccgtcgatgacttgttgttgtctctagatggtactgctaacaagtccaagctaggtgctaacgctatcttgggtgtctccatggccgctgccagagccgctgctgctgaaaagaacgtcccattgtaccaacacttggctgacttgtctgactccaagacctctccattcgtcttgccagttccattcttgaacgtcttgaacggtggttcccacgctggtggtgctttggctttgcaagaattcatgatcgccccaaccggtgctaagtctttccgtgaagctatgagaattggttccgaagtctaccacaacttgaagtctttgaccaagaagagatacggttcctccgccggtaacgtcggtgacgaaggtggtgtcgctccagacattcaaaccgctgaagaagctttggacttgatcgttgacgctatcaaggccgctggtcacgaaggtaaggtcaagatcggtttggactgtgcctcctccgaattcttcaaggacggtaagtacgacttggacttcaagaaccctaactctgacgcttccaagtggttgtccggtccacaattggctgacttgtaccactccttggtcaagaagtacccaattgtctccatcgaagatccattcgctgaagatgactgggaagcttggtcccacttcttcaagaccgctggtgttcaaattgttgctgatgacttgactgtcaccaacccaaagagaattgccaccgctattgaaaagaaggccgctgacgctttgttgttgaaggttaaccaaatcggttctctatccgaatccatcaaggctgctcaagactctttcgctgccggctggggtgtcatggtttcccacagatctggtgaaactgaagacactttcattgctgacttggtcgtcggtttgagaactggtcaaatcaagaccggtgctccagctagatccgaaagattggctaagttgaaccaattgttgagaattgaagaagaattgggtgacaaggctgtctacgctggtgacaacttccaccacggtttcaagttgtaa

SEQ ID NO: 4046 - protein, 437 aa, Candida glabrata
MAVSKVYARSVYDSRGNPTVEVELTTEKGVFRSIVPSGASTGIHEALEMRDGDKSKWLGKGVENAVKNVNDVIAPAFVKANVDIKDQKAVDDLLLSLDGTANKSKLGANAILGVSMAAARAAAAEKNVPLYQHLADLSDSKTSPFVLPVPFLNVLNGGSHAGGALALQEFMIAPTGAKSFREAMRIGSEVYHNLKSLTKKRYGSSAGNVGDEGGVAPDIQTAEEALDLIVDAIKAAGHEGKVKIGLDCASSEFFKDGKYDLDFKNPNSDASKWLSGPQLADLYHSLVKKYPIVSIEDPFAEDDWEAWSHFFKTAGVQIVADDLTVTNPKRIATAIEKKAADALLLKVNQIGSLSESIKAAQDSFAAGWGVMVSHRSGETEDTFIADLVVGLRTGQIKTGAPARSERLAKLNQLLRIEEELGDKAVYAGDNFHHGFKL

SEQ ID NO: 4047 - DNA, 1317 bp, Candida glabrata
  CDS (1)..(1317)
atgtcagtcactaaagtccacgccagaacagtctatgactccagaggtaaccctacagttgaagtagaggtctacaccaaggacggtatgttcagggctattgtcccatccggtgcctcaacgggttctcatgaagccctcgagcttcgtgacggtgacaagtccaagtgggaaggtaaaggtgtcaccaaggctgtctccaatgtcaacgatatcattggaccaaagctgattgaatccaagctggatgtcaaggaccaaaaagccatcgatgagttcatgatcaagcttgacggtacaaagaacaagagtaagttgggtgccaacgcaatcttgggtgtttctttggctgtcgctagggccggtgccgctgccaaaggggtgccactgtaccaacacatcgctgagttggcggacatgaagaaagaaccatacgtcattccttgtcctttcttcaacgtcttgaacggtggtgtccatgctggtggtaacctggctttgcaagaatttttaattgctcctgttggcgctgagtccttccatgaggctttgagactaggttccgaagtctaccacaagttgaaggccttggctaagaagagaatcggctcttctgctggcaatgtcggtgatgagggtggtatcgccccatctctatctactccattcgaagctttggatttgatctacgacgctatcaaagaagctggtcacgaaggtaaggtgaagattgccatggaccccgcttcttcggaatttttccaaggtgacaagtatgacttggactttaagaacccacatccagatgctaagaacaagttgtcaggtgctcaactcggtgactactacaagaccattttggaaaaatatccaattgtgtctttggaagatccatttgctgaagacgactgggaggcttggactaacttcttccctaaggcaggtgttcaaatcatcgctgatgacttaactgtcaccaaccctgaaagaatccaaactgccattgacaagaagactgctgactgtttgttgttgaaggttaaccaaattggttctttgacagaatcaattaactctgctaagctggcttacggtgccggctggggtgtccaggtttcccatagatctggtgaaactgaagacactttcattgctgatcttgttgttggtttgagaactggtcaaattaaatctggttctctggctagatcagaaagattggcaaagtggaaccaaattttgagaattgaagaggaattgggtgcttcaaacacaatttttgcaggtgccaaattccataagggacaattgttgtaa

SEQ ID NO: 4048 - protein, 438 aa, Candida glabrata
MSVTKVHARTVYDSRGNPTVEVEVYTKDGMFRAIVPSGASTGSHEALELRDGDKSKWEGKGVTKAVSNVNDIIGPKLIESKLDVKDQKAIDEFMIKLDGTKNKSKLGANAILGVSLAVARAGAAAKGVPLYQHIAELADMKKEPYVIPCPFFNVLNGGVHAGGNLALQEFLIAPVGAESFHEALRLGSEVYHKLKALAKKRIGSSAGNVGDEGGIAPSLSTPFEALDLIYDAIKEAGHEGKVKIAMDPASSEFFQGDKYDLDFKNPHPDAKNKLSGAQLGDYYKTILEKYPIVSLEDPFAEDDWEAWTNFFPKAGVQIIADDLTVTNPERIQTAIDKKTADCLLLKVNQIGSLTESINSAKLAYGAGWGVQVSHRSGETEDTFIADLVVGLRTGQIKSGSLARSERLAKWNQILRIEEELGASNTIFAGAKFHKGQLL

SEQ ID NO: 4049 - DNA, 1269 bp, Bartonella quintana
  CDS (1)..(1269)
atgactataattgtcgatatcattgggcgtgaaatacttgatagccgagggaatccaacagtagaagttgatgttcatttggaaaatgggattgtaggtcgtgcttttgttccttcaggcgcatctaaaggggcccatgaagctgtagaacttcgtgatggtgggatacgttatcaaggtaaaggtgttgaaagagcggttgctgcagtaaatggtgaaattcttgaggaacttgttgggcgagatgcaagaaatcaaatcgctattgatcaagcaatgattgctttggatggaacaccaaataaagcgcgtcttggtgcgaatgctattctcggcgtttcattggctgttgcgaaagcagcagcagaatcattgtgtttacctttatatcgttatattggtggtacacaagcgcatgttcttccaactcccatgatgaatattattaatggtggtgtccatgctgataactcgattgattttcaagaatttatgattattcccgtaggtgcatctacgctgaaagaagcagttcgctacggtgctgaaatttttcatatgttaaaaaagcgcttaaaagatgcgggtcataataccaatgttggtgatgaaggtggttttgccccccagtttaaaagtgctgagcaggcaattgattttattatggaatctataataacctgtggttataaaccaggggaacagattgcacttggtttagattgtgcttcaaccgaattttataaaaatggttcgtatttttataaaggtgaagggaaatgtcgtaatacccaagaacaggtcgattatttggcgcaacttgttaaaacttatcctattattacgattgaagatgggatggctgaggacgattgggaaggttggaagttactcactgactcgattggtaaacaatgtcagcttgttggcgatgatttatttgtaacaaattcagcgcgtttgcgcgatggtatcaaaatgggtgcggccaattctattcttatcaaaatgaaccagattggcacgttgagtgagacacttgatgctgtagagacagcgcatagagcaagctatcgtgctattatatcgcatcgctcgggcgaaacggaggattcttttattgcggatcttgctgttgcaaccaattgtggacaaattaaaactggttcgcttgcccgttcggatagattagcaaaatataatcagctcattcgcattgaagaaatgctaggggcacaggcatgttatgctggtaattggcattgttga

SEQ ID NO: 4050 - protein, 422 aa, Bartonella quintana
MTIIVDIIGREILDSRGNPTVEVDVHLENGIVGRAFVPSGASKGAHEAVELRDGGIRYQGKGVERAVAAVNGEILEELVGRDARNQIAIDQAMIALDGTPNKARLGANAILGVSLAVAKAAAESLCLPLYRYIGGTQAHVLPTPMMNIINGGVHADNSIDFQEFMIIPVGASTLKEAVRYGAEIFHMLKKRLKDAGHNTNVGDEGGFAPQFKSAEQAIDFIMESIITCGYKPGEQIALGLDCASTEFYKNGSYFYKGEGKCRNTQEQVDYLAQLVKTYPIITIEDGMAEDDWEGWKLLTDSIGKQCQLVGDDLFVTNSARLRDGIKMGAANSILIKMNQIGTLSETLDAVETAHRASYRAIISHRSGETEDSFIADLAVATNCGQIKTGSLARSDRLAKYNQLIRIEEMLGAQACYAGNWHC

SEQ ID NO: 4051 - DNA, 1296 bp, Bacillus thuringiensis serovar konkukian str
  CDS (1)..(1296)
atgtcaacaattattgatgtttatgctcgcgaagtccttgactctcgtggtaacccaactgtagaagtagaagtttacacagaaagcggcgctttcggacgcgctatcgtaccaagtggtgcatctactggtgagcacgaagcagtagaattacgtgacggtgacaaatctcgttaccttggtaaaggtgttatgaacgcagtaaacaacgttaatgaagcaatcgctccagaaatcgttggtttcgacgtaactgaccaagctggtatcgaccgtgctatgatcgaattagatggcactccaaacaaaggtaaactaggcgctaacgctatccttggtgtatctatggcagtagctcacgcagcagctgacttcgtaggtcttccattataccgttaccttggtggattcaatgcaaaacaattaccaactccaatgatgaacatcatcaacggtggttctcacgctgataacaacgttgacttccaagagttcatgatcttaccagttggtgctccaacattcaaagaatcaatccgtatgggtgctgaagtattccatgcacttaaagctgtattacatgacaaaggtcttaacactgcagtaggtgacgaaggtggattcgctccaaaccttggttctaaccgtgaagcattagaagtaatcatcgaagctatcgaaaaagctggttacaaagctggcgagaacgtattcttaggaatggacgttgcttcttctgagttctacaacaaagaaactggtaaatatgaccttgcaggtgaaggccgtactggcttaacttctgcagaaatggttgatttctacgaagagctttgcaaagacttcccaatcatctctatcgaagatggtttagacgaaaacgactgggatggtcacaaattattaactgagcgtatcggtgataaagtacaattagttggtgacgatttattcgtaactaacactcaaaaacttgctgaaggtatcgaaaaaggtatctctaactcaatcttaattaaagttaaccaaatcggtactttaactgagactttcgaagctatcgaaatggctaaacgtgctggttacacagcagttgtatctcaccgttctggtgaaactgaagatgctacaattgctgacatcgcagttgcaactaacgctggccaaatcaaaactggttctatgagccgtactgaccgtattgctaagtacaaccaattattacgcatcgaagacgaactaggcgaaatcgctgtttacgatggtatcaaatctttttataacatcaaacgataa

SEQ ID NO: 4052 - protein, 431 aa, Bacillus thuringiensis serovar konkukian str
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 4053 - DNA, 1368 bp, Mycoplasma mobile
  CDS (1)..(1368): trans_table 4
atgtcagcaattatgagaattcacgcaagagaagttttagattctcgtggaaatccaacaattcaaattgaagttgaatcagaatatggttatgggagtgcaatggtcccttctggagcttcaacgggtgaaaaagaagctaaagaattaagagataaaggtacaaagtatgagaaaaattgatatggtggaaaaggtgttcaaaccgctgttgataatgtaaataatattattgcaccaaaaatcgaaggttatgatgttcttgatcaaagagcaattgattatgaaatgattaaattagacggaacagaattcaaggaaaaattaggagcaaatgcaatactaggagtatctttagcggttgctaaagcagcagcagatgaattaaacattcctttatatcgttatgttggtggaacaaatggctttaagttacctgttccaatgcttaatgtgattaatggtggagaacatgcttcaaacactgttgattttcaagagtttttaattatgccaattggagcaaaaacttttaaagaagcaatgcaagttgcaaacaaagtatttcacaatttaaaagatttattagcttcacaaggtcattcaacagctgtgggagacgaaggtggatttgcacctgatttaaaatctcatgaagaagttttagattttattgtttcagcgattaaaaaagctggatatgaaccaagtaaaaaaggagacaaggctgttgctattgcaattgatgcagcatcaagtgaattatttgataaaaaatcaaaaacatacactttcaaaaaacttaaaaaagctattttaactaaacaaccaggatttgaaaatttaggaaaagttaaagttgaatattcatcagatgaacttgttgagtactttaaagatttgtttaaaaagtatccaatcatttctttagaagatggtttttcagaacatgattgagatgcttttacaaaattaaataattctgttggcgcaacacatcaaattatgggtgatgacttagtaacaactaatccaaaattcattaaaaaagcaattgaaactaaggcaataaattctgttttaattaaattaaaccaaatcggaactctttcagaaacaatggatgcaatcgaaatggctcataaagctggtatgacttgtgtggtttctcaccgttcaggagagactgaagatactacaattgctgatttagcagttgctttaaatacaggacaaattaaaactggttcaatttcaagaacagatagagttgcaaagtacaatagattattagtaattgaagaagaattaggcatagttgcttcttatgaaggaatccaagtttttcacaacttaaaagttaaataa

SEQ ID NO: 4054 - protein, 455 aa, Mycoplasma mobile
MSAIMRIHAREVLDSRGNPTIQIEVESEYGYGSAMVPSGASTGEKEAKELRDKGTKYEKNWYGGKGVQTAVDNVNNIIAPKIEGYDVLDQRAIDYEMIKLDGTEFKEKLGANAILGVSLAVAKAAADELNIPLYRYVGGTNGFKLPVPMLNVINGGEHASNTVDFQEFLIMPIGAKTFKEAMQVANKVFHNLKDLLASQGHSTAVGDEGGFAPDLKSHEEVLDFIVSAIKKAGYEPSKKGDKAVAIAIDAASSELFDKKSKTYTFKKLKKAILTKQPGFENLGKVKVEYSSDELVEYFKDLFKKYPIISLEDGFSEHDWDAFTKLNNSVGATHQIMGDDLVTTNPKFIKKAIETKAINSVLIKLNQIGTLSETMDAIEMAHKAGMTCVVSHRSGETEDTTIADLAVALNTGQIKTGSISRTDRVAKYNRLLVIEEELGIVASYEGIQVFHNLKVK

SEQ ID NO: 4055 - DNA, 1302 bp, Photobacterium profundum
  CDS (1)..(1302)
atgtctaagatcgttaaagttctaggtcgtgaaatcatcgattcacgtggtaacccaacagtagaagctgaagttcacctagaaggcggtttcgtaggtatggctgctgctccatctggcgcatcaacaggttctcgtgaagctcttgaactacgtgatggcgacaagtctcgcttcctaggtaaaggcgttcttaaagctcttgaagctgtgaacggtcctatcgctgaagcgctacttggtaaagatgcaacagatcaagctgcaatcgatcaggtaatgatcgacctagacggtactgaaaacaagtctaagtttggtgctaacgcaattcttgctgtttctctagcaaacgctaaagcaggcgctgcagctaaaggcatgcctttatacgagcacattgcagaactaaacggtactgcgggtcagttctctatgcctcttccaatgatgaacatcatcaacggtggcgagcacgctgataacaacgttgatatccaagagtttatgattcagcctgttggcgctaaaactttccgtgaagcggtacgtattggtgctgaagtattccacaacctagctaaagtacttaaggctaaaggcctaagcacagcagttggcgatgaaggtggttttgctcctaacctagaatctaacgctgcagcactagctgcaatcaaagaagcggttgaagcggctggttacgagctaggtaaagacgttactctagcaatggactgtgcagcatctgagttttacgacaaagaagctggcaactacaacatgaaaggcgaaggtaaaatctttacttctgaagagtttaacttctacctacaagaccttgctaaccaatacccaatcgtatctatcgaagacggtcttgacgaatcagattgggctggcttcaagcaccaaactgaacttctaggcgacaagcttcaaatcgttggtgacgatctattcgttacaaacacgaagattcttgctgaaggtattgagaaaggcgttgctaactcaatccttatcaagttcaaccaaatcggttctctaacagagactctagctgcaatcaagatggctaaagatgctggttacacagctgtaatctctcaccgttctggcgaaactgaagatgcaactatcgctgatctagcggtaggtacagctgcaggtcaaatcaagactggttctatgagccgttctgaccgtgttgctaagtacaaccagctacttcgtatcgaagaagcgctaggcgcgaaagcacctttcaacggtcttaaagaagttaaaggtcaagcttaa

SEQ ID NO: 4056 - protein, 433 aa, Photobacterium profundum
MSKIVKVLGREIIDSRGNPTVEAEVHLEGGFVGMAAAPSGASTGSREALELRDGDKSRFLGKGVLKALEAVNGPIAEALLGKDATDQAAIDQVMIDLDGTENKSKFGANAILAVSLANAKAGAAAKGMPLYEHIAELNGTAGQFSMPLPMMNIINGGEHADNNVDIQEFMIQPVGAKTFREAVRIGAEVFHNLAKVLKAKGLSTAVGDEGGFAPNLESNAAALAAIKEAVEAAGYELGKDVTLAMDCAASEFYDKEAGNYNMKGEGKIFTSEEFNFYLQDLANQYPIVSIEDGLDESDWAGFKHQTELLGDKLQIVGDDLFVTNTKILAEGIEKGVANSILIKFNQIGSLTETLAAIKMAKDAGYTAVISHRSGETEDATIADLAVGTAAGQIKTGSMSRSDRVAKYNQLLRIEEALGAKAPFNGLKEVKGQA

SEQ ID NO: 4057 - DNA, 1293 bp, Methanococcus maripaludis
  CDS (1)..(1293)
atgttaagaaacatggacgattcatttgatatatatgaaataaaagcaagacaggtacttgattcacggggaaacccaactgtggaagctgaagtgttaactgcaggtggtggatacggtcatacaattgttccaagcggtgcttcaacaggaactttcgaagcagttgaattaagagataaaaaagaaaaatatggcggaaaaagcgtattaaatgcagtttcaaacgtaaatgatattattgcacaggaattaatcggtgaagatgcaagaaaccagagattaattgatcaaataatgttaaacttggatggaactgaaaataaaggaaatttgggcgcaaatgcaattttagcagtttcacttgcagttgcaaaagcagcggcagacactgcatcacttccactttataaatacatcggtggctctaacgcatatgttatgcctgccccaatgatgaacgtgttaaacggtggccagcacgcaggaaatgcacttgattttcaggaattcatgataatgccagttggcgcggattcatttgcagaagctgtaagaatgtgttctgaaacataccaatctttgaaaaaagtagttgctgaaaaatacggaaaagatgctgtaaatgtaggggatgaaggtggatttgcaccccctgtaaaaacaatcgacgaagctctcgcagtacttttagaaggggttaaaaaagcaggttatgaagacgaaatcgtctttacaatcgattctgccgcaagtgagttttacgatgaaaaatccggttcatatatgattgcaggagaaaaagtttcaaccgataaattaatcgatatttacaaagaaatggttgaacaatatccaattgtttcaattgaggatccattgtttgaagaagatttcgaaggatttaaaactgcaacaaaagagttaaaaggaattcagattgtcggtgacgatttgtttgttacaaacacgaaaagactcaaaaaaggaattgaaatgggcgctgcaaattcacttctcttgaaagtaaatcagattggaaccctttcagaatcaatcgatgctgcaaacatggcatttagaaatggatacagtttggttgtttcacacagaagtggagaatcagaggactcaacaattgcagatttagccgttgcactaaatgcaggccagataaaaaccggtgctcctgcaaggggagaaagaactgcaaaatacaaccagttaatgagaatcgaagaagaactccagatttcaaaatatgctggaaaagatttcaaaattccattttaa

SEQ ID NO: 4058 - protein, 430 aa, Methanococcus maripaludis
MLRNMDDSFDIYEIKARQVLDSRGNPTVEAEVLTAGGGYGHTIVPSGASTGTFEAVELRDKKEKYGGKSVLNAVSNVNDIIAQELIGEDARNQRLIDQIMLNLDGTENKGNLGANAILAVSLAVAKAAADTASLPLYKYIGGSNAYVMPAPMMNVLNGGQHAGNALDFQEFMIMPVGADSFAEAVRMCSETYQSLKKVVAEKYGKDAVNVGDEGGFAPPVKTIDEALAVLLEGVKKAGYEDEIVFTIDSAASEFYDEKSGSYMIAGEKVSTDKLIDIYKEMVEQYPIVSIEDPLFEEDFEGFKTATKELKGIQIVGDDLFVTNTKRLKKGIEMGAANSLLLKVNQIGTLSESIDAANMAFRNGYSLVVSHRSGESEDSTIADLAVALNAGQIKTGAPARGERTAKYNQLMRIEEELQISKYAGKDFKIPF

SEQ ID NO: 4059 - DNA, 1305 bp, Parachlamydia sp
  CDS (1)..(1305)
atgtcatatataagatctgtaaaaggaagagaaattttagattctagaggtaatccaactgttgaggttgaactaattacagatcaaaatgtcatggttaaagcgtctgttccttctggagcttctacaggagaaaatgaggcattagaattacgtgatggggatctcaattattactttggtaaaggagttttaaaagcaattgctaatattaatggtccaattgcacaaattctggttggagagcaggtctatgatcaagaaagattagatcggatgttaattgaagctgatgggacagacaataaaggtcatttcggagccaacgcgattttaggtgtttcgctagctttagcacgggcgggagcgttgacagcaaatctccctttatatcgctacattggaggggttcatgcccatcttttaccatgtcccatgatgaatattattaatggaggggctcatgctgataactctcttgattttcaagaatttatgattcgacctgttggagcttctactcttcgtgaagcggttcggtggggagctgaaatttttcacacgttaaaaggaatacttaaaaaagctgggcatgtgacagctgttggagatgaagggggttttgcacctaacctttcctcaaatgaagaggctttagaattgattttattagcgattgaaaaagctggttatcaacctggtaaacaagtggttctagcaatggattgtgcagcttcggaattttatgataaaactactaagcaatattttgaaaagaaaaagaaacaaaagaatcaagtatttgcggaaagaaccgctgaagagcaaattgcctatcttgaaaccctttgtcaaaattatccaattgattcaattgaagatgcgttagctgaaggagattggtgtggttggcaacgattaactgaaagattaggacgaaaaatacaaattgtaggagatgatatttttgtcaccaaccccaaatttctggaaaaaggaattgaacttggtgtggggaatgcaattttagtgaaaattaatcaaatcggaacactaaccgaaacgctgcaaacaattcgtttggctcaaactaacaattatgcttgtattatttctcatcgatctggcgaaacagaagatagtatcattgccgatattagtgtagcggctaatacaggacaaatcaaaacaggttctctttctagatctgaccgaattgctaagtacaatcggttattagctattgaggcagaattagaatcgacagcgctttatcaagatagtaatcgatttcagattttctaa

SEQ ID NO: 4060 - protein, 434 aa, Parachlamydia sp
MSYIRSVKGREILDSRGNPTVEVELITDQNVMVKASVPSGASTGENEALELRDGDLNYYFGKGVLKAIANINGPIAQILVGEQVYDQERLDRMLIEADGTDNKGHFGANAILGVSLALARAGALTANLPLYRYIGGVHAHLLPCPMMNIINGGAHADNSLDFQEFMIRPVGASTLREAVRWGAEIFHTLKGILKKAGHVTAVGDEGGFAPNLSSNEEALELILLAIEKAGYQPGKQVVLAMDCAASEFYDKTTKQYFEKKKKQKNQVFAERTAEEQIAYLETLCQNYPIDSIEDALAEGDWCGWQRLTERLGRKIQIVGDDIFVTNPKFLEKGIELGVGNAILVKINQIGTLTETLQTIRLAQTNNYACIISHRSGETEDSIIADISVAANTGQIKTGSLSRSDRIAKYNRLLAIEAELESTALYQDSNRFQIF

SEQ ID NO: 4061 - DNA, 1269 bp, Bdellovibrio bacteriovorus
  CDS (1)..(1269)
atgtctgaaatcatcagtgtcatctctcgtgaaatcctggacagccgtggaaacccgactgtagaggttgaagttacaacagctgacggcaatatgggccgcgcagcagttccatctggtgcctccacaggtgctcacgaagcttgcgagcttcgcgatggcgacaaaaaccgtttcctgggtaaaggcgtttacaaagctgtcgacaatgttcgtgaaaaaatcgctccggaaatcgtgggccttcaggcaactgaacaggtttacatcgataaaatcctgcgcgacatcgacggcactgaaaataaatccaacttgggcgcaaatgcgatcctgggtgtttctttggcagttgccaaagcggcagctaaagactgccgtttgccgctttaccgttacgttggtggctctcaggcttctcgcttgccggttccattgatgaacgttctgaacggtggcgcgcacgcgaacaacggtttggatattcaggaattcatgatcgttccaactgtgaacaactcatacgctgagtccctgcgtgcaggtactgagatcttccacactctgaaaaagatcctggcgaaaaaaggtctttccacagcagtaggtgacgaaggtggcttcgcgccgaaattgggttccaatcaggaagctcttgatttgctgatgaatgcgattgtggatgctggttatgatccaggtcagaacgtgttcctggcgttggacgtggctgcaactgaaatgttcaaagaaggcaaatacgaatggcagggtggtcacatcagcccgaccgaacttcttggcatctacaaatcctgggcagagaaatatcctcttgtttccattgaagacggcttcgcggaagacgactgggattcctgggttcagtccacagctcaaatgggctccactatgcagttgattggtgatgatttgtttgtgaccaatccaaaacgtctgcgcatgggtcttgagaaaaaagcgggtaacgctttgttggtgaaagtaaaccaaatcggtactttgactgaaacttacgaagccgtgaacctggctcaacgtaacaaattccgcacaatcatgtcccaccgctctggtgagacggaagatgtgacgattgcagatctggctgtaggcctgaactgccatcagatcaaaacaggcagcttgtgccgtggtgaaagaaccgcgaagtacaaccagcttctgagaatcgaagaagacttgggcggtatgggcctatactgggacaaagccgccttccgatag

SEQ ID NO: 4062 - protein, 422 aa, Bdellovibrio bacteriovorus
MSEIISVISREILDSRGNPTVEVEVTTADGNMGRAAVPSGASTGAHEACELRDGDKNRFLGKGVYKAVDNVREKIAPEIVGLQATEQVYIDKILRDIDGTENKSNLGANAILGVSLAVAKAAAKDCRLPLYRYVGGSQASRLPVPLMNVLNGGAHANNGLDIQEFMIVPTVNNSYAESLRAGTEIFHTLKKILAKKGLSTAVGDEGGFAPKLGSNQEALDLLMNAIVDAGYDPGQNVFLALDVAATEMFKEGKYEWQGGHISPTELLGIYKSWAEKYPLVSIEDGFAEDDWDSWVQSTAQMGSTMQLIGDDLFVTNPKRLRMGLEKKAGNALLVKVNQIGTLTETYEAVNLAQRNKFRTIMSHRSGETEDVTIADLAVGLNCHQIKTGSLCRGERTAKYNQLLRIEEDLGGMGLYWDKAAFR

SEQ ID NO: 4063 - DNA, 1356 bp, Mycoplasma mycoides
  CDS (1)..(1356): trans_table 4
atgtcaagaatagaaagaattttcgctcgtgaaattctagattcaagaggaacaccaacagttgaagttgaagtttgaactgaatttggtggatatggttgtgctaaagctccttctggtgcttcaactggagttaatgaagctttagaattaagagatggagataaagctcgttataatggtaaaggtgtattaaaagcagttaaaaatgttaatgaaataattgcacctaaactaattggagttgatgctttagatcaattaacagtagatagaataatgttagatttagatggaacagaatttaaaactaaattaggagctaatggaattttagctgtttctttagctgttgcaaaatctgctgctagtgaattagacattccattatataaatatttaggtggagttcaagcaaaaaaattaccagttcctatgttaaatgttattaatggtggagaacacgctgattcagcaattgactttcaagaatttatgattatgccagttggagcaaaatcatttagtgaagctttaagatgatcttctgaaacttttcaagctttaaaatcattattaaaatctaaaaaagatattactgctgttggagatgaaggtggatttgcacctaattttgaatgagcgtatgaaaaacacgatttaaaatcatttaaagcaaaaacaccagctgaaatcgctttagatctattagttgaagctattaaaaaggcaggatacaaaccaggaaaagatggaattatgatcgcaatggattgtgcttcatctgaactatatttagaagataaaaaatatcattttaaaaaaattgaaaaagtaactaaccaagaatgatcattaactacagatgaaatgatttcatatttagaaaaacttgttgataattatccaattatttcaattgaagatggattagctgaaactgactgagaaggatttactaaattaactcaaaaaattggtgataaagttcaaattgttggagatgacttatttacaacaaaccctaaatttattaaacaaggtattaataaaaaagctgcaaactcaactttaattaaactaaaccaaattggtactttaagtgaaactgttgaagcaatcactatgactcaaaaagcgggatgaactgcagttgtatcacatagatctggagaaactgaagatacaactattgctgatttagctgttgcatttaacacaggacaaattaaaactggatcaatgtcaagaagtgatagaattgcaaaatacaatagattattacaaattgaatctgaacttgataaaaatgctgtatatgatggattagaagcattttataatttaaaaaaataa

SEQ ID NO: 4064 - protein, 451 aa, Mycoplasma mycoides
MSRIERIFAREILDSRGTPTVEVEVWTEFGGYGCAKAPSGASTGVNEALELRDGDKARYNGKGVLKAVKNVNEIIAPKLIGVDALDQLTVDRIMLDLDGTEFKTKLGANGILAVSLAVAKSAASELDIPLYKYLGGVQAKKLPVPMLNVINGGEHADSAIDFQEFMIMPVGAKSFSEALRWSSETFQALKSLLKSKKDITAVGDEGGFAPNFEWAYEKHDLKSFKAKTPAEIALDLLVEAIKKAGYKPGKDGIMIAMDCASSELYLEDKKYHFKKIEKVTNQEWSLTTDEMISYLEKLVDNYPIISIEDGLAETDWEGFTKLTQKIGDKVQIVGDDLFTTNPKFIKQGINKKAANSTLIKLNQIGTLSETVEAITMTQKAGWTAVVSHRSGETEDTTIADLAVAFNTGQIKTGSMSRSDRIAKYNRLLQIESELDKNAVYDGLEAFYNLKK

SEQ ID NO: 4065 - DNA, 1284 bp, Rhodopseudomonas palustris
  CDS (1)..(1284)
atgaccgccatcgtcgacatcatcggccgcgaaattctcgacagccgcggcaatccgaccgtcgaagtcgacgtggtgctcgaggacggctccgtcggccgcgccgccgttccgtcgggcgcctccaccggcgcccacgaggcggtcgagctgcgcgacggcgacaaggcccgctatctcggcaagggcgtgcagaaggcggtcgaggcggtcaacggcgagctgttcgacgcgctcggcggcatggacgccgaacagcaggtgcagatcgatcagaccatgatcgagctcgacggcaccccgaacaagggccggatcggcgccaacgccatcctcggcgtttcgctggccgcggcgaaggcggcggcggcatcctacgacatgccgctgtatcgctacgtcggcggcacctcggcccgcaccctgccggtgccgatgatgaacatcgtcaacggcggcgtgcacgccgacaatccgatcgacttccaggaattcatgatcatgccggtcggcgcgccgaccttcgctgacgcgctgcgctgtggctcggagatcttccacaccctcaagggcgaattgaagaaggccggccacaacaccaatgtcggcgacgaaggcggctttgcgccgaacctgccgtcggccgatgcggcgctcgacttcgtcatggccgccatcggcaaggccggctacaaggccggcggcgacgtgatgctggcgctggactgcgccgccaccgagttcttcaaggacggctcctacgtctatggcggcgagaacaagacccgctcgcgctccgagcaggccaagtacctcgccgatctcgtcgcgcgctatccgatcgtgtcgatcgaagacggcatgagcgaagacgacatggacggctggaaggagctgaccgatctgatcggcagcaagtgccagctcgtcggcgacgatctgttcgtcaccaacgtcacccggctcgcggacggcatcaagaacggtcgcgccaactcgatcctgatcaaggtcaaccagatcggcacgctgaccgagacgctcgccgctgtcgaaatggcgcacaaggccggctacaccgcggtgatgtcgcatcgttcgggcgagaccgaggactcgaccatcgccgacctcgcggtcgccaccaattgcgggcagatcaagaccggctcgctggcgcgcgccgaccgcaccgccaagtacaaccagctgctgcgcatcgagcaggagctcggcgctcacgcgcactacgccggcaaggcggcgctgaaagcgctccgctga

SEQ ID NO: 4066 - protein, 427 aa, Rhodopseudomonas palustris
MTAIVDIIGREILDSRGNPTVEVDVVLEDGSVGRAAVPSGASTGAHEAVELRDGDKARYLGKGVQKAVEAVNGELFDALGGMDAEQQVQIDQTMIELDGTPNKGRIGANAILGVSLAAAKAAAASYDMPLYRYVGGTSARTLPVPMMNIVNGGVHADNPIDFQEFMIMPVGAPTFADALRCGSEIFHTLKGELKKAGHNTNVGDEGGFAPNLPSADAALDFVMAAIGKAGYKAGGDVMLALDCAATEFFKDGSYVYGGENKTRSRSEQAKYLADLVARYPIVSIEDGMSEDDMDGWKELTDLIGSKCQLVGDDLFVTNVTRLADGIKNGRANSILIKVNQIGTLTETLAAVEMAHKAGYTAVMSHRSGETEDSTIADLAVATNCGQIKTGSLARADRTAKYNQLLRIEQELGAHAHYAGKAALKALR

SEQ ID NO: 4067 - DNA, 1278 bp, Corynebacterium diphtheriae
  CDS (1)..(1278)
atggctgacattatgcacgtatttgctcgtgaaatcttggactcccgcggtaacccaaccgttgaagccgaagttttcttggatgacggatcccacggcgttgcgggcgttccttccggtgcgtccaccggtgttcacgaggctcacgagcttcgcgacggtggcgagcgctacctcggcaagggcgttctcaatgcagttaacaacgtgaacgaggaaatcgctgacgcaatcgctggtgcagaagccgacgatcagcgcctgatcgatcaggcgatgattgctctcgacggcactgagaacaagtctcgtctcggcgcaaacgctatcttgggtgtatccatcgccgtagctaaggctgccgcagagtctgctggcctacctttgtaccgctacatcggcggccctaacgctcacgttcttccagttcctatgatgaacattgttaacggtggcgcacacgctgactccggcgttgatgttcaggagttcatgattgctcctatcggtgccgagtccttctctgaggctctgcgcatgggtgcagaggtctaccactccttgaagtccgtgattaagtccaagggactttccaccggcctcggcgacgaaggtggtttcgcaccttctgttgagtccaccaaggcagctctcgacctcatcgttgaggcaattgagaaggctggcttcaagccaggtgctgacatcgcacttgcactcgacgttgcttcctccgagttctacaaggatggcaagtaccacttcgaggggggcgagcacaccgctgaggagatggcaaaggtctacgagcagctcatcgctgagtacccaattgtttccatcgaggacccactgcaggaagacgactgggagggctacaccgccctgaccgccgcaatcggtgacaaggttcagatcgtcggcgacgacttcttcgtcaccaacccagcacgcctcaaggaaggcatcgagaagaaggctgccaatgccttgctggtaaaggtcaaccagatcggtaccctgaccgagaccttcgacgctgttgatctcgcacaccgcaacggctaccgcaccatgatgtcccaccgctccggcgagactgaagacaccaccattgctgaccttgcagtcgcattgggctgtggccagatcaagaccggtgcaccagctcgttccgagcgcgttgccaagtacaatcagcttctgcgcatcgagcagcagcttgacgatgcagcagtctacgcaggccgttcagcatttccacgttttcagggctaa

SEQ ID NO: 4068 - protein, 425 aa, Corynebacterium diphtheriae
MADIMHVFAREILDSRGNPTVEAEVFLDDGSHGVAGVPSGASTGVHEAHELRDGGERYLGKGVLNAVNNVNEEIADAIAGAEADDQRLIDQAMIALDGTENKSRLGANAILGVSIAVAKAAAESAGLPLYRYIGGPNAHVLPVPMMNIVNGGAHADSGVDVQEFMIAPIGAESFSEALRMGAEVYHSLKSVIKSKGLSTGLGDEGGFAPSVESTKAALDLIVEAIEKAGFKPGADIALALDVASSEFYKDGKYHFEGGEHTAEEMAKVYEQLIAEYPIVSIEDPLQEDDWEGYTALTAAIGDKVQIVGDDFFVTNPARLKEGIEKKAANALLVKVNQIGTLTETFDAVDLAHRNGYRTMMSHRSGETEDTTIADLAVALGCGQIKTGAPARSERVAKYNQLLRIEQQLDDAAVYAGRSAFPRFQG

SEQ ID NO: 4069 - DNA, 1694 bp, Capsella bursa
  CDS (87)..(1421)
gactcctcagctaccactgttaagcgattctcactaaaaccctcgaacacatcgcccttatctctctctctcttgatctactcgctatggctactatcaccgttgttaaggctaggcagatcttcgacagccgtggtaaccccaccgttgaggttgatatccacacatcaaatggtgtcaaggttacagcagctgtcccaagtggagcttccactggaatctacgaggctcttgagctgagggatggaggatcagactaccttggaaagggtgtctctaaggctgttggcaacgtgaacaacatcattggcccagctcttattggcaaggacccaactcagcagacagctattgacaacttcatggtccatgaacttgatggaacccagaatgagtggggttggtgcaagcaaaagcttggagccaatgctattcttgctgtgtctcttgcagtctgcaaagccggggctgttgtcagcggcattcctctgtacaagcacattgccaatcttgctggaaacccaaagattgtcctgccagttcctgccttcaacgtcatcaatggtggatctcatgctggaaacaagcttgccatgcaggagtttatgatcttacctgttggagcttcttctttcaaggaagccatgaaaatgggtgtggaagtttaccaccacttgaagtccgtgattgagaagaagtacggtcaggatgccacaaatgttggtgatgaaggtggctttgcaccaaacattcaggagaacaaggaaggtcttgaattgcttaagactgctatcgagaaggctggctacactggcaaggttgtcattggaatggatgttgctgcttcagagttttactcatcagacaagacctatgacttgaacttcaaagaagagaacaacaatggttctcagaagatttctggagatgctcttaaggacctgtacaagtcctttgttgctgaatacccaattgtgtccattgaggacccatttgaccaagatgactgggagcactatgctaagatgaccaccgagtgtggaaaagaggtccagattgttggtgatgatttgttggtcaccaaccccaagagagttgcaaaggcaattgccgagaagtcttgcaatgctcttcttttgaaggttaaccaaatcggatcagtaactgagagtatcgaggcagttaggatgtcgaagaaggcaggctggggagtgatgaccagccacagaagtggtgaaactgaggacaccttcattgctgatttagccgttgggttgtctactggacaaatcaagactggtgccccttgcagatccgagcgtcttgccaagtacaaccagcttttgcgtattgaggaggagttgggatcagaggcagtttacgctggagtcaacttccgcacaccagtggaaccctactaagtgaagcatttagaaggcaaagttagtcttcttgttgacacgagaagatgacttttgagtttggccatttgcttaattaaataaaacgtttgttttgtttttttctttgttggggttttacgtttatactttggaccctttggaggaaaagtttgtgtttatttttgtaaggggaaacatgagtgagctctgcctttacggaggacggtagcccttattttacaatctaatttcggctttacccaaaaaaaaaaaaaaaaaaaaaaaaaaaaa

SEQ ID NO: 4070 - protein, 444 aa, Capsella bursa
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHHLKSVIEKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTTECGKEVQIVGDDLLVTNPKRVAKAIAEKSCNALLLKVNQIGSVTESIEAVRMSKKAGWGVMTSHRSGETEDTFIADLAVGLSTGQIKTGAPCRSERLAKYNQLLRIEEELGSEAVYAGVNFRTPVEPY

SEQ ID NO: 4071 - DNA, 1317 bp, Cryphonectria parasitica
  CDS (1)..(1317)
atgcctatctccaagattcacgcccgttacgtctacgactctcgtggcaaccccaccgtcgaggtcgacctcgtcaccgagaccggcctccaccgtgccatcgttccctccggtgcttcgaccggtcagcacgaggcatgcgagctccgtgacggtgacaagtccaagtggctgggcaagggtgtcctgaaggccgtcgagaatgtcaacaccgtcctcggccctgagctgatcaaggctggcctggacgtcaaggaccagaccgccgtggacgagttcctcatcaagctcgacggcactgccaacaagaccaagctcggcgcgaatgccatcctcggtgtcagtctggctgtcgccaaggccggtgccgctgagaagggtgttcccctgtacgctcacgtctccgaccttgctggcaccaagaagccctacgtcctccctgttcccttccagaacgtcctgaacggtggctcccacgctggtggccgtctcgccttccaggagttcatgattgttccttctgccgctccctccttctctgagggtctgcgctggggtgccgagacctaccaccagctgaagagcctggccaagaagaagtacggccagtctgccggcaacgtcggcgatgagggtggcgtcgcccccgatatccagactgccgaggaggcgctcgagctcatctccgaggccatcgagaaggctggctacacaggcaagatgaagattgccatggacgttgcctcgtccgagttctacaaggaggacgtcaagaagtacgacctcgacttcaagaacccagactcggaccccagcaactggctcacctacgagcagctggccgccctgtacgccgacctcaccaagaagtaccccatcgtctcgatcgaggaccccttcgccgaggatgactgggaggcctggagctacttctacaagacccaggacatccagctcgttgctgatgacctgaccgtcaccaaccccatccgcatcaagaaggccatcgagctcaaggccgccaacgccctgctgctcaaggtcaaccagatcggtaccctgaccgagtccattcaggccgccaaggactcgtacgctgacggctggggtgtcatggtctctcaccgctctggtgagaccgaggatgtcaccattgccgacattgtcgtcggtatccgggctggccagatcaagactggtgcccctgcccggtctgagcgccttgccaagctcaaccagattctccgcattgaggaggagctcggctcgaacgccatctacgctggcgaggacttccgcaagtctgttaccctgtaa

SEQ ID NO: 4072 - protein, 438 aa, Cryphonectria parasitica
MPISKIHARYVYDSRGNPTVEVDLVTETGLHRAIVPSGASTGQHEACELRDGDKSKWLGKGVLKAVENVNTVLGPELIKAGLDVKDQTAVDEFLIKLDGTANKTKLGANAILGVSLAVAKAGAAEKGVPLYAHVSDLAGTKKPYVLPVPFQNVLNGGSHAGGRLAFQEFMIVPSAAPSFSEGLRWGAETYHQLKSLAKKKYGQSAGNVGDEGGVAPDIQTAEEALELISEAIEKAGYTGKMKIAMDVASSEFYKEDVKKYDLDFKNPDSDPSNWLTYEQLAALYADLTKKYPIVSIEDPFAEDDWEAWSYFYKTQDIQLVADDLTVTNPIRIKKAIELKAANALLLKVNQIGTLTESIQAAKDSYADGWGVMVSHRSGETEDVTIADIVVGIRAGQIKTGAPARSERLAKLNQILRIEEELGSNAIYAGEDFRKSVTL

SEQ ID NO: 4073 - DNA, 1607 bp, Glycine max
  CDS (36)..(1370)
ctcactcactgcagatctcaattgcatcgctgcccatggctaccatcgttagcatcaacgcccgccaaatcttcgacagtcgtggcaatccaactgtcgaggtggatttgacttgctccgatggtacttttgccagagctgctgttccaagtggtgcatccactgggatttatgaggcccttgaattgagagatggaggatctgactaccttggaaagggtgtatcaaaggctgttgacaatgtgaacaccgtcattggccctgctttgattggcaaggacccaactgagcagactgctattgacaacttaatggttcaacagcttgatggaactgttaacgaatggggttggtgcaagcaaaagctaggagcaaatgccatattggcagtgtttcttgcagtctgcaaagctggtgctagcgtcctgaaaattcctctttacaagcatattgctaatatcgcgggtaacaaaaagttggttttgcctgttcctgctttcaatgtcattaatggtggatcacatgctggaaacaaacttgctatgcaggagtttatggttcttcctgtgggagcttcctcgttcaaggaagccatgaagatgggtgtagaagtgtatcacaatttgaagtctgtgattaagaagaaatatggtcaagatgcaataaatgttggtgacgaaggtggctttgcccctaacatccaggaaaacaaggaaggcttggaattgctgaaaactgccatcgccaaagctggttacacaggcaaagttgtcattggaatggatgttgcagcttctgaattctacaaggaagacaaaacatacgatttgaacttcaaggaagataacaatgatggctcccagaggatctctggagatgctttgaaagatctgtacaagtcatttgtgtcagagtacccaattgtttcaattgaggatccatttgaccaggatgactgggagcactatgctaagctaactgctgaggttggagccaatgtacaaattgttggtgatgatctcttggttaccaaccccaagagggttcagaaggcaattgatactaaagcatgcaatgctcttctcctcaaggtcaaccaaattggttctgtgactgagagtattgaagctgtcaggatgtccaaaaaagctggatggggtgtcatggccagtcacagaagtggagagactgaggataccttcattgctgacctttctgttggtttggctacgggtcaaattaagactggagctccatgcaggtctgagcgtcttgctaaatataaccagctcttgagaattgaggaggagcttggtgctgaagcagtgtacgccggagctaacttccgtacccccgttgaaccctactaaagttttcaagtggaaaaaacctggagatccacacgagtttgagcattgagatttgggtgcgcggtttttggtgtgatatataagttgatagttggaacattatacaagaatataaagaccttgccaataatttgagttctgattcacagagctaggacagttatgtcttaagactttgaaaggtgtttaatgatatttagctttaatacttgaagcctaaaaaaaaaaaaaaaaaaa

SEQ ID NO: 4074 - protein, 444 aa, Glycine max
MATIVSINARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVFLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 4075 - DNA, 1278 bp, uncultured bacterium 583
  CDS (1)..(1278)
atgcaaattaaacaaatcaaagcccgtgaggttttagactctagaggtaaccctactgttgaggcagatgtaattcttaataatggtgttttcggaagggcaatggttccgtctggagcttctactgggcaacgtgaagccttggaactaagagatggagataaaaatcgttatttaggaaaaggtgttactcaatctgttattaatatcaaccatgagattaacgacgccctcgttgatatgaaaatctcaaatcagcaagatattgatcaaaaaatgattgacatggatggtactgaaacaaaatctcgcttgggtgctaattctattttggcagtctccttagcctgtgcgcacgccaatgcaaataacaacaaacaatcattgtttcgttcgtttaatttttctgaaacttatcaacttccagtgcccatgatgaatattatcaatggaggtgagcatgccaataatagtattgatatccaagagtttatgattatcccagctggagcacctagcttcaaagaagcattaagatacggtgctgaagtttttcatcatttaaaaaagctgcttgaccaaggaggttttaatacagcagtcggagatgaaggtggctttgcacctgacttaagctccaacgaggaggctttaaaggtcatccttaaagctattgagagtgcgggatatgaagcaggaaaagatatctttattggaattgatgctgctagttctgagttttacaataacggcacctataacttaacctcagaaggtttgaaactgagtaatgaggaatttacgagttatcttgcatcatgggttgaaaaatatccaatcatttcgattgaagacggaatggatgaaaatgactgggtaggttgggagatgcttaccaaaaaattatctgacaaagttcaattggtaggtgatgatttatttgttactaatagtaaaattttagctaaaggtatagaaaataatattgccaactcgatccttatcaaagtcaaccaaataggcacacttacagaaacatttaacgcaatgaagatggcttcaaatgctggatatacttgcgttatgtcacatagaagtggcgaaactgaagacacgactattgctgacctatctgttgcaactagctgtggacaaattaaaacaggctcattgtctcgctctgacaggcttgcaaaatataatcgattgctgcgtatcgaagaggaactaggggatgatgcatactatcctggactcagtacattcaaacatttataa

SEQ ID NO: 4076 - protein, 425 aa, uncultured bacterium 583
MQIKQIKAREVLDSRGNPTVEADVILNNGVFGRAMVPSGASTGQREALELRDGDKNRYLGKGVTQSVININHEINDALVDMKISNQQDIDQKMIDMDGTETKSRLGANSILAVSLACAHANANNNKQSLFRSFNFSETYQLPVPMMNIINGGEHANNSIDIQEFMIIPAGAPSFKEALRYGAEVFHHLKKLLDQGGFNTAVGDEGGFAPDLSSNEEALKVILKAIESAGYEAGKDIFIGIDAASSEFYNNGTYNLTSEGLKLSNEEFTSYLASWVEKYPIISIEDGMDENDWVGWEMLTKKLSDKVQLVGDDLFVTNSKILAKGIENNIANSILIKVNQIGTLTETFNAMKMASNAGYTCVMSHRSGETEDTTIADLSVATSCGQIKTGSLSRSDRLAKYNRLLRIEEELGDDAYYPGLSTFKHL

SEQ ID NO: 4077 - DNA, 1278 bp, uncultured bacterium 560
  CDS (1)..(1278)
atgacaattaaacaaatcaaggctcgagaggttttagattctagaggcaaccctactgttgaggcagatgtaattcttagtaacggtgttttcggaagggcaatggttccatctggagcttcaactgggcaacgtgaagctttagagctaagagatggcgataaaaaccgttatttgggaaaaggtgttactcaatctgttaataatattaatcatgagattaacaacgccctagttggtatgaaaatctcaaatcaacaagctatcgatcaaaaaatgattgacatagatggcactgaaacaaaatctcgcttaggtgcaaattctattctggcagtttccttagcctgtgcacacgctaatgcaaataataataaacaatcattgtttcgttcgtttgatttttctgaaacttatcaacttccagtccccatgatgaacattatcaatggcggtgagcatgccaataatagcattgatatacaagaatttatgattatcccagctggagcacctaacttcagggaagcattaagatacggtgctgaagtttttcatcatttaaaaaagttactcgatcaagaaggtcttaatacagctgtcggagatgaaggtggctttgcacctgacttaagctccaacgaagaggctttaaaaatcataattaaagctattaagagtgcgggatataaagcaggaaaagatatttttattggaattgatgctgctagttctgagttttacaataacggcacttataacttatcctcagaaggtttgaaactgagtaatgaggaatttacgagttatcttgcatcatgggttgaaaaatatccaataatttcgattgaagacgggatggatgaaaatgactggtcaggctgggagatgcttaccaaaaaattatctgacaaagttcagttggtaggtgatgatttatttgttacaaatagtaaaattttagctagaggtatagaaaataatattgccaactcaatccttatcaaagtaaaccaaataggcacacttacagaaactttcaacgcaatgaagatggccttaaatgctggatacacttgcgttatgtctcatagaagtggcgaaactgaagacactacaattgcagacctatctgttgcaaccggatgtggacaaattaaaacaggatcattatctcgttctgacagacttgcaaaatataatcgattactgcgtattgaagaggaactaggggatgatgcattctatcctggaattaatgcattcaaacatctttaa

SEQ ID NO: 4078 - protein, 425 aa, uncultured bacterium 560
MTIKQIKAREVLDSRGNPTVEADVILSNGVFGRAMVPSGASTGQREALELRDGDKNRYLGKGVTQSVNNINHEINNALVGMKISNQQAIDQKMIDIDGTETKSRLGANSILAVSLACAHANANNNKQSLFRSFDFSETYQLPVPMMNIINGGEHANNSIDIQEFMIIPAGAPNFREALRYGAEVFHHLKKLLDQEGLNTAVGDEGGFAPDLSSNEEALKIIIKAIKSAGYKAGKDIFIGIDAASSEFYNNGTYNLSSEGLKLSNEEFTSYLASWVEKYPIISIEDGMDENDWSGWEMLTKKLSDKVQLVGDDLFVTNSKILARGIENNIANSILIKVNQIGTLTETFNAMKMALNAGYTCVMSHRSGETEDTTIADLSVATGCGQIKTGSLSRSDRLAKYNRLLRIEEELGDDAFYPGINAFKHL

SEQ ID NO: 4079 - DNA, 1323 bp, Tuber borchii
  CDS (1)..(1323)
atgattaccaaaattcacgcccgctcagtctacgactctcgtggtaaccccacggttgaagtagatctcacaaccaccgacaccggtttacacagggctattgtcccctccggcgcttccaccggccaacatgaagccattgagcttcgtgacaaagacaagaccaagtgggccgggaagggcgttctcaaggccgttgagaacgtcaacactatcatcgctcccgccctcattaaggaaaagtttgacgttaaggaccaagctactatcgacaagttcttgattgatcttgacggaaccccgaataaggccaaattaggagccaacgctatcctcggcgtttctttggcggttgctaaggctggagctgctgcaaagaaagttccgttgtatgcccatgttgcggatcttgccggtaccaaaaagccattcgttctcccggttccgttcatgaatgtcattaatggaggatctcatgccggaggccgtcttgccttccaagagttcatgattgttcccagcgaggccccgagctttaccgaggctatgaggcagggagctgaagtttaccagatcctcaagacccttaccaagaagaagtacggccagtctgccggtaatgttggtgatgaaggtggttggcccgacattcagaccgttgaggaggctcttgaccttatcaccgatgctattgacaaggctggatacactggccagataaagatcgccatggatgttgcttcttccgagttctacaaggaggatgctaagaagtacgatcttgacttcaagaaccctgactccgatagcagcaagtggttgacctatcaggaattggctgatctctataagagccttgcccagagataccccattgtcagcattgaggatccctttgccgaggatgactgggaagcctgggcccacttttacaagaccagcgacttccagatcgttggtgacgatttgactgttactaaccccatccgtatcaagagggccattgacgagaagagctgcaatgctctccttctcaaggttaaccagatcgctactcttaccgaatctatccaggccgctaaggactcatactccgctggctggggtgtcatggtctcccaccgttctggtgagactgaagatgtcaccattgcggacatcgttgtcggtctccgtgccggccagatcaagactggtgcccccgcgagaagtgaacgtcttgccaagctcaaccagatcctccgtatcgaggaggagttgggcgagcaggccatctacgctgggacaagttcagaaccgccgcacctttacatttttatttag

SEQ ID NO: 4080 - protein, 440 aa, Tuber borchii
MITKIHARSVYDSRGNPTVEVDLTTTDTGLHRAIVPSGASTGQHEAIELRDKDKTKWAGKGVLKAVENVNTIIAPALIKEKFDVKDQATIDKFLIDLDGTPNKAKLGANAILGVSLAVAKAGAAAKKVPLYAHVADLAGTKKPFVLPVPFMNVINGGSHAGGRLAFQEFMIVPSEAPSFTEAMRQGAEVYQILKTLTKKKYGQSAGNVGDEGGWPDIQTVEEALDLITDAIDKAGYTGQIKIAMDVASSEFYKEDAKKYDLDFKNPDSDSSKWLTYQELADLYKSLAQRYPIVSIEDPFAEDDWEAWAHFYKTSDFQIVGDDLTVTNPIRIKRAIDEKSCNALLLKVNQIATLTESIQAAKDSYSAGWGVMVSHRSGETEDVTIADIVVGLRAGQIKTGAPARSERLAKLNQILRIEEELGEQAIYAGTSSEPPHLYIFI

SEQ ID NO: 4081 - DNA, 1624 bp, Brassica napus
  CDS (20)..(1354)
tctagatctactcgaaaccatggccactatcaccgtcgttaaggctaggcagatcttcgacagtcgtggcaatcccacggttgaggttgatgtccacacatcaagtggtgtcaaggtcactgctgctgttccgagtggagcttccactggtatctacgaggctcttgggcttagggatggtggatctgattatctcggaaagggtgcttctaaggctgttggtaatgtgaacaacatcatcggcccagcgttgattggaaaggacccgactcagcagactgctattgacaacttcatggtccatgaacttgatggaacccagaacgagtggggttggtgcaagcaaaagcttggagccaatgccatccttgctgtgtcccttgctgtttgcaaagctggggccgttgtcagtggcattcctctctacaagcacattgccaaccttgctggtaaccctaaaattgtgctaccagttcccgctttcaacgtcatcaatggtggattacatgcaggaaacaagctcgctatgcaggagtttatgattctccctgttggagcttcatctttcaaagaagccatgaaaatgggtgttgaagtttaccacaacttgaagtctgtgatcaagaagaagtatggccaggatgctaccaacgttggtgatgaaggtggctttgcaccaaacattcaggagaacaaggaaggtcttgaattgcttaagactgccattgaaaaggctggctacactggcaaggttgtcattggaatggatgttgccgcttcagagttctactcatcagacaagacctacgacttgaactccaaagaagagaacaacaatggctctcagaagatttctggtgatgcactaaagggcctctacaagtcctttgtctctgagtacccaattgtgtccattgaggacccatttgaccaagatgactgggagcactatgctaagatgaccgccgagtgtggagacaatgttcagattgtcggtgatgatttgttggtcaccaaccccaagagagttgccaaggcaatcgcagaaaagtcttgcaatgctcttctcttgaaggttaatcaaatcgggtcagtaacagagagtattgaggcagtgaagatgtcaaagagagcaggatggggagtgatggctagccaccgaagtggtgaaaccgaggacaccttcatcgctgacttatccgttggcttgtctactggacaaatcaagactggagctccttgcagatccgagcgtcttgccaagtacaaccagcttttgcgtattgaagaggagttgggatcagaggcagtttacgctggagctaacttccgcaagcctgtggagccgtactagacaagtgctgctcgtagaagcgaagtgctctcctttgttacgagaaaaagaagatctgagttgtgcttggtcattttgctttaaataaaacattacgtttgctttttttttctccctttgttggtttattttccaaaccactcttgttgggattaagttgcttatttttgtaagaaaaaaacctgagatagctctgcctttaaagaggacagcagctcttcttttataatctaatttcggcttcttttaatttcaaaaaaaaaaaaaaaa

SEQ ID NO: 4082 - protein, 444 aa, Brassica napus
MATITVVKARQIFDSRGNPTVEVDVHTSSGVKVTAAVPSGASTGIYEALGLRDGGSDYLGKGASKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGLHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNSKEENNNGSQKISGDALKGLYKSFVSEYPIVSIEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 4083 - DNA, 1580 bp, Brassica campestris
  CDS (20)..(1354)
tccagatctctactcaaccatggccactatcaccgctgttaaagctaggcagatcttcgacagccgtggcaatcccacggttgaggttgatgtacacacatcaagtggtgttaaggttacagcagcggttccgagtggagcttccaccggtatctacgaggctcttgagcttagggatggtggatcagactaccttggaaagggtgtctctaaggctgttggcaatgtgaactccatcatcggcccagcttcgattggaaaagacccaactcagcagactgctattgacaacttcatggtccatgaacttgatggaacccagaacgaatggggatggtgcaagcaaaagcttggagccaatgctattcttgctgtatctctagctgtctgcaaagctggggctgttgtcagtggcattcctctctacaagcacattgccaatcttgctggtaaccctaagattgtgctaccagttcctgcgttcaacgttatcaatggtggatcccatgccggaaacaagctcgccatgcaggagtttatgatcctccctgttggagcttcttctttcaaagaagccatgaaaatgggtgttgaagtttaccacaacttgaagtctgtgattaagaagaagtatggacaggatgccaccaacgtcggtgatgaagggggctttgcaccaaacattcaagaaaacaaggaaggtcttgaactgcttaagactgctatcgagaaggctggatacactggcaaggttgtcattgggatggatgttgccgcttctgagttctactcatctgacaagacttacgacttgaacttcaaagaagagaacaacaatggttctcagaagatttctggagatgctctcaaggacctgtacaagtccttcgttgctgagtacccaattgtgtccattgaggacccatttgaccaagatgactgggagcactatgctaagatgaccgccgagtgtggagacaatgttcagattgtcggtgatgatttgttggtcaccaaccccaagggagttgccaaggcaatcgcagaaaagtcttgcaatgctcttctcttgaaggttaatcaaatcgggtcagtaacagagagtattgaggcagtgaagatgtcaaagagagcaggatggggagtgatggctagccaccgaagtggtgaaaccgaggacaccttcatcgctgacttatccgttggcttgtctactggacaaatcaagactggagctccttgcagatccgagcgtcttgccaagtacaaccagcttttgcgtattgaggaggagttgggatcagaggcagtttacgctggagccaacttccgcaagcctgtggagccctactagaagaagtacaagcttttttgaagcaaagtggtcttttgtgacgcgaagaggatgagagttgttttggtcattttgcttaaataaaacactacgcttctgttttttctgtgtttatgatttgaacccttatttttgtaagagaaacctgagatagctttgtctttatagacaacagcagcgttcttttataatataatttcggctttactcaaaaaaaaaaaaaaaa

SEQ ID NO: 4084 - protein, 444 aa, Brassica campestris
MATITAVKARQIFDSRGNPTVEVDVHTSSGVKVTAAVPSGASTGIYEALELRDGGSDYLGKGVSKAVGNVNSIIGPASIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTAECGDNVQIVGDDLLVTNPKGVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 4085 - DNA, 1580 bp, Gossypium barbadense
  CDS (20)..(1357)
aagctctctttttcatctcatggctgctactatcgtctccgtcaaagctaggcagatcttcgacagccgtggaaatcccactgttgaggttgatgtggaaacatcgaacggtataaaggctagggccgcagttcctagcggtgcatccactggaatttacgaggctcttgagttgagagatggaggttccgattacctcggtaaaggtgtatcgaaggctgttgctaatgttaacacaatcatcggccctgcattgattggaaaggacccaaccgagcagactgcaattgacaatttcatggttcaacaactggatggaacccaaaatgagtggggttggtgcaaacaaaagctcggtgcaaatgccattcttgccgtgtcccttgctgtttgcaaagctggagctgaagtcaagaaacttcccctttacaagcacattgctaaccttgctggtaacagcaagttggttcttcctgtccctgctttcaatgtcatcaacggtggttcacatgcaggaaacaaattggctatgcaggagttcatgattcttcctgtaggagcatcatcctttaaggaggccatgaaaatgggtgttgaagtctatcaccatttgaagtctgtgattaagaagaagtatggtcaagatgcaaccaatgtcggtgatgaaggtggctttgctcctaatatccaggagaacaaggaaggacttgaattgttgaatacagccattgctaaagctggttacactggcaaagttgttattggaatggatgttgccgcgtctgaattttatggaacagataaaacttacgacctgaacttcaaagaagagaacaatgacggtaaacaaaagatctcaggagatgctttgaaagatttatacaagtcattcgtagccgagtatccaattgtgtcaatcgaagatccatttgaccaagatgattgggagcactactccaaactaaccaaggaaatcggagaaaaagttcagattgtaggagatgatcttttggtcaccaacccaaagagggttgcgaaggctattgccgaaaaaacttgtaatgcccttcttctcaaggtcaatcaaattggatctgttaccgaaagtattgaagctgtgaaaatgtccaagcaagctggatggggtgtgatggccagccaccgcagtggtgaaacggaggatacttttattgctgatctttcagtcggtttggccacgggccaaattaagaccggagctccacgcaggtctgagcgtttagccaagtacaaccagcttctgcgaattgaggaggagcttggtgcgaaagccgtctatgccggagctagcttccgtgctccagttgcaccctattaagatgcttgtttagatgataatgtgctgagactggatgcgtgcggcagagcttcagtggtttgttgagaccctaaaacatatttcaataattttgatagcaattttggacttgtgttcaaaataaatcgatctccgtgttatttttgttggactttgcctgcatatatgctcgctatattcataaatacatgatgcttgaaaaaaaaaaaaaaaaaaaaaaaaa

SEQ ID NO: 4086 - protein, 445 aa, Gossypium barbadense
MAATIVSVKARQIFDSRGNPTVEVDVETSNGIKARAAVPSGASTGIYEALELRDGGSDYLGKGVSKAVANVNTIIGPALIGKDPTEQTAIDNFMVQQLDGTQNEWGWCKQKLGANAILAVSLAVCKAGAEVKKLPLYKHIANLAGNSKLVLPVPAFNVINGGSHAGNKLAMQEFMILPVGASSFKEAMKMGVEVYHHLKSVIKKKYGQDATNVGDEGGFAPNIQENKEGLELLNTAIAKAGYTGKVVIGMDVAASEFYGTDKTYDLNFKEENNDGKQKISGDALKDLYKSFVAEYPIVSIEDPFDQDDWEHYSKLTKEIGEKVQIVGDDLLVTNPKRVAKAIAEKTCNALLLKVNQIGSVTESIEAVKMSKQAGWGVMASHRSGETEDTFIADLSVGLATGQIKTGAPRRSERLAKYNQLLRIEEELGAKAVYAGASFRAPVAPY

SEQ ID NO: 4087 - DNA, 1293 bp, Onion yellows phytoplasma
  CDS (1)..(1293)
atgccatatattgaaagtattttagcgcgcgaagtgctagattccagaggaaatcctacagtagaagtagaagtttatacagaatcaggagcgtttggaagagctattgttccttcaggagcttctaccggacaatacgaagcagttgaattaagggatggggatgcccaaagatttttaggtaaaggcgttttgcaagctgttaaaaatgttattgaagttattcaaccagaattagaaggttattctgtcttagaacaaactttaattgataaattattaattaaacttgacggaactcctaacaaatctaatttaggagctaacgctattttaggtgtttctttggcttgtgctaaagctgcagctaactacttaaatcttgagttttatcaatatgtaggaggcgttttacctaaacaaatgccagttcctatgatgaatgttatcaacggtggagctcatgcttctaacagtgttgattttcaagagtttatgattttaccaactggaccaacatcttttaaagaagctttacgttatggggctgaagtttttcaccatttaggaaaaatcttaaaacaaaaaggacttccaactacagtaggagacgaaggcggatatgcacctgaccttaattctaacgaagaagccttacaaatcattttggaagctatcaaaagtgcaggatacgagccaggaaaagacatttttttaggaatggacgttgcagcttccgagttttatgacaaaaaacttcaaaaatacgttcttgcatctgaaaataacaaagcttttagtagccaagaattagttcattattacgaaactttagtttctaaatatccaattatttcaatcgaagacggacttgatgaaaatgattgggatggatggaaatacttaacccaaaaattaggtaaccaaatccaattagtaggggatgacctatttgttactaacacccaaaaattagctcaaggaattgaaaacaaaataggaaactctattttaattaaattaaatcaaataggaactctaacagaaaccctagaaacaattgaaatggcaaaaaaagcttcttacaccgctgttatttctcaccgtagtggcgaaaccgaagacacaactattgctgatttagctgttgctactaatgcgggtcaaattaaaactggttcttgttcacgtactgatcgtatggcaaaatacaatcaattattaagaattgaagaccaattagtagaagctccttttttaggattaaaaactttttataatttgaaaaaataa

SEQ ID NO: 4088 - protein, 430 aa, Onion yellows phytoplasma
MPYIESILAREVLDSRGNPTVEVEVYTESGAFGRAIVPSGASTGQYEAVELRDGDAQRFLGKGVLQAVKNVIEVIQPELEGYSVLEQTLIDKLLIKLDGTPNKSNLGANAILGVSLACAKAAANYLNLEFYQYVGGVLPKQMPVPMMNVINGGAHASNSVDFQEFMILPTGPTSFKEALRYGAEVFHHLGKILKQKGLPTTVGDEGGYAPDLNSNEEALQIILEAIKSAGYEPGKDIFLGMDVAASEFYDKKLQKYVLASENNKAFSSQELVHYYETLVSKYPIISIEDGLDENDWDGWKYLTQKLGNQIQLVGDDLFVTNTQKLAQGIENKIGNSILIKLNQIGTLTETLETIEMAKKASYTAVISHRSGETEDTTIADLAVATNAGQIKTGSCSRTDRMAKYNQLLRIEDQLVEAPFLGLKTFYNLKK

SEQ ID NO: 4089 - DNA, 1314 bp, Kluyveromyces lactis
  CDS (1)..(1314)
atgccaatctctaaagtttacgccagatccgtctacgattctcgtggtaacccaactgttgaagttgaattgaccaccgaaaagggtactttcagatccattgttccatctggtgcctccactggtgttcacgaagctctagaattgagagatggtgacaaatctaaatggttaggtaagggtgttttgactgctgtttctaacgttaacaacatcattgctccagctttggttaaggctaacgttgacgttaccaaccaacaacaagtcgatgacttgttgttgtctctagacggtactgctaacaagtccaagttgggtgctaacgctatcttgggtgtttccttggctgcttccaaggccggtgctgctgccaagaacgtcccattgtaccaacatttggctgacttggccggtgctaagacccaaccattcgtcttgccagttccattcttgaacgtcttgaacggtggttcccacgctggtggtgctttggctttgcaagaatttatgattgctccaactggtgctgaaaccttcgctgaagccttgagaatgggttccgaagtttaccacaacttgaagtctttgaccaagaagagatacggtgcttctgccggtaacgtcggtgacgaaggtggtgttgctccaaacattcaaactgctgaagaagctttggacttgattgtcgatgctatcaaggctgctggttacgaaggtaagatcgatatcggtttggactgtgcttcttctgaattctacaaggacggtaagtacgacttggacttcaagaacccagaatccgacccatccaagtggttgtctggtccacaattggctgacttgtaccacgaattggtcaagaagtacccaattgtttccatcgaagatccatttgctgaagatgactgggaagcttggtctcacttctacaagaccgctggtgtccaaatcgttgctgacgatttgactgtcaccaacccagtcagaatcgctactgctatcgaaaagaaggctgccgatgctctattgttgaaggtcaaccaaatcggttctctatccgaatccatcaaggctgctaatgactccttcgctgctaactggggtgtcatggtctctcacagatctggtgaaactgaagacactttcattgctgacttggtcgtcggtctaagaactggtcaaattaagactggtgctccagctagatccgaaagattggctaaattgaaccaattgctaagaattgaagaagaattgggttccaacgctatcttcgctggtaagaagttccacaacggtaaccaattgtaa

SEQ ID NO: 4090 - protein, 437 aa, Kluyveromyces lactis
MPISKVYARSVYDSRGNPTVEVELTTEKGTFRSIVPSGASTGVHEALELRDGDKSKWLGKGVLTAVSNVNNIIAPALVKANVDVTNQQQVDDLLLSLDGTANKSKLGANAILGVSLAASKAGAAAKNVPLYQHLADLAGAKTQPFVLPVPFLNVLNGGSHAGGALALQEFMIAPTGAETFAEALRMGSEVYHNLKSLTKKRYGASAGNVGDEGGVAPNIQTAEEALDLIVDAIKAAGYEGKIDIGLDCASSEFYKDGKYDLDFKNPESDPSKWLSGPQLADLYHELVKKYPIVSIEDPFAEDDWEAWSHFYKTAGVQIVADDLTVTNPVRIATAIEKKAADALLLKVNQIGSLSESIKAANDSFAANWGVMVSHRSGETEDTFIADLVVGLRTGQIKTGAPARSERLAKLNQLLRIEEELGSNAIFAGKKFHNGNQL

SEQ ID NO: 4091 - DNA, 1293 bp, Listeria monocytogenes
  CDS (1)..(1293)
atgtctattattactgaagtttatgctcgcgaagtcttagattcccgtggtaacccaactgttgaggttgaagtttatactgaagctggtgcgtttggtcgcgctttagttccaagtggtgcttcaactggtgaatacgaagctgtagaattacgcgatggcgacaaagctcgttaccttggaaaaggtgttttaaaagctgttgaaaacgtaaacgacattattgctgacaaaattatcggttttgacgtaactgaccaaatcggaattgacaaagcaatgatcgaacttgatggtacacctaacaaaggtaaattaggtgctaacgctattcttggtgtttctttagctgctgctcgtgctgctgctgacgaactaggcgtacatttatatgaatatcttggcggagtgaacggtaaagttcttccagttccaatgatgaacatccttaacggcggagaacatgctgataacaatgtcgacgttcaagaatttatggtaatgcctgttggagctccaaactttaaagaagctctacgtatgggtgctgaaatcctacacgcacttaaagctgtacttaaaggtaaaggcttaaacactggtgttggtgatgaaggtggattcgctccaaaccttaaatccaatgaagaagctcttgaaacaatcatgcaagcaattaaagatgctggttacaaacctggcgaagaagttaaacttgcgatggatgctgcatcaagtgagttctataaccgcgaaactggtaaatacgaacttaaaggtgaaggcgtaactcgtacttctgaagaaatggtaacttggtatgaagaaatgattactaaatacccaatcatctctattgaagatggcctagacgaaaacgactgggacggattcaaactacttacagaacgtattggtgaccgcgttcaattagtaggtgacgatctatttgtaactaacacaactaaacttaaagaaggtatcgaaaaaggtatcgctaactccatcctaatcaaagttaaccaaatcggtactttgactgaaacattggatgcaattgaaatggctaaacgcgctggctacactgcagttatctctcaccgttctggtgaaacagaagattccacaatcgctgacattgcagtagctacaaacgctggtcaaatcaaaactggtgcgcctactcgtactgaccgtgttgcaaaatataaccaattactccgcatcgaagacaatttggctgatcttgctgaataccatggtaacgaaactttctacaacttaaaaaaataa

SEQ ID NO: 4092 - protein, 430 aa, Listeria monocytogenes
MSIITEVYAREVLDSRGNPTVEVEVYTEAGAFGRALVPSGASTGEYEAVELRDGDKARYLGKGVLKAVENVNDIIADKIIGFDVTDQIGIDKAMIELDGTPNKGKLGANAILGVSLAAARAAADELGVHLYEYLGGVNGKVLPVPMMNILNGGEHADNNVDVQEFMVMPVGAPNFKEALRMGAEILHALKAVLKGKGLNTGVGDEGGFAPNLKSNEEALETIMQAIKDAGYKPGEEVKLAMDAASSEFYNRETGKYELKGEGVTRTSEEMVTWYEEMITKYPIISIEDGLDENDWDGFKLLTERIGDRVQLVGDDLFVTNTTKLKEGIEKGIANSILIKVNQIGTLTETLDAIEMAKRAGYTAVISHRSGETEDSTIADIAVATNAGQIKTGAPTRTDRVAKYNQLLRIEDNLADLAEYHGNETFYNLKK

SEQ ID NO: 4093 - DNA, 1314 bp, Desulfovibrio vulgaris
  CDS (1)..(1314)
atgagcaccatcgtttccgtctgggcgcgcgagattcttgactcccgcgggaatcccaccatcgaggtcgaagtctccctcgaatccggccattccgggcgtgccgccgtgccgtccggtgcctccaccggcacccgtgaagccctcgaactgcgtgacggcgacaagggccgctacaagggcaagggcgtggagaaggccgtggacaacgtcatgggcgaaatcgccgaggccgtcatcgggctcgacgccctgcgtcaggtgcaactcgacaacacccttctcgacctcgacggcaccgacaacaaggaacgcctcggggccaatgccatgctgggcgtctcgctggcgaccgcccgtgccgcttcgagcttcctcggcctgccgctgtaccagtacctcggcggggtcaacgccaaggtgctgcccgtgccgctgatgaacatcatcaacggtggcgcgcacgcccccaacaacctcgacatccaggaattcatgatcatgcccatcggtgccgccaccttccgtgacgcgctccgcatgggtgccgagaccttccataccctcaaggccctgctcgccgccgacggtcacgtgaccagcgtgggcgacgagggcggcttcgcccccaacctcaagagccacgacgaggccttcaagtacatcacccgcgccatcgaggagtcgggctacatccccggcgccgaaatagcgctggccatcgacgccgccgcctccgagttctaccgcgacggcaagtaccatctggcgggtgagggcaagaccttctccaacagcgagatgaccgaatggctcggcgagttcaccgccaagtatccgctcatctccatcgaagacggccttgccgaaggcgactgggaaggctggggcgagctcacctacaagctgggcgacaccgtgcagcttgtgggcgacgacatcttcgtcaccaaccccgacatcctcgcgcagggcatcgatgaaggcgtggccaactccatcctcatcaagctgaaccagattggcacgctcaccgagaccctcgacaccatcgagatggcgaagcaggcggcctacaccacggtcatctcgcaccgttcgggcgagaccgaagaccacttcatcgccgacctcgccgtggggctcaacgccgggcagatcaagaccggctcgctgtgccgcagcgaccgtcttgccaagtacaaccagttgctgcgcatcgaagaggacctcgacgatgcgggcatctacttcggccccatgatcgcctcccacttcggctacgagggcgacgaagagttcgaggacgcctag

SEQ ID NO: 4094 - protein, 437 aa, Desulfovibrio vulgaris
MSTIVSVWAREILDSRGNPTIEVEVSLESGHSGRAAVPSGASTGTREALELRDGDKGRYKGKGVEKAVDNVMGEIAEAVIGLDALRQVQLDNTLLDLDGTDNKERLGANAMLGVSLATARAASSFLGLPLYQYLGGVNAKVLPVPLMNIINGGAHAPNNLDIQEFMIMPIGAATFRDALRMGAETFHTLKALLAADGHVTSVGDEGGFAPNLKSHDEAFKYITRAIEESGYIPGAEIALAIDAAASEFYRDGKYHLAGEGKTFSNSEMTEWLGEFTAKYPLISIEDGLAEGDWEGWGELTYKLGDTVQLVGDDIFVTNPDILAQGIDEGVANSILIKLNQIGTLTETLDTIEMAKQAAYTTVISHRSGETEDHFIADLAVGLNAGQIKTGSLCRSDRLAKYNQLLRIEEDLDDAGIYFGPMIASHFGYEGDEEFEDA

SEQ ID NO: 4095 - DNA, 1269 bp, Thermus thermophilus
  CDS (1)..(1269)
atgaccaccatcgtcggcgtccgggcacgcgaggttttggattccaggggctttcccacggtagaggcggaggtggagctggaaggcggggccaggggccgggccatggtgccctccggggcctccaccggaacccacgaggccctggagctcagggacggcggcaagcgctacctgggcaagggggtgcgccgggcggtggagaacgtcaacgagcgcatcgcccccgagctcgtcggcatggacgccctggaccaggaaggggtggaccgggccatgctggagctggacggcacccccaacaaggccaacctgggggcgaacgccgtcctcgcggtctccctggccgtggcccgggcggcggccgaggccctgggcctgcccctttaccgctacctgggcggggtccagggggtcaccctgcccgtgcccctcatgaacgtcatcaacggggggaagcacgccgacaaccgggtggacttccaggagttcatgctggtgcccgcgggggcgggaagcttcgccgaggccttgaggatcggggccgaggtcttccacaccctcaaggccgtcctcaaggagaagggctacagcaccaacgtgggggacgaggggggcttcgcccccgacctcaggagcaacgaggaggcggtggagcttttgctcctcgccattgagcgggcggggtacaccccgggccaggaggtctccctggccctggacccggccacgagcgagctttaccgggacgggaagtaccacctggagggggagggcaaggtcctctcctcggaggagatggtggccttctgggaggcctgggtggagaagtaccccatccgctccattgaggacggcctcgccgaggacgactgggaggggtggcggcttctcaccgagcgcctgggggggaaggtccagctcgtgggggacgacctcttcgtcaccaacccggaaaggctccgggcggggattgagcggggggtggccaacgccatcctggtcaaggtgaaccagatcgggaccctctcggagaccctcgaggccatccgcctggcccagcgctcggggtacagggcggtgatcagccaccgctccggggagacggaggacagcttcatcgccgacctcgccgtggcggtgaacgccggacagatcaagaccggttccctttcccgctccgaccggctggccaagtacaaccagctcctgcgcattgaggaggagctgggccgggccgcgaggtttttggggtatgccgccttttag

SEQ ID NO: 4096 - protein, 422 aa, Thermus thermophilus
MTTIVGVRAREVLDSRGFPTVEAEVELEGGARGRAMVPSGASTGTHEALELRDGGKRYLGKGVRRAVENVNERIAPELVGMDALDQEGVDRAMLELDGTPNKANLGANAVLAVSLAVARAAAEALGLPLYRYLGGVQGVTLPVPLMNVINGGKHADNRVDFQEFMLVPAGAGSFAEALRIGAEVFHTLKAVLKEKGYSTNVGDEGGFAPDLRSNEEAVELLLLAIERAGYTPGQEVSLALDPATSELYRDGKYHLEGEGKVLSSEEMVAFWEAWVEKYPIRSIEDGLAEDDWEGWRLLTERLGGKVQLVGDDLFVTNPERLRAGIERGVANAILVKVNQIGTLSETLEAIRLAQRSGYRAVISHRSGETEDSFIADLAVAVNAGQIKTGSLSRSDRLAKYNQLLRIEEELGRAARFLGYAAF

SEQ ID NO: 4097 - DNA, 1275 bp, Wolbachia pipientis wMel
  CDS (1)..(1275)
atgaataaggtaatcaataacgtatttgcaagagaaattttagatagcaggggttaccccactattgaggtagaaattgagctctgtgatggtgcaataggcagggcatctgtaccttctggagcttcaaccggtaaattagaagtcttggaactcagggaccaagatgagaaaaggtattgtggtaagggagtgctgaaagctgttcaagctgtaaatgggataatagcagatgaaatcattggaatgaatgcagcggaccaaaatgcaattgataaagcattaattgaactggatggaacaaaaaacaaatcaaaacttggagcaaatgcaactttgggtgtgtctcttgcagttgcaaaagcagcagcaaacagtttcaaaatgccgctatatagatatttgggaggaaagcagacgagtgttatgccggttccactcattaacataattaatggtggagtacatgcagacaataagctcgatttccaagaattcatgattcttccggtcggtgctgagactttcagcgaagcgattagaatatctgcggaggtattccacaacttacgtagcattcttaagaaaaaaggttatagcacaaatgtaggggatgaaggtggttttgcaccaaatattgaaagtactgaagaagcacttgatttgatcatatacgttatagaatcagcaggttattcagcgcaaagtgattttgcactaggccttgatgttgcttcatctactttttatgaagatggaatttacaaatttgaacacagagatcttacttcagaagagttgactgaatattattgtaatcttgtggaaagatatccaataatttctatagaagatgcaatgagtgaagacgactatgaaggttggaaattacttactgcaaaattggggagtaaaattcaattggttggggatgatttgtttgttacaaattgtgaactgatatgcaaaggaatagaggaaaaaatggcaaatgctgtactgatcaagccaaatcaaatagggacgttaacagaaacttttgctgctattgaaatggcaaaatcaaatggctataaagctgttgtttctcatcgctcaggtgaaacagaagacacaacaatatctcatatagcagttgcgtcaaattgcgggcaaataaaaaccgggtcgctatcgcgttctgatagactcgcgaagtataacgagctaatcagaatagaaagcgcattaggaaaggatgctaaatattatcgtgggttagcatgggttttatag

SEQ ID NO: 4098 - protein, 424 aa, Wolbachia pipientis wMel
MNKVINNVFAREILDSRGYPTIEVEIELCDGAIGRASVPSGASTGKLEVLELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYVIESAGYSAQSDFALGLDVASSTFYEDGIYKFEHRDLTSEELTEYYCNLVERYPIISIEDAMSEDDYEGWKLLTAKLGSKIQLVGDDLFVTNCELICKGIEEKMANAVLIKPNQIGTLTETFAAIEMAKSNGYKAVVSHRSGETEDTTISHIAVASNCGQIKTGSLSRSDRLAKYNELIRIESALGKDAKYYRGLAWVL

SEQ ID NO: 4099 - DNA, 1302 bp, Treponema denticola
  CDS (1)..(1302)
atgtctgatattatttatattgaaggccgcgagattttggattcgcggggaaatcctactgtagaggttgaggttcagttaagcgattttagctacggccgggcctgtgttccttcgggagcttctacgggagaatatgaagctttggaaatgagggacggcgataaaagccgctacatgggaaagggtgttttaaaggctgttgaccaagttaatacggttattgccgaagaacttgacggggctgatgctttggatcaggccgaaatagataatatgcttatcaatcttgacggcaccgaaaataaatccaagctcggagcaaatgctatgctcggtgtttcgatggctgtagcccgtgccgctgccgacagtttaggtttgccgctttaccgctatttgggaggcgttcatgcaatgcagatgccggttcccatggctaatatcataaacggcggccgccactccgacaataagatagattttcaggagtatatgattatgcccgtcggtgctccgtcaatccgtgaaggcataagaatgactgccgaggttttccatgccttaaaggatattctaaagaaggaaggccatgttacggctgtaggcgatgagggcggttttgctcccaatattgaaaatgttcaagccttggattatataatgaaggctatcgaaaaagcaggctacaaacccggaaaggatgtggtgatagctttggactgcgcttcttcagagctctttgatgctggagacagaaagggttacaagttctggaagtcggagccttctaaaattttaaatgccgacgagatggttgacctgtttaaagattggataagcaaatatccgattgtttctattgaagacccgctcgatcaaaacgattgggaaggctatgcaaagatgacaaaggaattgggaaatcaaattcagattgtgggtgacgacttttttgtaacaaacacaaaacggcttgcccgcggtattgaagaaggagcctgcaattctattttgataaagctcaaccaaatcggaaccgttaccgaaacaatcgatgccgtaagaatggctcaaaaggccggctacactgcggttatttcgcaccgctcaggcgagaccgaagatgcctttattgcagacttggctgttgcccttgaaaccggacaaattaaaaccggttcaatgagccgcagcgaccgcattgcaaagtataaccagcttatgaggattgaagatgagctcggctacaacgcccgctatgcaggtatggcaacctttgcaaacctgataaaaaaataa

SEQ ID NO: 4100 - protein, 433 aa, Treponema denticola
MSDIIYIEGREILDSRGNPTVEVEVQLSDFSYGRACVPSGASTGEYEALEMRDGDKSRYMGKGVLKAVDQVNTVIAEELDGADALDQAEIDNMLINLDGTENKSKLGANAMLGVSMAVARAAADSLGLPLYRYLGGVHAMQMPVPMANIINGGRHSDNKIDFQEYMIMPVGAPSIREGIRMTAEVFHALKDILKKEGHVTAVGDEGGFAPNIENVQALDYIMKAIEKAGYKPGKDVVIALDCASSELFDAGDRKGYKFWKSEPSKILNADEMVDLFKDWISKYPIVSIEDPLDQNDWEGYAKMTKELGNQIQIVGDDFFVTNTKRLARGIEEGACNSILIKLNQIGTVTETIDAVRMAQKAGYTAVISHRSGETEDAFIADLAVALETGQIKTGSMSRSDRIAKYNQLMRIEDELGYNARYAGMATFANLIKK

SEQ ID NO: 4101 - DNA, 1290 bp, Mycobacterium paratuberculosis
  CDS (1)..(1290)
atgccgattatcgagcaggtcggggcccgcgagatcctcgactcccgcggtaacccgacagtcgaggtcgagatcgccctgaccgacggaacgttcgcccgcgcggcggtgccgtccggggcgtcgaccggtgagcacgaggccgtcgaactgcgcgacggcggggagcggtacggcggcaagggcgtgcagaaggcggtgcaggccgtgctggacgagatcggcccggcggtgatcgggctgaacgccgacgaccagcgcctggtggaccaggcgctggtcgacctggacggcaccccggacaagtcgaggctgggcggcaacgcgatcctgggcgtgtcgctggccgtggccaaggcggccgccgattccgcggagttgccgctgttccgctacctgggcgggcccaacgcgcacatcctgccggtgccgatgatgaacatcctcaacggcggcgcgcacgccgacaccgccgtcgacatccaggagttcatggtcgccccgatcggcgcgccgagtttcgccgaggcgttgcgctggggtgcggaggtgtatcactcgctgaagtcggtgctgaagaaggagggcctgagcaccggcctgggcgacgagggcggcttcgcccccgacgtggcgggcaccaccgcggcgctggacctgatcggccgggccatcgaatcggccggcttcaaactcggcaccgacgtggcgctggccctcgacgcggcggccaccgagttctacagcgacggcaccggctacaagttcgagggcagcacccgcaccgccgagcagatggccgagttctacgccgggctgctcggcgcgtatccgttggtgtccatcgaagacccgctgtccgaagatgattgggacggctgggcggcgctgaccgcgtcgatcggcgaccgggtgcagctcgtcggcgacgacgtcttcgtcaccaatcccgaacgcctggaagagggtatcgagaagggcgtcgcaaatgcgttgctggtcaaggtgaatcagatcggcacgctgaccgagacgctggacgccgtcgcgctggcccaccacagcggctaccgcacgatgatgagccaccgcagcggtgaaaccgaggacaccacgatcgccgacctggcggtggccgtcggcagtgggcagatcaagaccggagcgccggcccgcagcgagcgggtggccaagtacaaccagctgctgcggatcgaggaggcgctcggcgacgccgcgcgttacgccggcgacctggccttcccgcggttcgcgttggagaccagatag

SEQ ID NO: 4102 - protein, 429 aa, Mycobacterium paratuberculosis
MPIIEQVGAREILDSRGNPTVEVEIALTDGTFARAAVPSGASTGEHEAVELRDGGERYGGKGVQKAVQAVLDEIGPAVIGLNADDQRLVDQALVDLDGTPDKSRLGGNAILGVSLAVAKAAADSAELPLFRYLGGPNAHILPVPMMNILNGGAHADTAVDIQEFMVAPIGAPSFAEALRWGAEVYHSLKSVLKKEGLSTGLGDEGGFAPDVAGTTAALDLIGRAIESAGFKLGTDVALALDAAATEFYSDGTGYKFEGSTRTAEQMAEFYAGLLGAYPLVSIEDPLSEDDWDGWAALTASIGDRVQLVGDDVFVTNPERLEEGIEKGVANALLVKVNQIGTLTETLDAVALAHHSGYRTMMSHRSGETEDTTIADLAVAVGSGQIKTGAPARSERVAKYNQLLRIEEALGDAARYAGDLAFPRFALETR

SEQ ID NO: 4103 - DNA, 1287 bp, Geobacter sulfurreducens
  CDS (1)..(1287)
atgagcgaaatcactgatgtttacgcgagggagatcctcgattcccgcggcaatcccaccctggaggtggaagtttttctggagtccggcgtcatgggccgtgcggctgttccctccggcgcctcgaccggtgagcgggaagctctggaactgcgggacggcgacgcctcacgttacctgggcaagggagttctcaaggccgtcgacaacgtgaacgacatcattgccgagcaactcatcggcatggaggccaccgaccaggtggggatcgaccggcggatgctggagctcgacggaacggaatacaagagcaccctgggggccaacgccattctcggcgtgtcgcttgccgttgccaaggccgcggccgaagaggtcggcctccccctctaccagtacatcggcggctgcaatgcccgggagcttcccctccccatgatgaacatcctcaacggcggtgcccacgccgacaacaacgtcgacatccaggagttcatgatcatgcccgccggtgcccggagcttttccgaagccctgcggatgggggccgaggtgttccacgcactgaagagcgtcctgaagggtaagggctacaatactgccgttggggacgaagggggcttcgcaccgaacctcaagtcgaacgaagaggcactcgaagtcatcatggaagccattgccaaggccggttacaaggcgggtgaggacatcctcctggccctcgacgtggcgtcgtcggagctgttcaaggacggcaagtacttccttgagaacgaggccaaacccgaaaaaaccgcagacgagctgatcgatttctatgagaacctggtgaacaagtatcccatcatctccatcgaggacggcatggccgagaacgactgggaaggatggaagaagatcaccgaccgcctcggcaaacgggtccaactggtgggagacgacctcttcgtaaccaatacgaagatcctcaaggaggggatcagcaagggtgtagccaactccatcctcatcaaactgaaccagatcggcacgctcaccgaaaccctcgacgccatcgagactgccaagcgcgccgggtacaccaccgtcatctcccaccgctccggcgaaaccgaggacacgacccttgccgacctggcggtggcggtgaacgccggacagatcaagaccggctccctgtgccggaccgaccgggtggccaagtacaaccagttgctcaggatcgaggatgaactggatgtgaccgcccagttccgcggtaaggatgtattctacaacctgcgttga

SEQ ID NO: 4104 - protein, 428 aa, Geobacter sulfurreducens
MSEITDVYAREILDSRGNPTLEVEVFLESGVMGRAAVPSGASTGEREALELRDGDASRYLGKGVLKAVDNVNDIIAEQLIGMEATDQVGIDRRMLELDGTEYKSTLGANAILGVSLAVAKAAAEEVGLPLYQYIGGCNARELPLPMMNILNGGAHADNNVDIQEFMIMPAGARSFSEALRMGAEVFHALKSVLKGKGYNTAVGDEGGFAPNLKSNEEALEVIMEAIAKAGYKAGEDILLALDVASSELFKDGKYFLENEAKPEKTADELIDFYENLVNKYPIISIEDGMAENDWEGWKKITDRLGKRVQLVGDDLFVTNTKILKEGISKGVANSILIKLNQIGTLTETLDAIETAKRAGYTTVISHRSGETEDTTLADLAVAVNAGQIKTGSLCRTDRVAKYNQLLRIEDELDVTAQFRGKDVFYNLR

SEQ ID NO: 4105 - DNA, 2421 bp, Lactobacillus johnsonii
  CDS (1)..(1287)
atgctcaaatcagttattgagaatgtacatgcacttgaaatctttgattcacgtggtaacccaactgttgaagttttcgttactctttcaaacggtgttgtaggtaaggctgaagttccatctggtgcttcaactggtgaaaacgaagctgttgaattacgtgatggtggttcacgtcttggtggtaaaggtgttatgaacgctgttaacaacgttaacactgaaatcaacgacgctttaaagggattagatccacatgatcaaccaaacatcgacgcaactatgattgctttagatggtactccaaacaagggccgtcttggtgctaacgctatcttaggtgtatctatggctactgctgctgcagctgctaaggataaccaccaaccattataccgttaccttggtggtactgaccttgaaatgcctcaaactttccacaacgttattaacggtggtgaacacgcagacaacggtatcgatattcaagaattcatgattaccccagttgctaagacttcattccgtgatggttttgaaaagattgttaacgtataccacactttgaagaaagttcttgaagatatgggttacgaaactggcttaggtgacgaaggtggtttcgctcctaacatgaagaactcagaagaagctttgaaggcattacatgaatcaatcatcaaggctggttacaagccaggtgaagatattgctattgcatgtgactgtgctgcttcatacttctacaacaaagaagacggcaagtaccaccttgaaggtaaagttcttactgacgaagaattggcagactactacgacaagttacttgacgaattcccagaattaatttctatggaagacccatacgatgaaaacgatgttgaaggtatggttaagtttactcaaagccacaaggaccgtatccaaatcgttcttgacgacttcatttgtactaaccctaagcttttgaacaaggctattcacgaaggtgctggtaacgcttcattaatcaagttgaaccaaatcggtactgttactgaaactcttgaaactattcgtctttcacgtaagaatggttacaacactatgatttctcaccgttcaggtgaaactggtgatactttcatcgctgacttcgcagttgctgttaacggtggtcaattgaagactggtgctccagctcgttcagaacgtgttgaaaagtacaaccgtttacttgaaatcgaagaagaacttggtaagggtgaacgtttagcattcttcccagacaacgttgacttagattaatataagttgatattaaaaaaagagattgatttttgatcaatctctttttttgtgcttgagataactataaaaagtaagtaaactagataacatagtatagaaaggaagattagttgaaaaagaaaattagatcttttgataataagactgtattaacgattggacgaattggctcagttttatctgttctaatgtatgtttcttatattccacaaattatgaataatttgcaaggaaattacggcaatcctattcagccattagtcgcagccattaactgccttatttgggttctgtatgctctcttaagagagaaaaaggattggccgttgtttgtagctaactttccggggattttatttggattagctacattcattaccagtttgcattaaattttcataaaaagactttctataatgtgttataactaaaaaattagatgtaagagaggaaaataatttgattactgtctcagatttaagtttaaatttatctggtcgtaccttatacgaagatgttaacttgaaattcactcccggtaattgttatggagtaatcggtgctaatggtgccggtaagtcaacttttttgaaactgttagaaggtaagattgaacctactactggtaatatttctattgatgctaatgaaagaatgtcgagcttgaatcaagatcactttgctttcgaagaatttactgttttagatacagtaattcaggggcataaagaactttatcaagtaatgaaagataaggatgagctttattctaaggctgattttagcgatgaagatggagttaaggctgcagaattagaatctaaatttgctgaacttgacggttggaacgccgaagcagacgcatctaagcttttgcagtctttaggtataccagaagagttgcatcaaagtaagatgagtgaattaccagaagcggaaaaagttaaagtattattagcacaagccttatttggtaatcctgatattcttttaattgatgagcccactaacggtttagatgttcatactgtaaactggcttgaagactttttagccgattatccaaatattgttattgtagtttcccacgacccgtcacttcttaaatcaagtatgtacacaaatgtgtga

SEQ ID NO: 4106 - protein, 428 aa, Lactobacillus johnsonii
MLKSVIENVHALEIFDSRGNPTVEVFVTLSNGVVGKAEVPSGASTGENEAVELRDGGSRLGGKGVMNAVNNVNTEINDALKGLDPHDQPNIDATMIALDGTPNKGRLGANAILGVSMATAAAAAKDNHQPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKEDGKYHLEGKVLTDEELADYYDKLLDEFPELISMEDPYDENDVEGMVKFTQSHKDRIQIVLDDFICTNPKLLNKAIHEGAGNASLIKLNQIGTVTETLETIRLSRKNGYNTMISHRSGETGDTFIADFAVAVNGGQLKTGAPARSERVEKYNRLLEIEEELGKGERLAFFPDNVDLD

SEQ ID NO: 4107 - DNA, 1299 bp, Lactobacillus johnsonii
  CDS (1)..(1299)
atgtctgttattactgatattcacgcacgtgaagttcttgactctcgtggtaatccaactgttgaagctgaagtttacactgaattaggtggctttggtcgtgctatcgtaccatctggtgcttctactggtgaacatgaagcagtagaattacgtgatggtgacaagtctcgttttcttggtcaaggtgttttaactgctgttgaaaacgttaatggtgaaattgcaaaagctgttattggcttagatgtaactgatcaacgtttaattgaccaaactatgattgaccttgacggtactccaaacaagggtcgtttaggtgctaacgctatgttggctgtttcattagcaagtgcacgtgctgcagctgatgaattaggtttacctttatacgaatacttaggtggaccaaacgctcatgttttaccaactccaatgatgaatgttattaacggtggtaagcacgccgataacaacgttgatatccaagaattcatgattatgccagttggtgctaagtctcttcatgaagctgttcgtatgggtgcagaaactttccatactttgaagagcttgcttcaagaacgtggtgaatcaactgctgtaggtgacgaaggtggttttgcaccaaacttgaagaacaacgaagaaccatttgaaattttagttgaagctattcaacgtgctggctacaagcctggtcaagatatttctattgcatttgactgtgcagcttctgaattctacaacaaggatactaagaagtatgtgactgttgctgacggccgtgaatacactgctgaagaatggacttcacttatggaagacatcgttgacaaatacccagttatttccattgaagatcctttggacgaaaacgattgggaaggttggaaagtcttcactgaacgtttaggtgataaggtacaaatcgttggtgacgatttattcgtaactaacactaactaccttgaaaagggtattaagatgggtgttgctaactcaatcttaattaagcttaaccaaatcggtactttgactgaaacttttgaagctattgaaatggctaaggaagcaggctacactgctgttgtttctcaccgttctggtgaaactgaagatactacaattgctgatttagttgttgcaactaatgctggtcaaattaagactggttcaatgtcaagaactgatcgaattgctaagtacaaccaattaatgagaattgaagaagctttgggttcaactgctcaatacaaaggaattcacagtttctacaacttacacaaacaattttaa

SEQ ID NO: 4108 - protein, 432 aa, Lactobacillus johnsonii
MSVITDIHAREVLDSRGNPTVEAEVYTELGGFGRAIVPSGASTGEHEAVELRDGDKSRFLGQGVLTAVENVNGEIAKAVIGLDVTDQRLIDQTMIDLDGTPNKGRLGANAMLAVSLASARAAADELGLPLYEYLGGPNAHVLPTPMMNVINGGKHADNNVDIQEFMIMPVGAKSLHEAVRMGAETFHTLKSLLQERGESTAVGDEGGFAPNLKNNEEPFEILVEAIQRAGYKPGQDISIAFDCAASEFYNKDTKKYVTVADGREYTAEEWTSLMEDIVDKYPVISIEDPLDENDWEGWKVFTERLGDKVQIVGDDLFVTNTNYLEKGIKMGVANSILIKLNQIGTLTETFEAIEMAKEAGYTAVVSHRSGETEDTTIADLVVATNAGQIKTGSMSRTDRIAKYNQLMRIEEALGSTAQYKGIHSFYNLHKQF

SEQ ID NO: 4109 - DNA, 1314 bp, Ashbya gossypii
  CDS (1)..(1314)
atggctatttccaaggtctacgctagatccgtgtacgattcccgtggtaacccaaccgtcgaggttgaggtgaccaccgagaacggcactttcagatcgattgttccatccggtgcttccaccggtgtccacgaggctcttgagttgagagacggtgacaagtccaagtggttgggcaagggtgtgaccaaggccgtgtccaacgtcaacgacatcatcgctccagctttgctatccgccaacgtcgacgtcaaggaccagaaggccgttgacgctttgatgttgaccttggacggcactccaaacaagagcaagttgggtgctaacgccatcttgggtgtctccatggctgttgccaaggctgctgctgctgagaagaaggtgccattgtaccagcacttggctgacttggctggctcttccaccactccattcgtgttgccagttccattcttgaacgttttgaacggtggctctcacgccggtggtgctttggctctacaggagttcatgatcgccccaaccggtgctgagtctttctccgaggctttgagaatgggctctgaggtctaccacaacttgaagtctttgaccaagaagagatacggtgcctccgccggtaacgtcggtgacgagggtggtgttgctccaaacatccagactgccgaggaggctttggacttgattgtcgacgccatcaaggctgccggctacgagggcaagatcgacattgccttggactgtgcttcttccgagttcttcaaggacggtaagtacgacttggacttcaagaacccagagtccgactcttccaagtggttgtctggccaggagttggctgacctatacaagaagttggtcgagaagtacccaattgtctccatcgaggacccattcgctgaggacgactgggaggcttggtctcacttctacaagaacgctggtgtccagattgtcgctgacgacttgaccgtcaccaacccaactagaattgccactgctattcagaagaaggccgccgacgctttgttgttgaaggtcaaccagattggttctttgactgagtctatccaggccgccaaggactctttcgacgccacctggggtgtcatggtctctcacagatctggtgagactgaggacactttcattgccgacttggttgtcggtttgagaaccggccagatcaagactggtgctccagccagatctgagagattggccaagttgaaccagttgttgagaatcgaggaggagttgggctccaaagctatctacgctggtaagaagttccacaacgctaacaagttgtaa

SEQ ID NO: 4110 - protein, 437 aa, Ashbya gossypii
MAISKVYARSVYDSRGNPTVEVEVTTENGTFRSIVPSGASTGVHEALELRDGDKSKWLGKGVTKAVSNVNDIIAPALLSANVDVKDQKAVDALMLTLDGTPNKSKLGANAILGVSMAVAKAAAAEKKVPLYQHLADLAGSSTTPFVLPVPFLNVLNGGSHAGGALALQEFMIAPTGAESFSEALRMGSEVYHNLKSLTKKRYGASAGNVGDEGGVAPNIQTAEEALDLIVDAIKAAGYEGKIDIALDCASSEFFKDGKYDLDFKNPESDSSKWLSGQELADLYKKLVEKYPIVSIEDPFAEDDWEAWSHFYKNAGVQIVADDLTVTNPTRIATAIQKKAADALLLKVNQIGSLTESIQAAKDSFDATWGVMVSHRSGETEDTFIADLVVGLRTGQIKTGAPARSERLAKLNQLLRIEEELGSKAIYAGKKFHNANKL

SEQ ID NO: 4111 - DNA, 1504 bp, Penicillium chrysogenum
  CDS (39)..(1355)
aactgactgaatccataatcagcctgtccaattccaacatgcctatctctaagatccacgctcgctccgtgtacgactcgcgcggcaaccccaccgttgaggtggatgttgtcaccgagaccggccttcaccgcgccattgtcccctccggtgcttccactggcctgcacgaggtcgttgagctccgcgatggtgacaagaccaagtggggtggtaagggtgtcctcaacgccgtcaagaacgtcaacgacgtcattggccccgccctcatcaaggagaacatcgacgttaaggaccaggccaaggttgacgagttcctgaacaagcttgatggaacccccaacaagggcaagctcggtgccaacgccatcctcggtgtttctctcgccgttgccaaggctgccgccgctgagaagggtgttcccctctacgctcacatctccgaccttgccggaaccaagaagcccttcgtcctgcccgtccccttccagaacgtcctgaacggtggctcccacgccggtggccgtctcgccttccaggagttcatgattgttcccgacactgcccccactttctccgagggtctccgccagggtgctgaggtctaccaggagctcaaggctctcgccaagaagaagtacggtcagtccgccggtaacgtcggtgacgagggtggtgtcgctcctgatattcagaccgccgaggaggctctcgacctcatcaccgaggccattgagcaggctggctacactggccagatcaagattgccatggatgttgcctccagcgagttctacaaggaggatgccaagaagtacgatcttgacttcaagaatcccgagagcgaccccaccaagtggctcacctacgagcagcttgccgacctctacaagtccctcgctgccaagtaccccattgtctccatcgaggaccccttcgctgaggacgactgggaggcctggagctacttctacaagacctccgacttccagatcgtcggtgatgacttgactgtcaccaaccctctgcgcattaagaaggccattgagctcaagtcctgcaacgcccttctcctgaaggtcaaccagatcggtaccttgaccgagtctatccaggccgccaaggactcctatgccgacggctggggtgtcatggtctcccaccgctccggtgagaccgaggatgtcaccattgctgacatcgctgttggtctccgtgccggtcagatcaagaccggtgcccctgcccgttccgagcgtcttgccaagcttaaccagatcctccgcattgaggaggagcttggtgccaacgctgtctacgccggcgagaagttccgcactgctgtcaacctgtaaatgcagcctttcggcagcatagatcgggcctgatgagggcccatcaaaaacgatggtttgatgatctacggagccgtcgcccatgatgattatgaatttaataggatctttttcaatgaaaacaaattcaatcactgaaaaaaaaaaaa

SEQ ID NO: 4112 - protein, 438 aa, Penicillium chrysogenum
MPISKIHARSVYDSRGNPTVEVDVVTETGLHRAIVPSGASTGLHEVVELRDGDKTKWGGKGVLNAVKNVNDVIGPALIKENIDVKDQAKVDEFLNKLDGTPNKGKLGANAILGVSLAVAKAAAAEKGVPLYAHISDLAGTKKPFVLPVPFQNVLNGGSHAGGRLAFQEFMIVPDTAPTFSEGLRQGAEVYQELKALAKKKYGQSAGNVGDEGGVAPDIQTAEEALDLITEAIEQAGYTGQIKIAMDVASSEFYKEDAKKYDLDFKNPESDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADIAVGLRAGQIKTGAPARSERLAKLNQILRIEEELGANAVYAGEKFRTAVNL

SEQ ID NO: 4113 - DNA, 1269 bp, Wolinella succinogenes
  CDS (1)..(1269)
atgatttatatcgataatattgttgctcaagaagtcatggatagccgaggcaatccgaccgtcaaagccaccgtgaccctaagcgatggaaatagcgccagcgctatcgttccaagtggtgccagcacagggaaaagggaggctttggagcttcgagacggcgattctcgatatttaggcaagggagtcttgcaggcctgcgaaaatgtcaacaccaagctctccgaggagctcatcggattgagcccttttgatcagagtgagattgacgccattatccaagaattagatggcacggaaaactttgccaatatcggcgccaatgccgctcttggagtctctatggcagtggctagaagcgcggcgaaaagcctcaatattcctctttatcgctatcttggcggagccaatgccctcaccctgcccgtccccatgctcaacatcatcaacggcggaagccatgccgataacacggtggattttcaagagtatatgatcatgcccctaggctttgagaacttctccgaatcgcttcgcgctagcgccgaagtctatcatcacctcaaaaagattctcaaagattccaaacatatcaccagcattggagatgaggggggctttgcacccaacctcaaaactaatgaagagcccatccaaatcatcatacaggcgattgagaaagcgggttatcgacccggcgaagagatcgctctcgcccttgatgtcgctagcagcgagtttgtcaacgagcaaggcctctatcacctcgagggagaaggacgcacgcttagcagtgaggagcttgtgggctattatgaatctctcatcgccaaatatcccattgtctccattgaagatggtctgagcgaagatgattggaaaggatggaaatatctcaccgagagattgggcggcaaagttcagcttgtaggggatgatctcttcgtcaccaacgccaaaatcctccaagagggaatctctcaaggaatcgccaatgcgattctcattaagcccaaccaaattggaaccgtgagccaaaccatgcagaccgttcgattggctcaaagaaatcactatcgatgcgtgatgagtcaccgaagtggcgaaagtgaagattcctttattgccgattttgccgtagcgctcaacacaggcgaaatcaaaacaggctccaccgcccgaagcgaacgaatcgccaaatataatcgcctgcttgccattgagagcgagctttgccgctctgaatatcttggccgctctcttttttaa

SEQ ID NO: 4114 - protein, 422 aa, Wolinella succinogenes
MIYIDNIVAQEVMDSRGNPTVKATVTLSDGNSASAIVPSGASTGKREALELRDGDSRYLGKGVLQACENVNTKLSEELIGLSPFDQSEIDAIIQELDGTENFANIGANAALGVSMAVARSAAKSLNIPLYRYLGGANALTLPVPMLNIINGGSHADNTVDFQEYMIMPLGFENFSESLRASAEVYHHLKKILKDSKHITSIGDEGGFAPNLKTNEEPIQIIIQAIEKAGYRPGEEIALALDVASSEFVNEQGLYHLEGEGRTLSSEELVGYYESLIAKYPIVSIEDGLSEDDWKGWKYLTERLGGKVQLVGDDLFVTNAKILQEGISQGIANAILIKPNQIGTVSQTMQTVRLAQRNHYRCVMSHRSGESEDSFIADFAVALNTGEIKTGSTARSERIAKYNRLLAIESELCRSEYLGRSLF

SEQ ID NO: 4115 - DNA, 1278 bp, Porphyromonas gingivalis
  CDS (1)..(1278)
atggaaattgcaaagattattggcagggagatcctcgattccagaggcaatccgacggttgaggtagatgtacacctggcctgtggcataataggacgcgcggctgtacccagcggagcttccaccggtgagaatgaggctatcgagcttcgcgatcaggataaggctcgctactgtggcaaaggtgtcctcaaggctgtgaagaacgtaaatgaagtgatagatcccgcactctgcggaatgtctgtattggaacaaacagctattgaccgcaagctcatcgaattggatggcaccaaaacgaaaagcaacctcggagcaaatgccatgctgggcgtatcactggccgtagccaaagcagctgcagcttatttggatattcctctctaccgatatatcggcggttcgaacacctatgtcctgcctgttcctatgatgaatatcatcaacggcggttctcactcggacgctcctatcgcattccaggagttcatgatccgccctgtgggagcatgctgcttccgtgagggcttgcgcatgggtgccgaagttttccatgcactcaaaaaggtgcttcacgatcgtggtctgagtactgcagtcggggatgaaggaggttttgctcctgccctgaatggtacggaagatgctatcgaatcaatcctcaaggctgtggaagctgccggatacgtgcccggtaaggatattaccatcgcaatggactgcgcctcttccgagttcttcaaggatggtatttacgactacactaagttcgaaggcgaaaagggcaagaaacgctctatcgatgagcaggtggcttatctgaccgaactggttggcaagtatcccatcgattctatcgaagacggtatgagcgaaaatgactgggaaggatggaagaagctgaccgtagctttgggagataaggttcagctcgtcggcgacgatctcttcgttaccaacgtggaattccttcgccgtggtatcgccgagaagtgcggcaactccatccttatcaaggtaaaccagattggtacgctcacagagaccctgaatgccatcgagatggcacaccgtcacggctttaccagcgttacttcgcaccgctccggagagacagaagacaccactatcgcagacattgctgtagcaaccaactcgggacagatcaagacgggatcgctcagtcgtaccgaccgtatggctaagtacaaccaactgctccgcatcgaagaggagttaggcccttgcgctgtatacggctacaagaaagtgtaa

SEQ ID NO: 4116 - protein, 425 aa, Porphyromonas gingivalis
MEIAKIIGREILDSRGNPTVEVDVHLACGIIGRAAVPSGASTGENEAIELRDQDKARYCGKGVLKAVKNVNEVIDPALCGMSVLEQTAIDRKLIELDGTKTKSNLGANAMLGVSLAVAKAAAAYLDIPLYRYIGGSNTYVLPVPMMNIINGGSHSDAPIAFQEFMIRPVGACCFREGLRMGAEVFHALKKVLHDRGLSTAVGDEGGFAPALNGTEDAIESILKAVEAAGYVPGKDITIAMDCASSEFFKDGIYDYTKFEGEKGKKRSIDEQVAYLTELVGKYPIDSIEDGMSENDWEGWKKLTVALGDKVQLVGDDLFVTNVEFLRRGIAEKCGNSILIKVNQIGTLTETLNAIEMAHRHGFTSVTSHRSGETEDTTIADIAVATNSGQIKTGSLSRTDRMAKYNQLLRIEEELGPCAVYGYKKV

SEQ ID NO: 4117 - DNA, 1302 bp, Photorhabdus luminescens
  CDS (1)..(1302)
atgtccaaaatcgttaaagtgatcggtcgtgaaatcattgactcccgtggtaacccaactgtagaagcagaagtgcatctggaagggggctttgtgggtttagcggctgcaccctctggtgcatctaccggttctcgcgaagcgttggaactgcgtgacggtgacaaatcccgttttatgggtaaaggtgtattgaaagctgttgatgcagtaaatggcccgattgcacaggcagttatcggccaggatgcgaaagatcaggctaacatcgacaaaatcatgatcgacctggatggtactgaaaataaatctcaattcggtgctaatgcgattctggcggtttctctggctaatgcgaaagccgcagcagcagcgaaaggtatgccgttgtacgagcacattgctgaattgaatggcactccgggtaaattctctatgccgttgccgatgatgaacatcatcaatggtggtgagcacgcggataacaacgttgatatccaggaatttatgattcaaccgattggagcaaaaacgctgaaagaggcggttcgtatcggttctgaagttttccataacttggctaaagttctgaaagcaaaaggcatgagtactgcggttggtgacgaaggtggttatgcgcctaacttggaatctaacgctgctgcgctggctgctattaaagaagcggtagaacaagcaggctatgttctgggcaaagatgtcactttggctatggattgtgctgcttctgaattctacaacccagaaaccggtaattacgaactgaaaggtgaaggtaaaactttcacttctcaagagttcactcattacctcgaagatttgaccagaaaatatccgattgtttctattgaagatggcttgaatgaatctgactgggaaggcttcgcttaccagacaaaagtgctgggcgaaaaaatccagttggttggtgatgacctgtttgttaccaatactaagatcctgaaagaaggtattgagaaaggcattgctaactccattttgattaaattcaaccagattggttctctcactgaaacactggcagcgattaaaatggcaaaagacgcaggttacacggcggtaatttctcatcgttctggtgaaactgaagatgcgactattgctgatctggcagtaggtaccgcggcaggtcaaatcaaaaccggttctatgagtcgctctgatcgcgttgctaaatacaatcagttgatccgtattgaagaagctttgggtaaccgcgctcctttctatggcctgaaagaagtaaaaggtcaggcttaa

SEQ ID NO: 4118 - protein, 433 aa, Photorhabdus luminescens
MSKIVKVIGREIIDSRGNPTVEAEVHLEGGFVGLAAAPSGASTGSREALELRDGDKSRFMGKGVLKAVDAVNGPIAQAVIGQDAKDQANIDKIMIDLDGTENKSQFGANAILAVSLANAKAAAAAKGMPLYEHIAELNGTPGKFSMPLPMMNIINGGEHADNNVDIQEFMIQPIGAKTLKEAVRIGSEVFHNLAKVLKAKGMSTAVGDEGGYAPNLESNAAALAAIKEAVEQAGYVLGKDVTLAMDCAASEFYNPETGNYELKGEGKTFTSQEFTHYLEDLTRKYPIVSIEDGLNESDWEGFAYQTKVLGEKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGNRAPFYGLKEVKGQA

SEQ ID NO: 4119 - DNA, 1428 bp, Mycoplasma gallisepticum
  CDS (1)..(1428): trans_table 4
atggcaaagacaaacagtactagcaaaaacaataaattagaaataaagagtgtttttgcataccaagcatttgattcaagaggttttcctacagttgcttgtgaagttgttttaaacgacggatctaaaggattatcaatggtttcatctggtgcttcaactggtgaaaaggaagctttagaattaagagatggtggcactaaatatcatggtaaaggtgtaactaaagctgttaataatattaacaaaaagattggtccaaaaatcttaggtgttgatgctactttacaaactcagatcgatgagttcatgattgaattagacggtactaagactaaagctaaattaggtgcaaatgcaatcttagcagtatcaatggctgtatgtagagcagctgctaaatcattaaatctacctttatatcaatacattgctaagaaagtggcaaaagttaagggtgctgatttcatcttaccagttcctatgttaaacgtaattaacggtggagctcacgctgataacacaatcgacttccaagagttcatgattatgccagttggtgcaaaaacgatggctaaagcgttacaaatggctagtgaagtgttccactcactacaaaaactacttaaagctaagaagtttaacactaacaaaggtgatgaaggtggttttgcgcctaacttaaaatcagctgaagaagcacttgatttaatgagtcaagcagttgttgatgctgggtatgctttaggtaaggatgttgcgtttgcacttgactgtgcagctagtgaattctacagcaaagaaaagcaagcttatgtctttaaaaaagcagtaaaagctggaattctttctgaagaaaaaggtactaaaacaactgaacaattaattagttacttagaagatttaactaagaaatatccaatcgtttcaatcgaagatggtttagatgaaaacgactgaaaagggatggaatcactaactaaaaagatcggtaagaaagtacagatcgttggtgatgacacttactgtacaaaccctgaattaacttctaagggtgtttcattatcagcgactaactcagtattaattaagttaaaccaaatcggaacattaactgaaacgatccaaacaattaatattgctaaaaaagcaaactgaacggctgtagtttctcaccgttcaggtgaaactgaagatgctttcattgctgatttagctgtagctctaagtacaggtcagatcaagactggttcaatgtcacgatctgaaagaattgctaaatacaaccgtttattagcaattgaaatgcaattaggtaataaagctaaatatctaggaagtaaaactttctataacctaagcacacctgctgcaacacctaaaaagagtccagctaaaaaaacaacaaaagcaaaatcaaaaaaataa

SEQ ID NO: 4120 - protein, 475 aa, Mycoplasma gallisepticum
MAKTNSTSKNNKLEIKSVFAYQAFDSRGFPTVACEVVLNDGSKGLSMVSSGASTGEKEALELRDGGTKYHGKGVTKAVNNINKKIGPKILGVDATLQTQIDEFMIELDGTKTKAKLGANAILAVSMAVCRAAAKSLNLPLYQYIAKKVAKVKGADFILPVPMLNVINGGAHADNTIDFQEFMIMPVGAKTMAKALQMASEVFHSLQKLLKAKKFNTNKGDEGGFAPNLKSAEEALDLMSQAVVDAGYALGKDVAFALDCAASEFYSKEKQAYVFKKAVKAGILSEEKGTKTTEQLISYLEDLTKKYPIVSIEDGLDENDWKGMESLTKKIGKKVQIVGDDTYCTNPELTSKGVSLSATNSVLIKLNQIGTLTETIQTINIAKKANWTAVVSHRSGETEDAFIADLAVALSTGQIKTGSMSRSERIAKYNRLLAIEMQLGNKAKYLGSKTFYNLSTPAATPKKSPAKKTTKAKSKK

SEQ ID NO: 4121 - DNA, 1278 bp, Gloeobacter violaceus
  CDS (1)..(1278)
atgctgattacatcgatcgaagcgcacgaaattctcgattcacggggcaatccgaccgtcgaagcacaggtggcgcttgaaaacgggacgaccggctcggccatcgttccttcgggcgcctccaccggcgaaaaagaagcggtggagttgcgcgacagcgatccgaagcgctacggcggcaaaggggtgctgagcgccgtggccaacgtcaacgactcgatcgcccccgaaattatcggcatggaagtcaccgaccagcgcagcatcgaccgcaagatgatcgaaatcgacggtaccgccaacaaagccaccctcggcgccaacgcgatcttggcggtctcgatggcggtggcacgcaccgccgctctctcgctggggctgcctctctatcgctatttgggcggtacgaacgcctcgctgttgccggtaccctgcatgaacgtgatcaacggcggcaagcacgccgacaacaccgtcgattttcaagaatttatgatcgccccgcacaacgcacccaattttgccgaggcactacgcatgggagctgagactttccatgccctcaaatcgatcctgcgcggcaaaggctacagcacgggcgtgggcgacgaaggcggctttgcccccgatctcaagtccaacgaagaggcggtcgaagtgattttgcttgcgatcgaaaaggccggctaccggcccggcgaggacatctcgatctgtcttgacccggccaccagcgagatgtggaaggacggcaagtacttgttcttcaagtccgaccagtccaccaagacctccgaggaaatggtcgatctgtgggcttcctgggcaggccagtatccgatcgtttcgctcgaagacggcatgggtgagaacgattgggaaggctggaaaatgctcaccgaccgcatcggtgccactgtcgagctggtaggagacgacctgttttgcactaacgctaaaattcttgccgaaggcatcgaaaagggtgtcgccaattccattttgatcaaattgaatcagatcggttcggtcagcgagacgctcgacaccatcgaactggccgtcaagcacaactacaaatgttttgtctcccatcgctccggcgagaccgaggacacgaccattgcggatctgaccgtggcgaccgccgcgggccagatcaagaccggctccggctgccgcagtgagcgggtggccaagttcaaccagttactgagaatcgagcgccagctcggcgaggcggcccgcttcgcgggcaagtccgcctttgcgcgttag

SEQ ID NO: 4122 - protein, 425 aa, Gloeobacter violaceus
MLITSIEAHEILDSRGNPTVEAQVALENGTTGSAIVPSGASTGEKEAVELRDSDPKRYGGKGVLSAVANVNDSIAPEIIGMEVTDQRSIDRKMIEIDGTANKATLGANAILAVSMAVARTAALSLGLPLYRYLGGTNASLLPVPCMNVINGGKHADNTVDFQEFMIAPHNAPNFAEALRMGAETFHALKSILRGKGYSTGVGDEGGFAPDLKSNEEAVEVILLAIEKAGYRPGEDISICLDPATSEMWKDGKYLFFKSDQSTKTSEEMVDLWASWAGQYPIVSLEDGMGENDWEGWKMLTDRIGATVELVGDDLFCTNAKILAEGIEKGVANSILIKLNQIGSVSETLDTIELAVKHNYKCFVSHRSGETEDTTIADLTVATAAGQIKTGSGCRSERVAKFNQLLRIERQLGEAARFAGKSAFAR

SEQ ID NO: 4123 - DNA, 1305 bp, Fusobacterium nucleatum subsp
  CDS (1)..(1305)
atgacaggaatagtagatgtaattggaagagaaattttagattcaagaggaaatccgacagtagaagtagatgtaatattagaatgtggtgtaaaaggtagagcagctgttccatctggtgcttcaactggaagccatgaagcagttgagttaagagatgaagataaaacaagatatttaggaaaaggagttttaaaagctgtaaataatgtaaatactgaaattagagaagctcttttaggaatggatgctttaaatcaagttgaaattgatagagtaatgctagaattagatggaactgctaataaaggaagattaggagctaatgctatattaggtgtatctcttgctgtatcaaaagcagcagcagaagcattgggactacctttatataaatatttaggtggagtgaatgcaaaagaattaccactacctatgatgaatattttaaatggtggagcacatgctgattcagcggttgacttacaagaatttatgatacaaccagttggagctaaatcatttagagaagctatgcaaatgggagcagaagttttccatcatttaggaaaaattttaaaagctaatggagattcaacaaatgttggaaatgaaggaggatatgctccatcaaagattcaagggacagaaggagctttatctttaattagtgaagcagtaaaagctgctggttatgaattaggtaaagatatcacatttgcattagatgctgcttcaagtgaattttgtgaaaaagtaaatggagaatatcaatatcattttaaaagagaaggtggaattattagaaacactgatgcaatgataaaatggtatgaagaattaataaataaatatccaatagtttcaatagaagatggtttaggtgaagatgactgggatggttgggtaaaactaactaaggctattggagatagagttcaaatagttggagatgacttatttgtaactaatactgaaagattgaaaaaaggaatagaattaggagcaggaaactctatccttataaaattaaatcaaataggttcattaactgaaacattagatgcaatagaaatggcgaaaagagcaggatatacagctgttgtgtctcatagatcaggagaaacagaagatgcaacaatagctgatgtagctgttgcaaccaatgctggacaaattaaaactggttcaacttcaagaactgatagaatggctaaatacaaccaattattaagaatagaagaagaattagggtctgttgctcaatataaaggtagagatgtattctacaatataaagaaataa

SEQ ID NO: 4124 - protein, 434 aa, Fusobacterium nucleatum subsp
MTGIVDVIGREILDSRGNPTVEVDVILECGVKGRAAVPSGASTGSHEAVELRDEDKTRYLGKGVLKAVNNVNTEIREALLGMDALNQVEIDRVMLELDGTANKGRLGANAILGVSLAVSKAAAEALGLPLYKYLGGVNAKELPLPMMNILNGGAHADSAVDLQEFMIQPVGAKSFREAMQMGAEVFHHLGKILKANGDSTNVGNEGGYAPSKIQGTEGALSLISEAVKAAGYELGKDITFALDAASSEFCEKVNGEYQYHFKREGGIIRNTDAMIKWYEELINKYPIVSIEDGLGEDDWDGWVKLTKAIGDRVQIVGDDLFVTNTERLKKGIELGAGNSILIKLNQIGSLTETLDAIEMAKRAGYTAVVSHRSGETEDATIADVAVATNAGQIKTGSTSRTDRMAKYNQLLRIEEELGSVAQYKGRDVFYNIKK

SEQ ID NO: 4125 - DNA, 1317 bp, Neurospora crassa
  CDS (1)..(1317)
atgcccatctccaagatccacgctcgctacgtctacgactctcgtggcaacccgaccgttgaggttgacgttgttactgagctcggccttcaccgcgccattgtcccctccggtgcctccactggccagcacgaggcttgcgagctccgcgatggtgacaagaccaagtggggtggcaagggtgttctcaaggccgtccagaacgtgaacgaggtcatcggccccgctctcatcaaggagaacattgacgtcaaggaccagtccaaggttgacaagttcctcatcgacctcgatggcacccccaacaagaccaagctcggcgccaacgccatcctcggtgtctcgctcgccgttgccaaggccggtgctgctgagaagggcgttcccctttacgctcacatctccgaccttgctggcaccaagaagccctatgtccttcccgttcccttcatgaacgtcctcaacggcggttcccacgctggtggccgtctcgccttccaggagttcatgatcgtcccctccgccgctcctaccttctctgaggcccttcgtcagggtgctgaggtgtaccagatcctcaagagcctcgccaagaagaagtacggccagtccgctggtaacgtcggtgacgagggtggtgtcgctcccgatatccaaaaccccgaggaggccctcgaccttatcaccgaggccattgagaaggccggctacactggccaggtcaagatcgccatggatgtcgcttccagcgagttctacaaggaggacgtcaagaagtacgacctcgacttcaagaaccccgagtccgacccctccaagtggctcacctacgaggagctcgccaacctctactccgagctctgcaagaagtaccccatcgtctccatcgaggaccccttcgctgaggatgactgggaggcctggagctacttctacaagacccaggacatccagatcgttgctgatgacttgaccgtcaccaaccccctccgcatcaagaaggccattgagctcaaggccgccaacgccctcctcctcaaggtcaaccagatcggtacccttaccgagtccatccaagctgccaaggactcctacgccgatggctggggtgtcatggtctctcaccgctctggtgagactgaggatgtcaccattgccgacattgtcgttggtatccgctctggccagatcaagactggtgctcctgcccgttccgagcgtcttgccaagctcaaccagatcctccgcatcgaggaggagcttgccgacaacgccatctttgccggcgagaagttccgcaaggctgttgagctctaa

SEQ ID NO: 4126 - protein, 438 aa, Neurospora crassa
MPISKIHARYVYDSRGNPTVEVDVVTELGLHRAIVPSGASTGQHEACELRDGDKTKWGGKGVLKAVQNVNEVIGPALIKENIDVKDQSKVDKFLIDLDGTPNKTKLGANAILGVSLAVAKAGAAEKGVPLYAHISDLAGTKKPYVLPVPFMNVLNGGSHAGGRLAFQEFMIVPSAAPTFSEALRQGAEVYQILKSLAKKKYGQSAGNVGDEGGVAPDIQNPEEALDLITEAIEKAGYTGQVKIAMDVASSEFYKEDVKKYDLDFKNPESDPSKWLTYEELANLYSELCKKYPIVSIEDPFAEDDWEAWSYFYKTQDIQIVADDLTVTNPLRIKKAIELKAANALLLKVNQIGTLTESIQAAKDSYADGWGVMVSHRSGETEDVTIADIVVGIRSGQIKTGAPARSERLAKLNQILRIEEELADNAIFAGEKFRKAVEL

SEQ ID NO: 4127 - DNA, 1290 bp, Mycobacterium bovis
  CDS (1)..(1290)
atgccgattatcgagcaggttggggcccgagagatcctcgattcccgcggcaacccgacggtggaggtcgaggtggcgcttatcgacgggacattcgcccgggccgcggtgccgtcgggcgcctcgaccggggagcacgaggccgtcgagttgcgcgacggcggcgatcgctacggcggcaaaggcgtgcaaaaagccgtgcaggctgttcttgatgagatcggcccggccgtcatcggactcaacgccgacgaccagcgattggtcgaccaggcgctggtggacctagacggcacccccgacaagtcccggctgggcggcaacgcgatcttgggtgtctcgctcgctgttgccaaggcggcggcggattcggcggagctgccgttgttccgttatgtcggggggccaaacgcgcacattctgccggtaccgatgatgaacatcctcaacggcggcgcacacgccgataccgctgtcgacattcaagagttcatggtggcgccaattggcgcgcccagcttcgtcgaggcgttgcgctggggcgctgaggtgtaccacgcgctcaagtcggtcctgaaaaaggaggggctgtccaccggcctgggcgacgaaggcggcttcgccccggatgtggccggcaccaccgcggcgttggacctgatcagccgggccatcgagtcggcgggcttgcgacccggcgccgacgtggcgctggccctggacgcggcggccaccgagttcttcaccgacggcaccggctacgtcttcgagggcaccacccgtaccgcagaccagatgaccgagttctacgcgggcctgctcggcgcctacccgctggtgtcgatcgaagacccactgtccgaagacgattgggacggctgggccgcgctgacggcctcgatcggtgaccgggtgcaaatcgtcggcgacgacatctttgtcaccaatcccgagcggctcgaggagggcatcgaacggggcgtggcaaatgcgttgctggtcaaggtgaaccagatcgggacgttgaccgagacactcgacgcggtcacgctggctcaccacggcggataccgcacgatgatcagtcaccgcagtggcgagacggaggacaccatgatcgccgacctcgcggtggccatcggcagcgggcagatcaagacgggcgcgcctgctcgcagtgagcgcgtcgcaaaatacaaccagctgctgcggatcgaagaggcgcttggcgacgcggcccgctacgcgggcgacctggcatttcctcggttcgcgtgcgagacgaaatag

SEQ ID NO: 4128 - protein, 429 aa, Mycobacterium bovis
MPIIEQVGAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 4129 - DNA, 1293 bp, Synechococcus sp
  CDS (1)..(1293)
atgatcgattcgctcgacctcgtcatcgacaccatcgtggcccgcgaagttctcgattcccgcggcaacccaaccgttgaagccgaagtgctgctcgaaggtggtgccatgggccgggccatcgtgcccagcggcgccagcacaggtgcccacgaggcccacgaactgcgggacggcggcgaccgttacatgggtaaaggcgtcagccaggccgtcacccacatcgaagagcgcatcgcgccaaccctgtgcggactctccgccctggatcaggccgccgtggatgcagcgatgctcgagttggacggcagcgacaacaaatccagcctgggagccaatgcgattctcgcggtgagcatggccaccgcccgcgctgcggccaacggactgggactacccctgtaccgctaccttggcggaccgatggccaacctgctgccggtgccgttgatgaacgtgatcaacggtggcgcccatgcggccaacagcctggatttccaggaattcatgctggtgccccacggagcccccagcttccgcgaggctctgcgcatgggcaccgaggtcttccacaccctcaagggtctgctcaaagccaagggcatgagcacctctgtgggggatgagggtggtttcgcccccgacctgggcaatgtggaagccggggagatcctggtggaggcgatcacgaaggccggctacaaacctggcgagcagatttccctggcgctggatgtcgccagcaccgaattcttcgagaacggccgctatgcctttgatggcggcaactacgacagcgccgaaatggtcggccagctggagcagctggtggagaaattcccgatcgtgtcgatcgaggacggcctggcggaagacgactgggagggttggaagctgctcaccgaacggcttggcggcaaggtgcagctggtgggtgatgacctgttcgtgaccaacaccaagcgcctgcagcagggcatcgacaacagcacggcgaactcgatcctgatcaaggtgaaccagatcggatctctcaccgaaaccctgcaggcgatcgatctggctgggcgttccgggtacaccagcgtgatcagccaccgcagtggcgaaaccgaggacaccaccatcgccgacctctccgtcgccacccgcgccggtcagatcaagaccggttcgctcagccgcagcgagcgcgtcgccaagtacaaccagctcctacggatcgaggacgaactgggcagccaggcggtttacgccggagctgtgggccagggtccccggggtaacgcctga

SEQ ID NO: 4130 - protein, 430 aa, Synechococcus sp
MIDSLDLVIDTIVAREVLDSRGNPTVEAEVLLEGGAMGRAIVPSGASTGAHEAHELRDGGDRYMGKGVSQAVTHIEERIAPTLCGLSALDQAAVDAAMLELDGSDNKSSLGANAILAVSMATARAAANGLGLPLYRYLGGPMANLLPVPLMNVINGGAHAANSLDFQEFMLVPHGAPSFREALRMGTEVFHTLKGLLKAKGMSTSVGDEGGFAPDLGNVEAGEILVEAITKAGYKPGEQISLALDVASTEFFENGRYAFDGGNYDSAEMVGQLEQLVEKFPIVSIEDGLAEDDWEGWKLLTERLGGKVQLVGDDLFVTNTKRLQQGIDNSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGNA

SEQ ID NO: 4131 - DNA, 1287 bp, Rhodopirellula baltica
  CDS (1)..(1287)
atgacactgatcgaatcgattcacgctcggcaaatcttggacagccgcggcaaccccaccgtcgagtgcgaagtcacattgatggacggtgccgccggtcgcgctgccgtgcccagcggagccagcaccgggatgcacgaagcctgggaactgcgagacggtgacaagtccgtcttcatgggcaaaggcgtcacaaccgctgtcaagaacgtcaacacaaaaatcgccgatgccttggaaggcatggacgcaaccgatcaagctgcggttgaccaagcgatgattgaactggatggcacacctaacaaaaaagaacttggtgctaacgccattctcggcgtttcgttggccgtcgctcacgcagcggccgcttcgaccaaccagcccttgttccgctacctcggtggtgctggcgctcgcatgttgcctgccccgatgatgaacatcatcaacggtggtgagcacgctgataacggcgtcgacatccaagagttcatggtcatgccattgggctttgaacgcttcagcgatgctctgcgttgcggaactgaaatcttccacaacctgaagaaggttctgtcggacaagggttacagcaccgcggttggcgatgaaggcggtttcgcacctgacttgaagagcaaccaagaagctctcgatgtgatcatgaccgcgatcgacaaggctggctacaaagctggcgaacaagtctggatcgccttggacgcggcttcgactgagttctacgacaagtcatccggcaagtactcgttggacaacaaccaaatgtccggcgatgaaatggtcgacttcttggccggttggtgcgacaagtacccgatctgcagcatcgaagacggatgcgatgaagacgactgggaaacttggaagaaactgaccaccaagatcggcgacaaggttcaactggttggcgacgacttgttcgtaaccaacgtcgaacgtttgcaacgcggtatcgacgaagggatcgccaacagcatcttgatcaaggtcaaccaaatcggaacgatgaccgaaaccatcgacgcgatccagctcgctcatcgcaacggttacacctccatcagcagccaccgcagtggtgaaacagaagattcgaccatcgctgacttggccgttgccatgtcgactggtcagatcaagactgggtcggcaagtcgtagtgaccggatggccaaatacaaccaattgcttcgcatcgaagaattgttgggcgacgccgctcagtacggcggtcctttgttcgccaagcgaatcaccggctga

SEQ ID NO: 4132 - protein, 428 aa, Rhodopirellula baltica
MTLIESIHARQILDSRGNPTVECEVTLMDGAAGRAAVPSGASTGMHEAWELRDGDKSVFMGKGVTTAVKNVNTKIADALEGMDATDQAAVDQAMIELDGTPNKKELGANAILGVSLAVAHAAAASTNQPLFRYLGGAGARMLPAPMMNIINGGEHADNGVDIQEFMVMPLGFERFSDALRCGTEIFHNLKKVLSDKGYSTAVGDEGGFAPDLKSNQEALDVIMTAIDKAGYKAGEQVWIALDAASTEFYDKSSGKYSLDNNQMSGDEMVDFLAGWCDKYPICSIEDGCDEDDWETWKKLTTKIGDKVQLVGDDLFVTNVERLQRGIDEGIANSILIKVNQIGTMTETIDAIQLAHRNGYTSISSHRSGETEDSTIADLAVAMSTGQIKTGSASRSDRMAKYNQLLRIEELLGDAAQYGGPLFAKRITG

SEQ ID NO: 4133 - DNA, 1293 bp, Prochlorococcus marinus subsp
  CDS (1)..(1293)
atgaaagaaactattgatttccttattgacactattgaagctaggcaagtgcttgattcaagagggaaccccactgtagaggctgaagtatttttggaatgtggtgctattggcagagcaatagttcctagcggagcgagtactggtgctcatgaagcacacgaattgagagatggtgggacaaaatatatggggaaaggtgtcttaaatgcggttaataaaattcatgagacgatttctcctgctttatgtggattatcagctttagatcaaacaagtattgataacttaatgattgaaattgatggaactcctaataaatctagtttgggtgctaactcaattcttgcagtgagtctagccaacgctagagctgcatcaaatgctttggatctaccgttatatagatatcttggcgatccattatctaatcttctccctgtaccactgatgaatgtaattaatggtggagctcatgcacctaatggtcttgattgccaagaatttatgcttgtccctcatggggtgaaaacttttagtgaagcattaagaattggaactgaaatatttcattcactaaaatctttacttgaaaaaaaaggtttatctacagctgttggagacgaaggtggttttgctccagaattatcatctagtgaagcagcaggagatttgcttttagaggctattcagaaagcaggatttattcctggtgagcaggtatcgttagcattagacgtagctagtactgaattttataaagatggattttataaatatgaaggtaaaagtttaactagctctcaaatgatttcttatctttcaaatttagtttcaaattatccaatagtttcaatagaggatggactagcagaagatgattgggagggttggtcagccctaaataaagagattggaaataaagtgcagttagtaggtgatgatttatttgttactaatactgaaaggttaagaaaaggaatattagaaaaatccgcaaattcaatattaataaaggtaaatcaaattggcacattaacagaaactctggaagctatggatctagctaaaagtgctggttttacaagtgttatcagtcatagaagcggcgaaacagaagatacaacgattgccgatttatctgtggcaacgcgagccgggcaaattaaaactggctctttgagcagaagtgaaagaattgctaagtacaataggctcttaaggattgaggaagagttgggtgatcaagctagatttgctggtgatttaggattaggtccaaaaaatatatag

SEQ ID NO: 4134 - protein, 430 aa, Prochlorococcus marinus subsp
MKETIDFLIDTIEARQVLDSRGNPTVEAEVFLECGAIGRAIVPSGASTGAHEAHELRDGGTKYMGKGVLNAVNKIHETISPALCGLSALDQTSIDNLMIEIDGTPNKSSLGANSILAVSLANARAASNALDLPLYRYLGDPLSNLLPVPLMNVINGGAHAPNGLDCQEFMLVPHGVKTFSEALRIGTEIFHSLKSLLEKKGLSTAVGDEGGFAPELSSSEAAGDLLLEAIQKAGFIPGEQVSLALDVASTEFYKDGFYKYEGKSLTSSQMISYLSNLVSNYPIVSIEDGLAEDDWEGWSALNKEIGNKVQLVGDDLFVTNTERLRKGILEKSANSILIKVNQIGTLTETLEAMDLAKSAGFTSVISHRSGETEDTTIADLSVATRAGQIKTGSLSRSERIAKYNRLLRIEEELGDQARFAGDLGLGPKNI

SEQ ID NO: 4135 - DNA, 1296 bp, Prochlorococcus marinus
  CDS (1)..(1296)
atgatcgattccctcgacctcgtcattgacaccatcgtggccagagaggttctggactctcgcggcaaccccacagttgaagcagaagtgttgctcgaagcaggtgctatcggtagggccatcgtgcccagcggagcaagcaccggtgcccatgaggcgcatgaattaagagatggcgacagccgctacctgggcaaaggggtgactaaggctgtgaaccatatcgaggatcggattgccccagcgctctgtgggatctcttccctagatcaggccagtgttgatggcaccatgcaagagcttgatggcagcgacaacaaatcaagcctgggcgcaaacgcgatcctggccgtgagcatggccactgcccgcgcggccgccaatggcttgggtttgcccctctaccgctacctgggtggccccatggcctcattgctgcccgtaccgctgatgaatgtgatcaacggcggtgcgcatgctgctaacaatctcgattttcaggaattcatgctggtgccccatggagcaagcagcttccgagaatcgctgcgcatgggcgcagaagtattccacacactcaagggcctgctcagtgctcaggggctctcaacggcagttggagatgaaggcggctttgcacccaatctggccaacaatgatgcagcaggagatctgctcattcaagcaatcgaaaaagcaggctattcgccaggtaaggatatttccttggcactagatgtagccagcacagagttctatcaagacggctgctatgccttcgggggtggtcgttacaccagtaccgaaatggtcaatgagctcgaaaaacttgttgatcgctacccaattatttcgatcgaagatggactagcagaagatgattggcaaggttgggctctactcacaaaaaaattggggaagcgtatccaactgataggtgacgatatttttgtaacgagtactaagcgcctacagcagggaattgatcaaaacgtagccaattccatcctgattaaagtgaatcagatcggctcgctaacggaaacgcttcaggccattgatcttgctgggcgctctggttacaccagcgtaatcagccaccgcagcggcgaaacggaagacaccacaattgcagatcttgccgttgccacccgtgctgggcagatcaaaacgggctccctaagtcgcagtgaacgggtagcgaaatacaaccaactgctgcgaatcgaagacgaactcggtagccaagcggtctatgccggtgccacaggacaagggccacgggggcgaagctaa

SEQ ID NO: 4136 - protein, 431 aa, Prochlorococcus marinus
MIDSLDLVIDTIVAREVLDSRGNPTVEAEVLLEAGAIGRAIVPSGASTGAHEAHELRDGDSRYLGKGVTKAVNHIEDRIAPALCGISSLDQASVDGTMQELDGSDNKSSLGANAILAVSMATARAAANGLGLPLYRYLGGPMASLLPVPLMNVINGGAHAANNLDFQEFMLVPHGASSFRESLRMGAEVFHTLKGLLSAQGLSTAVGDEGGFAPNLANNDAAGDLLIQAIEKAGYSPGKDISLALDVASTEFYQDGCYAFGGGRYTSTEMVNELEKLVDRYPIISIEDGLAEDDWQGWALLTKKLGKRIQLIGDDIFVTSTKRLQQGIDQNVANSILIKVNQIGSLTETLQAIDLAGRSGYTSVISHRSGETEDTTIADLAVATRAGQIKTGSLSRSERVAKYNQLLRIEDELGSQAVYAGATGQGPRGRS

SEQ ID NO: 4137 - DNA, 1299 bp, Prochlorococcus marinus
  CDS (1)..(1299)
atgattgattcccttgatttggttattgatagcatctttgcaagagaagtgcttgattcaaggggaaaccctacagttgaagctgaggtattgcttgaaggcggagcaaaaggcagagcaattgttcccagtggagcaagtactggtgcctatgaggcgcatgaattaagggatggtggaactcgctacatgggaaagggtgttctcagagtcgtagaacatatagaagaccgcatagcaccttccctttgtggtttatctgcttcggatcaagtaaatgttgatcaaataatgcgagagcttgatggtactgaaaataaagaaaatttaggagcaaatgccatcttggcagtcagtattgcaacagcacgctctgctgctaatgcttttgggatgcctttgtatcgttatttaggtaatccaatgtcttcactattaccagtcccattaatgaatgtgattaatggaggagctcatgctgccaataatcttgattttcaagaatttatgttggtgcctcatggtgctgagagctttcgcgaagctctcagaatgggtgcagaagtttttcatacacttaagaagcttctttcagataagggtttatctactgcagttggagatgaaggaggctttgcacctgaccttgaaaataataacgctgctggagacctacttgttcaagcaattgaaaaagctggatttcgtccaggagaagagatttctttggctttagatgttgcaagcactgaattttttaaaaatggcttgtatcactttggtgagggaaaattctcaagtgaaaagatggtagaagaattgaaaaagttagttaatttatatccaattatttcaatagaagatggtttgtcggaagatgattggtcaggctgggaattattaacaaaagaattaggaaataaggtccaactagttggggatgatttgtttgtcacaaatacaaaacgattgcgccaaggaatagataggagtattgcaaattctatattaattaaagtcaatcagattggtactttgactgagacactagaagcaatagatctatctcatcgtatgggatatacaagtattattagtcatagaagtggtgaaactgaagatactacaatcgctgatctagcagtggcaacaagagctggtcaaatcaaaacaggctcattgagtaggagtgagagagtagctaaatacaatcaacttcttcgaattgaagatcaattaggtgctcaggctgtctacgcaggatctgttggattagggcctagaggtttatctaaataa

SEQ ID NO: 4138 - protein, 432 aa, Prochlorococcus marinus
MIDSLDLVIDSIFAREVLDSRGNPTVEAEVLLEGGAKGRAIVPSGASTGAYEAHELRDGGTRYMGKGVLRVVEHIEDRIAPSLCGLSASDQVNVDQIMRELDGTENKENLGANAILAVSIATARSAANAFGMPLYRYLGNPMSSLLPVPLMNVINGGAHAANNLDFQEFMLVPHGAESFREALRMGAEVFHTLKKLLSDKGLSTAVGDEGGFAPDLENNNAAGDLLVQAIEKAGFRPGEEISLALDVASTEFFKNGLYHFGEGKFSSEKMVEELKKLVNLYPIISIEDGLSEDDWSGWELLTKELGNKVQLVGDDLFVTNTKRLRQGIDRSIANSILIKVNQIGTLTETLEAIDLSHRMGYTSIISHRSGETEDTTIADLAVATRAGQIKTGSLSRSERVAKYNQLLRIEDQLGAQAVYAGSVGLGPRGLSK

SEQ ID NO: 4139 - DNA, 1278 bp, Helicobacter hepaticus
  CDS (1)..(1278)
atggtttatattgaagcaattgatgcacaagaagtaatggatagtcgtggaaacccaactgttagagcagcagtaaggttaagtgatggcacaagagcggcagctatcgttccaagtggtgcaagcactggtaaaagagaagcccttgaattacgtgatggcgataaagaacgttatcttggtaaaggcgtgttgaaagcctgtgcaaatattaaaactgaaattgctgcacaacttgatggggtatcaccttatgaccaaagtaaaattgatttgattttaaaaaaaattgatggcacagagaattattcagagcttggggcaaatgcaactttaggcgtgagtatggctattgctcgtgcaagtgcgcaatctttgaggttacctctttatcgttatttaggtgggagtaatgcgcttacacttcctaccccgatgcttaatatcattaatggtggttctcacgcagataatactgtggattttcaagagtatatgattatgcctttgggttttgatacttttgctgaaagtttgcgtgcatcagctgaaatttatcatcatctcaaagcgattcttaaaggaagtggacatattacaagcattggtgatgaaggtggattcgcccctaatttaaaaaacaatgaagagcccatagaaattattttaaaggctattgaacaagcgggttataagccgcttgatgagattgctattgcactagatgtggcaagtagtgagcttgtagatgagaatggtatgtatcatttggcaggagagggcaaagtgcttgatagtgcaggtatgattgcatattatgagaatcttgtagcaaaatatcctattgtttctattgaagatggcttaagtgaagatgattgggagggttggaaacttcttactcaaaaacttggcaataaaattcagcttgtgggcgatgatttatttgttacaaataaaaaaattcttcaagaaggtattgaaaaaaatatagctaatgcaattttgattaaacctaatcaaatcggtagcgtgagtgaaacaatgcaatctgtgcgccttgcccaacgtaataattataagtgcataatgagtcatcgtagtggggagagtgaagatacatttattgcagattttgctgtggcacttaatacaggtgagattaaaactggctcaactgcaagaagtgagcggattgcaaaatataatcgtttgcttgaaattgagcgagagattagtgatgcggaatatattggaaaaacactttttaagcgttaa

SEQ ID NO: 4140 - protein, 425 aa, Helicobacter hepaticus
MVYIEAIDAQEVMDSRGNPTVRAAVRLSDGTRAAAIVPSGASTGKREALELRDGDKERYLGKGVLKACANIKTEIAAQLDGVSPYDQSKIDLILKKIDGTENYSELGANATLGVSMAIARASAQSLRLPLYRYLGGSNALTLPTPMLNIINGGSHADNTVDFQEYMIMPLGFDTFAESLRASAEIYHHLKAILKGSGHITSIGDEGGFAPNLKNNEEPIEIILKAIEQAGYKPLDEIAIALDVASSELVDENGMYHLAGEGKVLDSAGMIAYYENLVAKYPIVSIEDGLSEDDWEGWKLLTQKLGNKIQLVGDDLFVTNKKILQEGIEKNIANAILIKPNQIGSVSETMQSVRLAQRNNYKCIMSHRSGESEDTFIADFAVALNTGEIKTGSTARSERIAKYNRLLEIEREISDAEYIGKTLFKR

SEQ ID NO: 4141 - DNA, 1302 bp, Haemophilus ducreyi
  CDS (1)..(1302)
atggctaaaattgtaaaagtaattggtcgtgaaattatcgactctcgtggtaacccgacggttgaagctgaagttcatttagagggcggttttgtaggcttagcggctgctccgtctggtgcatcaacaggatcacgtgaggcattagagttacgtgacggcgataaatcacgttttttaggtaaaggcgtattaaaagcggttgcggcagtaaataatgaaattgcgcaagcaatcgtaggaaaagaaggttgcgcacaatctgaaatcgaccaaactatgatcgatttagatggtactgaaaataaatctaaattcggtgcgaatgcaattttagcggtttctttagcaacagcaaaagcagctgcagcttctaaaggtttaccattatatgcttatattgcagaattaaatggtacaccgggtgtgtattctatgccattaccaatgatgaatattatcaatggcggtgagcacgcggacaacaatgttgatattcaagaatttatgattcaacctattggtgcaaaaacattacgtgaggcattacgtatcggcgcagaagttttccataatttagccaaggtattaaaagcgaaaggtttaagtactgcggtaggtgatgaaggtggtttcgcaccaaacttggcatctaatgctgatgctttagcttgtattaaagaagcggttgaaaatgcaggttatgtgttaggtaaagatattactttggcgatggattgtgcatcatccgaattctataataaagaaaatggtttatatgaaatgaaaggtgagggtaaatcattcacttctcaagaatttactcactatctagaaaatttatgtaaagaataccctattgtttctattgaagatggccaagatgaatccgattgggatggctttgcttatcaaactaagatattaggtgataaagtccaattagttggcgacgatctatttgttactaataccaaaatcttaaaagaaggtattgaaaaaggcattgcaaattctatcttaattaagttcaatcagattggttcattaacagaaacgttagctgcaattaaaatggcaaaagatgctggctatactgccgttatttcgcaccgttcaggtgaaactgaagatgcaacaattgctgatttagccgtcggcactgcagcaggtcaaatcaaaacaggatcaatgagccgttcagatcggatcgctaaatataatcaattaatccgtattgaagaagcattaggcgaaatggcgccattcttagggttaaaagccattaaaggtcaagcataa

SEQ ID NO: 4142 - protein, 433 aa, Haemophilus ducreyi
MAKIVKVIGREIIDSRGNPTVEAEVHLEGGFVGLAAAPSGASTGSREALELRDGDKSRFLGKGVLKAVAAVNNEIAQAIVGKEGCAQSEIDQTMIDLDGTENKSKFGANAILAVSLATAKAAAASKGLPLYAYIAELNGTPGVYSMPLPMMNIINGGEHADNNVDIQEFMIQPIGAKTLREALRIGAEVFHNLAKVLKAKGLSTAVGDEGGFAPNLASNADALACIKEAVENAGYVLGKDITLAMDCASSEFYNKENGLYEMKGEGKSFTSQEFTHYLENLCKEYPIVSIEDGQDESDWDGFAYQTKILGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEMAPFLGLKAIKGQA

SEQ ID NO: 4143 - DNA, 1344 bp, Candidatus Blochmannia floridanus
  CDS (1)..(1344)
atgccagagatagtaaatattattagtcgtgaaattgttgattctagaggtaatcctacggtggaatcagaagtacatactaaaagtggtttttttggtttagcatctgttccgtcaggatcttctttgggttctcaagaagcattggaattacgagataatgatcatgctcgtttttttggaaaaggagtaaaaaaatcagtcaatattattaatagtactattcgtgtatcattgttaaatatagatgtaacgaaacaaagtgttattgatgaaattatgattaatttagacggtactaataataaatctcaacttggagctaattctattttgagtgtatctttagcgatagctaaagctgctgctagttttatgggtatgccgttgtatcaatatatagctagattatatggaatgtcgagtaatgtgtattctatgccggttcctatgatgaacattatgaatggaggaaaacatgctgataataatttagatattcaggaatttatgattgtacctgttggggctaaaaatattaaacaagctatacaaatgggatcagaaatttcatatagtttaaaaaatgttttaaataatttagggatatctattgcattaggtgatgaagggggatatgctccaaatttaaaatctcattcttatgcattagaattaattaataagtctatagagcaatctaattatgtgttaggtaaagatgtggttttggctatagattgtgctgcatctgaattatttgaagtatctactggaaagtacgttataaatagtgaaaaagttagttttacttctgaagaatttgttgattatttatcatctttagcacgtaaatattgtattttttctattgaagatggtcagagtgagcatgattggcatgggttttcttatcttactaagaaacttggagatattatgcaattagtgggtgatgatttatttgttactaatccaaatttattaaaaatgggtattaataagaatgtagcaaattctattttagttaaacctaatcaaataggttcgttaactgagactttaaatgtgattaaattggcaaaagaatctggatattcgaccattgtttcacatagatctggagaaactgaagatacaagtattgctgatatagctgttggtacatctgctgggcagataaaaactggtccagtacgttgttctgaacgtacatctaagtataatagattaatacgtattgaagaatttttgaaagataatagtaagttttatggagtgaacgagataaagaatctctcagctcagttgtggatgtatcaaaataagaatatgaatatatag

SEQ ID NO: 4144 - protein, 447 aa, Candidatus Blochmannia floridanus
MPEIVNIISREIVDSRGNPTVESEVHTKSGFFGLASVPSGSSLGSQEALELRDNDHARFFGKGVKKSVNIINSTIRVSLLNIDVTKQSVIDEIMINLDGTNNKSQLGANSILSVSLAIAKAAASFMGMPLYQYIARLYGMSSNVYSMPVPMMNIMNGGKHADNNLDIQEFMIVPVGAKNIKQAIQMGSEISYSLKNVLNNLGISIALGDEGGYAPNLKSHSYALELINKSIEQSNYVLGKDVVLAIDCAASELFEVSTGKYVINSEKVSFTSEEFVDYLSSLARKYCIFSIEDGQSEHDWHGFSYLTKKLGDIMQLVGDDLFVTNPNLLKMGINKNVANSILVKPNQIGSLTETLNVIKLAKESGYSTIVSHRSGETEDTSIADIAVGTSAGQIKTGPVRCSERTSKYNRLIRIEEFLKDNSKFYGVNEIKNLSAQLWMYQNKNMNI

SEQ ID NO: 4145 - DNA, 1287 bp, Bordetella pertussis
  CDS (1)..(1287)
atgagtgcaatcgtcgatatcatcggccgcgaaatcctcgattcgcgcggcaaccctaccgtcgagtgcgatgtgctgctggagtcgggcgcgatgggtcgcgcctccgtgccttcgggcgcctccaccggctcgcgcgaggccatcgaactgcgcgacggcgacaagggccgttatctgggcaagggcgtgctgcgggcggtggagaatctcaacaccgagatctccgaagccctgatgggcctggatgcgcaggagcagaccttcgttgatcgtaccctgatcgaactcgacggcaccgacagcaaggagcgcctgggcgccaatgccatgctggccgccagcatggcggtcgcgcgcgccgcggccgacgagtcgggcctgtcgctgtaccgctacttcggcggcagcggccccatgagcatgcccgtgccgatgatgaacgtcatcaacggcggcgcgcacgccaacaatacgctggacctgcaggagctgatgatcctgccggtgggcgcggccagcttccgcgaagcgctgcgctggggcgccgaagtgttccacatgctcaagaagctgatccacgaccagggcatgtcgaccgccgtgggcgacgagggcggtttcgcgcccaacgtggccagccacgaggccgccatccagctgatcctcaaggccatcaccgaagccggctacgagccgggcacgcagatcgccctgggcctggattgcgccagctcggagttctaccgtgacggcaagtacacgctggctggcgaaggcggcgtgtcgctgtcctcgcaggagtttgccaacctgctggcgacctggtgcgacaagtaccccatcatctcgatcgaagacggcatggccgaaaacgactgggacggctggaagctgctgaccgaccagctgggcaagaaggtgcagctggtgggcgacgacctgttcgtcaccaacacgcgcatcctgcgcgaaggcatccagaagggcgtggccaactcgattctcatcaagatcaaccagatcggcaccctgaccgagaccttcgccgccatcgaaatggccaagcgcgccggctacaccgccgttgtctcgcaccgttccggtgaaaccgaagactccaccattgccgacatcgcggtggctaccaacgccatgcagatcaagaccggttcgctgtcgcgttccgaccgcatggcgaagtacaaccagttgctgcgcatcgaggaagaactggccgaagtggcttcctacccgggcctcgaggcgttctacaacctgcgttaa

SEQ ID NO: 4146 - protein, 428 aa, Bordetella pertussis
MSAIVDIIGREILDSRGNPTVECDVLLESGAMGRASVPSGASTGSREAIELRDGDKGRYLGKGVLRAVENLNTEISEALMGLDAQEQTFVDRTLIELDGTDSKERLGANAMLAASMAVARAAADESGLSLYRYFGGSGPMSMPVPMMNVINGGAHANNTLDLQELMILPVGAASFREALRWGAEVFHMLKKLIHDQGMSTAVGDEGGFAPNVASHEAAIQLILKAITEAGYEPGTQIALGLDCASSEFYRDGKYTLAGEGGVSLSSQEFANLLATWCDKYPIISIEDGMAENDWDGWKLLTDQLGKKVQLVGDDLFVTNTRILREGIQKGVANSILIKINQIGTLTETFAAIEMAKRAGYTAVVSHRSGETEDSTIADIAVATNAMQIKTGSLSRSDRMAKYNQLLRIEEELAEVASYPGLEAFYNLR

SEQ ID NO: 4147 - DNA, 1615 bp, Onchocerca volvulus
  CDS (52)..(1359)
ggcacgaggtttgagtagctttctcgctgatcataagagatatcatcaactatgccgatcacacgtgttcatgcccgtcctatctatgattcacgcggtaatccaaccgtcgaagttgacttaaccactgagaaaggtattttccgcgcagctgtgccaagtggtgcttcaactggtatacacgaagcgcttgaacttcgggataatgatgaagctgttaatcacggtaaaggtgttttgcaggctgtcggaaatgtcaatgaacagattggacccgctctggttgcgaagaatttctgtccaactcaacaacgtgaaatcgatctttttatgctgcagcttgatggaacagaaaataaagcgaaacttggtgccaatgcaattttgggtgtttcattggcggtctgcaaggctggtgccgtgcataaaggcatgccattgtataagtatatagcggaattggctggtaccagacaaattgttctaccagttcctgctatgaatgtcatcaacggtggctctcatgctggtaacaaattagcgatgcaggaatttatgatcatgcctgttggagctagttcattcagcgaagcaatgcgtatgggttccgaaatttatcattatttgaaggcagaaatcgaaaaacgctatggtctcgatgcaacagcagtgggtgatgaaggggggttcgctcctaatattcaagataacaaggaaggccttgatttattaaatacagctattgcaacagctggatacactggaaaagtatcaatcgcaatggattgtgccgcatctgaatattccaaagaagcggataagctctatgatttaaaattcaaaaatcctaattcgggcaaaactcaatggaaaactggtgatcaaatgatgaattttcaatcgtttattaaggaatatccagtggtgtcaattgaagattggtttcacgaagatgattggcacaattggccaaaaggattggccaagacaaatattcaaattgttggcgatgacttgactgttccgaacccaaagagaatcgcattggctgccgaaaagaaagcttgcaactgtctgctgctcaaggtaaaccaaattggctccgtgacagaatcaattgatgcggctaacttagctcgcaaaaatggttggggtgtgatggtttcgcatcgttctggtgaaaccgaagacacatttatcgctgatctagtcgtcggtctcgctgctgggcagatcaaaactggagccccatgccgttcggagcgtcttgccaaatacaatcaaatacttcgtatcgaggaagaacttggatcagctgcagtttatgctggtcaaaaattccgaaatcctcaggcataaattgtgagacattggtgggaaaaattattgcgtcttaactgattattatatctttctttcatgaatattatgttagtcgtatgcagtaataatagctgttgatttattaagtcatttaaattaatttaaactatttctcattgttcccgatttggattgtagttttcgtgcttatctggttgaagttccatagaaattaaaattgatttatgatgataaaaaaatttttttttaaaaaaaaaaaaaaaaaaaaaaa

SEQ ID NO: 4148 - protein, 435 aa, Onchocerca volvulus
MPITRVHARPIYDSRGNPTVEVDLTTEKGIFRAAVPSGASTGIHEALELRDNDEAVNHGKGVLQAVGNVNEQIGPALVAKNFCPTQQREIDLFMLQLDGTENKAKLGANAILGVSLAVCKAGAVHKGMPLYKYIAELAGTRQIVLPVPAMNVINGGSHAGNKLAMQEFMIMPVGASSFSEAMRMGSEIYHYLKAEIEKRYGLDATAVGDEGGFAPNIQDNKEGLDLLNTAIATAGYTGKVSIAMDCAASEYSKEADKLYDLKFKNPNSGKTQWKTGDQMMNFQSFIKEYPVVSIEDWFHEDDWHNWPKGLAKTNIQIVGDDLTVPNPKRIALAAEKKACNCLLLKVNQIGSVTESIDAANLARKNGWGVMVSHRSGETEDTFIADLVVGLAAGQIKTGAPCRSERLAKYNQILRIEEELGSAAVYAGQKFRNPQA

SEQ ID NO: 4149 - DNA, 1287 bp, Streptomyces avermitilis
  CDS (1)..(1287)
atgccgtccatcgacgtcgtcgtagcccgggaaatcctggactcccgaggcaaccccacggtcgaggtcgaggtcggcctcgacgacggcagcacgggtcgtgccgccgtcccgtccggcgcctccaccggtgccttcgaggccatcgagctccgcgacggtgaccccaaccgttaccagggcaagggtgtcgagaaggccgtcctcgccgtcatcgagcagatcggcccggagctcgtcggctacgacgccaccgagcagcgcctgatcgaccaggcgatgttcgacctggacgccaccgacaacaagggctcgctcggcgccaacgccatcctcggcgtctccctcgccgtcgcgcacgccgcctccgaggccagcgacctcccgctcttccgctacctgggcggcccgaacgcgcacctgctgcccgttccgatgatgaacatcctgaacggcggctcgcacgccgactccaacgtggacatccaggagttcatgatcgccccgatcggcgcggagtccttctccgaggccctgcgctggggcgccgaggtctaccacaccctcaagaaggtgctgaagaccaagggcctgtccaccggcctcggcgacgagggcggcttcgccccgaacctggagtcgaaccgcgccgcgctcgacctcatcatcgaggccatcaagcaggccggttacatcccgggcgagcagatcgcgctcgcgctcgacgtcgccgcgtccgagttctacaaggacggcaagtacgagttcgagggcaagtcccgctcggccgccgagatgaccgagtactacgaggagctcgtctccgcgtacccgctcgtctccatcgaggacccgctgtacgaggacgactgggccggctggaaggtcatcaccgacaagctgggcgacaaggtccagatcgtcggcgacgacctcttcgtcaccaacccggagcgcctggcccgcggcatcgaggagggctccgccaacgccctgctcgtcaaggtcaaccagatcggttcgctgaccgagaccctggacgccgtcgagctggcccagcgcaacggcttcaagtgcatgatgtcccaccgctccggcgagaccgaggacgtcaccatcgccgacctcgccgtcgccgtgaactgcggtcagatcaagaccggcgccccggcccgctcggaccgtgtcgccaagtacaaccagctgctgcgcatcgaggagatcctcgacgacgccgccgagtacgccggccgctcggcgttcccccggttccgctcggcgaactga

SEQ ID NO: 4150 - protein, 428 aa, Streptomyces avermitilis
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLIIEAIKQAGYIPGEQIALALDVAASEFYKDGKYEFEGKSRSAAEMTEYYEELVSAYPLVSIEDPLYEDDWAGWKVITDKLGDKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAEYAGRSAFPRFRSAN

SEQ ID NO: 4151 - DNA, 1287 bp, Coxiella burnetii
  CDS (1)..(1287)
atgacagcgaccatcactgatattaatgctcatgaaattttagattcgcgcgctaatcctactttggaagtgcgcgtcaccttgtcttcacaagcctacggttgtgcggccgtcccgtcaggggcatccaccggcgagcgggaggcggttgaattacgcgataatgatcttgaacgttacggcggcaaaggtgttttacaagccgtcgaaaacgtcaatggccccatccgcgacgccttgctcggacaagatccgcgctcgcaagaagaaattgatcgcattatgattgaattggatggcacagaaaataaagcgaatttaggcgctaacgcgatcttaggtgtttcattagccgtggcttatgcggctgccaataatgcggatttacccttgtatcgttatttaggaggcgacggcggtccttttagtatgcctgtgcccatgatgaatattatcaacggcggcgcgcacgctactaataatttggattttcaagaatttatgattgtcccggtcggtgcgccgacctttgctgaagcattgcgttacggagccgaagttttccacgctttaaaaaaacgtttggtttctcgagggttaatgtcagcggtcggtgatgaagggggttttgctcccgatttgccgaataacgaagcagcgtttgagttaattttagaagccattgaagatgcaaactatgttcccggaaaagatatttaccttgccttagatgcagccagttctgaactttaccaaaatggccgttatgattttgaaaacaatcaattgacgagtgaagaaatgatcgatcgattgactgaatggacgaagaaatacccggttatttccattgaagacggcttatcagaaaatgattgggcgggctggaaattattgacagaacgtttagaaaataaagtgcagttggtaggcgacgatattttcgtcacgaatccagacattttagaaaaaggcattaaaaaaaatatcgccaacgccattttggttaaacttaatcaaattggaacgctcactgaaacgttagctacagtgggattagcgaaaagtaataaatacggtgttattatttcgcaccgttctggagaaacggaagatacgaccattgctgatttggctgtggcgaccgatgcgagacaaataaaaacggggtctttgtgccgctccgatcgtgtggcaaaatataatcgattattgcaaatcgaacgggagcttaatgatcaagccccgtatgctggcaaggaagcatttctttttaacaggaagtaa

SEQ ID NO: 4152 - protein, 428 aa, Coxiella burnetii
MTATITDINAHEILDSRANPTLEVRVTLSSQAYGCAAVPSGASTGEREAVELRDNDLERYGGKGVLQAVENVNGPIRDALLGQDPRSQEEIDRIMIELDGTENKANLGANAILGVSLAVAYAAANNADLPLYRYLGGDGGPFSMPVPMMNIINGGAHATNNLDFQEFMIVPVGAPTFAEALRYGAEVFHALKKRLVSRGLMSAVGDEGGFAPDLPNNEAAFELILEAIEDANYVPGKDIYLALDAASSELYQNGRYDFENNQLTSEEMIDRLTEWTKKYPVISIEDGLSENDWAGWKLLTERLENKVQLVGDDIFVTNPDILEKGIKKNIANAILVKLNQIGTLTETLATVGLAKSNKYGVIISHRSGETEDTTIADLAVATDARQIKTGSLCRSDRVAKYNRLLQIERELNDQAPYAGKEAFLFNRK

SEQ ID NO: 4153 - DNA, 1287 bp, Tropheryma whipplei
  CDS (1)..(1287)
atgtgtctaatagattctgtacatgcaaggcagatcctcgactctagaggcactccgaccgtggaggttgaggtaactctcgaagatggatctatgggaagatccgcagttccatctggagcttctaccggtgcgtttgaggcgcacgaattgcgcgatcaggataataatgaatacctcggtaagggcgtcacgcgggctgttcgttctgttaattccgagatagcaccggttcttatcggttttgacgcattcgatcaggttggccttgaccaccgtatgattgagctagatgggactaacaacaagagtaggcttggcgcaaatgccattcttggcgttagtttggcctccgcgagcgctgcggcacgcgccgctgacctgtcgctttttaggtatttaggcggtccatcctcgcgcatattgccggttccaatgatgaatataataaacggcggtgcgcacgctgatacaggtgttgatattcaagagtttatgattctgccggtcggcgcacgtagtttttcggaatccttgcgctggggctgtgaggtgtatcactctttgaaggtccaacttagagagagcggactttcgtctggtttgggtgatgaggggggttttgcccctgctttgcgcagcaatcgcacggcgctggatttgattttatctgctattgagaaagctggtttctccccggggatcgatatagtgcttgcccttgatatcgcggcgagcgagttctgtaaagcacctggacactacagatttgaagggaaagatataacatctgacgagctcatttcatactatgagggcctgttatcttcatatccgcttgtcagcatagaagatccgcttgatcaagacgattgggaggggtatcgcaccctaaccacccacattggtgatagggtgcaaattgttggcgatgatctcttcgtaactaatacctcgaggttatccagggggattcagtctggtgtggcaaattctattcttgttaaagtaaatcaaataggtactttgaccgagacgtttgacgcagtcgatatggcagctaaagggggatataccgcagttctgtctcatcgctcgggcgaaaccgaggatacaactatcgcagatatggcggttgcaacaaactgtggacagataaagactggcgcgcccgctcgcggcgagcgtattgcaaagtacaaccagctcttgcgaattgaggaaaagcttggaaggtctgctcgttatgctgggtggctatcgtacccacgatggcaaggcaaatga

SEQ ID NO: 4154 - protein, 428 aa, Tropheryma whipplei
MCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 4155 - DNA, 1302 bp, Streptococcus sobrinus
  CDS (1)..(1302)
atgtcaattattactgatgtttacgcacgcgaagtccttgactcacgcggtaacccaacacttgaagtagaagtttatactgaatcaggtgctttcggacgtggtatggttccttcaggagcttctactggtgaacacgaagcagttgaacttcgtgatggtgacaaatctcgttacggcggacttggtactcaaaaagctgttgacaacgtaaacaacatcatcgcagaagctatcatcggttacgatgtacgcgaccaacaagcaatcgaccgtgcaatgatcgctcttgatggtactcctaacaaaggtaaattgggtgctaatgccatccttggtgtgtctatcgctgcagcacgcgcagccgctgactaccttgaaatcccactttacagctaccttggcggattcaacactaaagttcttccaacgccaatgatgaacatcgtcaacggtggttctcactctgacgctccaattgctttccaagaattcatgattatgcctgttggcgcaccaacattcaaggaaggtcttcgttggggtgctgaagtattccatgctttgaagaaaatccttaaagaacgtggtcttgaaacagccgttggtgatgaaggtggattcgcacctcgtttcgacggaattgaagatggtgtagaaactatccttaaggctatcgaaactgctggttacgaagctggtgaaaaaggaatcatgcttggtttcgactgtgcttcatctgaattctacgaagatggcgtttacgactacactaaattcgaaggtgaaaaaggtgctaaacgttctgcagcagaacaaatcgattacatcgaaggtttggtaaacaaatacccaatcatcacaatcgaagatgctatggatgaaaacgactgggaaggttggaaggccctcacagaacgtcttggtaaccgtgttcaattggttggtgacgacttcttcgttacaaacactgactaccttgcacgtggtatcaaggaaggtgccgcaaactcaatccttatcaaggttaaccaaatcggtactttgacagaaactttcgaagctattgaaatggctaaggaagctggatacactgccgttgtatcacaccgttcaggtgaaactgaagattcaacaatcgctgacatcgcagttgcaactaacgctggtcaaatcaagacaggctcactgtcacgtacggaccgtatggctaaatacaaccaattgcttcgtatcgaagatcaacttggtgaagttgctcaatataaaggaatcaactcattctacaacttgaaaaaataa

SEQ ID NO: 4156 - protein, 433 aa, Streptococcus sobrinus
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAAARAAADYLEIPLYSYLGGFNTKVLPTPMMNIVNGGSHSDAPIAFQEFMIMPVGAPTFKEGLRWGAEVFHALKKILKERGLETAVGDEGGFAPRFDGIEDGVETILKAIETAGYEAGEKGIMLGFDCASSEFYEDGVYDYTKFEGEKGAKRSAAEQIDYIEGLVNKYPIITIEDAMDENDWEGWKALTERLGNRVQLVGDDFFVTNTDYLARGIKEGAANSILIKVNQIGTLTETFEAIEMAKEAGYTAVVSHRSGETEDSTIADIAVATNAGQIKTGSLSRTDRMAKYNQLLRIEDQLGEVAQYKGINSFYNLKK

SEQ ID NO: 4157 - DNA, 1290 bp, Methylobacterium extorquens
  CDS (1)..(1290)
atgaccgcgatcaccaatatcgccgcccgcgagattctcgacagccgtggcaaccccaccgtcgaggtcgatgtccttctggaggacggctctttcggccgcgccgccgtcccctccggcgcctccaccggcgcacacgaggcggtcgagctgcgggacggcgacaagagccgctacaacggcaagggcgtgctcaaggccgtcgacgcggtgcagagcgaaattctcgacgcgatcggcggcatggatgccgaggatcaggtcgccgtcgatgaggcgatgatcgcgctcgacggcacccccaacaaggcacggctcggcgccaacgccatcctcggcgtctcgctcgcggtcgccaaggctgcggccgagaccgccggcctgccgctctaccgctatgtcggcggcgtgcagggccgggtgctcccggtgccgatgatgaacatcgtcaacggcggggcccacgccgacaacccgatcgacttccaggaattcatggtgatgccggttggcgccacctcgctctccgacgcggtgcggatgggcgccgagatcttccacaccctcaagagcgccctgaagaaggccggccacaacacgaatgtcggcgacgagggcggcttcgccccgaacctgccttcggccgaggctgcgctcgatttcgtcatggaatcgatcaacgccgccgggttcaagcccggcagcgacgtggtgctggcgctcgactgcgccgcgaccgagttcttcaaggacggcgcctaccgctacgagggcgagggccagacccgctcgatcgagcaacaggttgattacctcgccaagctgaccgaggcctatccgattctctccatcgaggacggcatgtccgaggatgattgggagggctggaagctcctcaccgaccggatcggcagccgtgtgcagctcgtcggcgacgacctgttcgtcaccaatgtcgagcgcctcgcccgcggcatcgagacggggacggccaactcgattctcgtgaaggtcaaccagatcggctcgctcaccgagaccctggccgccgtcgatatggcccagcgcgccggctacaccgcggtgatgtcgcaccgctccggcgagaccgaggattcgaccatcgccgacctcgcggtcgcgacgaattgcgggcagatcaagaccggctcgctcgcccgctcggacagactggccaagtacaaccagctcatccgcatcgaggagggcctcggtgcccaggcgctctacgccggccgcagcgcgatccgccagctcgccgggcgctga

SEQ ID NO: 4158 - protein, 429 aa, Methylobacterium extorquens
MTAITNIAAREILDSRGNPTVEVDVLLEDGSFGRAAVPSGASTGAHEAVELRDGDKSRYNGKGVLKAVDAVQSEILDAIGGMDAEDQVAVDEAMIALDGTPNKARLGANAILGVSLAVAKAAAETAGLPLYRYVGGVQGRVLPVPMMNIVNGGAHADNPIDFQEFMVMPVGATSLSDAVRMGAEIFHTLKSALKKAGHNTNVGDEGGFAPNLPSAEAALDFVMESINAAGFKPGSDVVLALDCAATEFFKDGAYRYEGEGQTRSIEQQVDYLAKLTEAYPILSIEDGMSEDDWEGWKLLTDRIGSRVQLVGDDLFVTNVERLARGIETGTANSILVKVNQIGSLTETLAAVDMAQRAGYTAVMSHRSGETEDSTIADLAVATNCGQIKTGSLARSDRLAKYNQLIRIEEGLGAQALYAGRSAIRQLAGR

SEQ ID NO: 4159 - DNA, 1734 bp, Dunaliella salina
  CDS (66)..(1505)
caaccgcgcagagcccaacacccctcttaagcagcagcaaggcgctccccccccaacgcagcacaatggccaccgtgcaggagtacatcgacaagcaccagctgcagaaaaagacggaggacgtgctcaacatcgcggtgaagtccaagcccgatgagccactgtccttcctggccaaggagctgctcaggatggctccatcagagatcttgaaggttgtaggccgtcagatcattgactctcgcggcaaccccactgtggaggcagacgtgcacacccataagggcatgttccgtgctgctgtgccctccggtgcctccactggcatccacgaggcagttgagctgcgtgatggcgacaagaccaagttcctgggcaagggtgtgcagaaggctgtggagagcatcaacaccatcatcagccccgccctgaagggcatggaccccaagaaccagagcgaggtggaccagaagatgatcgaccttgatggcactcccaacaaggccaagctgggtgccaatgcaattctggccgtctccctggccactgccaaggctggtgctgccgagaaggaagtgcctctgtacaggcacattgctgacctggccggcaaccccaagctgtacttgcccgtgccagcgttcaacatcatcaacggcggcagccacgcaggcaacgcccttgccatgcaggagttcatgatcttacccactggagcatcatctttctctgaggccatgcgcatgggcactgaggtgtaccacacactgaagggcatcatcaaggccaagtacggccaggatgctaccaacgttggtgatgagggtggctttgcccccaacatccaatccaatgatgatggtctgtccttggtcaccgatgccattgagaaggcaggatacactggcaaggtcaagatcggcatggacgtggctgcgtcagagttcattaccgaggacaagatgtacgacctgaacctcaagcagcagcccaacgatggctcccacaagaagacagctgcccaaatgctggagatgtacaaggagttctgcaccaagtaccccgtcatctccatcgaggatcccttcgagcaggatgactgggagcctgccaagtccctgactgcagagaacatctgccaggtggttggcgatgacatgctggtgacgaaccccatccgcgtcaagcgcggcattgagcagaaggcagtcaactccttgctcctgaaggtcaaccagattggctccctgactgagtccatcgaggccgtgaggatgtccaaggaggcaggctggggtgtgatgaccagccacaggtctggtgagactgaggactgcttcatcgcagacttggcagttggcctgtccacaggccagatcaagactggtgctccttgccgctctgagcgcaatgctaagtacaaccagctgctccgcattgaggaggagcttggcgagaatgcagtgtacgctggtgagaagtggcgcttcattgagtggcagtgaattgtcatggagtagacttatgttgcttggtggaaatgttgggctgcaaatgcccttgcttgtgtcctgagtggagtgtgtctcgtgggttaatcggatagcttcagcataatgctcctagagagctcacacttcacctgtgtgatccaaacccttggtttgctgaaattctagacgaataatggtgtaacaaacagggctctgaagaaaaaaaaaaaaaaaaaaaaaa

SEQ ID NO: 4160 - protein, 479 aa, Dunaliella salina
MATVQEYIDKHQLQKKTEDVLNIAVKSKPDEPLSFLAKELLRMAPSEILKVVGRQIIDSRGNPTVEADVHTHKGMFRAAVPSGASTGIHEAVELRDGDKTKFLGKGVQKAVESINTIISPALKGMDPKNQSEVDQKMIDLDGTPNKAKLGANAILAVSLATAKAGAAEKEVPLYRHIADLAGNPKLYLPVPAFNIINGGSHAGNALAMQEFMILPTGASSFSEAMRMGTEVYHTLKGIIKAKYGQDATNVGDEGGFAPNIQSNDDGLSLVTDAIEKAGYTGKVKIGMDVAASEFITEDKMYDLNLKQQPNDGSHKKTAAQMLEMYKEFCTKYPVISIEDPFEQDDWEPAKSLTAENICQVVGDDMLVTNPIRVKRGIEQKAVNSLLLKVNQIGSLTESIEAVRMSKEAGWGVMTSHRSGETEDCFIADLAVGLSTGQIKTGAPCRSERNAKYNQLLRIEEELGENAVYAGEKWRFIEWQ

SEQ ID NO: 4161 - DNA, 1296 bp, Clostridium tetani
  CDS (1)..(1296)
atgaaaaattatattgaaattatcgatgtatcagcaagacaagtacttgattcaagatcaaatccaacagttgaggtagatgtaatcctagaagatggaactacaggaagagcagctgtaccatcaggagcatcaacagggatttttgaagctgttgaattaagagatggtgataaatcagtatataatggaaaaggtgttttaaaggcaatagaaaatgtaaacactataattgcagaagaattagttggtatgaatgttttagatcaaattgcaatagacaaaacaatgatagaattagatggaacagataataaaggtaaattaggagctaatgctatgcttggagtatctctagcatgtgcaaaagctgcagcagaatatttaggattaagcctatatcaatatattggaggagtaaatgcaaaggtattaccagttccaatgatgaacataataaatggaggagagcatgcagacaacaatgtagatcttcaagaatttatgataatgcctgcaggagcatcaagttttagtgaagctttaagaatgtgttcagaagtatatcatagcttaaaatctttattaaaagctaaaggatatgatacaggtgtaggcgatgaaggtggatttgctccaaatctaaattctaatgaagaagctattcaagttatagtagaagctatagaaaaagctggatataaaccaggagtagaaatatttattgcattagacccagcgtcttcagaaatatttgaagatggaaaatacaatttaaagggagagggaaaagttcttactccacaagaaatggtagattattatgctaatttagtagctaaatatccaatcatatccatagaagatggtatggcagaagaagattgggaaggttggagacttataactgaaagattaggaacaaaaattcagttagtaggagatgatctatttgtaactaatactgataggttaactatgggaattgaaagaggagtagcaaattcaattcttattaagctaaaccaaataggaactttaactgaaactttaaatgctatagaaatggctgaaagagcaggatatactgcggtagtttcacatagatcaggagaaactgaagatacaactatagcagacttagttgtagctgtaaatgcaggtcaaataaagactggtgcaccagcaagaagtgaaagggttgctaaatacaatcaattattaagaattgaagatgagttaggagaaatgggagaatacagaggattaaaagctttctataatattaaaaagtaa

SEQ ID NO: 4162 - protein, 431 aa, Clostridium tetani
MKNYIEIIDVSARQVLDSRSNPTVEVDVILEDGTTGRAAVPSGASTGIFEAVELRDGDKSVYNGKGVLKAIENVNTIIAEELVGMNVLDQIAIDKTMIELDGTDNKGKLGANAMLGVSLACAKAAAEYLGLSLYQYIGGVNAKVLPVPMMNIINGGEHADNNVDLQEFMIMPAGASSFSEALRMCSEVYHSLKSLLKAKGYDTGVGDEGGFAPNLNSNEEAIQVIVEAIEKAGYKPGVEIFIALDPASSEIFEDGKYNLKGEGKVLTPQEMVDYYANLVAKYPIISIEDGMAEEDWEGWRLITERLGTKIQLVGDDLFVTNTDRLTMGIERGVANSILIKLNQIGTLTETLNAIEMAERAGYTAVVSHRSGETEDTTIADLVVAVNAGQIKTGAPARSERVAKYNQLLRIEDELGEMGEYRGLKAFYNIKK

SEQ ID NO: 4163 - DNA, 1284 bp, Bradyrhizobium japonicum
  CDS (1)..(1284)
atgaccgccatcatcgacatcatcggccgcgaaatcctcgacagccgtggcaatcccaccgtcgaggtcgacgtcgtgctggaagatggcgcgctcggccgcgccgcggtgccatcaggcgcctccaccggcgcccacgaggcggtggaactgcgcgatggcgacaaggcccgctatctcggcaagggcgtcaccaaggcggtcggcgccgtcaatggcgagatcttcgaggccttgagcggcctcgatgtcgagcagcaggcccagatcgaccagatcatgatcgacctcgacggcaccccgaacaagagccgccttggtgccaatgccatcctcggcgtgtcgctcgcctgcgccaaggcggctgcgaactcgctcgacatgccgctctaccgttacgtcggcggcacctcggcgcgactgctgccggtgccgatgatgaacatcatcaatggcggtgtgcatgccgacaacccgatcgacttccaggagttcatgatcctgccggtcggcgcgtcgagcttcgccgagggcctgcgttacggcgcggaggttttccacacgctgaagtcggagctgaagaaggccggccacaataccaatgtcggcgacgagggcggctttgccccgaacctgccgtcagcggacgccgcgctcgaattcgtcatgaacgcgatcggcaaggccggcttcaaggcgggcagtgacatcgtgatcggcctcgactgcgcctcgaccgagttcttcaaggacggcaagtacgtctatgaaggcgagggcaagacccgttcgatctccgagcaggccaagtaccttgccgacctcgttgcgcgctatccgatcgtgaccatcgaggacggcatgtcggaagacgacatggacggctggaaggagctcaccgacctcatcggcaagaagtgccagctcgtcggcgacgatctgttcgtcaccaacgtcaagcgcctcgccgaaggcatcaaggcgggccgggccaactcgatcctgatcaaggtcaaccagatcggcacgctgaccgagacgctggccgccgtcgagatggcgcacaaggcgggctacacctccgtgatgtcgcaccgctccggcgagaccgaggattccaccatcgccgacctcgcggtcgccaccaattgcggtcagatcaagaccggctcccttgcgcgttccgatcgcaccgccaagtacaaccagctcctgcgcatcgagcagcagctcggcaagcaggcgctctatggcggcaaggcggcactgaaggcgctggcctaa

SEQ ID NO: 4164 - protein, 427 aa, Bradyrhizobium japonicum
MTAIIDIIGREILDSRGNPTVEVDVVLEDGALGRAAVPSGASTGAHEAVELRDGDKARYLGKGVTKAVGAVNGEIFEALSGLDVEQQAQIDQIMIDLDGTPNKSRLGANAILGVSLACAKAAANSLDMPLYRYVGGTSARLLPVPMMNIINGGVHADNPIDFQEFMILPVGASSFAEGLRYGAEVFHTLKSELKKAGHNTNVGDEGGFAPNLPSADAALEFVMNAIGKAGFKAGSDIVIGLDCASTEFFKDGKYVYEGEGKTRSISEQAKYLADLVARYPIVTIEDGMSEDDMDGWKELTDLIGKKCQLVGDDLFVTNVKRLAEGIKAGRANSILIKVNQIGTLTETLAAVEMAHKAGYTSVMSHRSGETEDSTIADLAVATNCGQIKTGSLARSDRTAKYNQLLRIEQQLGKQALYGGKAALKALA

SEQ ID NO: 4165 - DNA, 1281 bp, Bacteroides thetaiotaomicron
  CDS (1)..(1281)
atgaaaatagaaaaaattgtagctcgagaaattctcgattcaagaggtaaccccacagtagaagttgacgtagtattggaatcaggtatcatgggacgtgcgtctgttccgtcaggtgcttccacaggtgaacatgaagcactcgaacttcgtgatggtgacaagcaacgttacggtggcaaaggcgtacaaaaggcggtggacaatgtaaacaagatcattgctccgaaactgatcggtatgtcttctctcaaccaaagaggaatcgactacgcaatgttggcactcgacggtactaaaaccaagtccaatctaggtgctaacgctattcttggcgtatctctcgctgtagccaaagcagcagccagctatcttgatctccctctctatcgctatatcggcggaacaaatacatacgtaatgcctgtaccgatgatgaatatcatcaatggcggttcacacagtgacgctcctatcgcattccaggaattcatgattcgtccggtaggtgcaccctcattcagagaaggtttgagaatgggcgccgaagtattccacgctttgaagaaagtactgaaagatcgtggcctcagcactgccgtaggcgacgaaggtggtttcgctcctaacctcgaaggtacggaagatgctctgaactctatcatcgcagccatcaaagctgccggatacgaaccaggtaaagacgtaatgatcggtatggactgcgcttcttccgaattctaccatgacggtatctacgactataccaagtttgaaggtgccaaaggcaagaaacgtaccgccgaagaacagatcgactacctggaagaactgatcaacaaattcccaatcgactccatcgaagacggtatgagcgaaaacgactgggaaggctggaagaaactgactgaacgtatcggcgaccgctgccagttggtaggtgatgacctgttcgttacgaacgttgacttcctcgcaatgggtatcgagaagggatgtgcaaactctatcctgatcaaagtaaaccaaatcggttcgctgaccgaaactctgaacgctatcgaaatggctcaccgtcatggctatacgactgtcacttcccaccgctccggcgaaacggaagacgcaacgattgcagacatcgcagtagctacgaatagcggacagatcaagaccggttcattaagccgttcggaccgtatggctaaatataaccaactgctccgcatcgaagaagaactcggtgacttggctgtatacggatataagagaatcaaataa

SEQ ID NO: 4166 - protein, 426 aa, Bacteroides thetaiotaomicron
MKIEKIVAREILDSRGNPTVEVDVVLESGIMGRASVPSGASTGEHEALELRDGDKQRYGGKGVQKAVDNVNKIIAPKLIGMSSLNQRGIDYAMLALDGTKTKSNLGANAILGVSLAVAKAAASYLDLPLYRYIGGTNTYVMPVPMMNIINGGSHSDAPIAFQEFMIRPVGAPSFREGLRMGAEVFHALKKVLKDRGLSTAVGDEGGFAPNLEGTEDALNSIIAAIKAAGYEPGKDVMIGMDCASSEFYHDGIYDYTKFEGAKGKKRTAEEQIDYLEELINKFPIDSIEDGMSENDWEGWKKLTERIGDRCQLVGDDLFVTNVDFLAMGIEKGCANSILIKVNQIGSLTETLNAIEMAHRHGYTTVTSHRSGETEDATIADIAVATNSGQIKTGSLSRSDRMAKYNQLLRIEEELGDLAVYGYKRIK

SEQ ID NO: 4167 - DNA, 1510 bp, Phytophthora infestans
  CDS (48)..(1412)
ctcttaagcctcaagttcctgaaaacaagctctcctcctctaaaacaatggtgtcgattgtgtcgatcaaggcccgtcagatctttgactcgcgtggcaaccccaccgttgaggttgacctcgtcaccgagctcggcgagtaccgtgccgctgtcccgagcggagcctccacgggcgaatttgaggcccttgagatgcgtgacggcggcaaggactacatgggcaagggtgtcctgaacgctgtgaagaacgtgaacgagatcatcgctcctgctcttatcggcaaggacgtgacgaagcaggccgagatcgaccgcttcatggtggagaagctggacggcacgcagaacgagtggggctggtacaagaagaagctgggcgccaacgcgattctgggtgtgtcgcttgctctgtgccgtgccggtgccgctgccaagaagcagcctctgtggcagcacatcgccgacctggccggcaacccgaccccatgcctgcccgtgccgtcgttcaacattatcaacggtggctcgcacgccggcaacaagctggccatgcaggagttcatgatccttcctgtgggtgcgaagaacttcacggaggccatgaagatcggttcggaggtgtaccacaacctgaagaaggtgatcaagggtcgctacggcctggacgccactgctgtgggtgacgagggtggtttcgccccgaacatccagtcgaacggtgaggccatcgacctgatcgaggaggccatcaaggccgctggctacacgaaccaggtgcgtcttggcatggacgttgccgcgtcggagttctacactggcgccgaggacgctcgctacaaccttgacttcaagaacgagaacgctgcagagtcggagaagatcccggccgacaagctgctggaggtgtacgagggcttcatcgccaagtgcgctgactcgagcaagatcgtgtccattgaggacccgttcgaccaggatgactgggagtcgtgggtgaagatcacgggcaaggtgggcaaggacgtgcagatcgtgggtgacgacctcacggtgacgaacccgacccgtgtgaagaaggccatcgagcagaaggcttgcaatgctcttctgttgaaggtgaaccagattggcagcattacggagtcgatcgaggccgtgacgatggccaagaaggccggctggggcattatggccagccaccgtagtggtgagacagaggacacgttcatcgctgacctggctgtgggtctgagtgccggccagatcaagactggcgccccgtgccgttcggagcgtctggcgaagtacaaccagcttctgcgtattgaggaggagcttggcaacaaggctcgctacgccggcgaggacttccgtgacgtggagaagctcggcaagtactcgaccttttaagtatcttgcatccacatttgatatgatctaaagctctctttaattcgaggggcttaaggttcaacacgtagttctcgttctagtttttcaaaaaaaaa

SEQ ID NO: 4168 - protein, 454 aa, Phytophthora infestans
MVSIVSIKARQIFDSRGNPTVEVDLVTELGEYRAAVPSGASTGEFEALEMRDGGKDYMGKGVLNAVKNVNEIIAPALIGKDVTKQAEIDRFMVEKLDGTQNEWGWYKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSERLAKYNQLLRIEEELGNKARYAGEDFRDVEKLGKYSTF

SEQ ID NO: 4169 - DNA, 2194 bp, Drosophila melanogaster
  CDS (307)..(1809)
ccaacacactgcctttgcgccaacattcacatcaaaattcaacccaatcagtttggctaaccatttctttttatataaaaatagacatgcaatccacagctacgtgtggatcccgattactctaaccttgtgcgaaggtcaattttccccaaaaaatataggaaacgtaccagggaaaacaacaaaaaagggaaagcgcacccccacactgaaaaccggcgagcacctggaaacgcatacatataaaaggagagtaaatatacaaattggtagcactttcgccgccgtcttttacacattcaagccatgtcttggaccgcttcagttttcttgaggacttccaccactagcatgaagtttctgcgtctgcgctggcctctccccagaattccccagaataaatcggcaaacgttgcgccgcgtttcagaagcaaatcagcagtcagccagctctcatctggatttaaatttgtgcagatccgcaaaagtacttgtgacagcaacgagatgaccatcaaagcgatcaaggcccgtcagatctacgactcccgtggcaaccccaccgtggaggtcgacctgaccaccgagctgggactcttccgcgccgccgtgccctccggcgcctccactggcgtccacgaggccctggagctgcgcgacaacgacaaggccaactaccatggcaagtcggtgctgaaggccgtgggccatgtgaacgacaccctgggccccgagctgatcaaggccaatctggatgtggttgaccaggcgtccattgacaacttcatgatcaagttggacggcaccgagaacaagagcaagttcggagccaacgccatcctgggcgtttccctggccgtggccaaggctggagccgccaagaagggcgtgccgctgtacaaacacattgccgatctggctggcaacaaggagatcatcctgccggtgcccgctttcaacgtgatcaacggcggcagccacgccggcaacaagctggccatgcaggagttcatgatcctgcccaccggcgccaccagcttcacagaggccatgaagatgggctccgaggtgtaccaccacctgaagaatgtgatcaaggccaagttcggtctggacgccaccgccgtgggcgatgagggcggcttcgcccccaacatccagtccaacaaggaggctctgaatctgatcagcgatgccatcgccaaggccggatacaccggcaagatcgagatcggcatggatgtggccgcctccgagttctacaaggatggccagtacgatctggacttcaagaacgagaagagcgacaggtcgcagtggctgcccgccgacaagctggccaacctgtaccaggagtttatcaaggacttccccatcgtctcgattgaggatccctttgaccaggaccactgggaggcctggtccaacctgaccggctgcaccgacatccagatcgtgggcgatgatctgaccgtgaccaaccccaagcgtattgccaccgccgtggagaagaaggcctgcaactgcctgctcctgaaggtcaaccagatcggcaccgtcaccgaatccattgccgcccatctgctggccaagaagaacggctggggcaccatggtctcccaccgttccggtgagaccgaggactcgttcatcggtgacctggtcgtcggtctgtccaccggccagatcaagaccggagctccatgccgctcggagcgtctggccaagtacaaccagatcctgcgcatcgaggaggagatcggcgctggcgtcaagttcgccggcaagtcgttcaggaagccgcagtaagcgcagggcacttcgaaattccaaccacaccagccccatcgaatgagatctggatcttggagagggagctggacgcagtagatccatggaaaggcggcggtgcacgtgttcgtcaaccttttacgttcggaacttgtgtctggcgcacaaatacatcagaattaaactaccaaacccatttgctgtctctatgcttcgttcttagacattattaattaatgctaaaccttgatctaatcattatttataaacaaaagcataaaaaacactatgtgcaagatattcgttcagttgccgagagctttgaatatcttcaatgtaatcgctgtaatcgttttgaaattataaattgatctacacaaacaccaaaaaaaaaaaaaaaaaa

SEQ ID NO: 4170 - protein, 500 aa, Drosophila melanogaster
MSWTASVFLRTSTTSMKFLRLRWPLPRIPQNKSANVAPRFRSKSAVSQLSSGFKFVQIRKSTCDSNEMTIKAIKARQIYDSRGNPTVEVDLTTELGLFRAAVPSGASTGVHEALELRDNDKANYHGKSVLKAVGHVNDTLGPELIKANLDVVDQASIDNFMIKLDGTENKSKFGANAILGVSLAVAKAGAAKKGVPLYKHIADLAGNKEIILPVPAFNVINGGSHAGNKLAMQEFMILPTGATSFTEAMKMGSEVYHHLKNVIKAKFGLDATAVGDEGGFAPNIQSNKEALNLISDAIAKAGYTGKIEIGMDVAASEFYKDGQYDLDFKNEKSDRSQWLPADKLANLYQEFIKDFPIVSIEDPFDQDHWEAWSNLTGCTDIQIVGDDLTVTNPKRIATAVEKKACNCLLLKVNQIGTVTESIAAHLLAKKNGWGTMVSHRSGETEDSFIGDLVVGLSTGQIKTGAPCRSERLAKYNQILRIEEEIGAGVKFAGKSFRKPQ

SEQ ID NO: 4171 - DNA, 1981 bp, Anisakis simplex
  CDS (63)..(1373)
gcaaatcgccactctttgggcagcatatcgccgcactttctacaactgcatcatcactcgcaatgccgatcactcgtattcacgctcgtcaaatctacgactctcgtggtaacccaaccgttgaggttgatttgaccactgagaaaggtgttttccgtgctgcggtaccaagcggtgcgtccaccggagtgcatgaggcgctcgagctccgtgacggagacaaagccgtcaaccatggtaagagcgtgctgaaggctgtcgcgaatattaatgacaagattgcacctgcgattgtggccaagaacttctgctccacccaacaaaaggaaatcgatcagttcatgctggatatggacggaactgcgaataaagcgaatttgggtgcgaatgcaattctgggcgtttcgttggcggtcgccaaggctggagcagtgcacaagggaatgccactctacaagtatatcgctgaattggccggtgtgaagcaagtagttatgccggtgccgtcgttcaacgttatcaatggaggatcgcatgcaggaaacaaattggccatgcaggagtttatgattatgccaatcggagcgaagaatttcaccgaagcaatgcgaatgggctctgagatttatcatcatttgaaggcagagatcaagaaacgttacggtttggatgcgacagcagtcggagacgagggtggctttgcgccgaatattcaggataacagggaggggttggacctgttgaacacggccattgctctggctggttatactggcaaggtgtcgatcgctatggacacggctgcgtccgaattctacaaggccgatgagaaaaaatacgatctagacttcaagaatccgaattcggataagagccaatggaagactggagatcaactggccgagatttatcactcgttcgtaaaggagtatccaattgtgtccattgaagacgcattcgaccaggacgattgggagaattggaccaaattcaagagtactcttaacattcagttggttggagacgacttgacggtcacaaaccgtgagcgtattcagatggcgattgataagaaggcgtgcgactgccttttgttgaaggtgaaccaaattggatccgtcacggagtcgatcgaggcagccaagcttgcgcgtgcaaacggatggggcgtgatggtttcgcatcgttctggcgagactgaggacacgttcatcgcagatttagtggtgggtttggccgtaggacagatcaagaccggtgcgccgtgccgttcggaacgtttagccaaatacaatcagcttctgcgaatcgaggaagagctcggctcggcggccgtttacgcaggagagaagttcagaaatccgcaagcctaaatttgtggccgtctgacctgcccagattttggcaatttcatcagctgaagttttggtaccacaccccccccccctccacgaattttgtcaactttttgtgaatttcggtgtttatttattatcgttgttgttgtgcgtccggtgttacataattgtcactgcaatttctcttcgtaatcagtttcaatagttccatttcagttttaacatgttttttgtgctaatgttatgttaggatggatgtatgttctatgatattatgcatctgctattgaacagtattctcgctgctgaattattgaagccagtaataatgcattctgtcgctctgcaaacccgtagcaactggcggaatgtagcggggttcgtgttaattttacatattttcggggtaggattcccctcatgcagaggtaatgtttcttcagcatagcgaattgattttatacgtgttatcttttcaatttgaaaggtttttaacttattaatagtaataattttctcgtttgttataattattattattgatagaagttttttacttaattgcagtgttgtcttttgtaaaactgttataaatcataaggactaaaaaaaaaaaaaaaaaa

SEQ ID NO: 4172 - protein, 436 aa, Anisakis simplex
MPITRIHARQIYDSRGNPTVEVDLTTEKGVFRAAVPSGASTGVHEALELRDGDKAVNHGKSVLKAVANINDKIAPAIVAKNFCSTQQKEIDQFMLDMDGTANKANLGANAILGVSLAVAKAGAVHKGMPLYKYIAELAGVKQVVMPVPSFNVINGGSHAGNKLAMQEFMIMPIGAKNFTEAMRMGSEIYHHLKAEIKKRYGLDATAVGDEGGFAPNIQDNREGLDLLNTAIALAGYTGKVSIAMDTAASEFYKADEKKYDLDFKNPNSDKSQWKTGDQLAEIYHSFVKEYPIVSIEDAFDQDDWENWTKFKSTLNIQLVGDDLTVTNRERIQMAIDKKACDCLLLKVNQIGSVTESIEAAKLARANGWGVMVSHRSGETEDTFIADLVVGLAVGQIKTGAPCRSERLAKYNQLLRIEEELGSAAVYAGEKFRNPQA

SEQ ID NO: 4173 - DNA, 1305 bp, Streptococcus pneumoniae
  CDS (1)..(1305)
atgtcaattattactgatgtttacgctcgcgaagtcctagactcacgcggtaacccaacacttgaagtagaagtttacactgaatcaggtgctttcggacgtggtatggttccatcaggagcttctactggtgaacacgaagcagttgaacttcgcgacggtgacaaatctcgttacggtggtcttggtacacaaaaagctgttgacaacgtaaacaacatcattgctgaagctatcattggctacgatgtacgtgatcaacaagctattgaccgtgctatgatcgcacttgacggtactcctaacaaaggtaaattgggtgcgaatgcaatcctcggtgtgtctatcgctgtagctcgtgctgctgctgactaccttgaaatcccactttacagctaccttggtggattcaacactaaagcccttccaactccaatgatgaacatcatcaacggtggttctcactctgacgctccaatcgctttccaagagttcatgatcttgccagttggtgcgccaacatttaaagaagcccttcgttacggtgctgaaatcttccacgctcttaagaaaatccttaaatcacgtggtttggaaactgccgtaggtgacgaaggtggattcgctcctcgtttcgaaggaactgaagatggtgttgaaactatccttgctgcgattgaagctgctggatatgtaccaggtaaagacgtatttctcggatttgactgtgcttcatcagaattctacgataaagaacgtaaagtttacgactacactaaatttgaaggcgaaggtgctgctgttcgtacatctgcagaacaaatcgactaccttgaagaattggttaacaaatacccaatcatcactattgaagatggtatggatgaaaacgactgggatggttggaaagctcttactgaacgtcttggtaagaaagtacaacttgttggtgacgacttcttcgtaacaaacactgactaccttgcacgtggtatccaagaaggtgctgctaactcaatccttatcaaagttaaccaaatcggtactcttactgaaacttttgaagctatcgaaatggctaaagaagctggttacactgctgttgtatcacaccgttcaggtgaaactgaagattcaacaatcgctgatattgcagttgcaactaacgcaggacaaatcaagactggttcactttcacgtacagaccgcatcgctaaatacaaccaattgcttcgtatcgaagaccaacttggtgaagtagctgaatatcgtggattgaaatcattctacaaccttaaaaaataa

SEQ ID NO: 4174 - protein, 434 aa, Streptococcus pneumoniae
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKALPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 4175 - DNA, 1314 bp, Trichinella spiralis
  CDS (1)..(1314)
atgtctattttggatattcatgctagacagattttcgattcacgtggcaatccaactgttgaagtagatttgcgtacaaatagaggcatttttcgcgctgcggttcctagcggtgctagcactggcattcatgaagctttggaattgcgtgatggggacaaatctcagtacatgggaaaaggagtcagcaaagcggttaagaatatcaacgaagtcatcgcaccatctctgatagcgaagaattttgaagttacagaacaaagtctaatcgacaactttatgctttctctggacggaactgagaacaaatccgtcctcggagcgaacgctattcttggtgtttcgttggccgtttgcaaagctggagcggtgcacaaaggagtttcgctgtaccgttacattgctgacttggctggtgtagacaaggtgatcatgccagtgcctgcgttcaatgttataaacggcggttctcacgcaggaaataagttagctatgcaggaattcatgttgcttcccattggagcatccaactttaaggaagcgatgcgtatgggaagtgaagtgtatcatcatttgaagaactgcattaaagcacgctatggtttggacgcgacagctgtcggggacgaaggtggatttgcgccgaatatccaagacaacaaggaagcactcgagttgctgaaagaggctattggtaaagctggttacgaaggcaaagtgaaaattggcatggatattgcagcgtccgaattttataaatcgaaagaaaaattgtacgatttggatttcaaaaatccagaatcgaatgcaaaagattggaaaaatggcgagcaaatgcttgaattatacaaggattttgttacgaactatccaattgtgtctatcgaggatggttacgaccaggatgattgggataattgggccaaaatgtgcagtgagttgaaaatacaaatagttggagatgatttgacctgcacaaatccgaagcgtattcagcaggcaatagataagaaggcgtgcaacacgttgttgctgaaagtcaaccaaattggttcagtgactgaaagtattcaagcatgtcagctgtctcgtaaaaatggctggggtgttatggtttctcatcgtagtggagaaactgaagacacgtttatcgctgatcttgttgtcggtttggctactggacagattaaaactggcgcaccatgtcgttctgagcgtttggcgaaatataaccaactgttgcgtattgaagaagaactggaacgtcagggcattgcgaaatatgctggcgaaaactttcataatccacagtga

SEQ ID NO: 4176 - protein, 437 aa, Trichinella spiralis
MSILDIHARQIFDSRGNPTVEVDLRTNRGIFRAAVPSGASTGIHEALELRDGDKSQYMGKGVSKAVKNINEVIAPSLIAKNFEVTEQSLIDNFMLSLDGTENKSVLGANAILGVSLAVCKAGAVHKGVSLYRYIADLAGVDKVIMPVPAFNVINGGSHAGNKLAMQEFMLLPIGASNFKEAMRMGSEVYHHLKNCIKARYGLDATAVGDEGGFAPNIQDNKEALELLKEAIGKAGYEGKVKIGMDIAASEFYKSKEKLYDLDFKNPESNAKDWKNGEQMLELYKDFVTNYPIVSIEDGYDQDDWDNWAKMCSELKIQIVGDDLTCTNPKRIQQAIDKKACNTLLLKVNQIGSVTESIQACQLSRKNGWGVMVSHRSGETEDTFIADLVVGLATGQIKTGAPCRSERLAKYNQLLRIEEELERQGIAKYAGENFHNPQ

SEQ ID NO: 4177 - DNA, 1649 bp, Aspergillus fumigatus
  CDS (87)..(1403)
aaattgtctttgatcttccttttcatttgctgcacttgaaccccagttatcctctgatcctcactaccgtctgaaatctcgtcagaatgcctatctccaagatccacgctcgttccgtgtacgactctcgcggtaaccccaccgttgaggtggacgttgccaccgagaccggtttgcaccgtgctattgttccttctggagcttccaccggccagcacgaggctcacgagctccgtgacggtgacaagacccagtggggcggcaagggtgtcctcaaggctgtcaagaatgtcaacgagaccattggccctgctctcatcaaggagaacatcgatgtgaaggaccagtctaaggtcgacgagttccttaacaagcttgacgggactgccaacaagtccaacctcggtgctaatgccatcctcggtgtcagcttggctgttgccaaggctggtgctgctgagaagggtgtccctctctacgctcacatctccgaccttgccggtaccaagaagccctatgtccttcccgttcccttccagaacgtcctgaacggcggttctcacgctggtggtcgcctcgctttccaggagttcatgatcgtccctgactccgctccctctttctccgaggccctccgccagggtgctgaggtctaccagaagctcaaggctctggccaagaagaagtacggccagtccgctggcaacgttggtgacgagggtggtgttgctcccgatattcagaccgccgaggaggctctcgacctgatcaccgaggccatcgaacaggccggctacaccggcaagattaagatcgctatggacgttgcctccagcgagttctacaaggccgacgtcaagaagtacgaccttgacttcaagaaccccgagagcgacccctccaagtggctcacctacgagcagcttgccgacctctacaagtcccttgctgccaagtaccccattgtcagcattgaggaccccttcgctgaggatgattgggaggcctggagctacttctacaagacctccgacttccagattgttggtgatgacctgactgttaccaaccctgggcgtatcaagaaggccatcgagctcaagtcctgcaacgccctcctgctcaaggtcaaccagatcggtaccctgaccgagtccatccaggccgccaaggactcctacgccgacaactggggtgtcatggtctcccaccgctctggtgagactgaggacgtcaccattgccgacattgctgtcggtctgcgctctggccagatcaagaccggtgctccttgccgttccgagcgtctggctaagctgaaccagatcctccgtatcgaggaggagctcggcgagaataccgtttacgctggttccaagttccgcactgccgtcaacctgtaaatgcagccgcggaccttactatttacagagaaaaggttctcaacccaatcagacatacttcaaaaaatgacgattggactcggacccattttgggcttcgaaaaaataacagcattgccaggctgagcaacagaccagcacgtcccaatgctgttcgataaagagttatgatgatgatatgatcagccaattacactatatagtggcttaatgaaaaatgcatccagcttaaaaaaaaaaaaaaaa

SEQ ID NO: 4178 - protein, 438 aa, Aspergillus fumigatus
MPISKIHARSVYDSRGNPTVEVDVATETGLHRAIVPSGASTGQHEAHELRDGDKTQWGGKGVLKAVKNVNETIGPALIKENIDVKDQSKVDEFLNKLDGTANKSNLGANAILGVSLAVAKAGAAEKGVPLYAHISDLAGTKKPYVLPVPFQNVLNGGSHAGGRLAFQEFMIVPDSAPSFSEALRQGAEVYQKLKALAKKKYGQSAGNVGDEGGVAPDIQTAEEALDLITEAIEQAGYTGKIKIAMDVASSEFYKADVKKYDLDFKNPESDPSKWLTYEQLADLYKSLAAKYPIVSIEDPFAEDDWEAWSYFYKTSDFQIVGDDLTVTNPGRIKKAIELKSCNALLLKVNQIGTLTESIQAAKDSYADNWGVMVSHRSGETEDVTIADIAVGLRSGQIKTGAPCRSERLAKLNQILRIEEELGENTVYAGSKFRTAVNL

SEQ ID NO: 4179 - DNA, 1552 bp, Penicillium citrinum
  CDS (114)..(1430)
cgacctctctctcccctactactcttccatcaacatccttccagcttcacctaaagccaagaagggatagcactgtctatacttgacacattcagaccacacattacttcattatgcctatcgccaaggttcacgctcgttccgtgtacgtctctcgcggtaaccccaccgttgaggtggacgttgtcactgagactggtctgcaccgcgccattgtcccctccggtgcttccaccggtcaacacgaggctgttgagctccgtgacggtgacaaggccaagtggggtggcaagggtgtcctcaaggccgtcaagaacgtcaacgagaccattggccccgctctcatcaaggagaacattgacgtcaaggaccaggctaaggttgatgagttcctgaacaagctcgatggcactgccaacaagggtaaccttggtgccaacgccatccttggtgtctccctggccattgccaaggctgccgccgccgagaagggtgtccctctctacgttcacatttccgaccttgccggtaccaagaagccctacgtcctccccgttcccttccagaacgtcctgaacggtggctcccacgccggtggccgtctggccttccaggagttcatgattgtccctgacactgccgagtctttctccgagggtctccgtcagggtgctgaggtctaccagaagctgaaggctctggccaagaagaagtacggccagtccgctggtaacgttggtgacgagggtggtgtcgctcccgatatccagactgctgaggaggctcttgacctcatcaccgaggccatcgagcaggccggctacaccggcaagatctccatcgccatggatgttgcctccagcgagttctacaagaccgacgccaagaagtacgatttggacttcaagaaccccgactccgaccccaccaagtggctcacctacgagcagctggccgatctctacaagtctctggctgccaagtaccccattgtctccatcgaggaccccttcgctgaggacgactgggaggcctggagctacttctacaagacctccgacttccagattgtcggtgatgatctgactgtcaccaaccccctccgcatcaagaaggccatcgagctcaagtcttgcaacgctcttctgctgaaggtcaaccagatcggtaccctgaccgagtccattcaggccgctaaggactcctacgccgacaactggggtgtcatggtctcccaccgttccggtgagaccgaggacgtcaccattgccgacattgctgtcggtctccgctccggccagatcaagaccggtgcccctgcccgttccgagcgtctggctaagctgaaccagatcctccgcattgaggaggagcttggcgagaatgccatctacgctggcaagaacttccgtacctccgtcaacttgtaaatgcagtttgcacttgcacggtgactgttggaagtaaggatgagcgagaaaaaaaagcgataactcgcccttttttatgattatgaattaataagatctctgaatgaaaaaaaaaaaaaaaa

SEQ ID NO: 4180 - protein, 438 aa, Penicillium citrinum
MPIAKVHARSVYVSRGNPTVEVDVVTETGLHRAIVPSGASTGQHEAVELRDGDKAKWGGKGVLKAVKNVNETIGPALIKENIDVKDQAKVDEFLNKLDGTANKGNLGANAILGVSLAIAKAAAAEKGVPLYVHISDLAGTKKPYVLPVPFQNVLNGGSHAGGRLAFQEFMIVPDTAESFSEGLRQGAEVYQKLKALAKKKYGQSAGNVGDEGGVAPDIQTAEEALDLITEAIEQAGYTGKISIAMDVASSEFYKTDAKKYDLDFKNPDSDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADNWGVMVSHRSGETEDVTIADIAVGLRSGQIKTGAPARSERLAKLNQILRIEEELGENAIYAGKNFRTSVNL

SEQ ID NO: 4181 - DNA, 1754 bp, Spinacia oleracea
  CDS (103)..(1437)
tatctgataccaaagagacaccatcaccaattctcttctctccaccaaccgtcttcttcccctcactctacttttatcacagagacacagatcgatttcgccatggttaccatcaagtccgtcaaagctaggcagatcttcgacagccgtggtaaccctaccgtcgaggctgatattcatctagatgatggaaccttcgctagagctgctgttccaagtggtgcatccactggtatctatgaagcccttgagctcagggatggaggcaaagactatatgggaaagggtgttttcaaggctgttcagaatgtaaatgagatcattggccctgctttggttggcaaggacccaactgagcagactgctattgacaacttcatggttcaagaactcgatggaaccacaaatgaatggggttggtgcaagcaaaagttgggagcaaatgccatcttggctgtgtctcttgctgtctgcaaggctggagcgcaagtcaagaaaatcccactataccagcacattgctgagatttctggtaacaagaagatggtcttgccagtaccagccttcaacgttatcaatggtgggtctcatgccggaaacaagcttgcaatgcaagagttcatgattttgcctacgggagcttcctcgttcagggaagcaatgaagatgggtagtgaagtgtatcaccacttgaagagtgtgatcaagaagaagtacggtcaagatgcgacgaatgttggtgatgaaggtggctttgctcctaacatccaggagaacaaggaaggtcttgagttgctgaagactgccattgagaaagctggatacactggcaaggtggtcattggaatggatgttgctgcagctgagttctacagtaaggacaagacctacgacttaaacttcaaggaagagaacaatgacggatcacaaaagatctctggggatgcccttaaggatctttacaagtcatttgtgtcagagtaccccatagtgtcaattgaagatccctttgaccaagatgactgggagcattatggcaagcttactgcagaaattggagacaaagtacaaattgtaggagatgatctcttggtcaccaaccccaagagggtggagaaggcaatcaatgggaagtcctgtaatgctcttcttctcaaggttaaccaaattgggtcagtgacggagagtattgaggccgtgaagatgtcaaaacgtgctgggtggggtgtgatggctagccaccgcagtggagaaaccgaagatactttcattgccgatctttctgttggactttctacgggtcaaatcaagactggagctccatgcagatctgagcgtcttgccaaatacaaccagctcttgcgtattgaggaggaactcggtgacaaagctatttacgccggagcagacttccgtgcaccagttgagccttactaaggtgtgaatttgcatgctgattttgagagaaggcttatccgttaataatagaccagaccctagggtgttgcggagcaactttgttgatgtttttgttgagggcttgagcagtaattaattaatgctatgttttttggaaaccggaatgctttggtttaagctttatgatttcatattattttatctttgatgcctgcttcccaggactgccacggtcatactctcttagctcttacaatatgggatctttatcttacccattgctaaatttatcgtatgaaatgagaaggtcgaatagatgtggaatctacttttgg

SEQ ID NO: 4182 - protein, 444 aa, Spinacia oleracea
MVTIKSVKARQIFDSRGNPTVEADIHLDDGTFARAAVPSGASTGIYEALELRDGGKDYMGKGVFKAVQNVNEIIGPALVGKDPTEQTAIDNFMVQELDGTTNEWGWCKQKLGANAILAVSLAVCKAGAQVKKIPLYQHIAEISGNKKMVLPVPAFNVINGGSHAGNKLAMQEFMILPTGASSFREAMKMGSEVYHHLKSVIKKKYGQDATNVGDEGGFAPNIQENKEGLELLKTAIEKAGYTGKVVIGMDVAAAEFYSKDKTYDLNFKEENNDGSQKISGDALKDLYKSFVSEYPIVSIEDPFDQDDWEHYGKLTAEIGDKVQIVGDDLLVTNPKRVEKAINGKSCNALLLKVNQIGSVTESIEAVKMSKRAGWGVMASHRSGETEDTFIADLSVGLSTGQIKTGAPCRSERLAKYNQLLRIEEELGDKAIYAGADFRAPVEPY

SEQ ID NO: 4183 - DNA, 1501 bp, Euglena gracilis
  CDS (37)..(1332)
tagacggggccgcgacgggggcccgtcgtttttgggatgcctgtcatcaagactgttaaagcgcgtcaaatcctcgactctcgagggaacccaactgtggaggttgatgtcatcctggacaatggactcctgggtcgcggtgctgtgccttctggagcttccaccggagagtacgaagccgttgagctccgtgatggggataaggcggtgtacctcggaaagggggttctgaagagcgtggaggccgtgaacaccattgtcgcacccaaactcgttgggttggatcccacagaacagctgaaaatcgacaacttgatgcgcgagctggacggcaccccaaacaagggaaagattggtgccaacggcattctgggtgtctccatggcggtttgccgtgctgcagctcttgtcaagggagttccattgtatcgccacattggcgatttgcatggaaataagaccttccaaatgcccgtcccaatgtgcaacatcatcaatggaggcaagcatgcagacaacaaaattgacttccaagagttcatggtcatgcccgtaggtgcggcaaacttcagtgaaggtcttcgctggtgtgcagagatcttccaccacttgaagagcatcctgaagaaagctggacatgtcacctcagttggtgatgagggtgggtttgctccaaatctcgataatgatgaggctttggactttgttattgccgccatcaaagctgctggtttcgagccaggcaagcagattgccatcgccctggactgcgcctcttcagagctgtttgatgaaggtgaccgcaagggatacaagtactggaagtccaaccccgaccggttgttcagtgctgccgagatgattgagaagtacgcaggctgggttgcaaagtatcccattgtttccattgaggaccctttggatcagaatgactgggatggatatgtgaacatgacaaagcagctgggtggtaagatccagattgtgggtgatgacttctttgtgaccaatcccacccgcttcaagaagggcattgaacttgcagcctgcaactccatccttatcaaggtaaaccaaattggaacggtttccgaaactttggaatgcatcaagatggcccaagcagcaggatacacggctgttgcttctcaccgctctggtgagacagaggatgcattcattgcagacctggccgttggcactgcagcgggacagatcaagactggttcgttgtcccgcacggaccgcatggccaagtacaaccagctcatccgcatcgaggaggagttggggggagaggccaagtggaccactgccatgctgcggaagtgagcatgttggaagacacaacagcaaaaacgttttgaaagttttcacacgaaccgtcaaacatcgctccacctgtggttatcgcctcattaccccggtgcatcacacgggatcactctgttgtgccgctccgccgttggactgccagaagaaaagggcctgttgaggttca

SEQ ID NO: 4184 - protein, 431 aa, Euglena gracilis
MPVIKTVKARQILDSRGNPTVEVDVILDNGLLGRGAVPSGASTGEYEAVELRDGDKAVYLGKGVLKSVEAVNTIVAPKLVGLDPTEQLKIDNLMRELDGTPNKGKIGANGILGVSMAVCRAAALVKGVPLYRHIGDLHGNKTFQMPVPMCNIINGGKHADNKIDFQEFMVMPVGAANFSEGLRWCAEIFHHLKSILKKAGHVTSVGDEGGFAPNLDNDEALDFVIAAIKAAGFEPGKQIAIALDCASSELFDEGDRKGYKYWKSNPDRLFSAAEMIEKYAGWVAKYPIVSIEDPLDQNDWDGYVNMTKQLGGKIQIVGDDFFVTNPTRFKKGIELAACNSILIKVNQIGTVSETLECIKMAQAAGYTAVASHRSGETEDAFIADLAVGTAAGQIKTGSLSRTDRMAKYNQLIRIEEELGGEAKWTTAMLRK

SEQ ID NO: 4185 - DNA, 1645 bp, Lupinus luteus
  CDS (58)..(1392)
gaattcggcacgagttcatttctcttcagtaaccgtaaatctcatctcaaatctgaaatggccacaatcgctaccatcaaggctagacaaatcttcgacagtcgtggcaatccaaccgttgaggtggatttgacattatccgatggtacttttgccagagctgctgttccaagtggtgcttccaccggtatatatgaggcccttgaattaagagatggaggatctgactaccttggaaaaggtgtatcaaaggctgttgacaatgtaaacacaattattgcccctgcattgattggaaaggatccaactgaacagacagctattgacaactttattgttcaagagcttgatggaactgttaatgaatggggttggggcaagcaaaagcttggtgcaaatgccatattggcagtgtctcttgcagtttgcaaagctggtgctagtgccttgaaaatccctctttacaagcatatcgcaaatcttgcgggtaacaagaatttggttttgcctgttcctgctttcaatgtcataaatggtggatcacatgcaggaaacaaacttgccatgcaggagtttatgattctcccagtgggagcttccactttcaaggaagccttgaagatcggtgtggaagtatatcacaatttgaagtctgtgattaagaagaaatacggtcaggatgcagtaaacgttggtgatgaaggtggctttgctcccaacattcaggaaaacaaagaaggtttggaattgctgaaatctgccattgccaaagctggttacactgataaggttgtcattggaatggatgttgccgcatctgaattctacacatcagacaagaaatacgttctgaacttcaaggaagataacaatgatggctcacagaagatctctggggaagaattgaaagaactctacaaatcatttgttgcagagtacccaatagcttcaattgaagatccttttgatcaggatgactgggagcactatggtaagataactaccgagattggaaccgaggtgcaaattgttggtgatgatctcttagttaccaacccaaagagggttcagaaggcaattgactcaaaatcatgcaatgctcttctgctcaaggtcaatcaaattggatcagtcaccgaaagtattgaagccgtcaagatgtccaaaaaagctggatggggtgtaatgaccagtcaccgaagtggagagactgaggataccttcattgctgatcttgctgttggtttgtcaacgggtcagattaaaactggagctccatgcaggtcagagcgtcttgctaaatacaaccagctgctgagaattgaggaggagcttggtgatgaagctgtgtatgctggcgtaaactaccgtaacccagttgagccatactaaagctttgaagtggaaaaacaccaaatgagttgagcaatgtagtatttggttgaggggggttttgttgtgtgatgaataagttaacaattaaaacttcagtgttgttgaaaaagacttttccaataactcttgagttttgatttacagggccaagactgttatgacttatgccctatatttaaaggctgtttaatgatatttaacttcagtaattgaagcttatttccaaaaaaaaaaaaaaaaaaaaaaaaaa

SEQ ID NO: 4186 - protein, 444 aa, Lupinus luteus
MATIATIKARQIFDSRGNPTVEVDLTLSDGTFARAAVPSGASTGIYEALELRDGGSDYLGKGVSKAVDNVNTIIAPALIGKDPTEQTAIDNFIVQELDGTVNEWGWGKQKLGANAILAVSLAVCKAGASALKIPLYKHIANLAGNKNLVLPVPAFNVINGGSHAGNKLAMQEFMILPVGASTFKEALKIGVEVYHNLKSVIKKKYGQDAVNVGDEGGFAPNIQENKEGLELLKSAIAKAGYTDKVVIGMDVAASEFYTSDKKYVLNFKEDNNDGSQKISGEELKELYKSFVAEYPIASIEDPFDQDDWEHYGKITTEIGTEVQIVGDDLLVTNPKRVQKAIDSKSCNALLLKVNQIGSVTESIEAVKMSKKAGWGVMTSHRSGETEDTFIADLAVGLSTGQIKTGAPCRSERLAKYNQLLRIEEELGDEAVYAGVNYRNPVEPY

SEQ ID NO: 4187 - DNA, 1290 bp, Leishmania major
  CDS (1)..(1290)
atgccgatccgaaaggtttacgcccgcgaggtgctcgactcccgcggcaacccgaccgttgaggtcgagttgatgacggaggccggcgttttccgctccgctgtgccttccggcgcgtcgactggcgtgcatgaggcgtgcgagctgcgcgacggcgacaaggcgcgctactgtggcgccggctgcacgcaggcggtgaagaacgtgaacgagatccttgcgccggcgcttgtgggcaaggaagagtcggaccaggccggcctcgacaagatgatgtgtgagctggacgggacaaagaacaagagcaagctcggcgcaaacgcgatcctgggctgctcgatggcgatcagcaaggccgccgcggcgaaggctggcgtgccgctgtacaggtacatcgcgagtctcgccgggacgaaggatatccgcctgcctgtgccgtgcttcaacgtgatcaacggtggcaagcacgccggcaacatcctgccgttccaggagttcatgattgcgccgacgaaggcgacgtcgttccgcgaggcgctgcgcatgggctcggaggtataccacgcgctcaaggtgatcatcaagagcaagtacggccaggacgccgtgaacgtcggcgacgagggcggcttcgcgccgccgatcaagcatatcgacgagccgctgccgatcctgatggaggcgattgagaaggctgggcacaagggcaagttcgcgatctgcatggactgcgcggcaagcgaagcgtatgacgcggagaggaagatgtacaacctgacattcaagaaccccgagccgacgtacgtgtccgcggcggagttgcaggcgacctatgagcgctgggtcgcggagtacccgctggtgtccatcgaggacccgttcgcggaagacaactttgacgagttctcggcgatcacgaaggcacttgccgggaaggctcagatcgtcggtgatgacctgacggtgacaaacgtgaagcgtgtgacgatggcgatcgagaagtctgcgtgcaactcgctgctactaaaaatcaaccagatcggcacgatcagcgagtcgatcgcagcggcgaagctgtgcatggagaacgggtggtctgtgatggtgtcgcaccgtagcggcgagacggaggacacgtacattgctgacctgtccgtgggcctgggaaccggccagatcaagaccggcgcgccgtgccgtggcgagcgcactgcgaagctgaaccagctgctgcgcatcgaggaggagatcgggtccactgctacgtacggctaccccggctgggcgtaa

SEQ ID NO: 4188 - protein, 429 aa, Leishmania major
MPIRKVYAREVLDSRGNPTVEVELMTEAGVFRSAVPSGASTGVHEACELRDGDKARYCGAGCTQAVKNVNEILAPALVGKEESDQAGLDKMMCELDGTKNKSKLGANAILGCSMAISKAAAAKAGVPLYRYIASLAGTKDIRLPVPCFNVINGGKHAGNILPFQEFMIAPTKATSFREALRMGSEVYHALKVIIKSKYGQDAVNVGDEGGFAPPIKHIDEPLPILMEAIEKAGHKGKFAICMDCAASEAYDAERKMYNLTFKNPEPTYVSAAELQATYERWVAEYPLVSIEDPFAEDNFDEFSAITKALAGKAQIVGDDLTVTNVKRVTMAIEKSACNSLLLKINQIGTISESIAAAKLCMENGWSVMVSHRSGETEDTYIADLSVGLGTGQIKTGAPCRGERTAKLNQLLRIEEEIGSTATYGYPGWA

SEQ ID NO: 4189 - DNA, 1284 bp, Chlorobium tepidum
  CDS (1)..(1284)
atgaaaattcaaaatgttaatgctatcgagattctcgattcgagaggaaacccaaccgttgaagtgaatttaaaacttgaagacggtactatttctcgtgcaatggttccaagtggagcatcaacgggagaaagagaagcaacagaacttagagatggcgacaaaaagcgctatggcggtaaaggtgttttaaaagctgtcgagaatgttaattcagccattgcaaaagccattgagaataaacactttaccaatcaacgagaattggactattttcttattgaacttgacgaaactaataacaaatctaaactaggggctaatgcgatacttggtgtttcaatggcttttgcccgtgcaaaagcgcaaagttcacgtactccgctatatcaatatttaggcggcagtaatgctcacattatgcctgttccctgtatgaatgtcatcaatggaggtaaacatgcagacaatacaatagactttcaggaatttatgattgctccacataacgctccatcgtttagagaatcaatccgtatgggcgaagaagtttttcacgccttgaaagctgtattaaagttaaaaggattaagcactggcgttggagatgaaggcggttttgctccagacttaaaatccaatgaacaagccgttgaaatgatattagaagggattactaaagctggttataagccaagtgtagatgttagtatttgtcttgacccggcttcaagtgaaatgtgggaaaatgggaaatacaaattctttaaaagtactcagaaattggtttccagtgatgaaatggtgaaattgtgggaaagctgggtaaatcaatacccaattgtattactagaagatggaatggctgaaaatgactgggaaggttggaaaaatcttacagatgtaatcggaaacaaaatcgagattgttggcgatgatttgttctgtactaataaatcaattttattaaatggtataaataaaggcgttgcaaattctatcctgataaaattgaatcaaataggtactgtgacagagactttagaaacgattgaacttgcatataaaaattcatataattgttttgtttcccatcggagtggagaaacggttgatagttttattgccgatttgacagtaggaattaatgctggacatcttaagagtggtagtggttgtcgaggagaaagaatagaaaaattcaatcaacttatgcggattgaaaatgaattgggtaaatcagctcaatttgcaggattgaaagcctttaaaaatgcaaaataa

SEQ ID NO: 4190 - protein, 427 aa, Chlorobium tepidum [sequence omitted]

SEQ ID NO: 4191 - DNA, 1651 bp, Hevea brasiliensis
  CDS (30)..(1367)
ctagatctaacgcaaccaagcttttatccatggcgattaccattgtctccgtcagggcgagacagatcttcgacagccgtggaaatccaaccgttgaggctgatgtgaaattatctgatggttatttggcaagagccgccgttccaagtggggcatccactgggatctatgaggccctcgaactaagggatggaggatcagactaccttggaaaaggtgtttccaaggctgttgagaatgttaacattattattggccctgcattggttggcaaggacccaactgatcaggttgggattgataacttcatggtgcaacaacttgatggaactgtaaatgagtggggttggtgcaaacaaaagcttggggcaaatgccatattagcagtgtctcttgcagtttgcaaggctggggctcatgtcaaggggattcccctttacgagcacattgctaacctcgctggtaacaagaatttggtgttgcccgttcctgctttcaatgtcatcaatggtggatcacatgccggaaataaacttgctatgcaggagttcatgattcttcctgtgggagcttcttcattcaaagaagctatgaagatgggtgctgaagtataccatcacttgaagtctgtgataaaaaagaagtatggtcaggatgcaacaaatgttggcgatgaaggtggttttgctcctaatattcaggaaaacaaggaaggacttgagttgctcaagactgccattgctaaagctggctacacaggaaaagtggttattggaatggatgttgctgcttcggaattttatggctcagatcaaacatatgatttgaacttcaaagaagagaacaataatggttcgcaaaagatctcaggtgaagctctcaaggacctctacaagtcatttgtagctgagtatcctattgtatcaattgaggatccatttgaccaagatgactgggcacactatgcaaagctaactagtgaaattggagagaaagtacaaattgtgggagatgatctcttagtcaccaatcctaagagggttgagaaggctatcaaagagaaagcttgcaatgctctccttctcaaggttaatcagattgggtctgtgactgagagcattgaagctgtgaagatgtccaagagagctggctggggtgtaatggcaagccaccgcagtggtgaaactgaggatactttcattgctgatttgtcagttggtttggccacgggtcagataaagacaggagcaccatgcaggtctgagcgccttgcaaaatataatcagctcctgcgaattgaggaagagcttggctctgaagctgtttacgctggagcaaacttccgcaaacctgtcgaaccctattagaatgtgaaaggttgtcagctgtcacgttggatctgagtagttgaaagattacatgaagtgaataagttttatgtaaactgggaccttttttgaataattttctaagaaattttgttctgaggttggaacagtattaaagcgaagttttttaaatttgaaatatgtgctaccaaaaccttagattgagttttataatttttttctagtcgggaacgtgtactttggatgcattgtaatcctaggtgaatgattttgctttgcatatcaaaatggtttggtttgct

SEQ ID NO: 4192 - protein, 445 aa, Hevea brasiliensis [sequence omitted]

SEQ ID NO: 4193 - DNA, 1287 bp, Pseudomonas syringae
  CDS (1)..(1287)
atggcaaaaatcgtcgacatcaaaggtcgtgaagttctcgactcccgtggcaatcccaccgtggaagcagatgtgctcctcgataacggcatcatcggcagcgcctgcgcgccgtccggtgcttcaaccggctcgcgcgaagcgctggagctgcgtgatggcgacaagagccgttacatgggcaagggtgttctgaaggctgttgcgaatatcaacggtccgatccgtgatctgctgctgggcaaagacccggttgaccagaaagcgctggatcacgcgatgatcgcgctggacgctaccgagaacaaggcaagtctgggcgccaacgcgatcctcgccgtctccctggcggcggccaaggcggctgcacaggatcaggacctgccactgtatgcgcacatcgccaacctcaatggcaccccgggcgtttattccatgccggttccgatgatgaacatcatcaacggtggcgagcatgccgataacaacatcgacatccaggaattcatgatccagccggtcggcgccaagagcttcgctgaagcgctgcgctggggtaccgagattttccatcacctcaaggccgtgctcaaggcgcgtggcctgaacaccgcggtcggtgatgaaggcggtttcgccccgaacctggcatccaacaaagaagcactcgaggctattgccgaagccgtcgccaatgcgggttacacgctgggcaccgacgtgaccctggcgctggactgcgcggcgagcgagttctataaaaacggcaagtacacgctcagcgaagaaggcgagtacagctctgccgagtttgccgaataccttgccgaactgacccgcaagcacccgatcatttccatcgaagacggtctggacgagtccgattgggacggctggaaagtcctcaccgagaagatcggcgagaaggtccagctggtcggtgacgacctgttcgtgaccaacaccaagatcctgaaagagggcatcgacaagaacattgccaactcgatcctgatcaagttcaaccagatcggcaccttgaccgaaacgctggaagccattcaaatggccaaggctgccggttacaccgccatcatctcccaccgctccggtgagaccgaagattcgaccatcgccgacctggccgtgggcacctctgccggtcagatcaagaccggttcgctgtgccgttccgaccgtgtttccaagtacaaccaactgctgcgcatcgaggagcaattgggctccaaagctgtgtatcgtggtcgtgccgagtttcgcggctga

SEQ ID NO: 4194 - protein, 428 aa, Pseudomonas syringae [sequence omitted]

SEQ ID NO: 4195 - DNA, 2016 bp, Toxoplasma gondii
  CDS (321)..(1655): n means a or g or c or t/u, r means g or a
caacatactgtttccagctgcccattccctgagaacactcaggtgctccatgtacaaggtctttttcccagtcattgtacgtagcttcgcagtccgcaacaagctgctgtgtgccacgctttctgtcggatggtttgttagcactgtgcggtgcgcttggtagtgacatatcagagcttcctggaaagaacattcgagagcgaggaagggcaagtttgttgtaagcctcgagtagcttagcccccgatcatctgcagtgtcctgataatcaagctttggctggataaacgacgagttcactcatctacgcgcctgtcacgatggtggttatcaaggacatcgttgcacgcgagattttggattctcgcggcaatcccacaattgaagttgatgtatcaactgaaggaggtgtcttccgagctgcggttcctagtggagcgtctacgggtatttatgaggctctggagttgcgcgataaagatccgaaacggtacttggggaaaggcgtgctgaacgctgtagagattgtccgacaggaaatcaagccagcattgctgggcaaagatccgtgtgatcagaaaggtattgatatgcttatggtggagcagctggacggaacaaaaaacgagtggggctattccaagtcaaagctaggtgcaaatgccattttgggcgtgtcgatagcttgctgccgagcaggagcagcatcaaaaggcctaccactatacaaatacatcgctacacttgcagggaaaacgatcgataagatggttatgcctgtaccgtttttcaatgttatcaatggaggcgaacatgcaggcaatggcttggctcttcaagaattcctgatcgctcccgttggtgctccgaacatccgagaggcaattcgttatggatcagaaacgtaccaccacctgaaaaatgttataaagaacaagtatggcttggacgcgacgaatgttggcgatgagggcggctttgcaccgaacgtagccactgctgaagaggctctgaatctccttgttgaagccatcaaagctgcggggtacgagggtaagatcaagatcgcatttgacgcagctgcttcagagttctacaaacaagatgaaaaaaagtatgacctggattacaaatgtaagaccaagaatgcatccaaacacctgactggtgagaagctgaaggaggtttacgaggggtggctgaaaaagtatcccatcatatcggttgaagaccctttcgaccaagatgacttcgcaagtttctcagcttttactaaggatgtgggtgagaaaacacaggttataggggacgatattctggtaactaacattcttcgaattgagaaggcactcaaagacaaagcgtgcaattgcctgttactgaaggtaaaccagatcggctctgtaacagaggcaatcgaagcgtgcctccttgctcaaaaaagtggctggggggttcaggtttcccatagatccggtgaaacagaggattcatttattgccgatcttgtcgtgggccttcgctgtggccagatcaagagtgggtctccttgcaggtccgagcgactatgtaaatacaaccagcttatgcggattgaggagtccctaggagcggactgcgtatacgcgggagagagctttcgacacccaaaatgaagaaatgactcgcgaacgccgaaatggacttttcagcagagtgtcaaagccgaaccgtancatctcaagacggactacgsgtattgatgaacgcggatgtctctagaaaagcgagacctgrattagttcggatgccagttacatgtgacgccaagacagatgtgggcggcatcgtttcaggagtgcttttccacagtgtttgtgtggcaaacagcaatgtggtaggtgggtgtgcgtgaatatttccacaaactcaatgcatatcccacaaaacactcccaggtcgccaatgtccacactcctgccataaacgttaccaagtaaaaaaaaaaaaaaaaaaaaaaaaaaaaaaaaaaaaaaa

SEQ ID NO: 4196 - protein, 444 aa, Toxoplasma gondii
MVVIKDIVAREILDSRGNPTIEVDVSTEGGVFRAAVPSGASTGIYEALELRDKDPKRYLGKGVLNAVEIVRQEIKPALLGKDPCDQKGIDMLMVEQLDGTKNEWGYSKSKLGANAILGVSIACCRAGAASKGLPLYKYIATLAGKTIDKMVMPVPFFNVINGGEHAGNGLALQEFLIAPVGAPNIREAIRYGSETYHHLKNVIKNKYGLDATNVGDEGGFAPNVATAEEALNLLVEAIKAAGYEGKIKIAFDAAASEFYKQDEKKYDLDYKCKTKNASKHLTGEKLKEVYEGWLKKYPIISVEDPFDQDDFASFSAFTKDVGEKTQVIGDDILVTNILRIEKALKDKACNCLLLKVNQIGSVTEAIEACLLAQKSGWGVQVSHRSGETEDSFIADLVVGLRCGQIKSGSPCRSERLCKYNQLMRIEESLGADCVYAGESFRHPK

SEQ ID NO: 4197 - DNA, 1314 bp, Chlorobium tepidum
  CDS (1)..(1314)
atgtcagtcatcaccaggattcatgcccgccagataatggactcgcgaggaaacccgacggtcgaggtggatgttcatactgaaagttcttttggccgtgctgcggtgccaagcggcgcctcgacgggtgttcacgaagcggtcgagctgagggacaaggacaagagcgtttttctcggcaaaggggtgctcaaggctgtcgagaacgtcaacaccttgatcaatgatgctttgctgggcatggacgtgactgagcaggaggctatcgacgcgaagctcatcgagcttgacggtacgccgaacaagtcgaaactcggcgcgaacgccattcttggcgtttcactcgcctgcgcaaaagctggagccgaatattcagccctgccgctctaccgctacatcggcggaacgacggccaagaccctgcccgtgccgatgatgaacgtgctcaacggtggcgctcatgctgacaatacggttgatttccaggagttcatgattatgccgatcggcttcgagcgctattccgatgcgcttcggtgcggagccgaggtgtttcactcgctcaagtccctgctacacgatcgcggtctgagcacggcggtgggcgacgaaggcggatttgcgccgaacgtggagtccaacgaacaggccatcgagctggtgatcgaggccatcggcatggctggctacaaagctggtgcgccgactgacaggggaggcctcggcgatggtcatgtcatgatcgcactcgatccggccagctctgagttctacgacgccgaaaagaaaaagtacgttttcaagaaatcctccggacgcgaactttcgtcagaagagatggccagctactgggccgactgggcgagccgctatccgatcatctcgatcgaagatggcatggctgaggatgactgggaaggctggaagatgctgaccgacaagatcggcggccgtgtgcagcttgtgggtgatgacctgttcgtgaccaacagcaagcgccttgccgaaggtatcgagaagggcgtcggcaactcgattctcatcaaggtcaaccagatcggcactctgaccgaaacccttcaggccatcgagctggccaagcgcaacggctacacctcggtcatcagccatcgcagcggcgagaccgaagacaccaccattgcgcagatcgccgtggcgaccaacgccggacagatcaagaccggcagcatgtcgcgctccgaccgcatggccaagtacaacgagctgctcagaatcgaggaagagcttggcagcacggcgctctatccgggcatcggggccttccgggtctga

SEQ ID NO: 4198 - protein, 437 aa, Chlorobium tepidum [sequence omitted]

SEQ ID NO: 4199 - DNA, 1649 bp, Hevea brasiliensis
  CDS (28)..(1365)
ctagatctaacgcaccgagctttatccatggcgattaccattgtctccgtcagggcgagacagatcttcgacagccgtggaaatccaaccgttgaggctgatgtgaaattatctgatggttatttggcaagagccgccgttccaaggggggcatccactgggatctatgaggcccttgaactaagggatggaggatcagactaccttggaaaaggtgtttccaaggctgttgagaatgttaacattattattggccctgcattggttggcaaggacccaactgatcaggttgggattgataacttcatggtgcaacaacttgatggaactgtaaatgagtggggttggtgcaaacaaaagcttggggcaaatgccatattagcagtgtctcttgcagtttgcaaggctggggctcatgtcaaggggattcccctttacaagcacgttgctaacctcgctggtaacaagaatttggtgttgcccgttccggctttcaatgtcatcaatggtggatcgcatgccggaaataaacttgctatgcaggagttcatgattcttcctgtgggggcttcttcattcaaagaagctatgaagatgggtgctgaagtataccatcatttgaagtctgtgataaaaaagaagtacggtcaggatgcaacaaatgttggtgatgaaggcggttttgctcctaatattcaggaaaacaaggaaggacttgagttgctcaagactgccattgctaaagctgggtacacagggaaagtggttattggaatggatgttgctgcttctgaattttatggctcagataaaacatatgatttgaacttcaaagaagagaacaataatggttcacaaaagatctcaggagatgtgctcaaggacctctacaagtcatttgtaactgagtatcctattgtatcaattgaagatccatttgaccaagatgactgggagcactatgcaaagctaactagtgaaattggagtgaaagtgcaaattgtaggagatgatctcttagtcaccaatcctaagagggttgagaaggctatcaaagagaaagcttgcaatgctctcctcctcaaggttaatcagattggatctgtaactgagagcattgaagctgtgaagatgtccaagagagctggctggggtgtaatggccagccaccgcagtggtgaaacagaggatactttcattgctgatttgtcagtgggtttggccacgggtcagataaagacaggagcaccctgcaggtccgagcgccttgcaaaatataatcagctcctccgaatcgaggaagagcttggtgctgaagcagtttacgctggagctaacttccgcacacctgtcgaaccctattagaatgtgaaaggttgtcagctgtcacgttggatctgagtagttgaaagattacatgaagtgaataagttttatgtaaactgggaccttttttgaataattttctaagaaattttgttctgaggttggaacagtattaaagcgaagttttttaaatttgaaatatgtgctaccaaaaccttagattgagttttataatttttttctagtcgggaacgtgtactttggatgcattgtaatcctaggtgaatgattttgctttgcatatcaaaatggtttggtttgct

SEQ ID NO: 4200 - protein, 445 aa, Hevea brasiliensis
MAITIVSVRARQIFDSRGNPTVEADVKLSDGYLARAAVPRGASTGIYEALELRDGGSDYLGKGVSKAVENVNIIIGPALVGKDPTDQVGIDNFMVQQLDGTVNEWGWCKQKLGANAILAVSLAVCKAGAHVKGIPLYKHVANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNNGSQKISGDVLKDLYKSFVTEYPIVSIEDPFDQDDWEHYAKLTSEIGVKVQIVGDDLLVTNPKRVEKAIKEKACNALLLKVNQIGSVTESIEAVKMSKRAGWGVMASHRSGETEDTFIADLSVGLATGQIKTGAPCRSERLAKYNQLLRIEEELGAEAVYAGANFRTPVEPY

SEQ ID NO: 4201 - DNA, 1284 bp, Pseudomonas syringae
  CDS (1)..(1284)
atgaaaacgcaaatccaggccattcatgcacgtgaaattctcgattcacgcggtaaccctaccgttgaagtcgacgtcaccttggagtgcggcgccatgggccgggcttcagtaccgtccggtgcctctacaggcgctcacgaagcagttgagttgcgtgacaaagatacacagcggtactccggcaagggagtgttaaaggccgttagcaatgtgaataccgaaatacttgagtctgtgaggggcatgaatgcgattgaccaggaacaaattgatcatttgatgattaagctggatggaacctctgataaatccaggcttggaggaaacgcgatcttgggcgtgagcctcgccgttgccagagcggcggcttctgcgctgaacttgcccttgttccaatatctgggcggcgagcaagcagcaagaatgcccgtcccgatgttcaatattctcaatggcggtgttcacgccaactggcaaggccctgactttcaggaattcatgattgcacctacaggggctggcagtttcaaggaagccttgcgatggggctccgaggtgtaccacgagctgaaagcggtgcttaaggacgccggctattcaacagcggtcggagatgagggcggctttgcgccggcactcaagaaaaactcagacgccattgagctgatcatcaaggcaatcgagagggctggttacacccctggatctcagatcgagatcgctatcgatccagcatccagcggcttctatgaaaacggcctttaccatctgcgctctgagggtcgtaaggtcgatgctcaagagctgattaatctctattcctcctgggtcgacaagtatccgattgcggtactggaagatggactcgcggaagacgattggtcaggctggaagctattgaatgcagctctgggtgaccggatcgagttggttggagatgacctatttgtcaccaatgtcgaacggattcagcgaggcatcacagaaaacgtcgccaatgccgtattgatcaaacctaatcaaatcggaacgctgactgagaccaaagccgccatcgaaatggcctatggggcaaattggggggcgatggtttctcatcgtagcggggagacggtggacagctccatcgctgatctgactgtcgcgatggggactggccatctcaagacaggagctccatgccggggggagcgggtcgagaaatacaatcagtttctgcgaatagaagaggatcttggcagccgtgcgttttatgcaggacatgatgcattcgtgcgctga

SEQ ID NO: 4202 - protein, 427 aa, Pseudomonas syringae [sequence omitted]

SEQ ID NO: 4203 - DNA, 1305 bp, Streptomyces coelicolor
  CDS (1)..(1305)
atgtccgcaacagcagtcgagcccgccgcggcgatcgagaccgtcaccgcccgccggatcatcgacagccgcggcaaccccacggtcgaggtcgacgtcgtcctggaagacgggtccctgggacgggcagccgtcccgtccggcgcctccaccggagcccgggaagcggtggagctgcgcgacgaagaccccacccgctggcacggcaagggcgtcgaccgcgcggtggcccatgtgaacggggagatcgcggcgtccgtgcgcggccgcgacgcggcggaccaggcgggtctcgacgccgcgctgatcgccctggacggcaccgccgcgaagtcccggctcggcgccaacgcgctcctcggtgtctccctcgccgccgccaaggccgccgccgcggcccgccgtcagcccctctaccgttacctcggcggcgccgacgcgcacctactgccgctgccgatgatgaacatcgtcaacggcggtgcccatgccgacaatccgctggacttccaggagttcatgatcgtgccggtgggtgcggacacgttcgccgaagccgtccgcatgggcagcgaggtcttccacaccctgcgccgggatctgctggccgccgggcactccaccggcgtgggcgacgagggtggcttcgcgcccgcgctgcgcaccgccgaggaggccctcgacttcgtggtggccgccatcgagcgcaccggctaccgcgccggcccggacatcggcctggtcatggacccggcgtcgtcggagttcttccgcgacggcgggtacgactacgcgggcgagggggtgcgccggtcccccgccgaacacgccgaccacctggccgggctcatcgacgcctacccggtcgtctccatcgaggacccgatggccgaggacgatctggacggctggcgcgaactgaccgaccgcgtcggcgaccggtgccagctcaccggcgacgacgtgttctgcaccgacgaggcacttgtgcgcgagggcatccgtaccggcgtcggcaactcggtcctggtcaaggtcaatcagatcggaaccctcaccgaggcactggcgaccgtggccacggcgcacgaggcgggctggaccgttgtcatgtcgcaccgctccggcgagacggaggacaccaccatcgcggatctcgcggtggcgacgggctgcggtcagatcaagaccggctcgctctcccgctccgaccgcacggccaagtacaaccgactcatccggatcgaggaggaactgggcgcctcggcacggttcgcgggccgctccgcgctgcgccgggtctga

SEQ ID NO: 4204 - protein, 434 aa, Streptomyces coelicolor [sequence omitted]

SEQ ID NO: 4205 - DNA, 1634 bp, Toxoplasma gondii
  CDS (27)..(1361)
tctaccgttactcaacttccaacaaaatggtggccatcaaggacatcactgctcgtcagatcctcgactcccgaggaaacccgaccgtcgaggttgacttgttgaccgatggcggctgcttccgtgccgctgtccccagcggcgcatccactggcatctacgaggcgcttgagctccgtgacaaggaccaaactaagttcatgggcaagggtgtgatgaaggccgtggagaacatccacaagattatcaagccggcgcttattggcaaggacccgtgcgaccagaagggtattgacaagctgatggtcgaggagctcgatggaactaagaacgagtggggctggtgcaagtcgaagctcggcgcgaacgcgatcctggccgtctcgatggcttgctgccgcgccggcgctgctgccaagggcatgcccctgtacaagtacattgccactttggctggaaacccgacagacaagatggtaatgcccgtcccgttcttcaacgtcatcaacggcggctcccacgcaggcaacaaggtcgcgatgcaggagttcatgatcgcccccgtcggcgcctccacaatccaagaggcgatccagatcggcgcggaagtgtaccagcacctgaaggtcgtcattaagaagaagtatggcctcgacgccacgaacgtcggcgacgagggtggcttcgcccccaacatcagcggcgccacggaggccctcgacttgctgatggaggccatcaaggtgtctggtcacgaaggcaaggtcaagattgccgccgacgtcgccgcttccgagttcttcctccaggacgacaaagtctatgacctagacttcaagactccgaacaacgacaagtcgcaacgcaagactggcgaagagcttcgcaacctgtacaaggacctgtgccagaagtatcccttcgtgtccatcgaggacccgttcgaccaggacgacttccacagctacgctcagctcaccaacgaggttggcgagaaggtccaaatcgtcggcgacgacctcctggtcaccaacccgacgcgcattgagaaggccgttcaggagaaagcgtgcaacggcctgcttctcaaggtgaaccagattggcacagtcagcgagtctatcgaggcctgccagcttgcccagaagaacaagtggggcgttatggtttctcaccgctccggtgagactgaggactccttcatcgctgacctcgtcgtcggtctccgcaccgggcaaatcaagactggcgccccgtgcagatccgagcgtctctgcaagtacaaccagctgatgcgtatcgaagagtcgctcggctccgactgtcagtacgccggcgctggcttccgccatcccaactaagtggaaacggagtttcgactacccaactgctcaattggggctgggtggtttgtccactctgcaacaagggcgtgacgagatcgttgcacatgcaactgccttttttgtgcttggtgggaaggagcactttcgcaggtgcagcaccgagttgcggttgatgggaatttcggaactgatttgtttcttgcatgccatcaccgaaggaacgagcagtttcgttgataatattggaaagtcttttgaaaaaaaaaaaaaaaaaaaaaaaaaaaaaaa

SEQ ID NO: 4206 - protein, 444 aa, Toxoplasma gondii
MVAIKDITARQILDSRGNPTVEVDLLTDGGCFRAAVPSGASTGIYEALELRDKDQTKFMGKGVMKAVENIHKIIKPALIGKDPCDQKGIDKLMVEELDGTKNEWGWCKSKLGANAILAVSMACCRAGAAAKGMPLYKYIATLAGNPTDKMVMPVPFFNVINGGSHAGNKVAMQEFMIAPVGASTIQEAIQIGAEVYQHLKVVIKKKYGLDATNVGDEGGFAPNISGATEALDLLMEAIKVSGHEGKVKIAADVAASEFFLQDDKVYDLDFKTPNNDKSQRKTGEELRNLYKDLCQKYPFVSIEDPFDQDDFHSYAQLTNEVGEKVQIVGDDLLVTNPTRIEKAVQEKACNGLLLKVNQIGTVSESIEACQLAQKNKWGVMVSHRSGETEDSFIADLVVGLRTGQIKTGAPCRSERLCKYNQLMRIEESLGSDCQYAGAGFRHPN

SEQ ID NO: 4207 - DNA, 1792 bp, Alligator mississippiensis
  CDS (49)..(1353)
gtcgtgtctgggcgctgccactgctgctgctgggtcccggtattcaaaatgtcgattctcaagatccacgctcgtgaaatctttgactcccgtgggaaccccactgttgaggtagatctctataccagcaaaggtctgttcagagctgctgttccaagcggtgcctcaactggaatctatgaggctctggagcttcgtgacaatgacaagactcgcttcatgggaaaaggtgtctcaaaagctgttgcgcacgtcaataaaacaattgcacccgcactgattagcaagaacatcagtgttgtggagcaggagaagattgaccgactgatgctggaaatggatggatcggagaataagtccaaatttggtgctaacgccattctgggcgtgtctctggccgtgtgcaaagctggtgctgctgagaagggtgtgcccctctaccgtcacattgctgatcttgctgggaatcctgaagtcatcctgccagttcctgctttcaatgtgatcaatggtggctcccatgctggcaacaagctggccatgcaggagttcatgatccttcctgttggtgctgagagcttcaaggaagccatgcgcattggtgctgaggtctaccacaacttgaagaatgtcatcaaggagaaatatggaaaggatgcgaccaatgtgggtgatgagggtggctttgctcccaacatcctggagaacaaagaagctctggagctacttaagaatgccatcaacaaggctggctacagtgacaaaattgtcattggcatggatgtggctgcctctgagttttaccgtgatggaaagtatgacttggacttcaagtctcctgatgaccccagcagatacatcactcctgaccagctggctgacctatacaagagctttgtcaagaactaccctgtggtgtccattgaagatccttttgaccaggatgactgggcagcttggaagaagttcactgcctctgtgggcatccaggttgttggtgatgacctgactgtaaccaaccctaaacgcattgctaaggctgtggacgacaaggcctgcaactgcctgttgctcaaagtcaaccagattggcagtgtgaccgagtccctgcaagcctgcaagcttgcccagtccaatggctggggtgtgatggtgagtcaccgttctggagagactgaagataccttcattgctgacctggtggttggtctctgcactggacagatcaagactggtgccccttgtagatctgagcgtctggctaagtacaaccagatcctgagaattgaagaggagcttggcagcaaggcgcgttttgctggcaggaacttcaggaacccccgcatcaactaagctgagcttgtcaggcagccgctgttccggataaaagcactagtcgcctaattagctcacaattccctgtactagaaggaagggcagctgaaggaacaagacctgtttgcaggtcctcttacccaagacaccctagatgacttcacctagtatgttttgttttgtttttttccccagctctgacctgttgttcttaagcacttctgcttttgtagaacagtccttgtgggggagtttctgtattaaaaaccctcttggaacaatgtttaaaggctccgctctgacctcgcgactgtgggcttaaaacactttcacccccatctcaatgtgtggagccttgtaacttggcagtgcagccccaggtacctgcaaacaaactgtagtgttcttgtgaggtaaaataaaagcatacgtaccgtaaaaaaaaaaaaaaaaaaaa

SEQ ID NO: 4208 - protein, 434 aa, Alligator mississippiensis
MSILKIHAREIFDSRGNPTVEVDLYTSKGLFRAAVPSGASTGIYEALELRDNDKTRFMGKGVSKAVAHVNKTIAPALISKNISVVEQEKIDRLMLEMDGSENKSKFGANAILGVSLAVCKAGAAEKGVPLYRHIADLAGNPEVILPVPAFNVINGGSHAGNKLAMQEFMILPVGAESFKEAMRIGAEVYHNLKNVIKEKYGKDATNVGDEGGFAPNILENKEALELLKNAINKAGYSDKIVIGMDVAASEFYRDGKYDLDFKSPDDPSRYITPDQLADLYKSFVKNYPVVSIEDPFDQDDWAAWKKFTASVGIQVVGDDLTVTNPKRIAKAVDDKACNCLLLKVNQIGSVTESLQACKLAQSNGWGVMVSHRSGETEDTFIADLVVGLCTGQIKTGAPCRSERLAKYNQILRIEEELGSKARFAGRNFRNPRIN

SEQ ID NO: 4209 - DNA, 1715 bp, Anas platyrhynchos
  CDS (28)..(1332)
gaacggaacgggtgcggggtgttcaagatgtccattctcaagatccatgcccgtgaaatctttgattcccgtgggaatcccactgttgaggtagacctctacaccaacaagggtctgttcagagctgctgttcccagcggtgcctcaactggaatttatgaagctctggaacttcgtgacaatgacaagacacgctacatggggaaaggtgtctcaaaagctgttgagcacatcaataaaacaattgcacccgcactgattagcaagaatgtcaatgtagtggagcaagacaagattgacaaactgatgctggacatggatggatcagagaacaaatctaaatttggtgccaacgccatcttgggtgtatctctggctgtatgcaaagctggtgctgctgagaagggtgtccccttgtaccgtcacattgctgaccttgctggaaacccagaagtcatcctgcctgttcccgctttcaacgtgatcaacggtggctcccatgctggcaataagctggctatgcaggagttcatgatccctccctgtggtgctgacagtttcaaggaggcaatgcgcattggtgcagaggtttatcacaatctaaagaatgtcatcaaggagaagtatggaaaggatgcaaccaacgtgggtgatgagggtggcttcgcccccaacatccttgagaataaagaagccctggagctgctgaagactgccatcggtaaggctggctactctgacaaggttgtcattggcatggatgtggctgcctcagagttctaccgcgatggaaagtatgacctggacttcaaatcccccgatgatcccagcagatacatttctcctgaccagctggctgacctgtacaagggctttgtgaagaactacccagtggtgtccatcgaggacccatttgaccaggatgactggggtgcctggaagaagtttactggcagcgttggcatccaagtggttggtgacgatctgactgtgaccaacccgaagcgtattgccaaggctgtggaggagaaagcctgcaactgcctcctcctcaaggtcaaccagattggatctgtgacagagtccctacaagcctgcaagcttgcccagtccaacggctggggcgtgatggtgagtcaccgctccggagaaacagaagataccttcattgctgacctcgtggtcgggctctgcactggtcagatcaaaactggtgccccctgccgatctgagcgtctagccaagtacaaccagctgctgaggattgaagaggagcttggcagcaaggcccgctttgctggaagaaacttcaggaacccccgtatcaactaagctgcgtggatcagacacccccgttctggtttatagcactagtcacctacttagatcacaattacttgtattagaaagatgagggcagctgaaggaaaaagaccagtttgcaggtcctctccctccctagatgactccttcacctagtgtttccaccagctctgatctgttacttgtaacgatctgcttttgtagaacaatcccagtgaggttttgtgttaaacatgctccggaaccgtgacccgttgacactgggcataagcaattcccttctctgcctgtctggtctttgatgtttggagctgtttgacttgcaggacagcaagaggtacctacaaacagctagtagtgtttttacatgtgataaataaaaagcatcaaac

SEQ ID NO: 4210 - protein, 434 aa, Anas platyrhynchos
MSILKIHAREIFDSRGNPTVEVDLYTNKGLFRAAVPSGASTGIYEALELRDNDKTRYMGKGVSKAVEHINKTIAPALISKNVNVVEQDKIDKLMLDMDGSENKSKFGANAILGVSLAVCKAGAAEKGVPLYRHIADLAGNPEVILPVPAFNVINGGSHAGNKLAMQEFMIPPCGADSFKEAMRIGAEVYHNLKNVIKEKYGKDATNVGDEGGFAPNILENKEALELLKTAIGKAGYSDKVVIGMDVAASEFYRDGKYDLDFKSPDDPSRYISPDQLADLYKGFVKNYPVVSIEDPFDQDDWGAWKKFTGSVGIQVVGDDLTVTNPKRIAKAVEEKACNCLLLKVNQIGSVTESLQACKLAQSNGWGVMVSHRSGETEDTFIADLVVGLCTGQIKTGAPCRSERLAKYNQLLRIEEELGSKARFAGRNFRNPRIN

SEQ ID NO: 4211 - DNA, 1305 bp, Bos taurus
  CDS (1)..(1305)
atgtccatcctgaaggtccacgccagagagatctttgactctcgtgggaatcccaccgttgaggttgatctcttcaccgcgaaaggtctcttcagagctgctgtgcccagtggcgcttcaactggaatctatgaggccctggagctccgggacaatgataagacgcgctacatggggaagggtgtctcaaaggctgttgagcacatcaataaaactattgcgcctgccctggttagcaagaagtcgaacgtcgtggagcaggagaagatcgacaagctgatgatagagatggatggcacagaaaaaaaatctaagtttggtgcgaacgccatcctgggcgtgtccctggctgtctgcaaagctggtgctgtggagaagggggtgcccctctaccgccacatcgccgacttggctggcaatgctgaggtcatcctgccagttccggctttcaatgtcatcaacggtggctctcatgctggcaacaagctggccatgcaggagtttatgatccttcctgttggggccgaaaacttccgggaggccatgcgcatcggagcagaggtttaccacaacctgaagaatgtcatcaaggagaaatatgggaaggatgccaccaacgtgggagatgagggcggctttgcccccaacatcctggagaacaaagaagccctggagctgctgaagaatgccatcggcaaggctggctacagcgacaaggtcgtcatcggcatggacgtagctgcctctgagttctacaggtcgggcaagtatgacctggacttcaagtcgcccgatgaccccagcaggtacatcacacccgacgagctggccaacctgtacaagtccttcatcagggactacccagtggtgtctatcgaagatcccttcgaccaagatgactgggaagcttggcagaagttcactgccagcgcagggatccaggtggtgggggatgatctcacggtgacaaccccaaagacgatcgccaagggcgtgaacgaaaaatcctgcaactgcctcctgctgaaagtcaaccagaatggctctgtgaccgagtctcttcaggggtgcaagctggcccatgccaacgggtggggcgtcatggtttctcatcgttcgggggagactgatgataccttcatcgctgaactggtggtggggctgtgcactgggcagatcaagaatggtcccccttgccgtactgagcgcttggccaagtacaaccagatcctcagaattgaagaggaattgggcagcaaggctaagtttgccggcaggaacttcagaaacccgttggccaagtaa

SEQ ID NO: 4212 - protein, 434 aa, Bos taurus
MSILKVHAREIFDSRGNPTVEVDLFTAKGLFRAAVPSGASTGIYEALELRDNDKTRYMGKGVSKAVEHINKTIAPALVSKKSNVVEQEKIDKLMIEMDGTEKKSKFGANAILGVSLAVCKAGAVEKGVPLYRHIADLAGNAEVILPVPAFNVINGGSHAGNKLAMQEFMILPVGAENFREAMRIGAEVYHNLKNVIKEKYGKDATNVGDEGGFAPNILENKEALELLKNAIGKAGYSDKVVIGMDVAASEFYRSGKYDLDFKSPDDPSRYITPDELANLYKSFIRDYPVVSIEDPFDQDDWEAWQKFTASAGIQVVGDDLTVTTPKTIAKGVNEKSCNCLLLKVNQNGSVTESLQGCKLAHANGWGVMVSHRSGETDDTFIAELVVGLCTGQIKNGPPCRTERLAKYNQILRIEEELGSKAKFAGRNFRNPLAK

SEQ ID NO: 4213 - DNA, 1727 bp, Gallus gallus
  CDS (35)..(1339)
gttgagccgggtgcggagcggagcggtgttcaagatgtccattctgaagatccacgcccgtgaaatctttgattctcgtgggaatcccactgttgaggtagacctctacaccaacaagggtctgttcagagctgctgttcccagcggtgcctcaactggaatctatgaagctctagaacttcgtgacaatgacaagacacgctacttgggaaaaggtgtctcaaaagctgttgagcacgtcaataaaacaattgcacctgcactgattagcaagaatgtcaatgtggtggagcaagaaaagatagacaaactgatgctggaaatggatggaacggagaacaaatctaaatttggtgccaatgccatcttgggcgtatctctggctgtttgcaaagctggtgctgctgagaagggtgtccccctgtaccgccacattgctgaccttgctggaaaccctgaagtcattctgcctgttcctgctttcaatgtcatcaacggtggctcccatgctggcaacaagctggctatgcaggagttcatgatcctccctgtgggtgctgacaccttcaaggaggcaatgcgcattggtgcagaggtctatcacaatctgaagaatgttatcaaggagaagtatggaaaggatgcaaccaacgtgggtgatgagggaggctttgcccccaatatccttgaaaataaagaagctctggagttgctgaagactgctattggcaaggctggctactctgacaaggttgtcattggcatggatgtggctgcctcagagttctaccgtgatggaaagtatgacctggacttcaaatcccctgatgatcccagcagatacatttctcctgaccagctggctgacctgtacttgggctttgtgaagaactacccagtggtgtccattgaagacccttttgaccaggatgactgggctgcctggaagaagttcactgccagtgttggcatccaagtggttggtgatgatctgactgtgaccaacccaaagcgtattgccaaggctgtggaggagaaatcttgcaactgcctgctccttaaggtcaaccagattggctctgtgacagagtctctgcaagcttgcaagcttgcccagtccaatggctggggtgtgatggtgagtcaccgctctggggaaacagaagataccttcattgctgatctggtggttggtctctgcactggtcagatcaaaactggtgccccttgccgatctgagcgcctagccaaatacaaccagctgttgagaattgaagaggagcttggcagcaaggcccgttttgctggaaggaacttcaggaaccctcgtatcaactaagctgtttggatcgtacaaccctgttctggtttaaagcactagtcacctgtttagatcagtttcctgtattagaaagataagggcagctgaaggaaaaagtcaagtttgcaggtcctctcccttccccctagatgactcctttacgtagtgttctcaccagctctgatttgttacttgtaatgctctgctgcttttctagaacagtctcagtggggttttgtgtggtaaacatcttctggaaccatgaccttttaatactgggcgtaaacacttctctgcctgtctgttcttcagtgtttggagctgtgacttgcaatgcagtaagaggtacctgcaaacagaaatagtagtgtttttacatgtgacaaataaaagcatccaacaaccc

SEQ ID NO: 4214 - protein, 434 aa, Gallus gallus
MSILKIHAREIFDSRGNPTVEVDLYTNKGLFRAAVPSGASTGIYEALELRDNDKTRYLGKGVSKAVEHVNKTIAPALISKNVNVVEQEKIDKLMLEMDGTENKSKFGANAILGVSLAVCKAGAAEKGVPLYRHIADLAGNPEVILPVPAFNVINGGSHAGNKLAMQEFMILPVGADTFKEAMRIGAEVYHNLKNVIKEKYGKDATNVGDEGGFAPNILENKEALELLKTAIGKAGYSDKVVIGMDVAASEFYRDGKYDLDFKSPDDPSRYISPDQLADLYLGFVKNYPVVSIEDPFDQDDWAAWKKFTASVGIQVVGDDLTVTNPKRIAKAVEEKSCNCLLLKVNQIGSVTESLQACKLAQSNGWGVMVSHRSGETEDTFIADLVVGLCTGQIKTGAPCRSERLAKYNQLLRIEEELGSKARFAGRNFRNPRIN

SEQ ID NO: 4215 - DNA, 1329 bp, Lactobacillus plantarum
  CDS (1)..(1329)
atgtctattattacagatatttatgctcgcgaagtcttagactcacgtggtaacccaactgttgaagttgaactttatactgaaagtggcgcatttggccgcggtatcgttccttcaggtgcctcaactggtgaacatgaagccgttgaattacgtgacggtgacaagagccgtttcatgggcaagggtgttactaaagccgttgacaatgttaacaagttaattgctaaggaaattgttggttacgatgtaactgaccaacgtgccattgaccaagctatgatcaagttagatggtactcctaacaaagctaagttaggcgctaacgctatcttaggtgtttccattgccgctgcacgtgctgctgctgacgaacttgaaatgcctttatacaactaccttggcggattcaacgctcacgttttaccaacaccaatgatgaacgttatcaatggtggggcccacgccaacaacgacgttgacttccaagaattcatgatcatgcctgttggcgcttcttcagttaaagaagctatccggatgggttcagaaactttccacaacttgaaagcgatcttgaacgaacgcggttactcaactgccgttggtgacgaaggtggttttgcgcctgacttgaagaacaacgaagaaccattcgaaatcttagttgaagctatcgaacgtgccggttacaagcctggtaaggatattgccattgcctttgactgtgccgcttcagaattctacaacgaagaaactggcaagtacgacttaaagggtgaaggcgaaaatggtcaatcatttactgccgaagaattcgttgacttacttgacagcattgttgacaagtacccaatcgtttctatcgaagatcctttggatgaaaacaactgggaagactggcaaatggcaactgccaagcttggtaagaaagttcaaatcgttggtgacgacttattcgttacgaacacggactaccttgcaaagggtatcaagatgggcgttgctaactcaatcttaatcaaggttaaccaaattggtactttaactgaaactgttgaagctatcgaaatggctaaagaagctggctacactgccatcgtttctcaccgttctggtgaaactgaagacacgaccattgctgacttagttgtcgcaatgaacgctggccaaatcaagactggttcaatgagccgtactgaacggattgctaaatacaatcaattaatgcggatcgaagaccaacttgaaagcacttcagaatacaaaggtatccacggtttctacaacttagacgaagctgcacggaacaccattactagcaagtaa

SEQ ID NO: 4216 - protein, 442 aa, Lactobacillus plantarum [sequence omitted]

SEQ ID NO: 4217 - DNA, 1527 bp, Python regius
  CDS (88)..(1392)
gattcggcacgaaaaaaaaaagcgctactattccaatttatttcttaggcgctgctgcagcggagagcttagccccagaccaataaaatgtccatcctcaagatccaagcccgtgaaatcttcgactcccgtgggaaccccaccattgaagtagacctctacaccaagaaaggtcttttccgagcagctgtccccagcggggcatcaactggcatctatgaagccctggaacttcgtgacaacgacaagacgcggttcctggggaaaggtgtctcaaaagctgtagagcacgtgaataaaacaattgcacccgcgctcgttaacaagaatgtaagtgtggtggagcaagaaaaaattgacaagctgatgattgaaatggatggatccgagaacaagtctaaatttggtgcaaatgcaattctgggagtctccctcgccgtgtgcaaggctggtgcggcggagaaggacatccctttgtatcgccacattgctgatcttgctgggaacaaagaagttattctgccggtccctgctttcaacgtgatcaatggtggctctcatgctgggaacaagctggcaatgcaggagttcatgattcttcctattggggcggaatgcttcaaggaagccatgcgcatcggcgcggaggtgtaccacaacctgaagaacgtcatcaaagagaagtatggcaaagatgccaccaacgtgggtgacgaagggggctttgcccccaacatcctggagaacaaggaagctctggagttgctcaagacggccatcagcaaggccggctacgcggacaagattgtcattggcatggacgtggcggcttccgaattttaccgtgacgggaagtacgacctggacttcaagtcccccgatgaccgcagccgatacatcactcccgatcagctggccgacctctacaagggctttgtcaagaattacccagtggtgtccatcgaagacccctttgaccaagacgactggcccgcgtggaagaagttcacggccgagtcggggatccaggtggtgggggatgacctgacggtgaccaaccccaagcgcattgccaaagctgtgcaggagaagtcctgcaactgccttctcctcaaagtgaaccagatcgggtcggtcaccgagtcactccaggcctgcaagctcgcccagtccaacggatggggtgtgatggtgagccatcgctccggagagacggaagacaccttcattgcagacttggtggtgggtctgtgcaccggacagatcaagactggtgctccctgccgatctgaacgtttagctaaatataaccaacttctgagaattgaagaggagctgggaagcaaggcccgttttgccggccggaatttcaggaacccccgggtcaactaaaaatgtggtactcggacgaggaatacgtttagtcccctctttctttagcacctgcatcttaagcaaagaagggcagctgatggaaccagtcgatgtttgcgagtcctcaatcctgtcattcccccccccccagga

SEQ ID NO: 4218 - protein, 434 aa, Python regius
MSILKIQAREIFDSRGNPTIEVDLYTKKGLFRAAVPSGASTGIYEALELRDNDKTRFLGKGVSKAVEHVNKTIAPALVNKNVSVVEQEKIDKLMIEMDGSENKSKFGANAILGVSLAVCKAGAAEKDIPLYRHIADLAGNKEVILPVPAFNVINGGSHAGNKLAMQEFMILPIGAECFKEAMRIGAEVYHNLKNVIKEKYGKDATNVGDEGGFAPNILENKEALELLKTAISKAGYADKIVIGMDVAASEFYRDGKYDLDFKSPDDRSRYITPDQLADLYKGFVKNYPVVSIEDPFDQDDWPAWKKFTAESGIQVVGDDLTVTNPKRIAKAVQEKSCNCLLLKVNQIGSVTESLQACKLAQSNGWGVMVSHRSGETEDTFIADLVVGLCTGQIKTGAPCRSERLAKYNQLLRIEEELGSKARFAGRNFRNPRVN

SEQ ID NO: 4219 - DNA, 1757 bp, Sceloporus undulatus
  CDS (94)..(1398)
tctagctgcaccccagtcctgcgctgcaagctctagctctgctcgttcgcgtggatcttttgcaggtgcccggctcagccccagacaagcaaaatgtccattctcaagctccatgctcgtgaaatctttgactcccgtgggaatcccaccgtggaggtagacctctacaccaacaagggtctcttcagagctgctgtaccaagtggcgcttccactggcatctatgaagccctggaactccgtgacaatgataagactcgtttcctggggaaaggtgtctcaaaagctgttgagcacgtcaataaaacaatagcacctgcactggttaacaagaaagtgaatgtggtggagcaagagaaaattgacaagctgatgctggagatggatggaacagaaaacaagtccaagttcggtgccaatgcaatcctgggcgtctccctggctgtttgcaaggctggagctgctgagaagggtgtccctttgtaccgccatattgctgaccttgcaggaaacgaggacgtcatcttgcctgtccctgctttcaacgtgatcaatggcggttcccatgctggtaataaactggccatgcaagaattcatgattctccctgtcggtgctgagaactttaaggaagccatgcgcattggtgccgaggtgtaccagaacttgaagaatgtcataaaggaaaagtatgggaaggacgccactaatgtgggtgatgagggtggctttgcgcccaacatcttggagaacaaggaagccctggagctgctgaagtctgccatcagcaaggctgggtacactgataagatagtcattgggatggacgtggctgcttcagaattctatcgcgatgggaagtatgacctggatttcaagtctcctgatgaccccagcagatacatcactcctgaccagctgtctgatttatataagggtttcatcaaaaattatccagtggtttccattgaggacccctttgaccaacatgactgggctgcttggaaaaaattcactgccagcgcaggcatccaggtggttggtgatgacctcaccgtgaccaacccaaggcgcattaccaaagcagtggaagagaagtcctgcaactgcctgctgctcaaagtgaaccagattggctcagtcacggagtcactgcaggcctgcaagcttgctcagaccaatggttggggtgtcatggtgagtcaccgctccggagagactgaggacaccttcattgcagacctggtggttggactctgcactgggcagatcaaaactggtgctccctgccgatctgaacgtctagccaaatataaccagattctgaggattgaagaggagctgggcagcaagggtcgttttgccggcagaaacttcagaaaccctcgtgtcaactaaaacccttgtgtttcagttgggccaccacgttcccctcctggttgagattgaaagcactagtcacctagctagaaccttcctctccctgtgctccccctccataatagtacctgtgtactgataaagggcagctgatggaaccagaccagtttgcaggtcctccctttttcaacgatcactcatccagtttgtgtcctcatttcatttctctcccccactcctgttccaactcccatctgttgcttttaaaagcactacttggctgctttttgtgggcaaacaatccccccttcattgggaatttgttgcatttttctgaatgaaacaggaaggaaacccttgggttaaaatttacccca

SEQ ID NO: 4220 - protein, 434 aa, Sceloporus undulatus
MSILKLHAREIFDSRGNPTVEVDLYTNKGLFRAAVPSGASTGIYEALELRDNDKTRFLGKGVSKAVEHVNKTIAPALVNKKVNVVEQEKIDKLMLEMDGTENKSKFGANAILGVSLAVCKAGAAEKGVPLYRHIADLAGNEDVILPVPAFNVINGGSHAGNKLAMQEFMILPVGAENFKEAMRIGAEVYQNLKNVIKEKYGKDATNVGDEGGFAPNILENKEALELLKSAISKAGYTDKIVIGMDVAASEFYRDGKYDLDFKSPDDPSRYITPDQLSDLYKGFIKNYPVVSIEDPFDQHDWAAWKKFTASAGIQVVGDDLTVTNPRRITKAVEEKSCNCLLLKVNQIGSVTESLQACKLAQTNGWGVMVSHRSGETEDTFIADLVVGLCTGQIKTGAPCRSERLAKYNQILRIEEELGSKGRFAGRNFRNPRVN

SEQ ID NO: 4221 - DNA, 1750 bp, Trachemys scripta
  CDS (48)..(1352)
cttccttctcctgcgctgctaacgccactgcggctcagatactcaaaatgtccatactcaagatctttgctcgtgaaatctttgactcacgtgggaaccccactgtggaggtagacctctataccagcaaaggtctgttcagagctgctgtacctagtggcgcctccactggaatctatgaggctctggaacttcgtgacaatgacaagactcgcttcctgggaaaaggtgtctcaaaagctgttgggcacgtcaataaaacaattgcacctgcactgattagcaagaacataaatgttgtggagcaagagaagattgacaaactgatgctggagatggatggatcagaaaacaagtccaagttcggggctaatgccattctgggtgtgtctctggctgtgtgcaaagctggtgctgctgagaagggggtccccctgtatcgtcacattgctgaccttgcaggaaacccagaagtcatcctgccagttcctgctttcaatgtgatcaatggtgggtcccacgctggtaacaagctggccatgcaggagttcatgatcctcccggttggtgctgagagcttcaaggaagccatgcgtattggtgctgaggtctaccacaacttgaagaacgtcatcaaggagaagtacggaaaggatgccaccaatgtgggtgacgagggtggttttgcacccaacatcttggaggacaaagaagctctggagctgctgaagactgcgatcagcaaggccggctatactgacaaggtggtcattgggatggatgtggctgcctcagagttctatcgcgatggaaagtacgacctggatttcaagtctcctgatgaccccagcagatacatcactcctgaccaactagctgatctgtacaagagctttatcaagagctacccattggtgtctgttgaagatccctttgaccaggatgactggtcagcttggaagaagttcactgccaccgtgggtgttcaggttgtgggtgatgacctgaccgtgaccaatccgaagcgtattgctaaacccgtggaggagaaatcatgcaactgcctgttgctccaagtgaaccagattggctctgtgacagagtccctgcaagcctgcaagcttgcccagtccaatggctggggtgtgatggtgagtcaccgttccggggagactgaagataccttcattgctgacctggtggttggtctctgcactggacagatcaagactggtgccccttgccgatctgagcgtctagctaagtacaatcagcttctgagaattgaggaggagctcggaagcaaggcccgctttgctggcaggaacttcaggaacccccgtatcaactaagctgtgtgggtcagacagcccctgttctggtttaaagcactagtcacctgattagatcattatttacctgtattagaaagaagggcagctgaaggaacaagaccagtttgcagggcctcaccctagactgtatttcacctagtgttccccagctctacctgttgctcttaagcgctttgctgcttttgtagaacagtccctctggggggtttgtgtattaaaaaattggaaccatgttttaagtccccactttgaccttgttgactgtgggcataaacatacttccccctgtttaagtgtgtggcgctgtgtaacttgcagtgcagcctgaggttcctgcaaacagaaatagtagtgttatgtgaggcaaataaaagcatcaaacaaccagcaaaaaa

SEQ ID NO: 4222 - protein, 434 aa, Trachemys scripta
MSILKIFAREIFDSRGNPTVEVDLYTSKGLFRAAVPSGASTGIYEALELRDNDKTRFLGKGVSKAVGHVNKTIAPALISKNINVVEQEKIDKLMLEMDGSENKSKFGANAILGVSLAVCKAGAAEKGVPLYRHIADLAGNPEVILPVPAFNVINGGSHAGNKLAMQEFMILPVGAESFKEAMRIGAEVYHNLKNVIKEKYGKDATNVGDEGGFAPNILEDKEALELLKTAISKAGYTDKVVIGMDVAASEFYRDGKYDLDFKSPDDPSRYITPDQLADLYKSFIKSYPLVSVEDPFDQDDWSAWKKFTATVGVQVVGDDLTVTNPKRIAKPVEEKSCNCLLLQVNQIGSVTESLQACKLAQSNGWGVMVSHRSGETEDTFIADLVVGLCTGQIKTGAPCRSERLAKYNQLLRIEEELGSKARFAGRNFRNPRIN

SEQ ID NO: 4223 - DNA, 1290 bp, Lactobacillus plantarum
  CDS (1)..(1290)
atggaaaaacaagttattgaaacggtaaaggctcgcgaaatttttgattcacggggtaatccaacagttgaggctgatgttattttgtcagatgggacgctaggacgcgcggaagtaccatcgggagcttcgactggagaaaaagaggcagttgaattacgcgatggtggtgatcgtttagccggcaaaggtgttcttaaggctgttaataatgttaatacggtcattaatcatgctttacatggtgctgacccatttaaccaagcccatattgatcaaatcatgattgacctagatggtacgcccaacaaagcgcgtctgggtgcgaatgctattttgggtgtttcaatggcaacggcacgagcggcggcaaacgcattacagcagccgctttatcgttacttaggtggcactgatttagagctaccccaaacatttcataacgtgatcaatggtggggagcatgcagataatggcattgatattcaagaattcatgattacaccggtcgaacgaaccagttttcgggatggttttgaaaagatcgtgaatacttatcatactttgaaaaaagttatcgaagatgccgggtacacgagtggtttaggtgatgaaggtggctttgcgcctgatcttaaaaactcagaagaagccttgcaaatgttacatgatgcgattattaaagctggttatacacctggtaaagaaattgcgattgcttttgacgcggcggcctcgtatttttataatcgaacgacccacaattatgactttgaaggcaaaacgtacacgccggcagctcttggcgattattatctgcagttattagcgaaatttccagaaatcgtttcaattgaggacccatacggggaagaggactgggataactttgcaagctttacagctgctcatggtgaccagcttcagattgtggctgacgatccggtttgcactaatccgcaattaattcggcaagcaattcagcgggggatggctaacaatattttaattaaattaaatcaaattgggaccgttaccgaaactttggccgcgattcggctagctcgcaaaaatggttatgccacgatgatgtcacaccgatctggcgaaactggtgatactttcgtcgctgatttcacagtggccaccaatgcggctcagctaaaagctggtgcgccagcccgctctgaacgcgttgaaaaatataatcaattattgcggattgaggaagaattaggtgctgacggtgctcggttggcacacttcccaaataacgtgatgtttgactaa

SEQ ID NO: 4224 - protein, 429 aa, Lactobacillus plantarum [sequence omitted]

SEQ ID NO: 4225 - DNA, 1655 bp, Alnus glutinosa
  CDS (139)..(1461)
ggtacggctccaattaacctgagcccctctacaaatacgtggcgcatgtcgtttcaccttaaccacgcaactaattgcaactctctcttctctctcagcacgcacacactctcagtgacaaagatctaaattccagctatggccgaaatcacgcacatcaaggcacgccagatcttcgacagccgtggcaatccgacggtcgaggcggaggtgacaacggcaaatggcgttgtttctagagccgctgttccaagtggtgcatccactggagtttacgaggcccttgaactaagagatggagggtcagactaccttggaaaaggtgttttaaaggctgttgacaatgtcaacaagatcatcggcccggccttgattggcaaggatgcaactgagcagactgctattgatattgattttatgttccaacaactcgatggaactgttaatgagtggggttggtgcaagcaaaagctcggagcaaatgccatactggcagtgtctcttgcagtctgcaaggctggggctagtgttaaaaaaatccctctttacaagcatattgcaaaccttgctggaaacccgaaattggtgttacctgttcctgctttcaatgtcattaatggtggatcacatgcaggaaacaagcttgcaatgcaggagttcatgattcttcctgtaggagcttcctctttcaaggaggccatgaagatgggtgtggaagtatatcaccacttaaaggctgtgattaagaagaaatatggtcaggatgcaacaaatgtcggtgatgaaggtggctttgctcctaatattcaggaaaacaaggagggtcttgaattgctcaaaactgccatcgctaaagctggttacgttgtcattggaatggatgttgctgcatctgaattttatgagaaggataaggatataactaacttcaaggaagagaacaatgatggttcacaaaagatctcggcagatcagctaaaagatttatacaagtcatttgtggatgaatatcctattgtatcaattgaagatccgtttgaccaagatgactgggaacactactcgaagctaaccgctgaaattggggagaaagtacaaattgtgggagatgatctcttggtcaccaatcccaagagggttgagaaggcaatcaaagagaaagcctgtaatgccctccttctcaaggtcaatcaaattggatctgtaactgagagcattgaagctgtaaaaatgtccaagcgagctggttggggtgtgatggcacaccgcagtggagagactgaggatactttcattgctgatctctctgtgggtttggccacgggtcaaattaagacaggagctccatgccggtcagagcgtcttgcaaaatataaccagctgttgcgtattgaagaggagcttggctcggaagcagtctatgctggagcaaatttccggacgcccgttgagccctattagtacttgaagcgttggatgagagaagttgttgtttacatgagatctgagaaaataagtttatatatatagaatggcttttagtcatggaacttgagaccttttcccaataatcttcacggctgttttgttccgagagcctagacagtgtcacagtgctgtactgaggaatttttcgaagttgaagcatgtttaat

SEQ ID NO: 4226 - protein, 440 aa, Alnus glutinosa
MAEITHIKARQIFDSRGNPTVEAEVTTANGVVSRAAVPSGASTGVYEALELRDGGSDYLGKGVLKAVDNVNKIIGPALIGKDATEQTAIDIDFMFQQLDGTVNEWGWCKQKLGANAILAVSLAVCKAGASVKKIPLYKHIANLAGNPKLVLPVPAFNVINGGSHAGNKLAMQEFMILPVGASSFKEAMKMGVEVYHHLKAVIKKKYGQDATNVGDEGGFAPNIQENKEGLELLKTAIAKAGYVVIGMDVAASEFYEKDKDITNFKEENNDGSQKISADQLKDLYKSFVDEYPIVSIEDPFDQDDWEHYSKLTAEIGEKVQIVGDDLLVTNPKRVEKAIKEKACNALLLKVNQIGSVTESIEAVKMSKRAGWGVMAHRSGETEDTFIADLSVGLATGQIKTGAPCRSERLAKYNQLLRIEEELGSEAVYAGANFRTPVEPY

SEQ ID NO: 4227 - DNA, 1484 bp, Alternaria alternata
  CDS (52)..(1368)
gcacgagcggcacgagacttgatcttacacatacaactacaatccttcatcatgaccatcaccaagatccacgcccgctccgtctacgactctcggggtaacccgactgtcgaggttgacattgtcaccgagaccggccttcaccgcgccatcgtcccctccggtgcctccacgggctcccacgaggcttgcgaactccgcgatggagacaagtccaagtggggtggtaagggtgtcaccaaggctgtcgccaacgtcaacgacaccattgcgcctgctctcatcaaggagaagctcgacgtcaaggaccagtccgccgtagacgcgttcctcaacaagctcgatggcaccacaaacaagaccaacctgggcgccaacgccattctcggtgtctcaatggccattgcaaaggctgccgctgccgagaagggtgtacctctctacgcccacatctccgacttggccggcaccaagaagccctacgttctccctgtacctttccaaaacgtcctcaacggtggctcgcacgctggtggccgtcttgctttccaagagttcatgatcgttccttgtgaggcccctaccttctccgaggccatgcgccagggagccgaagtctaccagaagctcaaggcccttgccaagaagacctacggacagtccgctggaaacgtcggtgacgagggtggtgttgcccctgacatccagaccgccgaggaggcccttgacctcatcaccaaggctattgaggaggctggctacactggcaagatcaagatcgccatggatgtcgcatcaagcgaattctacaaggccgacgagaagaagtacgatcttgacttcaagaaccccgacagcgacaagagcaagtggctcacatacgaacaactcgccgagatgtacaagtccctggccgagaagtaccccattgtcagcatcgaggaccccttcgctgaggatgactgggaggcttggtcttacttcttcaagacctacgacggccagatcgttggtgatgacttgaccgtcaccaaccccgagttcatcaagaaggccattgagctcaagtcttgcaatgctctcctcctcaaggtcaaccagatcggtaccatcactgaggccatccaggctgccaaggacgctttcggcgctggctggggtgtcatggtttctcaccgctctggcgagactgaggatgtcaccattgccgacattgtcgtcggactgcgatccggccagatcaagactggtgcacctgcccgatctgagcgtctcgctaagctcaaccagatcctccgtatcgaggaggagcttggtgacaacgccgtctacgccggtaacaacttcaggactgccgttaacttgtaagcgcttcttttgcagggtccggtagtgttagcgttgtgaggaaatgcgacgaataatgagttaagagcaaaggaaatatgtatacaaaatgcaacgatatatcctacaaaaaaaaa

SEQ ID NO: 4228 - protein, 438 aa, Alternaria alternata [sequence omitted]

SEQ ID NO: 4229 - DNA, 1392 bp, Bacteroides fragilis
  CDS (68)..(1357)
attaatagtgattcttccgcttcccataagtgagtaaatttgcagagactaaaaaacaagagaaacaatgaaaatagaaaaaattacaggacgagaaattctcgactcaagaggtaaccctacagtagaagtagacgtagtattggaatcaggcattatgggacgtgcatccgttccatcgggtgcatcgaccggtgaacacgaagcgcttgaactccgcgacggtgataaacatcgttatggcggcaagggtgtacagaaagcagtagagaacgtcaataaagtcattgctccgcatctgatcggtatgtcggccctcgaccaaataggcattgatcatgccatgttggcattggatggaacaaagacaaaagccaaactgggtgccaacgctattctgggtgtttcgcttgccgtagctaaagctgctgccaactatctcgatattcctctttacagatacatcggaggtacgaatacgtatgtattgcctgtaccaatgatgaacatcattaatggaggctcacacagtgatgctccgatagccttccaggagtttatgatccgtccggtaggtgcaagttcttttaaagaagggttgcgcatgggtgccgaagtattccatgctttgaaaaaagtattgaaagaccgtggtctgagtacagctgtcggtgatgaaggcggttttgctcccaacctggaaggaacagaagatgcacttaactctattcttgccgctatcaaagctgcaggctacgaaccgggcaaagatgtaatgattggcatggactgcgcctcttccgaattctatcatgacggtatttacgattacaccaaatttgaaggtgaaaaaggcaaaaaacgtacagctgacgaacaaattgactatttggaaaaacttatcaacgaatatccgattgattccattgaggatggtatgagcgaaaatgactgggaaggctggaagaaattgactcaacgcatcggggatcgctgtcagttagtaggcgacgatttattcgtaactaacgttgacttcctggcaaaaggtatcgaaaagggttgcgctaactctatcctgatcaaggttaatcaaatcggttcactgacagaaacactgaacgctattgaaatggcacaccgccatggatatacaacggtcacttcacaccgctcaggcgaaacagaagatgcaaccattgcagatattgccgtagcaaccaacagcggacaaatcaagaccggttctctaagtcgttcggaccgtatggcaaaatacaatcagctgcttcgtattgaagaagagttgggagaccgcgctgtatacggatataaacgaattgtagtaaaaggctaaacaaaatcatgatagcatagcatgataaaaggtta

SEQ ID NO: 4230 - protein, 429 aa, Bacteroides fragilis [sequence omitted]

SEQ ID NO: 4231 - DNA, 1269 bp, Bartonella henselae
  CDS (1)..(1269)
atgactataattgtcgatattattggacgtgaagtacttgatagccgaggtaatccaactgtagaagttgaagttcatttggaaaatggagctttgggccgtgctcttgttccctctggggcatcgacgggtgcccatgaagctgtagaactacgtgatggtggtacgcgctatcaaggaaaaggcgttaagaaagcgattgctgcaataaatggcgagattcttgaggaacttggtggacgagatgccagaaatcaaatcggcattgatcaagcaatgattgccttggatggaacaccaaacaaagcacgtcttggagctaatgcacttcttggtgtttcattggctgttgcaaaagcagcagcagagtcattgtctttacctctatatcgttatattggtggtacacaagcacatattcttccgacaccaatgatgaatattattaatggtggtgttcatgctgataacccgattgattttcaagaatttatgattattcctgtaggagcatctacgctaaaagaagcaattcgctatggtgctgaaatttttcatacgttaaaaaaacgtttaaaagatgcaggttataataccaatgttggtgatgagggtggctttgcacctcaatttaaaagcgccgagcaagcgattgattttattatggaatctataatagcatgtgggtataaaccaggtgaacaaattgcccttggtttagattgtgctgcaaccgaattttataaaaatggttcctatttttatgaaggtgaggggaaatatcgtgatgtgggggaacaggtagattatttagcacaacttattaaaacttaccctattatcacaattgaagatggtatggctgaggatgattgggaaggttggaagttactcactgactcgattggtaaaaaatgtcagcttgttggcgatgatttatttgtaacaaattctgcgcgtttgcgggatggtatcaaaatgggagcagccaattctattcttatcaaagttaatcagattggcacgctaagtgaaacgcttgatgctgtagaaacagcgcataaagcaggttatcgtgccattatatctcatcgttcaggtgaaacggaagattcttttattgcagatcttgccgttgcgaccaattgtgggcaaattaaaacgggttctcttgcacgttcggatagattagcaaaatataatcagcttattcgtattgaagaaatgctaggattgcaggcatgttatgcgggcaattggtattgttga

SEQ ID NO: 4232 - protein, 422 aa, Bartonella henselae [sequence omitted]

SEQ ID NO: 4233 - DNA, 1299 bp, Bifidobacterium longum
  CDS (1)..(1299)
atggcagtaattgaaagcgtgtacgcgcgtcagattctcgattcccgtggcaacccgaccgttcaggtcgttctggacaccgaagacggcgcccagggcctgggcctggttccgtccggcgcctccaccggtgaggctgaggcttgggagcgtcgcgatggcgacaagtccgtctacggcggcaagggtgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcttgggcgtctccctggctgctctgtacgcttccgccgagtccgccggcctgccgctgtaccgctacatcggcggtaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgctatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcaccgagaccctcgacgccatcgagctggccaccgccaacggctacacatccatggtttcccaccgctccggcgagaccccggacaccaccatctccgacctggctgttgctaagaacacccgccagatcaagaccggtgccccggcccgtggcgagcgcgttgccaagtacaaccgcctgctcgagatcgaggaggagctcggctccaccgctcagtacgccggctacagcgccttcaaggcctgcaagaagtacctggccaagtga

SEQ ID NO: 4234 - protein, 432 aa, Bifidobacterium longum [sequence omitted]

SEQ ID NO: 4235 - DNA, 1305 bp, Buchnera aphidicola
  CDS (1)..(1305)
atgtctaaaatattaaaaataattggtcgtgaaatcatcgattctagaggtaatcctaccatagaatgtgaagttttgcttgaaggaggttttgttggtttagcttcagtaccttccggagcatctacaggttcttttgaaacatgggaattaagagatcaagataaaaatcgatttatgggtaagggtgtgcaaaaagcagtagaaataataaataataaaattttctactctttaaaaaataaaaatgcaatagatcaatttgatatcgatcaaaccatgattaatttagatggtacagaaaacaaatctaatttaggttccaattcgattttgtcagtatctttagcaactgctaaagcagctgcatcttctaagggcatgcctttatatcaacacattgcagaaattaataatacaccaggcgtattttccatgcctttgccaatgattaatataattaacggtggaaaacacgcgaataataatattgatattcaagaatttatgatacaacctatttcagcaaaatccattacagaagctatacgtataggagcagaaatatttcattcattaggaaatttactaaaagataaaggaatgagtactacagtaggcgacgagggaggatatgctccaaattttaaatctaatgaagaagcattaaatgtaattcaagatgcagtacacaaaactaaatataagttaggaaaagatattacattagctatagattgcgcagcttctgagttatacaataaaactagaaaaaaataccaattcatcggagaaggaactgaatttagttcacaagaactaactcattatttaaaaaaattgtctaataaatatcctattatttctattgaagatggacaagacgaatcagattgggaaggttttttatatcaaacaaaagaattaggtaattcactgcaattagtaggagatgatttatttgttactaataaaaatatcttaaaaaaaggaataaaaaaaggtgttgcaaatgcaattttaataaaattaaatcaaattggaacattaactgaaacaattgaaactattaaaatagcaaaaaaatttaattatggtgttattatttctcatcgttcaggtgaaacagaagatacatcaatagcagatttatcagtaggaacagcatcagggcaaattaaaacaggatcaatgagtcgttctgatagaacttctaaatacaatcaattaatcagaatagaagaaatattaaataaaaaaagagcgcctttctacggactaaaagaagtaaaatcatctttttaa

SEQ ID NO: 4236 - protein, 434 aa, Buchnera aphidicola
MSKILKIIGREIIDSRGNPTIECEVLLEGGFVGLASVPSGASTGSFETWELRDQDKNRFMGKGVQKAVEIINNKIFYSLKNKNAIDQFDIDQTMINLDGTENKSNLGSNSILSVSLATAKAAASSKGMPLYQHIAEINNTPGVFSMPLPMINIINGGKHANNNIDIQEFMIQPISAKSITEAIRIGAEIFHSLGNLLKDKGMSTTVGDEGGYAPNFKSNEEALNVIQDAVHKTKYKLGKDITLAIDCAASELYNKTRKKYQFIGEGTEFSSQELTHYLKKLSNKYPIISIEDGQDESDWEGFLYQTKELGNSLQLVGDDLFVTNKNILKKGIKKGVANAILIKLNQIGTLTETIETIKIAKKFNYGVIISHRSGETEDTSIADLSVGTASGQIKTGSMSRSDRTSKYNQLIRIEEILNKKRAPFYGLKEVKSSF

SEQ ID NO: 4237 - DNA, 1296 bp, Buchnera aphidicola
  CDS (1)..(1296)
atgtcaaaaattaaaaaaataatttctcgagaaataattgattcccgaggatatccaacgatcgaatctgaagtacacttacaaaacggatctattggacttgcttcaattccttcaggagcttctacaggttcgagagaagcactagaattacgagataacgatccattacgatattttgggaaaggcgtaaaaacagctgtatctatagttaatacttctatatccagtgctatatataaccaagatgcatatgatcaagaaaacattgataaaattatgattaatttagatggaactaaaaataaatctaaaatcggtgctaattctattttatctgtatcaatagcaacggcaaaagctgctgcacaatctaaaaaaatacctttatatcaatacatttctgaattgcacggaatcaaagaagaattactgatgccattaccaatgatgaatattattaatggaggaaaacatgcagacaataacattgacatacaagagtttatgatacaacccattaaagcaaatacgattaaagaagctattcaaataggagctgaagttttttatacgttaggattgattctaaaaagaagaggttttaatactactgtaggagatgaaggaggatatgctccaaatttaaaatctaatgaatcagcatttttaatattatcagaagcagtttcacaatctggatacatgttaggcaaagacattactttttgtatagactgtgcagcttctgagctatacaatagcaaaactaaaacatataaactaacaagcgaacaaaaaaaatttacttcatatgaatttacaaattatttaagtgctttagttgataaatatcccattacatctatcgaagatgggctagatgaatcagattggaatggatttaaatatcaaacaaaaaaattaggaaaaaaaatacaattagtgggtgatgatttattcgtaactaatactaatatacttaaaaagggaatacaaaacaacattgctaatactattttaatcaaattaaatcagataggaacattaactgaaactttaaatgctataaaattagcacaaaattcaaattataatactgttatttcgcatagatccggagaaactgaagatacgacaatatctgatttagctgtaggaacaaactctggacaaataaaaactggttctgtctgtcgatcagaacgtacagctaaatataatcaactaatacgcatagaagaaaaattgggagcaaaaactaaaatatttaaaaatttttattttaatatttaa

SEQ ID NO: 4238 - protein, 431 aa, Buchnera aphidicola [sequence omitted]

SEQ ID NO: 4239 - DNA, 1305 bp, Caenorhabditis elegans
  CDS (1)..(1305)
atgccaatcaccaagatccacgctcgccaaatctacgactcccgcggaaacccaactgttgaggttgatcttttcactgagaaaggagtcttccgtgccgcagttccatctggagcttctactggagttcatgaggccctcgagcttcgtgacggtgacaaggctgttcacctcggaaagggggttctcaaggccgtctcgaacatcaacgagaagatcgctccagctctgatcgccaagggattcgatgtcactgcacagaaggacattgacgacttcatgatggctttggatggatcggaaaacaagggaaacctcggagctaacgccattctcggagtttcacttgctgtcgccaaggctggagccgtacacaagggactcccactctacaagtacatcgccgagcttgcaggaactggaaaggttgtgctccctgttccagccttcaacgtcatcaatggtggatctcacgctggaaacaagctcgctatgcaagaattcatgattcttccagttggagcttccagcttcgctgaagccatgcgcatgggatcagaagtctaccaccacttgaaggctgaaattaagaagagatatggactcgatgccaccgctgttggagatgaaggaggtttcgctccaaatattcaagacaacaaggaaggacttgaccttctcaacactgccatcgacaaggctggatacactggaaagatttccattggaatggatgtcgcagcatcggaattcttcaaggacggaaagtacgatttggatttcaaaaacccagcttcagactcctccaagtggctctctggagagcaactgaccgagctctaccaatctttcatcaaggagtatccagttgtctctattgaggatgctttcgatcaggatgattgggataactggggcaaattccacggtgccacttccattcagcttgtcggagacgatttgactgtaaccaatccaaagagaattcaaactgccatcgacaagaagtcatgtaactgcctccttctcaaggttaatcaaatcggatccgtcacagagtcaatcgaagcagccaagctctcccgtgccaatggatggggagttatggtctctcacagatccggagagactgaagacacttttatcgctgatctcgttgttggacttgccactggacaaatcaagactggtgctccatgccgttctgagcgtttggccaagtacaaccagcttctccgcatcgaagaggaactcggagctgatgctgtttacgctggacacaacttcagaaacccacaagtgtag

SEQ ID NO: 4240 - protein, 434 aa, Caenorhabditis elegans
MPITKIHARQIYDSRGNPTVEVDLFTEKGVFRAAVPSGASTGVHEALELRDGDKAVHLGKGVLKAVSNINEKIAPALIAKGFDVTAQKDIDDFMMALDGSENKGNLGANAILGVSLAVAKAGAVHKGLPLYKYIAELAGTGKVVLPVPAFNVINGGSHAGNKLAMQEFMILPVGASSFAEAMRMGSEVYHHLKAEIKKRYGLDATAVGDEGGFAPNIQDNKEGLDLLNTAIDKAGYTGKISIGMDVAASEFFKDGKYDLDFKNPASDSSKWLSGEQLTELYQSFIKEYPVVSIEDAFDQDDWDNWGKFHGATSIQLVGDDLTVTNPKRIQTAIDKKSCNCLLLKVNQIGSVTESIEAAKLSRANGWGVMVSHRSGETEDTFIADLVVGLATGQIKTGAPCRSERLAKYNQLLRIEEELGADAVYAGHNFRNPQV

SEQ ID NO: 4241 - DNA, 1275 bp, Chlamydophila caviae
  CDS (1)..(1275)
atgttagaagttgtcatttccgatatccaagctagagaaattttagactccagaggatatccaacattatatgttaaagtaactacagacgcaggcactttcggagaagcttgtgtgccttcgggagcttctacaggaataaaagaagctttagaacttcgtgatcaagatagttctcgattccaagggaaaggtgttttacaagctgtaaaaaatgtgaaagaagtacttctccctgtcttacaaggaatcagtatattcgatcaaatccttatcgattctatcatggtagaggctgatggcacaccaaataaagagaagctaggggcgaatgccattttaggagtttctttagcatctgcaaaagctgctgctgctacattaggacgttctttttaccgttatctaggaggatgtttcgctcatgtgcttccttgccctatgatgaatcttattaacggagggatgcacgcaaataacggtttgcaattccaagagtttatgattcgtcctatcggagcaacttctctaaaagaagctgtacggatgggcgctgatgtttttcattctttgaaaaatatcctcaatgaaaaaaacttagctacaggggttggtgatgaaggaggctttgctccacaactaaaatctaactctgaagcattagatcttcttgtacttgctatcgaaaaagcaggtttccaacctggagaagacatctccctagctctcgattgcgcagcttcttccttctatgatacgaaagcagaaacctatgatggaaagagctatgaagaacaagtgaacatacttgccgatctctgtgatcgctatcctatcgattctatagaagatggcctcgctgaagaagattttgacggttgggaattgctaacagcagaacttggcgaaagcattcaaatcgttggagatgatctctttgttaccaatcctgaattaatagctgatggcattagtagaggtcttgctaatgctgtgttaatcaaaccaaatcaaattggtacattaacagaaacttcagaagctatacagcttgcccatagccaagggtatacaactattctttctcacagatctggagaaaccgaagatacaacaattgcagatcttgctgtagctttcaatacaggacaaattaaaacaggatcgctatcacgttctgagcgtattgccaagtacaacaggcttatggcaatagaagaagaactcggtcctgaaggactatttaaagattctaatccattttctggagaatag

SEQ ID NO: 4242 - protein, 424 aa, Chlamydophila caviae [sequence omitted]

SEQ ID NO: 4243 - DNA, 1296 bp, Clostridium perfringens
  CDS (1)..(1296)
atgaaacaatatattgaaataattgacgtggtagcaagacaaattttagattcaagatgcttcccaacagtagaggttgaagtttatttagaagatggaacagttggaagagctgcagtaccttcaggagcttcaacaggtatatatgaagctgttgaattaagagatggagataaagataaatacctaggaaaaggtgttgaaaaggcagtagcaaatgttaatgatacaattgcagaagaaataataggattaaatgtattagatcaagcttacatagataaaactcttatagagttagatggaactaacaataaaggtaaattaggagctaacgcaatcttaggagtttctttagcagtagctcaagcagcagctaactatttaggaatgcctttataccaatacattggaggagtaaatgctaaagttttaccagttccaatgatgaacataataaacggaggaagccatgctgataactcagtagatatccaagagtttatgattatgccagtaggctttgattgctttgaaagagctgtaagagcttgtgcagaagtttaccatgcattaaagaaaactttaaattcaaagggatactcaactggtgttggtgatgaaggtggatttgctccaaacttaaaatcaaatgcagaagcaatagaagttatattagaagctattgaaaaagcaggttatgagccaggaaaagaattcttcatagcaatagatgcagcttcatctgagtactacaaagatggaaaatatgttttagagcatgaaggaaaaactttaacagctgctgaaatggttgacttctttgaagattgggttaataaatatccaataatctcaattgaagatggtatggctgaagaagactgggaaggttggaagctaatgactgaaagacttggtaaaaaagttcaattagttggtgatgacctatttgttacaaatacagaaagattaaaaactggtatagaaaaaggaattgctaactcaattctaataaaacttaaccaaataggaacattaacagaaacattaaatgctatagaaatggctaacagagcaggatatacagctgttgtttctcatagatcaggagaaactgaagatacaactatagcagatttagttgttgcagttaatgcaggtcaaataaaaactggtgctccagctagaagtgaaagagtagctaaatacaaccaattaatcagaataaatgaagaattaggtgaagtagctgaatacagaggaagaaatgcattcttcaacctttcaaaataa

SEQ ID NO: 4244 - protein, 431 aa, Clostridium perfringens [sequence omitted]

SEQ ID NO: 4245 - DNA, 1278 bp, Corynebacterium efficiens
  CDS (1)..(1278)
atggctgaaatcatgcacgtatttgctcgcgagatcatggattcccgcggtaacccgaccgtcgaggcagaggttttcctggatgacggttcccacggcgttgccggcgttccctccggagcgtccaccggtgtccacgaggcgcacgagctgcgtgacggcggagatcgttacctgggcaagggtgttctcaaggctgttgagaacgtcaacgaggagatcggcgacgagctggccggcctggaggccgacgatcagcgtctcatcgatgcggccatgatcaagctggacggcaccgagaacaagtcccgcctgggcgccaacgccatcctgggtgtctccatggctgtggccaaggccgccgcggattccgcaggtctgcccctgttccgttacatcggtggcccgaacgcccacgtgctgcccgtcccgatgatgaacatcatcaacggtggcgcacacgccgactccggtgtggatgtccaggagttcatgatcgccccgatcggtttcgactccttctccgaggccctgcgcgcaggcgcggaggtctaccacgcactgaagaaggtcatcaacgagaagggcctgtccaccggtctgggcgatgagggcggcttcgccccgtccgtcgagtccacccgtgcagccctggacctcatcgtcgaggccatcaagaaggccggcttcgagccgggcaaggacatcgccctggccctggatgttgcttcctccgagttcttcaaggacggcaaataccacttcgagggtggcgagcacaccgccgaggagatggcgaacgtctacgccgagcttgtcgacgagtacccgatcgtctccatcgaggatccgctgcaggaggacgactgggatggctacgtcgcactgaccgcccagatcggtgacaaggttcagatcgtcggcgatgacttcttcgtcaccaacccggcccgtctgaaggagggcatcgccaagaaggccgccaactccatcctggtcaaggtcaaccagatcggtaccctcaccgagaccttcgacgccgtcgacatggcacaccgcgcaggttacacctccatgatgtcccaccgttccggtgagaccgaggacaccaccatcgccgatctggctgtcgcgctgaactgcggccagatcaagaccggtgcaccggcacgttccgaccgtgtggccaagtacaaccagctgctgcgcatcgagcagctgctgggtgacgcagccgtctacgccggccgttccgcgttcccacgtttccagggctag

SEQ ID NO: 4246 - protein, 425 aa, Corynebacterium efficiens [sequence omitted]

SEQ ID NO: 4247 - DNA, 1278 bp, Corynebacterium glutamicum
  CDS (1)..(1278)
atggctgaaatcatgcacgtattcgctcgcgaaattctcgactcccgcggtaacccaaccgtcgaggcagaggttttcctggatgacggttcccacggtgtcgcaggtgttccatccggcgcatccaccggcgtccacgaggctcatgagctgcgtgacggtggcgatcgctacctgggcaagggcgttttgaaggcagttgaaaacgtcaacgaagaaatcggcgacgagctcgctggcctagaggctgacgatcagcgcctcatcgacgaagcaatgatcaagcttgatggcaccgccaacaagtcccgcctgggtgcaaacgcaatccttggtgtttccatggctgttgcaaaggctgctgctgattccgcaggcctcccactgttccgctacatcggtggaccaaacgcacacgttcttccagttccaatgatgaacatcatcaacggtggcgctcacgctgactccggtgttgacgttcaggaattcatgatcgctccaatcggtgcagagaccttctctgaggctctccgcaacggcgcggaggtctaccacgcactgaagtccgtcatcaaggaaaagggcctgtccaccggacttggcgatgagggcggcttcgctccttccgtcggctccacccgtgaggctcttgaccttatcgttgaggcaatcgagaaggctggcttcaccccaggcaaggacatcgctcttgctctggacgttgcttcctctgagttcttcaaggacggcacctaccacttcgaaggtggccagcactccgcagctgagatggcaaacgtttacgctgagctcgttgacgcgtacccaatcgtctccatcgaggacccactgcaggaagatgactgggagggttacaccaacctcaccgcaaccatcggcgacaaggttcagatcgttggcgacgacttcttcgtcaccaaccctgagcgcctgaaggagggcatcgctaagaaggctgccaactccatcctggttaaggtgaaccagatcggtaccctcaccgagaccttcgacgctgtcgacatggctcaccgcgcaggctacacctccatgatgtcccaccgttccggtgagaccgaggacaccaccattgctgacctcgcagttgcactcaactgtggccagatcaagactggtgctccagcacgttccgaccgtgtcgcaaagtacaaccagcttctccgcatcgagcagctgcttggcgacgccggcgtctacgcaggtcgcagcgcattcccacgctttcagggctaa

SEQ ID NO: 4248 - protein, 425 aa, Corynebacterium glutamicum
MAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIINGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 4249 - DNA, 2167 bp, Desulfovibrio vulgaris
  CDS (376)..(1680)
cccgggacatcgcgcgggtgagcagctgtttcgaccacgtcaggcccgaccttttgctgcagggcctgcggctgttgtatctggaacgcgacgcacgctagggtttgcggcgcgccgcgtcggggccggattttcgacgtgccgcatggcggcatgggtatttgctgatatgacgacgctctgcgtctgattgcacgtttcgacgctccgcgtcaggcatgactcacgacgcttcgcgtctggcagcacgtaacgacgctcagcgtctggcatgacttatgacgcttcgcgtctggcatgacttgcgacgcacagcgtctggcatcgacattccgaccgaaacccgacgaacatgaaaggaccaaggagatgcagatgagcaccatcgtatccgtctgggcgagggaaatccttgactcccgcgggaaccccaccgtcgaggtggaagtctccctggaatcgggccacaccggccgcgccgccgtaccttccggcgcctctaccggctcccgtgaagcgctggaaatgcgcgacggcgacaagggccgctacaagggcaaaggcgttgagaaggccgtggacaacgtgatgggtgaaatcgccgaagccatcgtggggctggattccctgcgtcaggtgcaggtggacaacaccctgctggacctcgacggcaccgacaacaagtcgcgtctgggcgccaacgccatgctgggcgtgtccctggccaccgcgcgcgccgcgtccagctttctgggcctgccgctgtaccagtacctgggcggcgtgaacgccaaggtgctgcccgtgccgctgatgaacatcatcaacggcggcgcccacgcgcccaacaatctggatatccaggaattcatgatcatgcccatcggcgcggccaccttccgcgatgcgctgcgcatgggcgccgagaccttccacaccctgaaggcgctgctggccgccgacggccacgtgaccagcgtgggcgacgagggcggctttgcccccaacctgaagaaccacgacgaggccttccgctacatcatgaaggccatcgaggaagctggctacattcccggcgcggaaatcgcgctggccatcgacgctgctgcttccgagttccacaaggacggcaagtacgtgctggcgggtgaaggcaagaacctgtccaattccgagatggtggagtggctgggcgagttcaccacccgctacccgctgatctccatcgaggacggcctggccgaagccgactgggacggctggcgcgagctgacctacaagctgggcgacaccatccagctggtgggcgacgacatcttcgtgaccaacccggacatcctggccgagggcatcgacgagggcgtggccaactccattctcatcaagctgaaccagatcggtaccctgaccgagaccctggacaccatcgagatggccaagcaggccgcctacaccacggtgatttcgcaccgttcgggcgagaccgaggaccacttcatctcggatctggccgtgggcctgaacgccgggcagatcaagaccggctccttgtgccgcagcgaccggctggccaagtacaaccagctgctgcgcatcgaggaagacctggacgatacgggcatctacttcgggcccatgatgagctcgcacttcggcttcgaggaagaaggcgaggagtagcgggctgtcgcgtacatcgggggagggggcctgcgtggctccctcccttttgctttcgggcggtgggagaaaggccggaaagccggaggaagcgccgagtgcgtggtggcggcagtcacggattgcttgcgggccggcagaaaatttcagtttgaacccgccctcaggacaggggggaaggggggcatgctcccccggcgggtacggggcagcgccccgatatttcgaaggccgcccgctctcacacggagaagcagggccgcgacacatggcggatgcgaccggaacgcaggacggtgccgggcagcggaatcagacaggcggcgcgcacgcgcgccggatttcgggaggttggagacatgttgctgctcgacggcaaggcgacggctgcggccattcgcgcggagctgaaggaagaagtggcggcggggcttgcggcggcgggccgcgcgccggggttggcggtcattctggtgggtgaggatcc

SEQ ID NO: 4250 - protein, 434 aa, Desulfovibrio vulgaris [sequence omitted]

SEQ ID NO: 4251 - DNA, 1469 bp, Eimeria tenella
  CDS (27)..(1364)
ctttcaagccgacagtcccagcgaagatggtggccatagtcgaggtcaaggccagggaaatcttggactctcgggggaacccgacggtggaggtggacctgaagactgagcagggctgcttccgcgccgcagtgccctcgggggcctcgacgggcatttacgaggcgctggagctgcgcgacggcgacaagacccgctacaacggcaagggggtgctgaaggccgtggagaacgtgaacaaggtgctggcgccggcgctggtggggaaggactgccgcgagcaggcagcgctggaccggctgatggtggaggagctggacggcagcaaaaacgagtggggctggagcaaaagcgtgctgggcgccaacgcaatcctcgccgtgtcgatggccctgtgcagggccggggccgcggcgaaaggcatccccctgtacaagtacgtggcgcagctcgcgggccacgaggcgcccgagttcgtgctgccagtgccctgcttcaacgtgctgaacggcggcaagcacgcgggcaacagcctggccatgcaggagttcatggtggcgccggtgggcgcgcgcagcttcggcgaggcgctgcgcatgggcgcggaggtctaccaggcgctgcagcggctgctgaaggccaagttcgggctcgcggccaccaacgtgggcgacgaggggggctttgcgccggacatcaaggaccccagggaggcgctggggctgctggtcgaggccattcgcgctgcgggccacgagggcaaggtcaagatcatggcggacgtcgccgcctccgagttctacagcaaggaggccaagagctacgacttggacttcaagagccccgccgccgacgcccacaggctcttgactggcgaccagctcaaggacctgttcaaggagtggtctgaggagttcccgatagtgtcgatcgaagaccccttcgaccaggacgacttcagttcgtacgcggcgctgactgcggagatcggcagcaaagtgcaggtggtgggagacgacctgctggtgacgaaccccgcgcggatccgcaaggcgctgcagcacaaggcctgcaacgcgctgctgctgaaggtgaaccagattggctccatcaccgaggccatcgaggcctgcaagctggcccaggccagcggctggggggtgatggtgtcccacaggtccggcgagactgaagactccttcatagcggacctcgtggtgggcctccgcactggccagatcaagacgggggccccctgcaggtccgagcgcctctgcaagtacaaccagctgctgcgcatagaggagcagctccagggccgctgcacctacgccggcgagaacttccgaaacccctccaactagctgctgctgctgctgcggggtgagggatggctgccgcgcgcgctgctgcccacgatttgtccacagactcgactcttttagctgtttctttcgaaaaaaaaaaaa

SEQ ID NO: 4252 - protein, 445 aa, Eimeria tenella
MVAIVEVKAREILDSRGNPTVEVDLKTEQGCFRAAVPSGASTGIYEALELRDGDKTRYNGKGVLKAVENVNKVLAPALVGKDCREQAALDRLMVEELDGSKNEWGWSKSVLGANAILAVSMALCRAGAAAKGIPLYKYVAQLAGHEAPEFVLPVPCFNVLNGGKHAGNSLAMQEFMVAPVGARSFGEALRMGAEVYQALQRLLKAKFGLAATNVGDEGGFAPDIKDPREALGLLVEAIRAAGHEGKVKIMADVAASEFYSKEAKSYDLDFKSPAADAHRLLTGDQLKDLFKEWSEEFPIVSIEDPFDQDDFSSYAALTAEIGSKVQVVGDDLLVTNPARIRKALQHKACNALLLKVNQIGSITEAIEACKLAQASGWGVMVSHRSGETEDSFIADLVVGLRTGQIKTGAPCRSERLCKYNQLLRIEEQLQGRCTYAGENFRNPSN

SEQ ID NO: 4253 - DNA, 1317 bp, Enterococcus faecalis
  CDS (1)..(1299)
atgtcaattattactgatatttacgcacgcgaagtcttagactcacgcggtaacccaacaatcgaagtagaagtttacactgaaagcggagctttcggccgtggaatggttccttcaggagcttcaactggtgaatacgaagcagttgaattacgtgatggcgacaaagctcgttacttaggtaaaggtgttactaaagctgtagataacgtaaacaacatcattgctgaagcaatcatcggttacgatgtacgcgatcaaatggctatcgataaagcaatgatcgatttagatggaactcctaacaaaggtaaattaggtgctaacgctattcttggtgtgtctatcgccgtagctcgtgctgctgctgattacctagaagtgcctttatatcattacttaggcggattcaatacaaaagtattaccaactccaatgatgaacatcatcaatggtggatcacatgctgacaacagtattgacttccaagaattcatgattatgcctgtaggtgcgcctacattcaaagaagctttacgtatgggtgcagaagtattccacgcattagcttcaatcttaaaaggccgcggcttagctacttcagtaggtgacgaaggtggtttcgctcctaacttaggttcaaacgaagaaggtttcgaagtaatcatcgaagctatcgaaaaagctggctatgttcctggtaaagacgttgttcttgctatggatgctgcttcttcagaattctacgacaaagaaaaaggcgtttacgttttagctgactcaggcgaaggcgaaaaaacaactgaagaaatgatcgcgttctacgaagaattagtttctaaatacccaatcatttcaatcgaagacggcttagacgaaaacgactgggacggattcaaaaaattaactgaagtattaggcgacaaagttcaattagttggtgacgatttattcgtaacaaacacaactaaattagctgaaggtatcgaaaaaggtatcgctaactcaatcctaatcaaagttaaccaaatcggtactttaactgaaacatttgaagcaatcgaaatggctaaagaagctggctacactgcagttgtatctcaccgttctggtgaaacagaagattcaacaatctctgatatcgctgttgcaacaaacgctggccaaatcaaaactggttcattaagccgtactgaccgtattgctaaatacaaccaattattacgtattgaagatcaattaggcgatgtagctgaatacaaaggcttaaaatctttctacaacttaaaaaacaaataattcattaaatgaataacg

SEQ ID NO: 4254 - protein, 432 aa, Enterococcus faecalis [sequence omitted]

SEQ ID NO: 4255 - DNA, 1305 bp, Enterococcus hirae
  CDS (6)..(1304)
tccttatgtccattattactgatgtttacgcacgcgaaatcttagactcacgcggtaacccaacaatcgaagtagaagtatacacagaaagcggagcttttggccgtggaatggttccttcaggtgcttcaactggtgaatacgaagccgttgaattacgtgatggagacaaagctcgttatggcggtaaaggtgtaactaaagctgttgacaacgtaaacaacatcattgctgaagcaatcattggctacgatgtacgtgaccaaatggcaatcgataaagctatgatcgctttagacggaactcctaacaaaggtaaattaggtgcgaacgcaattttaggtgtatctatcgctgttgctcgtgcagctgctgactacctagaagtacctttataccactacctaggcggattcaatacaaaagttttaccaactccaatgatgaacatcatcaacggtggatcacatgcggataactcaatcgacttccaagaattcatgatcatgcctgttggcgctccaacattcaaagaagctctacgtatgggtgctgaagtattccacgcattagcagcaatcttgaaatctcgtggattagctacttctgttggtgacgaaggtggattcgctcctaaccttggttcaaacgaagaaggttttgaagtaatcatcgaagcaatcgaaaaagctggctatgtacctggtaaagacgttgttcttgctatggatgctgcttcttcagaattctacgacaaagaaaaaggtgtttacgtattagctgattcaggcgaaggcgaaaaaacaactgacgaaatgatcaaattctacgaagaattagtttctaaatatccaatcatctcaatcgaagacggattagacgaaaacgactgggacggattcaagaaattaactgacgtattaggcgacaaagttcaattagttggtgacgacttgttcgtaacaaacactcaaaaattatctgaaggtattgaaaaaggaatcgctaactcaatcctaatcaaagttaaccaaatcggtactttgacagaaacttttgaagcaatcgaaatggctaaagaagctggctacacagcagttgtttctcaccgttcaggtgaaacagaagattcaacaatctctgatattgctgttgcaacaaacgctggtcaaatcaaaactggttctctatcacgtactgaccgtattgctaaatacaaccaattactacgtatcgaagaccaattaggcgaagttgctgaatacaaaggtttgaaatctttctacaacttaaaagctgcataga

SEQ ID NO: 4256 - protein, 432 aa, Enterococcus hirae
MSIITDVYAREILDSRGNPTIEVEVYTESGAFGRGMVPSGASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALAAILKSRGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKAA

SEQ ID NO: 4257 - DNA, 1299 bp, Leptospira interrogans
  CDS (1)..(1299)
atgtctcatcactctcaaattcagaaaattcaagctcgggaaattatggactcccgtggaaatcctacggtcgaagtggacgtaatccttttagatggttcttttggaagagcggcggttccttccggagcgtctactggagaatacgaagccgtagaacttagagacggagataaacatcgttatcttggaaaaggggtacttaaggcggtagaacacgtaaacctgaaaattcaggaagtattgaaaggagaaaatgcgatcgatcaaaatagaatcgaccaactcatgttagacgctgatggaaccaaaaacaaaggtaaactaggtgcgaatgcaattttaggaacttctctcgcggtagccaaggctgctgctgctcattctaaacttccattatatcgttatataggaggaaactttgccagagaactacccgttcctatgatgaatatcatcaacggaggcgctcatgcggataacaacgtagactttcaagaatttatgattcttcccgtaggagccaaaagttttcgagaagctcttcgtatgggggcggaaatatttcattctttaaaatcagtactcaaaggaaagaaattgaacactgccgtcggagatgaaggtggatttgctccagatctgactagtaatgtggaagcgatcgaagttattctacaagctattgaaaaagcaggatataaacctgaaaaagacgttttactcggtttggatgcggcttcttccgaattttatgacaaaagtaaaaagaaatacgtactcggtgccgaaaataataaagagttctccagtgccgaactcgtggattattatgcgaatttggtttccaaatatccgattattacgatcgaagacggtttggacgaaaatgactgggatggttggaaacttctttccgaaaaattaggaaagaaaattcagctcgtaggagacgacctttttgtgacaaatatagagaaactctccaaaggaatttcttccggagttggaaattcgattctgatcaaggtaaatcagatcggttctctttctgaaactctctcttctatcgaaatggcgaaaaaagcgaaatatacaaacgtcgtaagccatagaagtggggaaacggaagacgttacgatttctcatattgcagttgcgactaacgcaggacagattaaaaccggttctctttctagaacggatagaattgcaaaatataacgaacttctaaggatcgaagaagaactcggaaagtcagcagtttataagggtagggaaactttttataatttataa

SEQ ID NO: 4258 - protein, 432 aa, Leptospira interrogans [sequence omitted]

SEQ ID NO: 4259 - DNA, 1515 bp, Loligo pealeii
  CDS (67)..(1371)
acttcacgcacgagcatcgtcttcagaccacattcttaggactgtagccgtcgcagatcagtcaaaatggttatcaagaaggttcattcccgtcaaatctttgacagtcgtggcaacccaactgtcgaggttgatttgtggactgacaagggcatgttccgtgctgcagtccccagtggtgcatcaactggcatctatgaggctcttgaaatgagagataaagatgctaaaaattaccatggcaaaactctattcaatgctgttggtaatgtaaataaaatcattgctcctgctttggttgataaaaaaatggatgagaaagatcaaacagcagttgataactttcttcttgcacttgatggtacagagaacaaaaacaagcttggagctaatgcgattcttggagtatctcttgctgtctgcaaagctggtgctgctgctaagggtgttccactttaccgccatattgctgatttagctggaaacaaggaagtaatcctccctgtacctgccttcaatgttatcaatggtggtagccatgccggtaacaaattggccatgcaggagtttatgatccttccaactggggccaagaattttacagaggccatgaaaatgggtactgaagtttaccatcatttgaaatctgtcatcaagaagaaatatggtcaagatgcttgcaatgttggtgatgagggtggttttgctccaaacattctggacaacaaagagggtctggaactgttgaagactgccattgcaaatgccggctatactgccgaaattgaaattggcatggatgttgctgcttctgagttctgtaaggaaaagaagtatgacttggatttcaaaaaccctgactctaaccccaatgattggcttacctctgaccagttggctgatgtttacaaagactttgttaagaattatccagttgtatccattgaggatccctttgaccaagatgactgggaagcttacacaaaaatgaccaaggatatggacatccagattgttggagacgatcttttggtcactaaccccaagagagtacagaagggaattgacttgaaggctgccaatgccctcctccttaaagttaaccagattggctcagttactgaatcaattcaggcatgcaaaatgtctcaagatgctggctggggagtgatggtatctcatcgtagtggtgagactgaggatacatttattgctgatttggtagtcggtctctgcactggacagatcaaaactggtgctccttgccgatcggaacgtctggccaagtacaaccagattcttcgtattgaagaggaattgggtgacaaagctgtctttgctggcaagaaattccgcaaccccctcaagtaagcttccagctttccccttccctcgtctaagtcaactttaactctattacctcttattcctaaggttggcatgcaagtatatgttctgtaatgtacaaaatataataaagtatctgtaagccaaaaaaaaaaaaaaaaaaaaaaa

SEQ ID NO: 4260 - protein, 434 aa, Loligo pealeii [sequence omitted]

SEQ ID NO: 4261 - DNA, 1515 bp, Mastigamoeba balamuthi
  CDS (31)..(1350)
ccgggctgcaggcaaacaccccaagcaacaatgtcgaccatcaagagcgtcttcgcccgcgagatcctggactctcgtggcaaccccaccgtcgaggttgacctgaccaccgagaagggcctcttccgctcggccgtcccctctggtgcctcgactggcatctatgaggcctgcgagctccgtgacggcgacaagtcgcgctacctcggcaagggtgtgctgaaggccgtcgagaacgtcaacaagatcctggcgcccaagctgatcggcctcgacgtcaccaagcagggcgagatcgacaggctcatgctccagatcgacggcactgagaacaagacccacctgggcgccaacgccatcctcggctgctcgatgtcggtctgccgtgcggccgccgcgttcaggggcctgcccctctaccgctacatcgcggagctgtcgggcaacaagtcgcccatgctgcctctgccctgcttcaacgtcatcaacggcggtgagcacgcgggcaacaagctcgccatgcaggagttcatgatctgccccacgggcgcgacctcgttccacgaggccctgcgcatggccgccgagacgtaccacaacctgaagctcgtcatcaagaagaggtacggcatggacgcgaccaacgtcggcgacgagggtggcttcgcccccaacatccaggccaaccacgagggcctcgagctcatcgttgaggccatcaagcaggccggctacactggcaagatcgagatcggcatggacgttgccgcctcgtcgttctgggacgccaaggagtcgaagtacgacctcggcttcaaggtccccgccgacaagaagacccccgacatgctcgtctcgggcgagggcctgatcaagctctacgaggagtggacctcgaagtacccgatctggtcgatcgaggaccccttcgaccaggacgactgggccacctacaccaggttcaccgagctgatccgcaacaggatccagatcgtcggcgacgacctgctggtcaccaaccccaagcgcatcgtcgaggcccgcaacaagaaggcctgcaacgcgctgctgctcaagctcaaccagatcggctcggtcagcgaggccgtcgaggcgtgccgcctggcccgcgaggtcaactggggcgtcatggtgtcgcaccgctcgggcgagactgaggacgcgttcatcgccgacctcgtcgtcggtctgggctgcggccagatcaagactggtgccccctgccgctcggagcgcctcgccaagtacaaccagctcctccgcatcgaggaggagctcggcgccaacgcccactacgccgccaagaccctctcgggcgtcggccactagatgactcgagatcttcgcggggcctcccctgtgcacaagcctcgcccgccgtgccctgtccagcacgggcggattaactgcacgacactgacttggggtctcttctgcaacaatgtcggtttttgaaacaaaaaaaaaaaaaaaaaaaaaaaaaaaaaaaaaaaa

SEQ ID NO: 4262 - protein, 439 aa, Mastigamoeba balamuthi [sequence omitted]

SEQ ID NO: 4263 - DNA, 1290 bp, Methanosarcina acetivorans
  CDS (1)..(1290)
atgatgtcgtatatcggtttacagcaggattctggagaatataagatccaaaagatacatgctcgggagatcctggactcaaggggaaatcccacaattgaagtagatgtgtttacaccaaagggatttggcagagcaagtgtcccttcaggagcttcgacgggtacgaatgaagccctagaactgcgtgatgcggaccccaacagatacggtggaaaaggagttctgactgcggtcaagaacgtaaataccattatccagaaggaattgcttggacttgatgtgcgaaaccagcgggaaatcgatgagctgatgatcgagctcgacgaaaccgaaaacaaatcaaaccttggagccaactccattcttggtgtctccatggcggttgcaaaagccgcagctgattcccttaacatgcccctttaccgctacttcggcgggtctaacgcttttacccttccggtacctacaatgaatgtcctgaatggaggcaaacatgcaggaaacgagcttgcaattcaggaattcatgatccagcccaaaggtgcagaaaccttctacgaagcccttcagatcggggcagagatctaccatgtacttgggaagtacctggagaaaaaatacggacgctcttctacaaatgtaggctatgaaggcgggtatgcgcccaaaatgagcgagtctacagaagctcttgacgccctcgtacaggcaattgaagaagcaggctataccgaatccgaagttacaatagggcttgacgccgcagcaaccgagttctacgaagaagagttctataatattgacggaaagaaactggctgctccggaactgcttgactactatgtggagcttgtaaactcctaccccatcctttctatcgaggatcccttctacgaagaagccttcgaggactttgaagccctgaccaacgaactctgggacacgatcattgtgggggacgacctctttgtcacaaacatcgaaaggctctccagaggcgtggacatgggagctgcaaatgcccttctcctcaaagtcaaccagataggctcaatctccgaagccttcgatgccgcaagcatggcttccagaaacggttacaccgtaattgtaagccaccgctctgccgaaaccgaagataccaccatctcagatctcgcagttgccataggtgcagaaatgatcaagaccggtgccccggcccgtggcgagaggactgcaaaatataaccagcttctcagaattgaagaagatctcggtgaagttgcacattacgtgcagctctaa

SEQ ID NO: 4264 - protein, 429 aa, Methanosarcina acetivorans [sequence omitted]

SEQ ID NO: 4265 - DNA, 1272 bp, Methanococcus jannaschii
  CDS (1)..(1272)
atggatgagagatttgaaattaaagatattgttgcaagagaagtaattgactcaagaggaaacccaacagttgaagtggaagttataacaaaagggaatggttacggttcagcaattgttccaagtggtgcatcaactggaacacatgaggcattagagttgagggataaagaaaagagatttggtggaaaaggagttttaatggctgttgaaaatgtaaattcaataattagaccagagattttaggttatgatgcaagaatgcagagagaaatagatacaataatgatagaattagatggtactccaaataaatcaagattgggagctaatgccatattggctgtttctttagctgtagcaaaggcagcagcagcaacagcaaaaatccctctctataaatacttggggggatttaactcctatgtcatgccagttccaatgatgaacgttataaatggaggaaaacacgctgggaatgatttagatttgcaagagttcatgataatgccagttggagctacatcaatttctgaagctgtaaggatgggttcagaagtttatcatgtcttaaaaaatgtcatcttagaaaaatatggaaaaaatgctgtaaatgttggagatgagggaggttttgctccaccattaaaaacatcaagggaggctttagatttattaactgagagtgttaaaaaggctgggtatgaggatgaggttgtctttgcattagatgctgctgcctcagagttttataaagatggatattattacgttgaaggtaaaaaattaacaagagaggagcttttagattactataaagcattagttgatgaatatccaatagtctcaattgaagacccattccatgaggaagattttgaaggctttgcaatgataactaaagaattagatatacagatagttggagatgacttgtttgttacaaatgttgaaaggcttagaaaaggtattgagatgaaggctgctaacgctctgcttttgaaagtcaatcagattggaactttaagtgaggcagttgatgctgctcaattggcatttagaaatggttatggtgtagttgtttcacatagaagtggagagactgaggatacaacaatagctgatttgtcagttgctttgaactctggacaaataaagactggagctccagcaagaggggagagaacagctaaatacaatcagttgataagaattgagcaagagttaggattaagcaaatatgctgggagaaactttagatgtccattttaa

SEQ ID NO: 4266 - protein, 423 aa, Methanococcus jannaschii [sequence omitted]

SEQ ID NO: 4267 - DNA, 1284 bp, Methanopyrus kandleri
  CDS (1)..(1284)
atgcccagaatagtctccgtgaaggccagggaagtgttagactcacgcggagaacccacggtggaagtggaggtggaactcgaagacggtaccgtcggtcgggccatggtcccatccggagcttccacgggcacgtacgaagcgctggagctgagggacggcgacgatcgttacggaggtaagggagtacgccgtgccgtcaggaacgtggaggagatcatcgccccggagatcgagggactcgacgcgacggcccaacctgacatcgaccgcacgatgatcgagctcgacggcaccgagaacaagtctcacctcggagcgaacgcgatcctgggagtctcgctggcggtcgcccgggcggcggccaagtcgctggggataccgttgtaccgatacctaggtggtccgacggcgcgccgactgcccgtgccgttcatgaacgtgatcaacggcggcgagcacgcgggtaacgaactcgacttccaggagcacatgatcgtcccgcacggcttcgagtcgttctccgaggctcttcgagccggtgtggagacgtaccacgtcctcggggagctactggaggaggagtacggacctatcgccacgaacgtgggtgacgagggcggttacgctccaccgatgaaggatacggtggaaccactggacgtcctcgtggaggccatcgaggaggccggatacgcacccggcaaggagatcgcgttggccctggacgcagccgcgagcgagttctacgacgaggactcggggacgtacagggcgtacggtcagaagtatacccgcgacgagctgatcgacgtgtacaaggatctggtaagccagtacccgatcgtttccatagaggacccgctgcacgaggaggacttccggggcttcgccaagatcaccgaggagctaggcgataaggtccaaatcgtgggtgacgacctgttcgtgacgaacccggaccgcctgcggaaggggatcgaaatgggggcggcgaacgccctgctcctgaaggtgaaccagatcggaaccctgacggaggccgtggaggcgggtgagctcgcgcttcaacacgggtacggtgtgatggtgagccaccggagcggcgacaccgaggacccgttcatcgccgacctggccgtggccctagggtgcggacagatcaagaccggagcgcccgcccgtagctctaggacggccaagtacaaccgcctgctccggatcgaggaagacttagccggggcggcggagttcggaccccggaacgacttcttcctcccctaa

SEQ ID NO: 4268 - protein, 427 aa, Methanopyrus kandleri [sequence omitted]

SEQ ID NO: 4269 - DNA, 1287 bp, Methanosarcina mazei
  CDS (1)..(1287)
atgtcgtatatcggtttacagcaggattctggagaatataagatccaaaagatacatgctcgggagatcctggactcaaggggaaatcccacagttgaagttgatgtgtttacacctaaaggatttggcagggcaagtgttccttcaggagcttccacgggtactaacgaagcccttgaactgcgtgatgcagatcctaacaggtacggaggaaaaggagtcctgaccgcagtcaagaacgtaaataccattatccagaaggaactgcttggacttgatgtgcgaaaccagcgggaaatcgacgagcttatgatagagctcgatgagaccgaaaacaaatctaaccttggagcaaatgccattcttggcgtatccatggcagttgcaaaagctgcagctgactctcttaatataccgctttaccgttatttcggcggctccaacgcttttaccctcccagtgcccacaatgaatgtcctgaatggaggaaaacatgcaggaaacgagcttgcaattcaggaattcatgattcagccgaaaggcgcagagaccttctacgaagctcttcagatcggggctgagatttaccagaccctcgggaagttcctggagaataaatacggacgctcttctactaacgtgggttacgaaggcgggtacgctccaaaaatgggcgagtccacagaagcccttgatgcgctcgtacacgcaattgaagaagcaggctataccgagtctgaggtcacaataggtcttgatgccgcagcaaccgagttttatgaagaggaattctataacattgacgggaagaaactggctgctcctgaactgcttgactattatgtggagcttgtaaactcttacccgatcctttctattgaagaccccttctatgaggaagccttcgaagactttgaagcgcttaccaatgaactctgggacacaatcattgtaggtgacgacctctttgtcacaaacattgaaaggctgtcaaaaggagtggacatgggagcagcaaatgccctccttctcaaagttaaccagattggctcaatctcggaagcttttgatgccgcaagcatggcttccagaaacggctacacagtaattgtaagccatcgctctgcagaaactgaagatacgaccatttcagacctcgcggttgcaataggagctgaaatgataaagaccggtgcaccggcacgcggcgagagaactgcaaaatacaaccagcttctcagaatagaagaagaccttggcgaagttgcacattatgtgcagctctaa

SEQ ID NO: 4270 - protein, 428 aa, Methanosarcina mazei
MSYIGLQQDSGEYKIQKIHAREILDSRGNPTVEVDVFTPKGFGRASVPSGASTGTNEALELRDADPNRYGGKGVLTAVKNVNTIIQKELLGLDVRNQREIDELMIELDETENKSNLGANAILGVSMAVAKAAADSLNIPLYRYFGGSNAFTLPVPTMNVLNGGKHAGNELAIQEFMIQPKGAETFYEALQIGAEIYQTLGKFLENKYGRSSTNVGYEGGYAPKMGESTEALDALVHAIEEAGYTESEVTIGLDAAATEFYEEEFYNIDGKKLAAPELLDYYVELVNSYPILSIEDPFYEEAFEDFEALTNELWDTIIVGDDLFVTNIERLSKGVDMGAANALLLKVNQIGSISEAFDAASMASRNGYTVIVSHRSAETEDTTISDLAVAIGAEMIKTGAPARGERTAKYNQLLRIEEDLGEVAHYVQL

SEQ ID NO: 4271 - DNA, 1290 bp, Mycobacterium leprae
  CDS (1)..(1290)
atgccggttatcgagcaggtcggggcccgcgagatcctcgattcccgcggcaaccccacggtcgaagtcgaggtggtgctgattgacggaaccttcgcccgcgcagcggtgccttcgggcgcatcgaccggcgagtatgaggccgtcgagttacgtgacggcgacggtcgttacggtggcaagggtgtgaaaagggccgtggatgctgtgctcgacgagatcggtccagtggtgatcggcctcaacgccaatgaccagcggctgatcgatcaggagctgctggacctcgacggcacccccgacaagtcccgattgggtggtaacgcgatcctgggtgtctcgctggccgtcgccaaggcagccgccgattcagcggaattgccgctgttccgttatattggagggtctaacgcacatatccttccggtgcctatgatgaacattctcaacggcggcgcgcacgccgacactgctgttgatgtgcaggagttcatggtggcaccgatcggggcacccagtttcgttgaggcgctgcgttggggcgccgaggtatatcacgctctcaaatcggttctgaagaaaaaagggttaagcaccggcctgggtgatgagggtggctttgcccctgaagtggccggaaccaccgcggcgctggacttggtcaccttagctattgaagcggcgggttttaagccgggtgccgatgtggcattggcccttgatgcggcagccaccgagttctacacggacggcatcggctaccatttcgagggcatgacccacactgccgaccagatgactgagttttatgccgacttgctgggttcatacccactggtgtccatcgaagatccgctgtccgaagatgattgggacggttgggctgctctgacggcgtcgataggggaacaggtgcagatcgtcggggacgacatctttgccaccaatcctgagagactggaggagggcatcggtcgcggtgtggcaaacgcgttgctggtcaaggtgaaccagataggcacgttgaccgagacgctcgaagctgttgcgttggcacatcacagcggatatcgcacgatgatcagccaccgcagtggcgagaccgaggacacgatgatcgctgacctggtcgtggctctcggtagcgggcaaattaagacgggagcgcccgcccgcagtgagcgcgtcgctaaatataaccagctgctgcggattgaagaggagctcggcgacgccgcccgctatgccggcgatctggcatttctgcgatacgtcgtggaaacgagataa

SEQ ID NO: 4272 - protein, 429 aa, Mycobacterium leprae [sequence omitted]

SEQ ID NO: 4273 - DNA, 1353 bp, Mycoplasma penetrans
  CDS (1)..(1353): transl_table=4
atgttcggtagtaaatttaaaatttgtaagattgaagcttacgaagtaattgattcaagagggttccctacagttgctgcaaaagtatatgctaagaatggtgtatttgcaaaagctatggttccatctggtgcttctactggtgaaagagaagctgttgaattaagagatggtgacaaagaaagatttaacggtaaaggtgttttaaaagctgttaacaatgttaatacaatcattgctcctaaagttgtaggaatggattgtagacaacaaactaagattgatgaattaatgattagtcttgatggaacacctaacaaagctaaactaggtgctaatgctattttggctgtttctttagcagttgcaaaattagctgcaatgatagaagaaaaaccattatacaaatacattagacaaaacatcatgggagatagcagtgattcatgaacaatgcctgttcctatgttaaacgttattaatggtggtgcacatgctgataacactattgatttccaagaatttatgttcatgccagttggagctaaatctttaaaagaagctgtaagaatggcatctgaatgtttccactcattacaatcaattttaaaatctaaaaaattagatactaacaaaggtgatgaaggtggatttgcacctaacttaaaaaatgctgatgaagcattaaagttaatggttgaagctgttgaaaaagcaggatacaaaccaggagttgatgcagatgttgcttttgcattagacccagcaacttcagaattatttgatgctgataaaaaaacatatacttttgaaaaagctttaaaagctaaaatcttaacagcaaaagatgcagttaaaaaatcagaagatatggttaaatattgagatggattatgtaaaaaatatccaatcatctcaattgaagatggattagctgaaaatgactgagatggattccaattaatggttaaagacttaggaagcagagttcaaattgttggtgatgacttattctgtacaaatcctaaaattgttaaagaaggaatttctaaaggagttgcaaactctgtattaattaaagttaaccaaattggtactttaactgaaactattgaaactattaaagcagcacatgcagctggttgaacttgtgtagtttctcatagatctggtgaaactgaagatactacaattgctgatattgcagttggtttaagtacaggacaaattaaaactggttcaatgtctagatctgaaagaattgctaaatataacagattaatcgaaattgaaaatgaattagggtcaaaagctcattaccctggtaaaagtacatttaaatcaattaaatag

SEQ ID NO: 4274 - protein, 450 aa, Mycoplasma penetrans [sequence omitted]

SEQ ID NO: 4275 - DNA, 1311 bp, Neocallimastix frontalis
  CDS (1)..(1311)
atggctattactaaggttcacgctcgtcaaattttcgattcccgtggtaacccaactgttgaagttgaagttactaccgacaagggtctcttccgtgctgccgttccatctggtgcttccactggtgttcacgaagctcttgaactccgtgatggaattaaggctgattacgttggcaagggtgtcttaaaggctgttgaaaacgttaacaagactattgccccagctcttgttgctgccaatcttgatgttaagaaccaaaaggctgtcgatgacttccttcttaagttagatggtactccaaacaagagtaagcttggtgctaacgccatccttggtgtttcccttgctgttgcccgtgctggtgctgctgataagggtgtcccactttaccaacacttaggtgaattagccggtaacaagggtccatggattcttccagttccatccatgaacgtccttaacggtggttctcacgctggtaacaagcttgccatgcaagaattcatgattcttccaactggtgctaagagtttcactgaagcccttaagatgggttctgaagtttaccacgctcttaagtctgtcatcaaggccaagtacggtcaagatgcctgtaacgttggtgatgaaggtggtttcgctccaaacattcaagataataaggaaggtcttgaactcttaaacgaagctattgctaaggccggttacactggtaaggttaagattggtatggatgttgcctcctctgaattctacaaggatggtaagtacgatcttgacttcaagaatccaaactctgacccatccaagtggatctctggtgaagaacttggtcaattctacaaggaaatcacttctgaatacccaattgtttctattgaagatccatacgaccaagatgatttcgaatcatggtctaagttcagagctgatatgcaagataagattcaaattgttggtgatgatcttactgtcactaacccaaagcgtattgctatggctattgaaaagaaggcctgtaacggtcttttattaaaggttaaccaaatcggtaccgtttctgaatctattcaagctgctcttgatgctttcaacgacggttggggtgttatggtttctcaccgttctggtgaaactgaagacactttcattgctgatcttgttgttggtcttaagagtggtcaaattaagactggtgctccatgccgttccgaaagattagctaagtacaaccaacttctccgtattgaagaagaacttggtgctaacgctacctacgcaggtgaaaacttccgtcgtccattctaa

SEQ ID NO: 4276 - protein, 436 aa, Neocallimastix frontalis [sequence omitted]

SEQ ID NO: 4277 - DNA, 1287 bp, Nitrosomonas europaea
  CDS (1)..(1287)
atgagtgcaatcgtagatgtaatcgcccgtgaaattatcgactctcgtggtaacccaaccatagaagccgatgtattgctggaatcgggcgtgcttgggcgcgcttcagtgccatctggcgcatctgtcggcacacgcgaagccgttgagctgcgcgatggagatgcacagcgctactatggaaaaggggtattgaaggcagttgaaagcgtcaatggtgaaatttctgaaacgatcatggggctggatgccatggagcagtgtttcattgataagaccctgatcgagcttgacggcagtgaaaacaaatccagactgggtgccaatgccatactcgccgtttcgcttgcagtggccaaagcagcagcagaagaatccggtctccccctttatcgctatctgggaggaatcaatgccaagtggttgcctgtaccgatgatgaatctggttaatggcggcgtgcacgcaaacaaccgtctggatatgcaggaattcatgattataccgctgggcttgccaaacctgcgtgaggccgtgcgttgtggcgcagaggtattcagcacactcagaacgttgctcaacaaaagaaatctgcccacgacagtgggtgatgaaggcgggtttgctcccagctttgctcgcaacgaagaggcactggctctgatcgtgcaggccatagatgaagcaggttatcaacccggctccgaggtggcgatcggagtggattgcgccagttccgaatttttccgggagggaaaatatcatctcgatgtagacggactcggtcttacctcggctcagtttgtagattatcttgccacctgggtggagaaatatccgatcatcagtatcgaagatggcatgagtgaacaagattgggagggctggggactgttgacggaaaggctgggtaaaacagttcagctggttggtgatgatgtgtttgtcaccaatacccgaattcttaaagagggtatcagtcgcaatattgccaattccattctgatcaagatcaatcagattggtacgcttaccgagacactgaacgcaatcgaaatggcaaagtgtgcgggctataccgccatagtttcccatcgttccggcgaaactgaggatacgaccattgctgacatagcagttgccaccaatgccttgcagatcaaaacaggttcactctcgcgttcggatcgactggccaagtacaatcaattgttgcgtatcgaggaagatctgggcgagatggcgcaatatgccggaagatcggcattctaccagttgaagccatga

SEQ ID NO: 4278 - protein, 428 aa, Nitrosomonas europaea [sequence omitted]

SEQ ID NO: 4279 - DNA, 1290 bp, Oceanobacillus iheyensis
  CDS (1)..(1290)
atgccatatattacagatgtttatgctagagaagtcttagattcaagaggtaacccaaccattgaagttgaaattttcacagagtcaggagcatttggttcagcaatcgtaccaagtggtgcatcaactggtgagtatgaagcagtagaacttcgtgatggtgacaaagatcgttatttaggtaaaggagttcaaaaagcagttgaaaatgtaaatgatctaattgcgcctgaacttattggtattgatgttacgcgtcaaaacattattgatgctttaatgatcgacctagatggaacggaaaacaaaggtaaactaggtgcgaatgcaatccttggagtatccatggcagcagcacatgcagcagcaaactatttagaagtacctctatacaactatttaggtgggttcaatgcaaaaacacttccaacaccaatgatgaacatattaaatggtggagagcatgcggataacaacgtagatattcaagaatttatgattatgcctgttggtgctccaacatttaaagaagcattgcgcactggtgctgaaattttccatgcgttgaaaaaagtactaacttcaaaaggctataacactgcagtaggtgatgaaggtggttttgcgccaaacctaggctctaatgaagaagcactacaaactatcgtagaagcaattgaagctgctggttataagccgggtgaagaagttaaacttgcaatggacgtagctgcttctgaaatctacagtgatggtaaatataacctaaaaggtgagggagttgttcgttcatctgaggaaatggttgactggtatgaagaaatgatttctaaatacccaattatctctattgaagatggattggatgaaaatgattgggatggtttcaaaatcctaactgatcgtcttggtgataaagttcaattagttggagatgacttgttcgtaaccaacacgaataaactttctaaaggtatcgatcaaggtattggtaactctatcttaatcaaagtaaaccaaatcggaactctaacagaaacatttgaagcaattgaaatggcaaaacgcgctggttatacagctgttatctctcaccgttctggtgaaacagaagatgttacgattgcagatattgcagtagcaacaaatgctggacaaatcaaaacaggtgcaccatctcgtacggaccgtgtagctaaatataaccaactacttcgcattgaagatgaattagctggtatgggtgagtatggtggattagcttcattctacaacttagctaacaaataa

SEQ ID NO: 4280 - protein, 429 aa, Oceanobacillus iheyensis
MPYITDVYAREVLDSRGNPTIEVEIFTESGAFGSAIVPSGASTGEYEAVELRDGDKDRYLGKGVQKAVENVNDLIAPELIGIDVTRQNIIDALMIDLDGTENKGKLGANAILGVSMAAAHAAANYLEVPLYNYLGGFNAKTLPTPMMNILNGGEHADNNVDIQEFMIMPVGAPTFKEALRTGAEIFHALKKVLTSKGYNTAVGDEGGFAPNLGSNEEALQTIVEAIEAAGYKPGEEVKLAMDVAASEIYSDGKYNLKGEGVVRSSEEMVDWYEEMISKYPIISIEDGLDENDWDGFKILTDRLGDKVQLVGDDLFVTNTNKLSKGIDQGIGNSILIKVNQIGTLTETFEAIEMAKRAGYTAVISHRSGETEDVTIADIAVATNAGQIKTGAPSRTDRVAKYNQLLRIEDELAGMGEYGGLASFYNLANK

SEQ ID NO: 4281 - DNA, 1302 bp, Pasteurella multocida
  CDS (1)..(1302)
atggcaaaaatcgttaaagtgatcggccgtgaaatcatcgattctcgtggtaacccaactgttgaagcagaagtccatttagaaggtggctttgtgggtctagccgccgcaccatcaggcgcatcaactggttcacgcgaagcattagaattacgtgacggtgacaaagcacgtttcttaggtaaaggtgtgttaaaagctgttgctgcagtgaacaacgaaattgcacaagctctcgttggtaaagatgcgacaaaccaagctgaaatcgaccaaattatgatcgatttagatggcacagaaaacaaatctaaattcggtgcaaacgccattttagcggtttctttagctaacgcaaaagcagcggcggcggcaaaaggtatgccattatttgcttggattgcagaacttaacggtacgccaggtcaatactctatgccattaccaatgatgaacatcatcaacggtggtgagcacgcagacaacaacgttgatatccaagaatttatgattcaaccagtgggtgcgaaaaccttaaaagaagcccttcgtatcggtgcggaagtattccacaaccttgcgaaagtattaaaaggcaaaggcttaagcacagcagtcggtgacgaaggtggttttgcacctaacttagaatctaacgcagcagcgcttgcttgtatcaaagaagccgtagaaaaagcgggttatgtgttaggtaaagatgtcacattagcaatggactgtgcatcatctgagttctataacaaagaaaatggtatgtacgaaatgaaaggtgaaggtaaatcattcacttctcaagaattcacacactacttagaagaattatgtaaagaatacccaatcgtgtctatcgaagatggtcaagatgagtcagactgggaaggtttcgcctaccaaactaaagtattaggcgacaaagttcaattagttggtgatgacttattcgtaacgaataccaaaatcttaaaagaaggtatcgaaaaaggtatcgcgaattcgatcttaatcaaattcaaccaaatcggttcattaactgaaacgttagcggcaatcaaaatggcgaaagacgcaggttacacggcggtgatttcacaccgttctggtgaaacagaagatgccactattgcagatttagccgttggtaccgcagcaggtcaaatcaaaacgggttcaatgagccgttctgaccgtatcgcgaaatacaaccaattaatccgtatcgaagaagcattaggtgataaagcaccattcttaggtttaaaagcggttaaaggtcaagcataa

SEQ ID NO: 4282 - protein, 433 aa, Pasteurella multocida
MAKIVKVIGREIIDSRGNPTVEAEVHLEGGFVGLAAAPSGASTGSREALELRDGDKARFLGKGVLKAVAAVNNEIAQALVGKDATNQAEIDQIMIDLDGTENKSKFGANAILAVSLANAKAAAAAKGMPLFAWIAELNGTPGQYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEELCKEYPIVSIEDGQDESDWEGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGDKAPFLGLKAVKGQA

SEQ ID NO: 4283 - DNA, 1290 bp, Pseudomonas putida
  CDS (1)..(1290)
atggcaaaaatcgtcgacatcaaaggtcgtgaagttctcgattcgcgtggcaaccccactgtggaagccgacgtactgctcgacaacggcatcatcggcagcgcttgcgcgccgtccggtgcttctaccggctcgcgcgaagcgctggagctgcgtgatggcgacaagagccgttacctgggcaagggcgtgctgaaggccgtcgccaacatcaacggcccgatccgtgacctgctgctgggcaaggatccttccgatcagaaggctctggaccgcgccatgatcgaactggacggtaccgagaacaaggccaagctgggcgccaacgccatcctggctgtttccctggctgccgccaaagctgctgcccaggaccaggacctgccgctgtacgcgcacatcgccaacctgaacggcaccccgggccagtactcgatgccggttccgatgatgaacatcatcaacggtggcgagcacgccgacaacaacgtcgacatccaggagttcatggttcagccggttggcgccaagaccttctctgacggcctgcgcatgggtaccgaaatcttccaccacctcaaggctgtactgaaggcccgtggcctgaacaccgccgtaggtgatgaaggtggtttcgcccctaacctggcatccaacgaagacgccctgggcgccatcgctgaagctgtcgaaaaagccggctacaagctgggcaccgacgtgaccctggccctggactgcgcggcttccgaattctacgaagacggcaagtacaacctgtccggcgaaggcaagtcgttcgacgccgaaggcttcgccgactacctgaaaggcctgaccgagcgtttcccgatcatttcgatcgaagacggcctggacgagtccgactgggctggctggaaaatcctcactgacaagatcggtgaaaaagtccagctggtcggtgacgacctgttcgtgaccaacaccaagatcctcaaggaaggcatcgagaaaggcatcggtaactcgatcctgatcaagttcaaccagatcggctcgctgaccgaaaccctggaagccatccagatggccaaggctgctggttacactgcagtgatctcgcaccgttccggtgaaaccgaagactcgaccattgccgacctggctgtgggtactgctgctggccagatcaagacaggctcgctgtgccgttccgaccgcgtttccaagtacaaccagctgctgcgcatcgaagagcaactgggcgccaaagcggtttaccgcggtcgtgccgagtttcgcggctaa

SEQ ID NO: 4284 - protein, 429 aa, Pseudomonas putida
MAKIVDIKGREVLDSRGNPTVEADVLLDNGIIGSACAPSGASTGSREALELRDGDKSRYLGKGVLKAVANINGPIRDLLLGKDPSDQKALDRAMIELDGTENKAKLGANAILAVSLAAAKAAAQDQDLPLYAHIANLNGTPGQYSMPVPMMNIINGGEHADNNVDIQEFMVQPVGAKTFSDGLRMGTEIFHHLKAVLKARGLNTAVGDEGGFAPNLASNEDALGAIAEAVEKAGYKLGTDVTLALDCAASEFYEDGKYNLSGEGKSFDAEGFADYLKGLTERFPIISIEDGLDESDWAGWKILTDKIGEKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAVYRGRAEFRG

SEQ ID NO: 4285 - DNA, 1287 bp, Pyrococcus abyssi
  CDS (1)..(1287)
atggagaacccctatgaaattgtggccgttattgcaagggagattctcgacagtaggggcaacccaacggttgaagttgacgtccacacgccaatttccatgggaagggccgcggttccaagcggtgcctcaaccggaactcacgaggccgttgaactgagggatggcggaaagaggtaccatggaaaaggtgttaggagagcagttgagaacgtgaacaagataatagccccagaattagttggaatggatgttagatggcagagggagatagatagacttctaatagaacttgatggaaccgagaacaagagcaaccttggagcaaacgcaattctagcagtttcattagcagttgcaaaagcagcggccaatgcgctcgagttacccttataccagtatcttggtggcgtaaatgcatacgtccttcccgttccactaagcaacgtcatcaacggtggtgttcatgctggcaatgaccttgactttcaagagttcatgataatgccaataggagcaaactcgttcagggaagcgataagatgggtcagcgaaacgtaccacgtgttgaagaaggtaatagcagaaaagtacggaaagaatgcagtgaacgttggagatgagggtggatttgctcctccgatgaaggaggtaaccgaaccattagacgttcttataaaggcaatagaggaggcaggttataaacctggtgaggaaatagcgctcgcgttagatgcagcttccagcgaattctataaggatgggaagtatatagttagcggaaaagagtacacgagggaagagctgctagagctgtacaaggagctaacatcgacatatcccatagtttccatagaagatccattccacgaggaggactgggaaggattcgtgatgataactagggaactagggaagaaggttcagatagttggagacgacctcttcgtgacgaatccgaagagactaaagaagggaatagagatgggagcggcaaatgccctgctcttaaaggtcaaccagataggaacgttaaccgaggcaatggacgcagcatacatggcatttagggctggatatggagttgtagtttcccatagaagtggagagacagaagatgcaacgatagcagatttggcagttgcactaaatgcgggccagataaagactggagcacctgctaggagcgatagaaatgctaagtacaaccagcttataaggatagaggaagagcttgaaggggttgcagtttacgcgggcaagaacttcaggaaggtattcttctga

SEQ ID NO: 4286 - protein, 428 aa, Pyrococcus abyssi [sequence omitted]

SEQ ID NO: 4287 - DNA, 1293 bp, Pyrococcus furiosus
  CDS (1)..(1293)
atggagaacccttatgaaattgttggtgtagtggcaagagaaatactagacagcaggggaaatccaacagtagaagttgacgtttatacacatgttggtatgggcagagccgctgtcccaagtggagcttctacaggaactcatgaggccctagagcttagggatggcggaaagaggtatcatggaaaaggagttagaagggcagtggaaaacgtcaacaaaataattgctcctgagcttataggaatggacgttagatggcagagagaaatagatgctcttctcttagagcttgatggaacagaaaacaagagcaacgtgggtgcaaatgccattttggcagtctctcttgccgttgcaaaggccgctgcgaactcccttgaactaccactctatcaatacttgggaggagtaaacgcttacgttctcccagtcccacttagcaacgttataaacggaggagttcacgcaggaaatgacttagacttccaagaatttatgataatgccaattggggcagattccttcagagaggcaattagatgggtatcagagacctaccacgtccttaagaaagtcattatggagaagtacggaaagaatgccgtaaacgttggagatgagggaggatttgcacctccaatgaaggaagttaccgaacccctagatgtgcttattaaggcaatagaagaagctggatataaacccggagacgagattgcattggccttagacgttgcatcaagcgaactcttcaacgaggagactggaaaatacgtagttggtgggaaagaatacgacagaggagagcttctcgaactttacaaagacctaacatcgacatatccaattgtctcaattgaagacccattccacgaagaagactgggaaggattcgtgatgataactaaagaacttgggcacaaggttcaaattgttggtgatgacctcttcgtcacaaatccaaagagactaagaaaaggaattgaacttggagctgcaaacgcactcctgctcaaagtgaaccagatagggacgttgagtgaggccatggatgccgcatttacagcattcagagcaggatatggggtaatagtctcccacaggtccggagaaacggaagatgctaccattgccgacttagcagtagcattaaatgctggtcaaataaaaacgggggccccagccagaagcgacagaaatgccaagtacaaccagctaattagaattgaggaagagcttgaaggtgttgcagtctacgctgggaagaggtttaggaaggtcttcttctga

SEQ ID NO: 4288 - protein, 430 aa, Pyrococcus furiosus
MENPYEIVGVVAREILDSRGNPTVEVDVYTHVGMGRAAVPSGASTGTHEALELRDGGKRYHGKGVRRAVENVNKIIAPELIGMDVRWQREIDALLLELDGTENKSNVGANAILAVSLAVAKAAANSLELPLYQYLGGVNAYVLPVPLSNVINGGVHAGNDLDFQEFMIMPIGADSFREAIRWVSETYHVLKKVIMEKYGKNAVNVGDEGGFAPPMKEVTEPLDVLIKAIEEAGYKPGDEIALALDVASSELFNEETGKYVVGGKEYDRGELLELYKDLTSTYPIVSIEDPFHEEDWEGFVMITKELGHKVQIVGDDLFVTNPKRLRKGIELGAANALLLKVNQIGTLSEAMDAAFTAFRAGYGVIVSHRSGETEDATIADLAVALNAGQIKTGAPARSDRNAKYNQLIRIEEELEGVAVYAGKRFRKVFF

SEQ ID NO: 4289 - DNA, 1284 bp, Ralstonia solanacearum
  CDS (1)..(1284)
atgagtgccatcgtagatatcatcgggcgcgaagtgctggactcgcgcggcaatcccaccgtcgaatgcgacgtgctgctggaatcgggcgtgatgggccgcgcggcggtgccgtcgggcgcctccaccggctcgcgtgaagccatcgagctgcgcgacggcgacaagggccgctatctgggcaagggcgtgctgaaggccgtcgagcacatcaacaccgagatctccgaagccatcatgggcctggacgcctccgagcaggcgttcctggaccgcacgctgatcgacctggacggcaccgagaacaagggccgcctgggcgccaacgccacgctggccgtgtcgatggccgtggccaaggccgccgccgaggaagccggcctgccgctgtaccgctacttcggcggttcgggcgcgatgcagatgccggtgccgatgatgaacatcgtcaacggcggcgcgcacgccaacaacagcctggacatccaggaattcatggtgatgccggtcggccagcagagcttccgtgaagccctgcgctgcggcgccgagattttccacgcgctcaagaagatcatcgccgacaagggcatgagcacggcggtgggcgacgagggcggctttgccccgaacttcgccagcaacgaagagtgcctgaacaccatcctgtcggcgatcgaaaaggccggctaccgtccgggcgaagacgtgctgctggcgctggattgcgctgcctccgagttctaccgcgacggcaagtaccacctggacggtgaaggcctgcagctgtcgtcggtggacttcgccaactacctggcgaacctggccgacaagttcccgatcgtctcgatcgaagacggcatgcacgagagcgactgggacggctggaaggtcctgaccgaaaagctcggcaacaaggtccagttggtgggcgacgatctgttcgtcaccaacacgcgcatcctgaaggaaggcatcgaaaagggcatcgccaactcgatcctcatcaagatcaaccagatcggcacgctgaccgagacgttcgccgccatcgagatggccaagcgggccggctacaccgctgtgatctcgcaccgctcgggcgagaccgaggacagcaccatcgccgatatcgcggtgggcaccaacgccggccagatcaagaccggctcgctgtcgcgctcggaccgcatcgccaagtacaaccagctgctgcgcatcgaggaagatctgggcgacatcgccagctacccgggcaagtcggcgttctataacctgcgataa

SEQ ID NO: 4290 - protein, 427 aa, Ralstonia solanacearum [sequence omitted]

SEQ ID NO: 4291 - DNA, 1275 bp, Rhizobium loti
  CDS (1)..(1275)
atgaccgccatcatcgacattgtcggacgtgaaatcctggacagccgtggaaacccgaccgtcgaggtcgatgttgtacttgaagacggttcgatgggccgcgccgcggtgccgtcgggcgcctcgaccggcgcccatgaagccgtcgagcttcgcgacggcggcgcccgctatctcggcaagggcgtgctcaaggccgtagaggcggtcaatggcgagctgttcgaagcgatcggcggcatggaagccgaaaaccagatccatatcgatcagaccatgatcgagcttgatggcacgcccaacaagagccggctcggcgccaatgccattctcggcgtttcgctggcggtggccaaggccgcggccgatgccgccggcctgccgctctatcgctatgtcggcggcaccaaggcgcacattctgcctgtgccgatgatgaacatcatcaatggcggcgcccatgccgacaatccgatcgacttccaggaattcatgatcctgccggtcggcgcgccgactttgcgtgaaggcgtgcgctggggctcggaaatcttccacacgctgcgcaagaagctgaaggatgccggccacaacaccaatgtcggcgacgagggcggctttgccccgaacctgaagagcgcgccggtggcgctcgatttcatcatggaatcgatcgagaaggccggcttcaagccgggcgaggaaatcgcgctcggcctcgattgcgccgcgaccgagttcttcaaggacggcaattacgtctatgaaggcgagaagaagacgcgcgatcccaaggcccaggccaagtaccttgccaagctcgccgccgactatccgatcgtctcgatcgaggacggccttgccgaggacgactgggaaggctggaaatatctgaccgacttgatcggcaagaagacacagctggtcggcgacgaccttttcgtcaccaacacggcgcggctgcgcgacggcatccgcatgggcgttgccaattcgatcctggtcaaggtcaaccagatcggctcgctgacggaaacgctcgatgccgtcgagaccgcgcacaaggctggctacaccgccgtcatgtcgcaccgttcgggcgagaccgaggattcgaccatcgccgatctcgccgtcgccaccaattgcgggcagatcaagaccggctcgctgtcgcgctccgaccgcatggccaaatacaaccagctgatccgcatcgaggaagagcttggcaagcaggcgcgttacgccggcaagtcggtgatcaagggctga

SEQ ID NO: 4292 - protein, 424 aa, Rhizobium loti
MTAIIDIVGREILDSRGNPTVEVDVVLEDGSMGRAAVPSGASTGAHEAVELRDGGARYLGKGVLKAVEAVNGELFEAIGGMEAENQIHIDQTMIELDGTPNKSRLGANAILGVSLAVAKAAADAAGLPLYRYVGGTKAHILPVPMMNIINGGAHADNPIDFQEFMILPVGAPTLREGVRWGSEIFHTLRKKLKDAGHNTNVGDEGGFAPNLKSAPVALDFIMESIEKAGFKPGEEIALGLDCAATEFFKDGNYVYEGEKKTRDPKAQAKYLAKLAADYPIVSIEDGLAEDDWEGWKYLTDLIGKKTQLVGDDLFVTNTARLRDGIRMGVANSILVKVNQIGSLTETLDAVETAHKAGYTAVMSHRSGETEDSTIADLAVATNCGQIKTGSLSRSDRMAKYNQLIRIEEELGKQARYAGKSVIKG

SEQ ID NO: 4293 - DNA, 1275 bp, Rhizobium meliloti
  CDS (1)..(1275)
atgactgcaatcatcgacatcatcggccgagagatcctcgacagccgcggcaacccgaccgtcgaggtcgatgtccatctcgaggatggcagtttcggtcgcgcggcggttccctcgggcgcctccaccggtgcgcatgaagcggttgagctgcgcgatggcggcacgcgttatctcggcaagggcgtcgagcgcgccgtcgatgcggtgaacggcgagatattcgaggcgatcggcggcctcgacgctgaaaatcagatccagatcgaccgtaccatgatcgagctcgacggcacgccgaacaagtcgcgcctcggcgccaacgccattctcggcgtttcgctcgccgtcgcgaaggccgctgcggaagcctccggcctgccgctctaccgctatgtcggcggcccgaacgcgcatctcctgcccgttccgatgatgaacatcatcaatggcggcgcgcacgccgacaatccgatcgacttccaggaattcatgatcatgccggtcggcgccgagaccctgaaggacgccgtccgcatgggttcggaagtcttccacacgctgaagaagcagctcgctgcggatggccataacaccaatgtcggcgacgaaggcggctttgcgccgggcctcgcctcggcgcctgcagccctcgacttcatcatgaagtcgatcgagaaggccggttacaaacctggcgaggacatgtatgtcgccctcgactgcgcttcgaccgaattcttcaaggacggcaaatacgtgctcgagggtgagggccgtacgctggagccgggcgccatggccgagtatctcgccgagctcgccggcaaatatccgatcatctcgatcgaggacggcatggctgaagacgattgggacggctggaaatccctgaccgacctcgtcggcaacaagtgccagcttgtcggcgacgacctgttcgtcaccaattctgcgcgcctgcgtgacggcatcaagatgggcgtcgcgaactccatcctcgtcaaggtcaaccagatcggatcgctttcggaaacgctcgatgcggtcgagaccgcgcacaaggcgcgttataccgccgtcatgtcgcaccgctccggcgagaccgaggattcgacgattgccgacctcgcggtcgccaccaattgcggtcagatcaagaccggctcgctcgcacgttccgaccggctcgccaagtacaaccagttgatccgtatcgaagaacagctcggcccgcaggcgcaatatgccggccgctcggtcctgcgtggatga

SEQ ID NO: 4294 - protein, 424 aa, Rhizobium meliloti
MTAIIDIIGREILDSRGNPTVEVDVHLEDGSFGRAAVPSGASTGAHEAVELRDGGTRYLGKGVERAVDAVNGEIFEAIGGLDAENQIQIDRTMIELDGTPNKSRLGANAILGVSLAVAKAAAEASGLPLYRYVGGPNAHLLPVPMMNIINGGAHADNPIDFQEFMIMPVGAETLKDAVRMGSEVFHTLKKQLAADGHNTNVGDEGGFAPGLASAPAALDFIMKSIEKAGYKPGEDMYVALDCASTEFFKDGKYVLEGEGRTLEPGAMAEYLAELAGKYPIISIEDGMAEDDWDGWKSLTDLVGNKCQLVGDDLFVTNSARLRDGIKMGVANSILVKVNQIGSLSETLDAVETAHKARYTAVMSHRSGETEDSTIADLAVATNCGQIKTGSLARSDRLAKYNQLIRIEEQLGPQAQYAGRSVLRG

SEQ ID NO: 4295 - DNA, 1497 bp, Rhodotorula rubra
  CDS (102)..(1421)
attgacatcaattgtttgtttttttttttaatttatcttataaatacttgtttcttaaaaaaagaaaacccccaattgaattcagcaaactataattaacaatggctatttcaaagatccactccagatacgtctacgactccagaggaaacccaactgttgaggttgaattgaccactgaaaagggtacttttagatcaattgtcccatccggtgcttccactggtgtccacgaagccttggagttgagagacggtgacaaatcaaaatggttgggtaaaggtgtcttgaaggccgttgccaacgttaacgacacaattgccccagccttgattgaggccaacattgatgttgctgaccaagccaagattgacgaattcttgttgaaattggacggtactccaaacaaggccaagttgggtgccaacgccatcttgggtgtctcattggctgccgctaaagccggtgccgctcaaaaagatgtcccattgtacaagcacattgctgacatttcaaaggccaaggaaggcaaatttgtcttgccagttcctttccaaaacgtcttgaacggtggttcccacgctggtggtgacttggctttccaagaatttatgattgtcccatccggtgctccatcattctctgaaggtttgagaatcggttcagaagtttaccaccacttgaaatcattgaccaagaagaagtacggtcaatccgcaggtaacgttggtgacgaaggtggtgttgctccagatatcaaaaccgctaaggaagctttggacttgatcgtttcagctattgaagctgctggttacaccggtcaagttgacattgccatggatgttgcatcatccgaattctacaaggatggattgtacgacttggactttaaaaatccaaactctgacaagtcgaaatggatcactggtccacaattggctgaattgtacgagcaattgttgaatgaatacccaattgtctccattgaagacccattcgctgaggatgactgggaagcttggagccactttttctccaaggttgaaggtaagacccaaatcgttggtgatgacttgaccgttaccaacccaattagaattaagaaggccatcgagaccaaggctgctgacgccttgttgttgaaggttaaccaaatcggtactttgaccgaatcaatccaagctgccaatgactcatacgctgccggttggggtgttatggtctcccacagatcaggtgagaccgaagacacctttatcgctgacttgtccgtcggtattagatcaggtcaaaccaagactggtgctccagctagatccgagagattggccaaattgaaccaaatcttgagaatcgaggaagagttgggtgacaaggccatctacgccggtaaggacttccacaaagcccactctttataagcagtttataggttatcagtctgggcactttgataagtgttaattgattgaggtgaagtaaaaaaaaaaaaaaaaa

SEQ ID NO: 4296 - protein, 439 aa, Rhodotorula rubra
MAISKIHSRYVYDSRGNPTVEVELTTEKGTFRSIVPSGASTGVHEALELRDGDKSKWLGKGVLKAVANVNDTIAPALIEANIDVADQAKIDEFLLKLDGTPNKAKLGANAILGVSLAAAKAGAAQKDVPLYKHIADISKAKEGKFVLPVPFQNVLNGGSHAGGDLAFQEFMIVPSGAPSFSEGLRIGSEVYHHLKSLTKKKYGQSAGNVGDEGGVAPDIKTAKEALDLIVSAIEAAGYTGQVDIAMDVASSEFYKDGLYDLDFKNPNSDKSKWITGPQLAELYEQLLNEYPIVSIEDPFAEDDWEAWSHFFSKVEGKTQIVGDDLTVTNPIRIKKAIETKAADALLLKVNQIGTLTESIQAANDSYAAGWGVMVSHRSGETEDTFIADLSVGIRSGQTKTGAPARSERLAKLNQILRIEEELGDKAIYAGKDFHKAHSL

SEQ ID NO: 4297 - DNA, 1462 bp, Schistosoma japonicum
  CDS (7)..(1311)
gggaaaatggcaattatagcgattcacgcccgtcaaatcttcgacagccgagggaatcccacagttgaggttgatctaaaaacagcaaaaggtttgttccgcgcagccgttccaagtggggcttcaacaggtgttcatgaggctcttgaattacgtgatacaaattcaaaggcttatatgtgcaaaggggttttgacagcagttagtaatgtgaataatatcatcgctccagctctgctgaagaaacaaattcctgtaaccaatcaatcggaggttgaccaatttatgatcgaactcgatggcaaagaaaacaaagggaatctcggagcgaatgctatattaggcgtatctttggctgtatgcaaggcgggtgcagctgaattaaatttacctctctataggtatattgcaaagttagctggccataaggatgtcataatgccggttcctgcatttaatgtcattaatggtggcagtcatgctggcaacaagctagcgatgcaggagtttatgattttacctactggggctagctcattcactgaggcaatgcaaatgggttctgaggtgtaccacaatttaaaggctgttatcaaacgtgagtttggattagatgcatgtaacgttggtgacgagggtggttttgcaccgaatattcaggataatatgaaaggtcttcaacttcttgaagaggctataaaaattgctggatatactggaaaagtagagattggtatggattgcgcggcttctgaatattataagaaggggaagtatgatttggatttcaagaatcctcaatctgccgaatctcattggcttagtcctgatgaaatggctaatgtttacaaggaaatgattcagaagtacccaatagtgagcattgaggacccgtttgatcaagatgattgggatgcgtggcctaaattgactgcgtcaactaacattcagattgtcggcgacgacttaacagtcaccaatccgaaacgcattgaaaaggccatcaaagtaaaagcttgcaattgccttcttttgaaagtaaaccagataggttcaataaccgagtctattgaagcttgcaaaatggcacaaaaagcaggctggggtgttatggtttcacatcgatcaggtgaaacggaagataatttcatcgctgatcttgtcgttggtctttgtactggacagatcaaaacaggtgcaccttgtcgatctgaacgtcttgcgaagtacaaccaactcttgcgtattgaagaggaattaggatcaacagcaaagtatgccggaaaacacttccgccatcctcaaatctgaacaaataataatattaacatttcaatgtcttttgaaggactgcattgatttagtttattgtcttatcatgtagactgttatttaaaagaaattaaatgtctgaattgttcccacatttatattaatagagcgtcgaagttatctgtttggt

SEQ ID NO: 4298 - protein, 434 aa, Schistosoma japonicum [sequence omitted]

SEQ ID NO: 4299 - DNA, 1461 bp, Schistosoma mansoni
  CDS (40)..(1344)
aaccgtcacggttttactcttgtgatttgttgcatgaaaatgtccattttaacgatccacgctcgtcaaattttcgatagtcgggggaatcccacagttgaggtggatttgaaaacatctaaaggtttgttccgcgctgccgttccaagtggagcttcgacaggtgtccatgaggctcttgagttacgtgatacaaattcaaaggcttatatgaagaaaggggttttaacagcagtcagtaatgtgaataaaattattgctccagctctaataaacaaaaatattcccgtaacaaatcaggcagctattgacaaatatatgattgatcttgatggtacggaaaacaaggaaaaacttggagccaatgctatattgggagtgtctttggccgtgtgcaaagctggtgcagctgaagccggtttacctctctataggtatattgcgaggttagctgggcatgaagatgttataatgcctgttccagcattcaatgtcattaatggtggcagtcatgccggcaacaagctagccatgcaagaatttatgattctgcctactggggccagctctttcactgaagcaatgcaaatcggtactgaggtgtaccacaatttaaaagctgttatcaaacgtgaatatggactggatgcatgcaacgttggtgacgaaggtggttttgcaccaaatatacaggataatatgaaaggtcttcagctgcttgaagaggccataaaaattgctggctatactgggaaagtagagattggtatggattgtgcggcttctgagttccataagaatgggaaatatgatttagatttcaagaaccctcattctgcagaatcaacctggcttagtcctgatgcaatggctaatatgtacaagcaaatgataagcaaatttccaattgtgagcattgaagatccatttgatcaggatgattgggaaacctggcccaaactaacttcttcaacaaatattcaaattgttggagacgatttgactgttaccaatccaaagcgcattaaacaggccatcgcttcaaaggcttgcaattgtcttcttttgaaagtaaaccagataggttcattaaccgagtccatcgaagcttgcaagttagcacaagactcaggttggggtgtcatggtttcgcatcgatctggtgaaacggaagatactttcattgctgatctagttgttggactttgcactggacagataaagacgggtgcaccatgtcgttctgatcgtttggccaaatacaaccaacttttacgtattgaagaagagttaggaacagcggcaaaatatgccgggaaaaacttccgccatcccaaagtataagaataattaataaaattaacacttcaatgtcttttggagaactaaattgatttagtttattgtcttattatgtagactgttatttaagaataaaatatttcagttctttaaaaaaaa

SEQ ID NO: 4300 - protein, 434 aa, Schistosoma mansoni
MSILTIHARQIFDSRGNPTVEVDLKTSKGLFRAAVPSGASTGVHEALELRDTNSKAYMKKGVLTAVSNVNKIIAPALINKNIPVTNQAAIDKYMIDLDGTENKEKLGANAILGVSLAVCKAGAAEAGLPLYRYIARLAGHEDVIMPVPAFNVINGGSHAGNKLAMQEFMILPTGASSFTEAMQIGTEVYHNLKAVIKREYGLDACNVGDEGGFAPNIQDNMKGLQLLEEAIKIAGYTGKVEIGMDCAASEFHKNGKYDLDFKNPHSAESTWLSPDAMANMYKQMISKFPIVSIEDPFDQDDWETWPKLTSSTNIQIVGDDLTVTNPKRIKQAIASKACNCLLLKVNQIGSLTESIEACKLAQDSGWGVMVSHRSGETEDTFIADLVVGLCTGQIKTGAPCRSDRLAKYNQLLRIEEELGTAAKYAGKNFRHPKV

SEQ ID NO: 4301 - DNA, 1296 bp, Shewanella oneidensis
  CDS (1)..(1296)
atggctaagattattaacgtgattggtcgcgagattatggattctcgtggtaacccaacagttgaagccgaagtgcatttagaaggtggttttatcggtatggcggctgcgccttctggtgcgtctaccggtagccgtgaagcgctagaactgcgtgatggcgataaaagccgttacttaggcaaaggtgtattaactgctgtggctaacgtaaacggtccaatccgtactgcgttaatcggtaaagatgcgactgcacaagccgaacttgatcaaatcatgatcgacttagacggcactgaaaacaaagacaagttaggagctaacgcgattttagctgtgtctttagcggcggctaaagcggctgcagcattcaaaggcatgcctttatacgctcacattgcggaattaaacggcacacctggccaatacgctatgccagtaccgatgatgaacatcctcaacggtggtgagcacgcagataacaacgttgatatccaagaattcatggttcaacctgttggcgcgaaaaatttccgcgaagctttacgtatgggcgctgagattttccacaccctgaaaaaagttctgcacggtaaaggtttaagcacttctgtaggtgacgaaggtggttttgcacctaacctgtcttcaaacgctgatgcattagcggtaatcaaagaagcggttgaattagcgggttacaagctgggtactgacgtgactctggcactagactgcgccgcttccgagttctacaaagacggtaaatatgacttggctggcgaaggcaaagtattcgattcaaacggtttctctgacttcctgaagtcactgactgagcaataccctatcgtatctatcgaagacggtctggacgagtcagattgggatggctgggcatatcaaactcagattatgggcgacaagatccaattagtgggcgacgatttattcgtcactaacactaagatcttaacccgtggtattgagaacggcatcgctaactcaatcctgatcaagtttaaccaaatcggttcattaactgaaaccttagcggctatccgtatggcaaaagcggcgggttacactgcggttatttcacaccgtagtggtgaaactgaagacgccactatcgctgatttagcggtaggtactgcggctggccaaatcaagaccggttcactgtgccgttctgatcgtgttgctaaatacaaccaattgctgcgtatcgaagagcaattaggtgaaaaagcaccttaccgcggtttgaaggaaatcaaaggtcaggcgtaa

SEQ ID NO: 4302 - protein, 431 aa, Shewanella oneidensis
MAKIINVIGREIMDSRGNPTVEAEVHLEGGFIGMAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 4303 - DNA, 1305 bp, Staphylococcus epidermidis
  CDS (1)..(1305)
atgccaattattacagatgtttacgctcgcgaagtcttagactcacgtggtaacccaacagttgaagttgaagtattaactgaaagtggtgctttcggacgtgcattagtaccttctggtgcttctactggtgaacatgaagcagttgaattacgtgatggagataaatcacgttatttaggtaaaggtgtgactaaagcggtagaaaatgttaacgaaatgatcgcaccagaaatcgttgaaggtgaattttcagttttagatcaagtatctattgataaaatgatgattcaattagacggtacacacaacaaaggtaaattaggtgcaaatgccattttaggtgtttctattgccgtagctcgtgcagctgctgacttattaggtcaaccattatataaatatttaggtggatttaatggtaaacaattgccagtacctatgatgaatattgttaatggtggttctcactcagatgcaccaattgctttccaagagttcatgattttacctgtaggtgctgagtcattcaaagaatcattacgttggggtgcagaaatcttccataaccttaaatcaatcttaagtgaacgcggtttagaaactgcagtaggtgatgaaggtggtttcgcacctagatttgaaggcactgaagacgctgtagaaactattattaaagctatcgaaaaagcaggatacaaaccaggtgaagatgtattcttaggatttgactgtgcttcttctgaattctatgaaaatggtgtttatgattacactaaattcgaaggtgaacacggtgctaaacgtagtgcagcagagcaagttgactacttagaagaattaattggtaaatatccaatcatcactattgaagatggtatggatgaaaacgattgggaaggttggaaacaattaactgatcgtatcggtgataaagttcaattagttggtgatgatttattcgtaactaacactgaaattttatctaaaggtatcgaacaaggtattggtaactcaatcttaatcaaagtaaaccaaatcggtacattaactgaaacattcgatgctattgaaatggctcaaaaagctggatatactgcggttgtatctcaccgttctggtgaaactgaagatactacaattgctgatatcgcagttgctacaaatgcaggccaaattaaaacaggttcattatctagaactgaccgtattgctaaatacaatcaattattacgtattgaagatgaattatacgaaacagctaaatttgaaggaattaaatctttctacaatttagataaataa

SEQ ID NO: 4304 - protein, 434 aa, Staphylococcus epidermidis
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 4305 - DNA, 1308 bp, Streptococcus agalactiae
  CDS (1)..(1308)
atgtcaattattactgatgtttacgcacgcgaagtccttgactcacgcggtaacccaacacttgaagtagaagtttatacagaatcaggtgctttcggacgtggtatggttccttcaggagcttctactggtgaacacgaagcagttgaacttcgcgacggcgacaagtctcgttacggtggtcttggaacacaaaaagctgttgacaatgtaaataacgttattgcagaagcaatcattggttatgatgtacgcgaccaacaagctatcgaccgtgctatgatcgctcttgacggaactcctaataaaggtaaattaggtgcaaatgctattcttggtgtttctattgccgtagcacgtgctgcagctgattaccttgaagtaccactttacagctaccttggtggattcaacactaaagttcttccaactccaatgatgaacatcatcaacggtggttctcactcagacgctccaatcgcattccaagaattcatgattatgccagttggtgcaccaactttcaaagaagcacttcgttggggtgctgaagtattccatgctcttaagaaaatccttaaagaacgtggtcttgaaacagctgttggtgatgaaggtggatttgcacctaaatttgaaggtactgaagatggcgtagaaactattcttaaagctattgaagcagctggttacgaagctggcgaaaacggaatcatgattggttttgactgtgcttcatcagagttctacgatgcggaacgtaaagtatacgactacagtaaattcgaaggtgaaggtggagcagttcgtactgctgcagaacaaatcgattaccttgaagagttggttaacaaatacccaatcatcactattgaagatggtatggatgaaaacgactgggatggttggaaagctcttacagaacgccttggtggacgtgtacaattagttggtgacgatttcttcgttacaaatactgattacttagcacgtggtatcaaagaagaagctgctaactcaatccttatcaaagttaaccaaatcggtactttgacagaaactttcgaagctattgaaatggctaaagaagctggttacactgcagttgtatcacaccgttcaggtgaaactgaagattcaacaatcgctgatatcgcagttgcaactaacgctggtcaaattaaaacaggttcattatcacgtactgaccgtattgctaaatacaaccaattacttcgtatcgaagaccaacttggtgaagttgctcaatacaaaggtatcaaatcattctacaacttaaaaaaatag

SEQ ID NO: 4306 - protein, 435 aa, Streptococcus agalactiae
MSIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 4307 - DNA, 2197 bp, Streptococcus intermedius
  CDS (8)..(1312)
gtaaaaaatgtcaattattactgatgtttacgctcgcgaagtcctagactcacgcggtaacccaacacttgaagtagaagtttatactgaatcaggtgctttcggacgtggtatggttccatctggagcttctactggtgaacacgaagcagttgagcttcgtgatggtgacaaatctcgttacggtggtcttggtacacaaaaagctgttgacaacgtaaacaatatcattgctgaagcagttattggttatgacgttcgcgatcaacaagctattgaccgtgcaatgattgcacttgatggtactccaaataaaggtaaattgggtgcaaatgcaatccttggtgtatctattgctgtggcacgtgctgctgctgattaccttgaaattccactttatagctaccttggcggattcaatactaaagttcttccaactccaatgatgaacatcatcaacggtggttctcactctgacgctccaatcgctttccaagaatttatgatcgtacctgctggtgcacctacattcaaagaagctcttcgttggggtgctgaaattttccatgctcttaagaaaatccttaaatctcgtggtcttgcaacagctgttggtgacgaaggaggatttgctcctcgttttgatggaactgaagatggtgtagaaacaattcttgctgctattgaagctgctggttatgttcctggtaaagatgtattccttggattcgactgtgcatcatcagaattctatgacaaagaacgtaaagtttatgattacactaaattcgaaggtgaaggagctgcagttcgtacagctgatgaacaaattgactaccttgaagaattggtgaacaaatatccaattatcactattgaagatggtatggatgaaaatgactgggatggttggaagaagcttactgaacgtcttggtaaaaaagtacaacctgttggtgatgacttcttcgtaacaaatacttcatatcttgaaaagggtatcaatgaagcttgtgctaactcaatccttatcaaagtgaaccaaattggtacccttactgaaacattcgacgctattgaaatggcgaaagaagctggttacactgccgttgtatcacaccgttcaggtgaaactgaagattcaacaatcgctgacatcgcagtcgcagctaacgcaggacaaattaagactggttcactttcacgtacagaccgtattgctaaatacaaccaattgcttcgtatcgaagaccaacttggtgaagtagctgaatatcgtggtttgaaatctttctataacttgtcaaaataattcagttataatacgaatcggctagtgaaactagtcgattttttctttattgtgtcgataaattttaggaggataatatggataaaattgaagaacttgctcgtattattcgaaatagccaaaatatagtattttttggtggtgcaggtgtttcaaccgaatctgccattccagattttcgtagttctaatggtatttacaatattgaattaaatcaacacttcacagcagaacaactagtttcctatacaatgtttgaacattatccaaagcagttttttgatttttacaagaaatatctcatttatcctgatgctaaccaaatgtagcacatatctatttagctcatttagagaatgtaggaaaactcaagcgattatcacacaaaatattgatagtttacacgagatggcaggaagtaaaaatgtattgaaactacatggtagtgtagaccgtaattattgtaccaattgtccatcgtttttatgatttagaggattttttgaaattgtttggaagtattccttattgcgagacttgtggccacattgtaaagccagatgtgactctttatgaggaatctctggatatgaccgtttttaatcaggcaattcaggctattagtcgagcagatctgctcattattggtggaacttcattagttgtttatctgcggctagtttggttcagtattttcaaggaagacagctagtcattatcaataaaagtaaagtggtacatgataatcaagctagcttaatcatcgagggcaagattggtgaggtactcagtaaagtatggaaattaacggataattaattcgaaaatcagtgaatgtatggcatttagctgtattttcaaaaaaagtaaaatttaaaaaatgtc

SEQ ID NO: 4308 - protein, 434 aa, Streptococcus intermedius
MSIITDVYAREVLDSRGNPTLEVEVYTESGAFGRGMVPSGASTGEHEAVELRDGDKSRYGGLGTQKAVDNVNNIIAEAVIGYDVRDQQAIDRAMIALDGTPNKGKLGANAILGVSIAVARAAADYLEIPLYSYLGGFNTKVLPTPMMNIINGGSHSDAPIAFQEFMIVPAGAPTFKEALRWGAEIFHALKKILKSRGLATAVGDEGGFAPRFDGTEDGVETILAAIEAAGYVPGKDVFLGFDCASSEFYDKERKVYDYTKFEGEGAAVRTADEQIDYLEELVNKYPIITIEDGMDENDWDGWKKLTERLGKKVQPVGDDFFVTNTSYLEKGINEACANSILIKVNQIGTLTETFDAIEMAKEAGYTAVVSHRSGETEDSTIADIAVAANAGQIKTGSLSRTDRIAKYNQLLRIEDQLGEVAEYRGLKSFYNLSK

SEQ ID NO: 4309 - DNA, 1299 bp, Streptococcus mutans
  CDS (1)..(1299)
atgtcaattattactgatgtttacgctcgcgaagtccttgactcacgcggtaacccaacacttgaagtagaagtttacactgaatcaggtgcattcggacgtggtatggttccttcaggagcttctactggtgaacacgaagcagttgaacttcgcgatggagataaatcacgttatggtggtcttggtactcaaaaagctgttgataatgtaaacaatattattgctgaagcacttatcggatatgatgttcgtgatcaacaagctattgataaagcaatgatcgcacttgacggtactccaaacaaaggtaaacttggtgctaatgctattcttggtgtttctattgctgtagctcgtgctgctgctgatttccttgaaattccactttacagctaccttggtggatttaacactaaagttctgccaactccaatgatgaacatcatcaacggtggttctcactcagatgctccaatcgctttccaagaatttatgattgtacctgctggtgcacctacattcaaagaagctcttcgttggggtgctgaaatcttccatgcacttaagaaaattcttaaggaacgcggacttgaaacagctgttggtgacgaaggtggattcgctcctaagtttgatggaactgaagacgctgtagaaacaattatcaaagctattgaaacagctggttacaaaccaggtgaagaagtcttccttggatttgactgtgcgtcatcagaattctatgataatggtgtttatgactacactaaattcgaaggtgaaaaaggtgctaagcgttcagctgcagaacaaattgattatattgaagaattggttaacaaatacccaattatcacaattgaagatgctatggacgaaaatgactgggatggctggaaagcattgactgctcgccttggtgaccgtgtacaattggttggtgacgacttcttcgttacaaatacggactaccttgctcgtggtatcaaagaaggtgctgcaaactcaatccttatcaaagttaaccaaatcggtactttgactgaaacatttgaagctatcgaaatggctaaagaagctggttatactgccgttgtatcacaccgttcaggtgaaactgaagattcaacaatcgctgatatttcagttgcaaccaacgctggacaaatcaagactggttcattgtcacgtacagatcgtattgctaaatacaaccaattgcttcgtatcgaagatcaacttggtgaagtcgctgaataccgtggtcttaaatcattctacaacttgaaaaaataa

SEQ ID NO: 4310 - protein, 432 aa, Streptococcus mutans
MSIITDVYAREVLDSRGNPTLEVEVYTESGAFGRGMVPSGASTGEHEAVELRDGDKSRYGGLGTQKAVDNVNNIIAEALIGYDVRDQQAIDKAMIALDGTPNKGKLGANAILGVSIAVARAAADFLEIPLYSYLGGFNTKVLPTPMMNIINGGSHSDAPIAFQEFMIVPAGAPTFKEALRWGAEIFHALKKILKERGLETAVGDEGGFAPKFDGTEDAVETIIKAIETAGYKPGEEVFLGFDCASSEFYDNGVYDYTKFEGEKGAKRSAAEQIDYIEELVNKYPIITIEDAMDENDWDGWKALTARLGDRVQLVGDDFFVTNTDYLARGIKEGAANSILIKVNQIGTLTETFEAIEMAKEAGYTAVVSHRSGETEDSTIADISVATNAGQIKTGSLSRTDRIAKYNQLLRIEDQLGEVAEYRGLKSFYNLKK

SEQ ID NO: 4311 - DNA, 1308 bp, Streptococcus pyogenes
  CDS (1)..(1308)
atgtcaattattactgatgtatacgctcgcgaagtccttgactcacgcggtaacccaacacttgaagtagaagtttatacagaatcaggtgcattcggacgtggtatggttccttcaggagcttcaactggtgaacatgaagccgttgaacttcgtgatggtgacaaatctcgttaccttggtctaggtactcaaaaagcagttgataacgttaataacattatcgctgaggcaatcatcggttacgatgttcgcgatcaacaagctatcgaccgtgcaatgatcgctcttgacggtactcctaacaaaggcaaacttggtgctaatgctattcttggtgtttctatcgctgttgctcgtgcagctgctgactatcttgaagtgccactttacacttaccttggcggattcaacactaaagttcttccaactcctatgatgaacatcatcaacggtggatcacactcagatgccccaattgcattccaagagttcatgatcatgccagttggtgcacctactttcaaagaaggtcttcgttggggtgctgaagttttccacgctcttaagaaaattcttaaagaacgcggacttgttacagctgtaggtgacgaaggtggatttgctcctaaatttgaaggaactgaagacggtgtagaaactatccttaaagctattgaagcagctggttacgaagctggtgaaaacggcattatgatcggttttgactgtgcatcatcagaattctacgacaaagaacgtaaagtttacgactatactaaatttgaaggtgaaggcgctgctgttcgtacatctgcagaacaagttgattaccttgaagagttggttaacaaatacccaattattactatcgaagatggtatggatgaaaacgactgggatggttggaaagttcttactgaacgcctaggcaaacgtgttcaattggttggtgacgacttcttcgttacaaacactgaataccttgctcgtggtatcaaagaaaatgcagctaactcaatccttatcaaagttaaccaaatcggtactttgactgaaacgtttgaagctatcgaaatggctaaagaagctggatatactgccgttgtatcacaccgttcaggtgaaactgaagattcaacaatcgctgacatcgcagttgcaacaaacgctggccaaatcaaaacaggttcattgtcacgtacagaccgtattgctaaatacaaccaattacttcgtatcgaagatcaacttggtgaagttgctcaatacaaaggtatcaaatcattctataacttaaaaaaatag

SEQ ID NO: 4312 - protein, 435 aa, Streptococcus pyogenes
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 4313 - DNA, 1269 bp, Streptococcus thermophilus
  CDS (1)..(1269)
atgacagtcacaatcgaaaacatccacgcgagagaaatttttgattctagaggaaatccaaccgttgaggtagatgttagattaacagatggaacactaggacgtgcagcagtaccctcaggagcatcaaccggagaccgtgaagcagttgaattaagagatggcggagcccgccttcaagggaaaggcgtttctaaagccgtcgcaaatgtcaatggcgaaatttatgaagccttgaaaggacaatcaccatttaatcaagcaaaattagatcatttgatgattgagcttgacgggacagaaaataaatcttgtttaggggctaatgcaattttaggggtttcaatggctatttttcgtgcggcagcgaatagtgaaaaaattccactttatcgctattttgggggagttgatttggaacttccacaaccatttttcaatgtcattaatggtggagtacatgccgattcaggaattgacgttcaagaatttttgattacaccagtcaaacgggacagctttcgtgatggtttaaaaaaaattgcaaatatctaccatactctgaaaaaaattttatctgacaaagggctaaaaacacccgtaggtgatgaaggtggctttgcccctaaacttggtactactgaaaatgcaattgctatactttatcaaccaattgacagtgcaggatattttcctggtgaaaaaattgcgattgccattgactcatcttcaattgaattttatgatgataaaaaaaaattttatcgttttgaagggaaaaatttgacttctaaagaactattgacttactatgacaatttagttgaaaaatatccagcacttatttccattgaagatggattttctgaacatgactgggagggctttgcagctcaaacgaaagctcgaggtcaaaaaattcaattagtaggtgatgatatttttgtgacaaatcccacaattttcaaagaaggaattaaaaagaacgtagcaaatgctattttgattaaacttaatcaaatcggaacagtaactgaaacgattgaaaccattagtttagcgagaaaagcaggctataagacaatgatttctcaccgttcaggtgaaacagttgatagctacattgccgatttttccgtagccatgcatgctggtcagataaaatcaggttcaatggctcgaagtgaacgggttgaaaaatataatcaattgttgcgaattgaagaagatttaggaaaagatgtagctcttgctcaatttccaggatag

SEQ ID NO: 4314 - protein, 422 aa, Streptococcus thermophilus
MTVTIENIHAREIFDSRGNPTVEVDVRLTDGTLGRAAVPSGASTGDREAVELRDGGARLQGKGVSKAVANVNGEIYEALKGQSPFNQAKLDHLMIELDGTENKSCLGANAILGVSMAIFRAAANSEKIPLYRYFGGVDLELPQPFFNVINGGVHADSGIDVQEFLITPVKRDSFRDGLKKIANIYHTLKKILSDKGLKTPVGDEGGFAPKLGTTENAIAILYQPIDSAGYFPGEKIAIAIDSSSIEFYDDKKKFYRFEGKNLTSKELLTYYDNLVEKYPALISIEDGFSEHDWEGFAAQTKARGQKIQLVGDDIFVTNPTIFKEGIKKNVANAILIKLNQIGTVTETIETISLARKAGYKTMISHRSGETVDSYIADFSVAMHAGQIKSGSMARSERVEKYNQLLRIEEDLGKDVALAQFPG

SEQ ID NO: 4315 - DNA, 1281 bp, Synechococcus elongatus
  CDS (1)..(1281)
atgatggatacggcgatcgcaaccattcgtgcccgcgaaattctcgactcgcggggtcgccccacggtagaagcagaagttgaactggagtgtggcattgtcggactggctcaggttcctagtggtgcctcaacagggagttttgaggcccatgaattgcgggacggtgatcccaagcgctatggtggcaaaggcgtcctcagcgccgttgaaaacattgaaaccaggattctcagtgcccttgtcgatctcaacgccctggatcaaacggtgattgaccagtgcctcttggaactggatggcagtgagaataaatccaacctcggtgccaatgccattctggcggtttcccttgccacggctaaagccgccgctgaatatcttggtcaacccctctaccgctacttgggggggcctctggccaatgtcctacccgtgcccatgatgaatgtgatcaatggcggggcccacgcggccaacaacattgattttcaggaattcatgatcatgcccattggtgcccctagttttcgggagggtttgcgctggggggcagaggtttttgctgctctgagtaaggtgctggctgataagggtttactgactggtgtgggggatgaaggggggtttgcgcccaacctagactccaaccaagcagctttggatattttgctgcaggcgattgaaacagcgggttacagacccggcactgacgtggccctagccctcgatgttgccgccaatgagttttatgaagacggcaaatatgtgtttgataataccagccgtacggcctctgagttaatccgctactacgaccaattggtaagcacctatcccattatttccattgaggatgggctgcaggaggaggactgggacaactgggcactcttgacggaaaccctggggagtcgcattcaactagtgggggatgatctgtttgtcaccaatcccaagcgtttgcaacggggaattgacaatggcgtggccaatgccatcttgattaagcttaaccagattggttcgttaactgaaactctgcaaaccattgatctggcaacccgcaagggttaccgcgccgtgattagccaccgctctggggaaacagaagatactacgattgcggatttagctgtagctacccgtgcgggtcaaattaaaacgggttccctgtgtcggagtgaacgggtggccaagtacaatcgcctgctgcgcattgaagcagaactgggggatcaggcggtctatgcccccaaggtgggcttggggccgcgctag

SEQ ID NO: 4316 - protein, 426 aa, Synechococcus elongatus [sequence omitted]

SEQ ID NO: 4317 - DNA, 1290 bp, Thermoanaerobacter tengcongensis
  CDS (1)..(1290)
atgtcatcaattattgatatttatgcgagggaaatattagattctcgtggcaatcctacgattgaggtagaagttgaattagacagtggtgcagtgggaagagctgctgtaccgtctggggcttctactggggcttttgaagcaattgagttaagagatggagataagtcaagatacttaggaaaaggcgtattgaaagcagtacagaatgtaaatgacattattgcgccagaattaattggtatggaagcacaggaccaggtagcaattgataaagctatgattgaactggatggaacgcccaataaaagcaagttaggagcaaatgctattttaggtgtgtctttggcagttgcaaaagcggcagcagaagagctgggtcttcctctgtaccagtatttagggggcgtaaatgctaagacacttcctgttccaatgatgaacatactaaatggcggaaagcatgctgacaacaatgtagatatacaagagtttatgattatgcctgtaggagctcccaattttaaagaggctttaaggatgtgttcagaagtttatcacagcctgaaaaatgtgcttcactccaagggattgagcactacagttggcgatgagggaggttttgcgcctaaccttacatcgaatgaagaggcaattaaagtaatacttgaggctatagaaaaagccggatatgtacctggggaagacatagttttagcgttggaccctgcggccactgaaatgtacaaagaagatgggaaataccattttgaaggagagggaattgtgagaacttctgaggaaatgatagagttctgggagcagctcgtcagcaaataccccattgtttctatagaagatggacttgcagaggaagactggaacggatggaaactcttaactgaaagattgggcaaaaaggtgcagctagtaggagacgacctatttgtgacgaatacggaaaggctctcaaaaggcattaacatgggagttgcaaattcaatactcataaagctcaatcagataggtactctgacagagacattggatgccattgaaatggctaaaagggcaggctacactgctatcgtatctcacaggtcaggagagacggaagatacaactattgctgatttagtagtagctacaaatgtaggtcagatcaaaacaggtgctccagcaaggaccgatagagttgcaaaatataaccaattattaagaatagaagaagcattgggaagcgtggcccagtatcctggaaaaaatgctttctacaacatcagaaaataa

SEQ ID NO: 4318 - protein, 429 aa, Thermoanaerobacter tengcongensis [sequence omitted]

SEQ ID NO: 4319 - DNA, 1302 bp, Vibrio parahaemolyticus
  CDS (1)..(1302)
atgtctaagatcgttaaagttctaggtcgtgaaatcatcgactcacgtggtaacccaactgtagaagctgaagtacacctagaaggcggtttcgtaggtatggcggcagctccatctggcgcatctactggttctcgcgaagctcttgagctacgtgacggtgacaaagcacgtttcctaggtaaaggtgttcttaaagcaattgaagctgtaaacggcccaatcgctgaagctctagttggcaaagacgctaaagaccaagctgcaatcgacgcagtaatgatcgaactagacggcactgaaaacaaatctaaattcggtgcgaacgctatcctagcagtttctctagcaaacgctaaagctgcagcagcagctaaaggcatgcctctatacgagcacatcgctgagctaaacggtactgctggtcagttctctatgcctctaccaatgatgaacatcatcaacggtggtgagcacgcagacaacaacgttgacatccaagaattcatgattcaaccagttggcgctgcaactcttaaagaagctgtacgcatgggtgcggaagtattccacaacctagctaaagttcttaagtctaaaggctacaacacagctgttggtgacgaaggtggtttcgctcctaaccttaaatctaacgctgaagctctagaagttatcgcagaagctgttgctgctgctggttacgagctaggcaaagacgttactctagctatggactgtgctgcatctgagttcttcgacaaagaagctggcatctacaacatgaaaggtgaaggcaaaactttcacttctgaagagttcaaccactacctagctggtctagttgagcaattcccaatcgtatctatcgaagacggtctagacgagtctgactgggatggtttcgcacaccaaactcaacttctaggcgacaagatccaactagttggtgacgatctattcgttacaaacactaagatcctagctgaaggtatcgagaaaggcatcgctaactctatcctaatcaagttcaaccaaatcggttctctaactgagactctagctgcaatcaagatggctaaagacgcaggttacacagcagtaatctctcaccgttctggcgaaactgaagatgcaactatcgctgacctagcggtaggtacagctgcaggtcaaatcaaaactggttctatgagccgttctgaccgtgttgctaagtacaaccaactaatccgtatcgaggaagctctaggtgagcgcgctcctttcaacggtcttaaagaagttaaaggccaagcttaa

SEQ ID NO: 4320 - protein, 433 aa, Vibrio parahaemolyticus
MSKIVKVLGREIIDSRGNPTVEAEVHLEGGFVGMAAAPSGASTGSREALELRDGDKARFLGKGVLKAIEAVNGPIAEALVGKDAKDQAAIDAVMIELDGTENKSKFGANAILAVSLANAKAAAAAKGMPLYEHIAELNGTAGQFSMPLPMMNIINGGEHADNNVDIQEFMIQPVGAATLKEAVRMGAEVFHNLAKVLKSKGYNTAVGDEGGFAPNLKSNAEALEVIAEAVAAAGYELGKDVTLAMDCAASEFFDKEAGIYNMKGEGKTFTSEEFNHYLAGLVEQFPIVSIEDGLDESDWDGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 4321 - DNA, 1302 bp, Vibrio vulnificus
  CDS (1)..(1302)
atgtctaagatcgttaaagttctaggtcgtgaaatcatcgactcacgtggtaacccaactgttgaagctgaagtacacctagaaggcggtttcgtaggtatggcggcagctccatctggcgcatctactggttctcgcgaagcgcttgagctacgtgacggtgacaaagcacgtttcctaggtaaaggtgttcttaaagcgattgaagcggtaaacggtgcaatcgctgacgcgctagttggtaaagatgcgaaagatcaagcagcgatcgacgctatcatgatcgagctagacggcactgaaaacaaatctaagtttggtgcgaacgcaatcctagctgtttctctagctaacgctaaagcagcggctgcttctaaaggcatgcctctatacgagcacatcgctgagctaaacggtactgctggtcagttctctatgcctctaccaatgatgaacatcatcaacggtggtgagcacgctgacaacaacgttgacatccaagagttcatgatccaaccagttggcgcaaaaactctgaaagaagcagttcgcatgggtgcggaagtattccacaacctagctaaagttcttaagtctaaaggctacaacactgctgttggtgacgaaggtggtttcgctcctaaccttaagtctaacgctgaagcgctagaagttatcgcagaagcagttgcagcagcgggttacgtactaggtaaagacgttactcttgctatggactgtgcagcatctgagttcttcgacaaagaagctggcatctacaacatgaaaggtgaaggcaaaacgttcacttctgaagagttcaaccactacctagctggtctagttgagcaattcccaatcgtatctatcgaagatggtctagacgagtctgattgggctggtttcgcacaccaaactcaacttctaggcgacaagatccaactagttggtgacgatctattcgttacaaacactaagatcctagctgaaggtatcgagaaaggcattgctaactctatccttatcaagttcaaccaaatcggttctctaactgagactctagctgcaatcaagatggctaaagacgcaggttacacagcagtaatctctcaccgttctggcgaaactgaagatgcaactatcgctgacctagcggtaggtactgcagcaggtcaaatcaagactggttctatgagccgttctgaccgtgttgctaagtacaaccaactaatccgtatcgaggaagctctagctggtcgtgctcctttcaacggtcttaaagaagtgaaaggccaagcttaa

SEQ ID NO: 4322 - protein, 433 aa, Vibrio vulnificus
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALAGRAPFNGLKEVKGQA

SEQ ID NO: 4323 - DNA, 1332 bp, Wigglesworthia glossinidia brevipalpis
  CDS (1)..(1332)
atgtcaaaaataataaaagtaattggtagagagataattgattctagagggtatcctactgtagaagcagaagtccatttattaggaggaattattggaagagcatcatctccttctggaatatctattggatctagagaagctcatgaagttcgtgatagagataattcaagatttttaggagaaggagttacaaaagcagtaaaatctataaataacaaaatatctaaatctttaatatcaaaaaatgcacaaaaacaaaaagatatagatcaaattatgatcaacttagatggaactaaaaataaatctaatttaggagcgaatgctattttagctgtatccttagctaacgctaaggctgcgtctaaaataaaaaatattccattatataaacacatatcagaaataaataacactcctggaattttttccatgcctcttcctatgattaatataattaatggcggaaaacatactaataataatattgatattcaagaattcatgatacaaccaattggagcaaaaagcataaagcaagctattcaaatgggatctgagatatttcataacttaggtaaaattttaaatgaaaaaggaatgagtacttcaataggggatgaaggtggatattctccaaatttaaaatcaaattcaaatgcttttgttttaattaaagaagcagtaaaaagatcaaaataccatataggaagagacataacttttgctattgactgcgcagcatctgaattttttgaagaatctactcagtcttattatttaaaaagtgaaaataattttttttcatcttatgaatttgtactttttttaaaaaaacttacagaagaatatccaattctttcaatagaagatggattgcacgaaaatgattgggaaggtttttctatgctgactaattatttaggaaataagatccaattagttggagatgatttatttacaactaatcctaaatttctaaaatatgggataaaaaaaggtattgctaattctattttaattaaaccaaaccaaattggttctcttacagaaactttagaagtaattaaaattgcaaaaaaatatggatatgctacaattatttctcatagatcaggagaaaccgaagatgttacaatagctgatttatcagtaggaacttcatctggtcaaataaaaactggatcaatgagtagatctgatagaacagctaaatataatagattaataagaatagaagaagaacttggatcaaacgctatatttcatggaaaaatggaaataaagaaccaatttatttatagtaataataatttaaaaaatttttag

SEQ ID NO: 4324 - protein, 443 aa, Wigglesworthia glossinidia brevipalpis [sequence omitted]

SEQ ID NO: 4325 - DNA, 1293 bp, Xanthomonas campestris
  CDS (1)..(1293)
atgaccactatcgccaagattctcgcccgtgaaatcctcgactcccgcggcaatcccacgctggaggcggaagtcacgctggcagacggctcgttcggccgcgccgccgtgccctcgggcgcctcgaccggcaccaaggaagcggtggaactgcgcgacggcgacaagacccgttacctgggcaagggcgtgcgcaaggccgtggaaaacgtcaacggcaccatcgccgagacgctcaaggacttcgatgccgccgaccagcagggcctggaccgtcgcctgatcgacctcgacggcaccgagaacaagggccgcctgggcgccaacgcgctgctgggtgtgtcgctggctgccgcgcatgcggtcgccgcctcgcgcaagcagccgctgtggcagtacctgtcgaccatcaccgaatccgatgtcgccctgccggtgccgatgatgaacatcatcaacggcggcgcgcatgccgacaacaatgtcgacttccaggaattcatggtgctgccggtgggctgcagctcgttttccgaagcgctgcgcgcaggcaccgagatcttccattcgctgaagtcggtgctcaagggccacggcctcagcacggcggtgggtgacgagggcggcttcgccccggacttccgcagcaatgtcgaagcgctggacaccattctcgaagcgattggcaaggccggttacaccgctggcgaagacatcctgctgggcctggatgtggcctcgtcggagttctacgacaacggcaagtacaacctggtgggcgaaaacaagcgcctgaccagcgagcagttcgtcgacttcttggccgattgggtggcgcagtacccgatcatcagcatcgaagacggcctggccgaagacgactgggccggctggaagctgctgaccgatcgcgtcggcaagaaggtgcagctggtgggcgacgatctgttcgtcaccaacccgaagatattcaaggaaggcatcgacagcggcaccgccaacgcgatcctgatcaaggtcaaccagatcggcacgctgactgagacgctggaagccattgccatggcgcatgcggccaactacgcctcgatcgtgtcgcaccgttcgggcgagaccgaagacaccaccatcgccgatatcgccgtggccaccaccgccacccagatcaagactggctcgctgtgccgcagcgaccgcgtcgccaagtacaaccagttgctgcgcatcgagcaggcactggggtccggcgcgcgttacgccggccgcgacgcgttcgtttcgctcaagcgataa

SEQ ID NO: 4326 - protein, 430 aa, Xanthomonas campestris
MTTIAKILAREILDSRGNPTLEAEVTLADGSFGRAAVPSGASTGTKEAVELRDGDKTRYLGKGVRKAVENVNGTIAETLKDFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTDRVGKKVQLVGDDLFVTNPKIFKEGIDSGTANAILIKVNQIGTLTETLEAIAMAHAANYASIVSHRSGETEDTTIADIAVATTATQIKTGSLCRSDRVAKYNQLLRIEQALGSGARYAGRDAFVSLKR

SEQ ID NO: 4327 - DNA, 1293 bp, Xylella fastidiosa
  CDS (1)..(1293)
atgaccgttattgccaaaatttatgctcgtgagattcttgattcccgtggcaaccctactcttgaagcggaggtcactctggagaatgctgtctgtggccgtgccgcagtcccctcaggtgcttcgactggtaccaaggaagcggtggaattacgtgatggtgacaagacacgttacttaggcaagggggtgcgtgcagcggtggataacgtcaatggtgttattgctgcggcgttggtgggtttcgatggagctgaccaaacaggcttggaccatcgtttaatcaatctggacggcaccgagaataaggggcgtttgggcgctaacgcgctgctcggtgtttcgttagcaaccgcacatgcggttgccgccgcgcgtaaacagccgctatggatgtatttgtccacccttggtgaatccaagttatcgttgccggtgccaatgatgaacatcatcaatggtggtgcgcatgcggataacaacgttgatttccaggagtttatggtgttgcccgttggttttgcttcgttttccgaagcactgcgtgccggtaccgagatctttcatgcgctaaagtcagtgctgaagggacagggtttaagtactgcggtgggtgatgaagggggctttgctccggacttccgcagtaatgttgaggcactggatgccattcttgaggcaataggtagggctggttatatcgctggagaggatgtgttgttaggtttggatgttgcttcttccgagtttcgcaacaacggtaagtacaacttggttggtgagaacaagcgtctgaccagtgagcagtttgttgatttcttggatgatttggttgcgcagtacccaatcatcagtattgaggatggtttagccgaggatgattgggtgggttggaagcaattgactgaacgtatcggccataaagtacagttggtgggcgatgatctgtttgtgactaatcctaaggttttccaggaaggcatcacttctggcatcgcgaatgcgatccttataaaacttaaccaaatcggtacgttgacggagactctggaatcaattgcgatggctcaccgtgctcagtacgctgctatcgtctcgcatcgatcaggcgagactgaggatacatcaattgcggacattgcggtggcgactacggcaactcaaatcaagactggctcgttatgccgttctgatcgtgttgccaagtacaaccagttgttacgcattgagcaggcgcttggtgttggtgcgcgttatgctggtcgtgatgcgttcgtttccctgaagtcctga

SEQ ID NO: 4328 - protein, 430 aa, Xylella fastidiosa
MTVIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRNNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 4329 - DNA, 1734 bp, Brachydanio rerio
  CDS (98)..(1399)
cgcaactgcagacgcaggttgtaactgttagtttgaacttagtttcaactcatcctgtcgttaatttatatcgtttcactaagatttttaaagaaagatgtctattctgaagatacacgctcgtgagatttttgattctaggggcaaccccactgtggaggtggacctctacacagaaagaggtttgtttcgagctgctgtccccagtggagcttctactgggatctatgaagcgctggagctcagagacaatgataagtcccgctacctgggcaaaggtgtatcaaaggctgttgagaatgtgaaccaacatattgcacctgctctcattggccagggaattcctgttgttgagcaagaaaagattgaccagttcatgctggaactggacggaactgagaataagtcccgatttggtgccaatgccatcctgggtgtgtccctggcggcgtgtaaggcaggagctgcggagaaaggtgttcctctgtaccgtcacattgctgaccttgctggaaacccagaggtcattctgcctgtgccggcctttaatgtgatcaatggcggctctcatgctggcaataaattggccatgcaggagttcatgattctgccggtcggggccagcagctttaaggaagccatgcgcattggtgcagaggtgtatcacaatctgaagaacgttattaagcagaaatatggccaggatgccaccaatgttggtgacgagggaggatttgcaccaaacattcttgagaacaaagaagctctagagctgctgaagaatgccatcagtaaagctggatacactgatgaagttgtgatagggatggatgtggcagcatctgaattctatcgtgacggacagtacgacttggactttaagtctcccgatgaccccgatcgatacatcagccccgatgagcttgctgacctttacaagagtttcatagaggattatccagtggtctctattgaggatccctttgatcaagatgactgggaggcctggaccaatttcaccaacagcacagaaatccaggtggtgggagatgatctcactgttaccaatcccaagcgcatagctactgcagtggagaacgaggcttgcaactgcctgttgctcaaagttaaccagattggtactgtgacagagtctctgcaggcatgtaacatggctcagtccagtggctggggagtgatggtgagccatcgctcaggggaaactgaggacacattcattgcagaccttgttgtgggactgtgcactggacagattaaaacaggagccccatgccgttcagagcgtctggccaagtacaaccagatcctcagaattgaagaggaactgggggagaaagctcgctttgctgggaagaacttcagaaatccactgaactgagaccaccacagtacagttagaagtatttaacctcatccagtaaatatactaatagtatatgttttaacttatgattaaagaataggttgatgctgagaccatatcatcaaggacactaaaacaagaatcataatcgttatgtgggtgaccatttggatgagtgtcacgtgtacttgtgtcatgatgattatattgcaaagaaagtgcaaacagtgttttcctgtaaatgctgcgtagcagatttttgaggactgtgcttgtaatagtggatactgttaaaataaaaacatcacctcaactaaaaaaaaaaaaaaaaaaaaaaaaaaaaaaaaaaa

SEQ ID NO: 4330 - protein, 433 aa, Brachydanio rerio
MSILKIHAREIFDSRGNPTVEVDLYTERGLFRAAVPSGASTGIYEALELRDNDKSRYLGKGVSKAVENVNQHIAPALIGQGIPVVEQEKIDQFMLELDGTENKSRFGANAILGVSLAACKAGAAEKGVPLYRHIADLAGNPEVILPVPAFNVINGGSHAGNKLAMQEFMILPVGASSFKEAMRIGAEVYHNLKNVIKQKYGQDATNVGDEGGFAPNILENKEALELLKNAISKAGYTDEVVIGMDVAASEFYRDGQYDLDFKSPDDPDRYISPDELADLYKSFIEDYPVVSIEDPFDQDDWEAWTNFTNSTEIQVVGDDLTVTNPKRIATAVENEACNCLLLKVNQIGTVTESLQACNMAQSSGWGVMVSHRSGETEDTFIADLVVGLCTGQIKTGAPCRSERLAKYNQILRIEEELGEKARFAGKNFRNPLN

SEQ ID NO: 4331 - DNA, 1792 bp, Brachydanio rerio
  CDS (74)..(1372)
gccttctctgctctgcaccacggtccacactcgactgcccttgcgctggttaggccagataagaaactgcaacatgtctatcctgaagatccatgctcgtgaaatctttgactcccgtggaaaccccactgtggaggttgatctgtacaccaaaaaaggtctcttcagagctgcagtgcccagtggtgcctccactggtatctatgaagcccttgaacttcgtgacaatgacaagacacgctatctgggcaaaggtgtctcaaaagcagttgagcatatcaataaaacaattgcacctggtctggttagccagaacgtgtcagtcttggaacaggagaagattgataagctgatgctcgatatggatggcacagacaacaagtcaaagtttggtgctaatgccatcctgggcgtttccctggctgtgtgcaaggctggtgctgcagagaagggcgtccccctttaccgccacatcgcagacctcgctggcaaccctgaagtcattctcccagtgcctgccttcaacgttatcaacggcggctctcatgccggcaacaagctggccatgcaggagttcatgatcctgcccgtcggtgccagcaactttaaagaggccatgcgcatcggtgctgaagtctatcacaacctgaagaatgtcatcaaggagaagtacggcaaagatgccaccaatgtgggcgatgaaggcggtttcgcccccaacatccttgagaacaaagaagctctggagctgctgaagaatgccatcagcaaagccggctacaccgacaagattgtgatcggcatggatgtggccgcctctgagttctacaagggtggcaaatacgacctggacttcaaatcacctgatgaccccagccgttacatcagccctgacaagctggctgacctctacaagagctttgtcaaggattatcctgtggtctccatcgaggatccatttgaccaggatgactgggaggcctggaccaacttcaccgccaccactaacatccaggtggtgggtgatgacctcacagtgaccaaccccaagcgcatcgctaaagccgtgtctgataaggcctgcaactgcctgctgttaaaggtcaaccagatcggctcggtcaccgagtccctgcaggcctgtaagatggcccagactaatggatggggtgtgatggtcagtcaccgttctggagagacggaggacaccttcatcgctgaccttgtagtcggactctgcactggccagattaagactggagctccctgccgatctgagcgtctggccaagtacaatcagctgctgaggattgaggaggagctaggagacaaggctcgcttcgctggcaagaacttcaggaaacccatctgaagcactgacccgtcctgagtctcggcgtgttcatcctgctttactgtcccacacataaacgccacgcaaagccacatcctgtagaatggagattagatggaaaagcagtgaaacgaaaggtccagatcaatagcgtatggcgcagaacactgccagatctccatctgtgctttggtatccaaatagcatcagtcccttaatcgtgtctctgtgttgtgtgagagatctttgtttagtttcttgtgatttgtagtgattctggtgctccactcaatattttagcagagatcaagccatttaatgtgctgcgacgtgcagcgtcagtatgtgcgttgtgttgcttttgagaagtgttagttctatatgcgtggcataacaaataaattatacctattgaaatggaaaaaaaaaaaaaaaaaa

SEQ ID NO: 4332 - protein, 432 aa, Brachydanio rerio
MSILKIHAREIFDSRGNPTVEVDLYTKKGLFRAAVPSGASTGIYEALELRDNDKTRYLGKGVSKAVEHINKTIAPGLVSQNVSVLEQEKIDKLMLDMDGTDNKSKFGANAILGVSLAVCKAGAAEKGVPLYRHIADLAGNPEVILPVPAFNVINGGSHAGNKLAMQEFMILPVGASNFKEAMRIGAEVYHNLKNVIKEKYGKDATNVGDEGGFAPNILENKEALELLKNAISKAGYTDKIVIGMDVAASEFYKGGKYDLDFKSPDDPSRYISPDKLADLYKSFVKDYPVVSIEDPFDQDDWEAWTNFTATTNIQVVGDDLTVTNPKRIAKAVSDKACNCLLLKVNQIGSVTESLQACKMAQTNGWGVMVSHRSGETEDTFIADLVVGLCTGQIKTGAPCRSERLAKYNQLLRIEEELGDKARFAGKNFRKPI

SEQ ID NO: 4333 - DNA, 1761 bp, Xenopus tropicalis
  CDS (38)..(1342)
ggaagagaacggttgtacctacaagtagaaagtaaaaatgtctatcaagaagatccttgcacgtgaaatttttgactctcgtggtaacccaacagtggaggttgacctgtacacatgcaaaggtctcttccgtgctgctgttccaagcggagcctccactggcatttatgaagcactagaactccgggacaatgataagactcgctacatgggaaagggtgtcggaagagctgtcaaatatataaatgagtttctgggacctgcattatgcacccagaatctaagtgttgtggagcaggaaaagatcgacaacctcatgattgaaatggatgggactgagaataaatccaaatttggtgctaatgcactcttgggagtgtccctagcagtgtgtaaagctggagctgcagagaaaggagtcccactgtaccgtcatatcgctgacctggctgggaacccagaggtcatccttcctgtaccggcatttaatgtgataaacgggggttctcatgctggaaacaagctggctatgcaagaattcatgatcttgcctgtgggtgcagacacctttaaggaggccatgcgcataggagcagaggtgtatcataacctaaagaatgtcatcaaggctaaatatggacaagatgccactaatgttggtgatgaaggaggctttgctcccaatatcttggagaataaggaagccctggagcttctgaaaactgccatcaacaaggctggctacccagataaagttgtaattggaatggatgttgcagcatctgaattctaccgtgacgggaaatatgacttggacttcaagtcccctgatgaccctaaaagacacatctcccctgacgagctggctgagttgtacatgagctttgtcaagaattatccagtggtgtccattgaagatccctttgatcaggatgactgggaagcctggaaaaagtttactgcatcttcgaatatccaggtagttggtgatgacttgacagtgaccaaccctaaacgtattgccaaggctgtggatgagaagtcttgtaactgtctgcttctgaaggtcaaccagatcggcacagtgacagaatccctgcaggcgtgcaagctggctcagtcaaatggctggggtgtgatggtcagtcatcgctctggggagacagaagatactttcattgctgacctggtggttggtctccgcactggacagatcaagacaggtgctccatgcagatctgagcgacttgcaaaatacaaccaattgctcaggattgaagaagagcttggcagcaaggcccgctttgctggaagaaatttcagaaaacctgttttcaactaaatggaggcatccttaggctctcacccaactgatgtagtagctgtgcacctaggagagactacaggaggtcttacatgtcactgctgagccctcatttaatttcaggcacttccagcaatgttagatgttacagcctctcccagcataaccttgctgtctttccagtttaaaagctttgctgcttaggattattccaaattcagtgtcacactggtgcctgcatgtagtccttgtcttttctattgtggcagtggtcctggtcatgtcaactttgtagtcttgtgttctcatcctattgcagtttcagactagataatggtttgtcacactctagacacgaagaggcaataaactcttttgaaggtgaaaaaaaaaaaaaaaaaaaaaaaaaaaaaaaaaaaaaaaaaaaaaaaaaaaaa

SEQ ID NO: 4334 - protein, 434 aa, Xenopus tropicalis
MSIKKILAREIFDSRGNPTVEVDLYTCKGLFRAAVPSGASTGIYEALELRDNDKTRYMGKGVGRAVKYINEFLGPALCTQNLSVVEQEKIDNLMIEMDGTENKSKFGANALLGVSLAVCKAGAAEKGVPLYRHIADLAGNPEVILPVPAFNVINGGSHAGNKLAMQEFMILPVGADTFKEAMRIGAEVYHNLKNVIKAKYGQDATNVGDEGGFAPNILENKEALELLKTAINKAGYPDKVVIGMDVAASEFYRDGKYDLDFKSPDDPKRHISPDELAELYMSFVKNYPVVSIEDPFDQDDWEAWKKFTASSNIQVVGDDLTVTNPKRIAKAVDEKSCNCLLLKVNQIGTVTESLQACKLAQSNGWGVMVSHRSGETEDTFIADLVVGLRTGQIKTGAPCRSERLAKYNQLLRIEEELGSKARFAGRNFRKPVFN

SEQ ID NO: 4335 - DNA, 26 bp, artificial sequence
  primer
atgtccaaaatcgtaaaaatcatcgg

SEQ ID NO: 4336 - DNA, 24 bp, artificial sequence
  primer
ttatgcctggcctttgatctcttt

SEQ ID NO: 4337 - DNA, 1419 bp, Escherichia coli K12
  CDS (1)..(1419)
atgagtcagaatgtttatcaatttatcgacctgcagcgcgttgatccgccaaagaaaccgctgaagatccgcaaaattgagtttgttgaaatttacgagccgttttccgaaggccaggccaaagcgcaggctgaccgctgcctgtcgtgcggcaacccatactgcgagtggaaatgcccggtacacaactacatcccgaactggctgaagctcgccaacgaggggcgtatttttgaagcggcggaactgtcgcaccagaccaacaccctgccggaagtttgcggacgagtctgcccgcaagaccgtctgtgcgaaggttcctgcactctgaacgatgagtttggcgcggtgaccatcggcaacattgagcgctatatcaacgataaagcgttcgagatgggctggcgtccggatatgtctggtgtgaaacagaccggtaaaaaagtggcgattatcggcgcaggcccggcaggtctggcgtgtgcggatgtcctgacgcgtaacggcgtaaaagccgttgtcttcgaccgtcatccagaaattggcgggctgctgaccttcggtattccggccttcaagctggaaaaagaggtaatgacgcgtcgccgtgaaatcttcaccggcatgggtattgaattcaaactcaataccgaagtgggccgcgacgtacagctggacgatctgctgagtgattacgatgccgtgttccttggcgtcgggacttatcagtcaatgcgcggcgggctggaaaacgaagacgccgatggcgtgtacgcagcgctgccgttcctcatcgccaacaccaaacagttaatgggctttggtgaaacccgcgacgaaccgttcgtcagcatggaaggcaaacgcgtggtggtccttggcggtggcgacactgcgatggactgcgtgcgtacgtccgtgcgccagggagcgaagcacgttacctgtgcctatcgtcgtgatgaagagaacatgccgggttcccgccgcgaagtgaaaaacgcgcgggaagaaggcgtagagttcaaattcaacgtccagccgctgggtattgaagtgaacggtaacggcaaagtcagcggcgtaaaaatggtgcgtaccgaaatgggcgaaccggacgccaaaggccgtcgccgcgcggagatcgttgcaggttccgaacatatcgttccggcagatgcggtgatcatggcgtttggtttccgtccacacaacatggaatggctggcaaaacacagcgtcgagctggattcacaaggccgcatcatcgccccggaaggcagcgacaacgccttccagaccagcaacccgaaaatctttgctggcggcgatatcgtccgtggttccgatctggtggtgaccgctattgccgaaggtcgtaaggcggcagacggtattatgaactggctggaagtttaa

SEQ ID NO: 4338 - protein, 472 aa, Escherichia coli K12
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETRDEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHNMEWLAKHSVELDSQGRIIAPEGSDNAFQTSNPKIFAGGDIVRGSDLVVTAIAEGRKAADGIMNWLEV

SEQ ID NO: 4339 - DNA, 3951 bp, Homo sapiens (man)
  CDS (82)..(3159)
gctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctatgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgccttcgactgtgcaacatctgctctacgttgtggagctcgccgagtgttcatcgtcttcagaaaaggctttgttaatataagagctgtccctgaggagatggagcttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgacttcccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaagctgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatctcttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggcataaaatagaataattcttttctgaggatagtagttaaataactgtgtggcagttaattggatgttcactgccagttgtcttatgtgaaaaattaactttttgtgtggcaattagtgtgacagtttccaaattgccctatgctgtgctccatatttgatttctaattgtaagtgaaattaagcattttgaaacaaagtactctttaacatacaagaaaatgtatccaaggaaacattttatcaataaaaattacctttaattttaatgctgtttctaagaaaatgtagttagctccataaagtacaaatgaagaaagtcaaaaattatttgctatggcaggataagaaagcctaaaattgagtttgtggactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaaccaaatgagatgataggatagatcctggttaccactcttttactgtgcacatatgggccccggaattc

SEQ ID NO: 4340 - protein, 1025 aa, Homo sapiens (man)
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPEEMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRSCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 4341 - DNA, 1239 bp, Escherichia coli
  CDS (1)..(1239)
atgccgcaacaaaattatctggatgaactcactccggcttttacgtctttactggcgattaaagaagcctctcgctgtttattatgtcacgacgctccctgtagtcaggcttgcccggcacagaccgatccggggaaatttattcgctcaatctactttcgtaattttaaaggcgctgccgagacaattcgcgaaaataatgccctcggtgccgtttgtgccagagtgtgcccgacggagaaattatgccaaagcggttgtacccgtgccggtgttgatgctcccattgatatcggccgcttacagcgttttgttactgattttgaacaacaaaccggaatggaaatttatcagcccggtactaaaacgctcggcaaagtcgcgattattggcgcaggtcctgccggattgcaggccagtgtgacactgacaaaccagggttatgacgtcacgatttatgagaaagaagcgcaccccggtggctggttgcgtaacggtattccgcaattccggttaccgcaatcagtgctggatgcagagatcgcccgtattgaaaaaatgggcgtgaccattaagtgcaacaacgaagtcggtaacacactcacccttgagcagctgaaagcagaaaaccgcgcggtactggtcaccgtggggttatcaagcggttccgggctaccgctgtttgagcatagtgacgttgagattgccgtcgacttcttgcaacgtgcacgacaggcgcaaggcgatatcagcattccacaaagcgcattaattatcggcggcggtgatgtcgcgatggacgtagccagcacgctgaaagttctcggctgtcaggcggtaacttgcgtagcgcgtgaagagttagatgagtttccggcaagcgaaaaagagtttaccagcgcccgggagctgggcgtttcgatcatcgatggattcacgccagtagccgtggaaggcaataaagtcacgtttaagcatgtacggttatcgggcgaactgacgatggcggcagataaaattattctcgccgtcggtcagcatgccagactagatgcctttgcggagttagagccgcagcgtaacaccatcaaaacacaaaattaccagacccgcgacccgcaagtctttgctgctggcgatattgttgagggtgacaaaaccgtggtctatgccgtgaaaaccgggaaagaagccgccgaggcgattcatcactatttagagggagcttgctcatgttaa

SEQ ID NO: 4342 - protein, 412 aa, Escherichia coli
MPQQNYLDELTPAFTSLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEVGNTLTLEQLKAENRAVLVTVGLSSGSGLPLFEHSDVEIAVDFLQRARQAQGDISIPQSALIIGGGDVAMDVASTLKVLGCQAVTCVAREELDEFPASEKEFTSARELGVSIIDGFTPVAVEGNKVTFKHVRLSGELTMAADKIILAVGQHARLDAFAELEPQRNTIKTQNYQTRDPQVFAAGDIVEGDKTVVYAVKTGKEAAEAIHHYLEGACSC

SEQ ID NO: 4343 - DNA, 1431 bp, Aquifex aeolicus
  CDS (1)..(1431)
atggcaaagaagattcgctaccttgacaggaataaagaacccactctcccgccagaagaaagggtaaaaaccttcagggagtttgaactcggatactccgtaaatttagcccttgacgaggcacagcgctgtttattttgtaaagacgccgaacagaggtgcataaagggctgtcccgttcacgtggacattcccggctttataaagaaaataacggaaggtgatttggtgggtgcgtacaaagtaataactcaatccgatatatttccctcaatatgcgggagagtttgccctcaggaaaggcagtgtgaaggttcatgcatcctttactacgacacggtcaggaatagaaagaacaaaggtcttccggttgcaatcggagcacttgagaagttcgtaggagactttataaggatatctggaatagaaatagaagaagaaaaggaaccccctacgggatttagggttgcggtaataggggcgggaccagcggggctttcctgtgcccatgagcttgcaaaaaaaggacacgaagtgcacgtttacgaagctctcccgaagcccggcggtgttatgtactacggaattcccaacgccagactggacaagagcataatagagtgggaagtcaagagacttgaaaaactcgggataaagtttttttacggatacttaataggaaagaacataacccttcaggaattgagggagaaatacgacgctgtattcatagcggttggtgcgggacgaggaaaactcggacttccgggggaccacctgaaaggggtttattccgcgatagactttttgatgagggtaaacctctacaaggcaaacgagtttcctaaaaagggagttcccgtagaactcgggaagagaaccgtaataataggcggtggatttactgcggtagactgtgccataactgcaaacagactgggagttgagacccacgtagtttacaggagaaccagagaaacctcttccgcaagacaggaagagtgggatcaccttatggaagaaggagtgaagatacactggctaacccagcccgtggaagttatagggaacgaaaaaggagaagttgtagggctcaagtgtataaagatggaactgggtgagcccgacgagagcggaagaccgagacccgttccagtacctaattccgaacacattattgagtgcgactcggttatcttcgcgatagggcagagggcaaacccaatagcctacgaaggaagcggaataaaaacgacgaagtgggggacgattgaggtgaacgaaaggtacgagaccaatttagagggagtatttgcgggaggagacgttataaacggcggtgacagggtagtagttgcccttgctcatggaaaagaagctgcaaagtacatacacgaatacttaatgagtaacaaggaggtaaggaaatga

SEQ ID NO: 4344 - protein, 476 aa, Aquifex aeolicus
MAKKIRYLDRNKEPTLPPEERVKTFREFELGYSVNLALDEAQRCLFCKDAEQRCIKGCPVHVDIPGFIKKITEGDLVGAYKVITQSDIFPSICGRVCPQERQCEGSCILYYDTVRNRKNKGLPVAIGALEKFVGDFIRISGIEIEEEKEPPTGFRVAVIGAGPAGLSCAHELAKKGHEVHVYEALPKPGGVMYYGIPNARLDKSIIEWEVKRLEKLGIKFFYGYLIGKNITLQELREKYDAVFIAVGAGRGKLGLPGDHLKGVYSAIDFLMRVNLYKANEFPKKGVPVELGKRTVIIGGGFTAVDCAITANRLGVETHVVYRRTRETSSARQEEWDHLMEEGVKIHWLTQPVEVIGNEKGEVVGLKCIKMELGEPDESGRPRPVPVPNSEHIIECDSVIFAIGQRANPIAYEGSGIKTTKWGTIEVNERYETNLEGVFAGGDVINGGDRVVVALAHGKEAAKYIHEYLMSNKEVRK

SEQ ID NO: 4345 - DNA, 1488 bp, Bacillus halodurans
  CDS (1)..(1488)
atggggaaaccaacaggatttatggaatataagcgggaaacacctccaaagaaagacccctttgaacgctcaaaaaactggcaagagtttacccttcttatgccggagagtgcattgagacaacaaggggcacgatgtatggattgtggtgttccattttgtcaaacagggacgtcaatggatggttctggggagattggttgccccgtctataacttgattccagaatggaatgacctcgtgtatcgcggtcactggaaggaagcgttagaacgtctacacaaaacgaataactttccagaatttacaggacgagtttgtcctgctccgtgtgaaggctcgtgtacggttgcgatcagcgacgacgctgttgcaataaagagcatggaattccatattgtagaacgtggattccaggaaggttggattgtgcctaaccctcctagatcgagaacaggcaaaaaagtagctgtcgtcggtagcggtcctgcaggcttagcagcagcggctcaattgaacaaagccggtcattgggtaacggtttttgaacgagaagatcgcatcggcgggctgttgacgtatggaattcctgatgtaaagcttccgtatcacgtagtggaacgtcgaatcaaccttttaaaagaagaagggattgaattccgcaccaatgttgaaattggaaaagatgtttcagcaaagcagttaaaagacgactttgacgcggtcgttttatgtacaggtgcgacaaagccacgtgatgtaaatgttaagggcagagagctcaaaggtattcacttcgccatggacttcttaacagcaaatacgaaaagcctattaaactcgaaccatcaagatggtaactatatttccgcaaaagggaagcatgtcgttgtgatcggtggtggagatacgggggctgattgtattacaacctctgtccgtcatggggcaaaatcgattacgcaatttgatattaatcgtgaaaaatcaaacgaacggcctgacaataacccatggcctttgttcccaatcgtccatacggtagaggacggccataaagaagcggcggctgtttatggaaaggacccgagagcttatcaagtcatgacgacaaaatttgtcggtgatgctgaaggtcatgtgaaggaaattcatacgatttctgtggaaacaaccgtgcatcctgatggaagcaaaacccgtgttgaaattccaggcaccgagaaagtttggccagctgaccttgtgtttctagctgtaggatttacggggccagaagaacagcttgttcgtgaactagagttggaaactgatacacgttcgaacattaaagctgagtatggtaaatatgagacgagcttagaaggtgtttttgctgccggtgataatcgccgtggacagagccttgttgtttgggcgatccacgaaggtcgtgaagcggcacgagaatgtgataaatatttgatgggagcctcgaatttaccgtaa

SEQ ID NO: 4346 - protein, 495 aa, Bacillus halodurans
MGKPTGFMEYKRETPPKKDPFERSKNWQEFTLLMPESALRQQGARCMDCGVPFCQTGTSMDGSGEIGCPVYNLIPEWNDLVYRGHWKEALERLHKTNNFPEFTGRVCPAPCEGSCTVAISDDAVAIKSMEFHIVERGFQEGWIVPNPPRSRTGKKVAVVGSGPAGLAAAAQLNKAGHWVTVFEREDRIGGLLTYGIPDVKLPYHVVERRINLLKEEGIEFRTNVEIGKDVSAKQLKDDFDAVVLCTGATKPRDVNVKGRELKGIHFAMDFLTANTKSLLNSNHQDGNYISAKGKHVVVIGGGDTGADCITTSVRHGAKSITQFDINREKSNERPDNNPWPLFPIVHTVEDGHKEAAAVYGKDPRAYQVMTTKFVGDAEGHVKEIHTISVETTVHPDGSKTRVEIPGTEKVWPADLVFLAVGFTGPEEQLVRELELETDTRSNIKAEYGKYETSLEGVFAAGDNRRGQSLVVWAIHEGREAARECDKYLMGASNLP

SEQ ID NO: 4347 - DNA, 1236 bp, Clostridium acetobutylicum
  CDS (1)..(1236)
atggataaccctaatttattgtcagaagaggcaaacagatgcctactatgcaaaaaccctagatgtaaagcaaattgccctattaatacacccataccagaaattataagcctttataaagaaggaaaaattatggaagcaggagaaattttatttaataacaatcctctttcagtaatatgctcattggtctgtattcatgaggatcaatgtaagggaaattgtgtaagaggaataaaaagcgagccaataaaatttcacgagatagaagaagagatatcagagaagtacttaaaagaggccaagcttaagaatgttcagaaggacaaggatagaattgcaatagttggaggaggtccagcaggaatcacagttgcatttgtacttgctaataaaggctataatgttaccatttttgaggctcacgataaaataggaggagtacttagatatggtattccagagtatagattgactaagaaattagtggataagcttgaagaaagacttatagaggttggagtgaaaattagacctaatactgttattggaccagttatttctttggacaggttacttgaagattcatataaggcagtatttattggaactggagtatggaatccaaaaaccttagatgtaaagggagaaactttaggaaatgttcattttgctattgattatttaaaatctcctgaaagctatagattaggaaaaaaagtagctgtaataggagcaggtaatgttgccatggatgctgcaagaactgctaagagaaatggtgctgaggtaacaatactttatagaaaaagctttaatgagatgccagcatcaaaacaagaaataagagaaactaaagaagatggagtagagtttaaattatttagagcaccaattgaaataacagaagagggtattaaagtagcatttacagaaaatgttacagatgcagaaggaaaaataagaactaaaattattgaaggaaaagaagagttttttgagtgtgattcagtagttgttgccgtaagtcaagcacctaaggataatatagtatctaatacaacaggcttagatactaaatggggattaatagtaacagatgaaaaaggcaatacaactaaaaaaggaacctttgcatgtggagatgtagttacaggagcaaaaactgtagttgaagctgcagcacaagcaaaagtagttgcagaaactattgatgagtattgcaagaataattaa

SEQ ID NO: 4348 - protein, 411 aa, Clostridium acetobutylicum
MDNPNLLSEEANRCLLCKNPRCKANCPINTPIPEIISLYKEGKIMEAGEILFNNNPLSVICSLVCIHEDQCKGNCVRGIKSEPIKFHEIEEEISEKYLKEAKLKNVQKDKDRIAIVGGGPAGITVAFVLANKGYNVTIFEAHDKIGGVLRYGIPEYRLTKKLVDKLEERLIEVGVKIRPNTVIGPVISLDRLLEDSYKAVFIGTGVWNPKTLDVKGETLGNVHFAIDYLKSPESYRLGKKVAVIGAGNVAMDAARTAKRNGAEVTILYRKSFNEMPASKQEIRETKEDGVEFKLFRAPIEITEEGIKVAFTENVTDAEGKIRTKIIEGKEEFFECDSVVVAVSQAPKDNIVSNTTGLDTKWGLIVTDEKGNTTKKGTFACGDVVTGAKTVVEAAAQAKVVAETIDEYCKNN

SEQ ID NO: 4349 - DNA, 1419 bp, Salmonella enterica subsp. enterica serovar Typhi
  CDS (1)..(1419)
atgagccagaatgtttatcaatttatcgacctgcagcgcgttgatccgccgaagaaaccgctgaagctccgtaagatcgagtttgttgaaatctacgaaccgttttctgaaggtcaggcgaaagcccaggcggatcgctgtttgtcctgcgggaacccctactgcgagtggaaatgtccggtacataactacatcccgaactggctgaaactggctaacgaagggcgtatttttgaggcggctgagctatcgcaccagaccaacaccctgccggaagtgtgtggccgcgtctgcccgcaggaccgcctgtgcgaaggctcctgtacgctgcacgatgagttcggcgcagtgaccatcggtaacattgagcgctatatcaacgataaagcgttcgaaatgggctggcgcccggatatgaccggcgtgcgccagacggacaaacgggtagcgattatcggcgctggtccggcagggctggcgtgcgccgacgtgctgacccgcaacggcgtgaaggcggtggtctttgatcgccatccggaaatcggtggtctgctgaccttcggtattccagctttcaaactggaaaaagaggtgatgacccgtcgtcgcgagatcttcaccggcatgggtattgagttcaaacttaataccgaagtgggtcgtgatgtacagcttgaagatctgctgaaagattacgatgcggtattccttggcgtcggcacctatcagtcgatgcgcggcgggctggaaaatgaagatgcggacggggttttcgacgctctaccgttcctgatcgccaatacgaagcagatcatggggtttggcgaaaccagcgacgaaccatatgtcagcatggaaggcaaacgcgtggtggtgctgggcggcggcgataccgcaatggactgcgtacgcacttccatacgccagggcgcaacgcacgtaacctgtgcttatcgtcgtgatgaagagaacatgccgggttccagacgcgaagtgaaaaacgcgcgcgaggaaggtgtcgagtttcagtttaacgttcaaccgctgggcattgaagtcaatgccaacggcaaagtgagcggcgtaaaaatggtgcgtactgaaatgggcgaaccggatgccaaaggccgtcggcgggcggagatcgtcgccggttccgagcatgtggttccggctgatgcggtggtgatggcgtttggttttcgtccacacagcatggaatggctggcgaaacacagcgtggaactggactcgcagggacgaattatcgcgccggaacgcagcgataatgctttccagaccagcaacccgaaaatcttcgccggtggcgacatcgtgcgcggttccgatctggtggtgacggcgattgccgaaggccgtaaagcggctgacgggattatgaactacctcgaagtgtaa

SEQ ID NO: 4350 - protein, 472 aa, Salmonella enterica subsp. enterica serovar Typhi
MSQNVYQFIDLQRVDPPKKPLKLRKIEFVEIYEPFSEGQAKAQADRCLSCGNPYCEWKCPVHNYIPNWLKLANEGRIFEAAELSHQTNTLPEVCGRVCPQDRLCEGSCTLHDEFGAVTIGNIERYINDKAFEMGWRPDMTGVRQTDKRVAIIGAGPAGLACADVLTRNGVKAVVFDRHPEIGGLLTFGIPAFKLEKEVMTRRREIFTGMGIEFKLNTEVGRDVQLEDLLKDYDAVFLGVGTYQSMRGGLENEDADGVFDALPFLIANTKQIMGFGETSDEPYVSMEGKRVVVLGGGDTAMDCVRTSIRQGATHVTCAYRRDEENMPGSRREVKNAREEGVEFQFNVQPLGIEVNANGKVSGVKMVRTEMGEPDAKGRRRAEIVAGSEHVVPADAVVMAFGFRPHSMEWLAKHSVELDSQGRIIAPERSDNAFQTSNPKIFAGGDIVRGSDLVVTAIAEGRKAADGIMNYLEV

SEQ ID NO: 4351 - DNA, 1860 bp, Salmonella enterica subsp. enterica serovar Typhi
  CDS (1)..(1860)
atgaatcgttttattatggccaatagccagcagtgtctgggatgccatgcctgcgaggtcgcctgcgtaatggctcacaatgatgagcgacatgttctgacgccacagcgctatcagccccgaattactgtcatcaaacatcagcgccagcgcagcgcggttacatgtcaccattgcgaagatgcgccctgcgcccgtagctgtccgaacggcgcgatcgcgcatattaacgacagcgtgcaggtcaatgcgcagaagtgcatcggctgtaagtcctgcgtcgtcgcctgcccattcggcaccatgcagatggtattgacgcccgtcgcgccaaaccagttcaaagccagcgcgcataaatgcgatctgtgtcagggacgtgaacagggtccggcctgtgtggaaaattgcccggcggatgcgctgcaactggtcaccgaagactcgttgacccgtctggctaaaacgcgacggctgcgtaccgcccggcaggagattcgcccctggcataccgtggatacacaacacagtgggacagcatgcagcaaagtcgagcgtatgcaggcgacgccgccgcgcggcgaaccggataaactggcgattgaagcgcgtaaaaccacctttgaggaaatttatctgccgtttcgcgccgcgcaggcggagcgtgaagcggcccgctgcctcacatgcggggaacacagtatctgcgaatggacctgtccgctgcataaccatattccccagtggatcgaactggtgaaagccggcgatattgatgcggcggtagagctttcccaccagaccaactgtctgccggaaattaccgggcgcgtctgtccgcaggatcggctatgcgaaggcgcgtgtacactccgcgatgagtatggcgcggttaccatcggcaacattgagcgctatatctccgatcgcgctctgagcaaaggctggcgtcccgacctgtcggacgtacagaagagcgataagcgcgtggcgattatcggcgcggggccggcaggtcttgcctgcgctgacgtgctggcgcgccgtcgggaaatcttcagcgcgatggggattcgtttcgaacttaactgcgaagtagggaaagatatttctctggagacgctgctggagagttatgacgccgtctttgtcggggtaggaacctatcgttccatgaaggctgatttaccgaatgaagacgcgccgggggtatatgatgcgttgccattcctcatcgccaataccaaacaggtgatggggcttccggcgttgcctgacgagccgtttattgatactgcgggccttaacgtggttgtgctgggcggcggtgacaccgcaatggactgcgtacgtacggcgttgcgtcatggcgctgccaacgtcacctgcgcttatcgccgcgatgaggccaatatgccagggtcgaaaaaagaggtgaaaaacgcgcgggaagagggcgcgaactttgaatttaacgttcagccagttgagttggtgctggatacgcacgggcgcgccagcggtattcgctttttgcgtacgcggcttggcgaaccggatggtcaggggcgacgccgtccggtacctgtaccggacagcgagttcgtgatgccggcggatgcggtcattatggcgtttggttttcatccgcatggtatgtcgtggctggaatcgcatggcgtgaaggtggataactggggacgtattgccgccagcgtcgagagcgagtttcgttaccagacgtccaacccgaaaattttcgctggcggcgatgcggtgcgcggcgccgatctggtggtgacggcgatggcagaaggccgacatgccgcgcaggggatactcgactggttagctaaataa

SEQ ID NO: 4352 - protein, 619 aa, Salmonella enterica subsp. enterica serovar Typhi
MNRFIMANSQQCLGCHACEVACVMAHNDERHVLTPQRYQPRITVIKHQRQRSAVTCHHCEDAPCARSCPNGAIAHINDSVQVNAQKCIGCKSCVVACPFGTMQMVLTPVAPNQFKASAHKCDLCQGREQGPACVENCPADALQLVTEDSLTRLAKTRRLRTARQEIRPWHTVDTQHSGTACSKVERMQATPPRGEPDKLAIEARKTTFEEIYLPFRAAQAEREAARCLTCGEHSICEWTCPLHNHIPQWIELVKAGDIDAAVELSHQTNCLPEITGRVCPQDRLCEGACTLRDEYGAVTIGNIERYISDRALSKGWRPDLSDVQKSDKRVAIIGAGPAGLACADVLARRREIFSAMGIRFELNCEVGKDISLETLLESYDAVFVGVGTYRSMKADLPNEDAPGVYDALPFLIANTKQVMGLPALPDEPFIDTAGLNVVVLGGGDTAMDCVRTALRHGAANVTCAYRRDEANMPGSKKEVKNAREEGANFEFNVQPVELVLDTHGRASGIRFLRTRLGEPDGQGRRRPVPVPDSEFVMPADAVIMAFGFHPHGMSWLESHGVKVDNWGRIAASVESEFRYQTSNPKIFAGGDAVRGADLVVTAMAEGRHAAQGILDWLAK

SEQ ID NO: 4353 - DNA, 1470 bp, Listeria innocua
  CDS (1)..(1470)
atgggaaaagcaactggatttatggaatatgatcgaattccttcgccaggacgtgatccgaaaagtcggacgcgtgactggaatgaatatagtttaccgatgccggtagcagatttaactttacaagccgctcgctgtatggattgtggtgtgccattttgtagtgtaggaatggaaattaaaaatggtgtgtcaggctgtccgctgcataatttaattcccgagtggaacgatgccgtttaccggggtgactggtatgaagcgttacaactgcttctaaaaacaaataattttccagagtttactggtcgaatttgtccggccccgtgtgagggtggttgtacagtagctatttctgaacctgctgtcggcattaaatcaattgaaaaagcaattattgatcgtggttttgaggaaggttggattaaaccgcaacctcctaagaaacgtaccggcaaacgtattgctgtgattggctctggaccagctggacttgcctgtgccgatcaattaaataaagctggtcatagtgtaacagtcatcgagaaaagtgatcgaattggtggcttattgatgtatggtattccaactatgaaactagaaaaagaacaagtgacacgccgagtgaacttgatggcggaagaaggaattgaatttgtaacaggtgttgcagcaggtactgatgttacttttgctgaactgcgcgctgaatatgattcgattgttcttgcgactggggctggtaatgcacgagatataccgcttgctggacgtgatgcggctgggattcacttcgccgttccgtatttgacacaaagcacgcgtgataatttagataatggcggagttcaaacactttctgctaaagataaaaatgttgttattattggtggcggagatacaggggctgactgtgtggcaactgcgcttagacaaggcgctaaaagtatttatcaattcggtattcaagataaattacccgaattaagaaatggtgaaaatccatggccgcaatatccacgtgttttcaaaatggattatgcgcatgaagaagcagaagcagtgtacggcagagatccacgtgagtatctcatcaatactacttctttcgaaaaagatgcagcaggaaatcttgttgggcttcacacggtagaagttacagaagataaagagacgagacaatatacaccagtagaaggtagcgagaaatattttgaagtagatatggttttaattgctattggcttttcgggtacgacagaagatatatttactaatttcggtgtaggaaaaacagagcgccatacaattgacgctgctaaaggattttaccgcacaagtgaagaaggcgtgtttgcttgtggggatgcacgtcacggtcaaagtttagttgtaaccgcgattgcagaaggaagagaagcagcacgagaagttgacttttacttgatgggagaaacatttttaccataa

SEQ ID NO: 4354 - protein, 489 aa, Listeria innocua
MGKATGFMEYDRIPSPGRDPKSRTRDWNEYSLPMPVADLTLQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPQPPKKRTGKRIAVIGSGPAGLACADQLNKAGHSVTVIEKSDRIGGLLMYGIPTMKLEKEQVTRRVNLMAEEGIEFVTGVAAGTDVTFAELRAEYDSIVLATGAGNARDIPLAGRDAAGIHFAVPYLTQSTRDNLDNGGVQTLSAKDKNVVIIGGGDTGADCVATALRQGAKSIYQFGIQDKLPELRNGENPWPQYPRVFKMDYAHEEAEAVYGRDPREYLINTTSFEKDAAGNLVGLHTVEVTEDKETRQYTPVEGSEKYFEVDMVLIAIGFSGTTEDIFTNFGVGKTERHTIDAAKGFYRTSEEGVFACGDARHGQSLVVTAIAEGREAAREVDFYLMGETFLP

SEQ ID NO: 4355 - DNA, 1470 bp, Listeria monocytogenes
  CDS (1)..(1470)
atgggaaaagcaactggatttatggaatatgaccgaattccctctccaggacgtgatccgaaaagccggacacgtgactggaacgaatatagtttaccaatgccggtagcagatttaacaatacaagccgctcgatgtatggattgtggtgtgccgttttgtagcgtagggatggaaattaaaaatggcgtatcaggttgtccattgcataatttaattcctgagtggaacgacgccgtataccggggtgactggtatgaagcgttacaactacttttaaaaacaaataattttccagagtttactggtcgtatttgtccggcgccgtgtgaaggtggctgtacggtggctatttcggaacctgctgtagggattaaatccattgaaaaagcgattattgaccgaggttttgaagaaggctggattaaaccggctcctcctaaaaaacgtaccggtaaacgaattgctgtgattggatcaggaccggctggacttgcctgcgcggatcaattaaataaagctggccatagcgtaacggtcattgaaaaaagtgatcgcattggtgggttattaatgtacggtattccaacgatgaaactggaaaaagaacaagtaacgcgccgagtgaacttgatggcggaagaaggaatcgaattcgtcacaggtgttgcagcagggacagatgttacttttgcagaactacgcgaagagtatgattctatcgttcttgcgacaggagcaggaaatgcgcgcgatatcccacttgctggacgtgacgcagctggtattcacttcgctgttccgtatttatctcaaagtacgcgtgataatctggataacggcgggatacaaacactttctgctaaaggtaagaatgttgtgattatcggtggtggagatacaggtgctgactgtgtggcaactgcgctcagacaaggcgcaaaaagtatttatcaatttggtattcaagataaactacctgaattgcgtgatggcgaaaacccttggccgcaatatccacgtgttttcaaaatggattatgcgcacgaagaagcggaagcagtgtatggaagagatccacgtgagtaccttattaatacaacttcttttgaaaaagatgaagcaggaaatcttattggattgcatactgtagaagtagaagaaaataaggcagaaagaaaatatacacctgtagaaggaagcgaaaaatactttgaagtagatatggttttaatcgcgattggttttgcaggaacaactgaagatatttttacaaactttggtgtaggaaaaacagatcgtcatacgattgatgcagccaaaggattttaccgtactagtgaagagggcgtattcgcttgcggagatgcgcgtcacggtcaaagtttagttgtaaccgcgattgcagaaggacgagaagcagctcgtgaagtagacttttacttgatgggtgaaacatttttaccataa

SEQ ID NO: 4356 - protein, 489 aa, Listeria monocytogenes
MGKATGFMEYDRIPSPGRDPKSRTRDWNEYSLPMPVADLTIQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAAGIHFAVPYLSQSTRDNLDNGGIQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTDRHTIDAAKGFYRTSEEGVFACGDARHGQSLVVTAIAEGREAAREVDFYLMGETFLP

SEQ ID NO: 4357 - DNA, 1419 bp, Yersinia pestis
  CDS (1)..(1419)
atgagtcagaacgtttatcagtttatcgacttacagcgcgtcgatccgcctaaaaaaccgctgaagatccgtaaaattgaatttgttgaaatttacgagccattctcagaaacacaagccaaagcacaggccgatcgctgcctgtcctgcggcaatccgtactgtgaatggaaatgcccggttcataactacatccctaactggctgaaactggccaacgaggggcggattatggaagcggctgatctggcacaccaaacgaacagcctaccggaggtctgtggccgtgtttgtccacaagatcgcttgtgtgaaggatcttgtactctgaacgacgaatttggtgccgtgaccatcggcaacatcgagcgttatatcagtgacaaagccattgcgatgggctggaaaccggatatgtcacatgttcaccctaccggtaaacgtgtggccgtgatcggggccggccctgccgggctggcctgtgctgatgtattagcacgtaacggtgttcaggctgtggtctttgaccgccatccagaaattggggggttactgaccttcggtatcccagcgtttaagctggaaaaagaagtgatgattaaacgccgtaagatcttctccgagatgggaattgaattccaactgaatactgaagtaggcaaagacatcaccatggaagcactgctgaaagattacgacgccgtgttcctgggggttgggacctaccaatctatgcgtggtggtttggaaaacgaagaggctaacggtgtatatgatgccttgcctttcctgattgctaatactaaacagctaatgggctatgaagcgacggctcacgaaccgtatatcaacatgcaaggtaaacgcgtcgtggtgcttggtggcggtgataccgcaatggactgtgtgcgctcctcaattcgtcagggggcaaccgatgtggtttgcgcctatcgccgcgatgaagtgaatatgccgggttccaagcgggaagtgaaaaacgcccgtgaagaaggggtagaatttaaattcaacctgcaaccattaagcattgaagtgaacagcaatggcaaagtctgtggtgtcagaatggtccgcacccagttgggcgcgccagatgcacagggccggcgcatggctgaacagatccctggctcagaacatgtattgccagcagatgccgtagtgatggcatttggtttccgcccacacagtatggaatggctggccgctcacgatgtgaagctggataagcaaggccgggtgattgcaccggaaagcactgataatgccttccagaccagtaacccgaaaatctttgcgggcggcgatattgtccgtggttccgatttagtggttaccgccattgccgaaggccgtaaagccgcagacggcatcatgaattatctggaagtctaa

SEQ ID NO: 4358 - protein, 472 aa, Yersinia pestis
MSQNVYQFIDLQRVDPPKKPLKIRKIEFVEIYEPFSETQAKAQADRCLSCGNPYCEWKCPVHNYIPNWLKLANEGRIMEAADLAHQTNSLPEVCGRVCPQDRLCEGSCTLNDEFGAVTIGNIERYISDKAIAMGWKPDMSHVHPTGKRVAVIGAGPAGLACADVLARNGVQAVVFDRHPEIGGLLTFGIPAFKLEKEVMIKRRKIFSEMGIEFQLNTEVGKDITMEALLKDYDAVFLGVGTYQSMRGGLENEEANGVYDALPFLIANTKQLMGYEATAHEPYINMQGKRVVVLGGGDTAMDCVRSSIRQGATDVVCAYRRDEVNMPGSKREVKNAREEGVEFKFNLQPLSIEVNSNGKVCGVRMVRTQLGAPDAQGRRMAEQIPGSEHVLPADAVVMAFGFRPHSMEWLAAHDVKLDKQGRVIAPESTDNAFQTSNPKIFAGGDIVRGSDLVVTAIAEGRKAADGIMNYLEV

SEQ ID NO: 4359 - DNA, 1242 bp, Salmonella enterica subsp. enterica serovar Typhi
  CDS (1)..(1242)
atgccgcaacaaaattatctggatgaactcacgcctggttttacgccattactggcaataaaagaggcttcccgttgtttattatgtcacgatgcgccctgtagtcaggcttgcccggcgcaaaccgatccggggaaatttattcgttctatttactttcgcaattttaaaggcgcagcggaaactatccgggaaaataatgcgcttggcgccgtctgcgccagagtctgtccgacggaaaaattatgccagcgcggatgtacacgttccggaatagataaacctattgatattgcacgcctgcaacgttttattaccgattttgaacagcagactgccatgcagatttatcagcccgggagtaaaacacgcgggaaagtcgcgattattggcgcgggtccggcaggtttgcaggcaagcgtgacgctcacacatttaggctatgacgtcaccatttacgaaaaacagccgcagcccggcggatggctgcgtcacggcatcccggcatttcgtctgccgcaaagcgtactcgatcaggaaattgcccgcattgtagaaatgggcgtcaatattaaatgtaattgtgacgtgggcgggtcgctatcgcttgcgcaactcaaagccgaatatcgcgccgtgctgatgaccgtcgggatgtcctgtggctctgatttaccgttatttgagcaagccagtcacgtagagattgccgttgattttttacagcgcgcccgtcaggccgacggcgatattagcgttccgcgtagcgcattaattattggcggcggcgacgtagcgatggatgtcgccagtacgttaaaaattctcggctgtccttccgtcacctgcgtggcgcgggaagaattagccgaattccccgccagcgaaaaagaatttaccagcacgcaggcattaggcgtatcgattattgatggttttacgcctgtcgccgtcagcggaaataaagtgaccttccaccatgtacgccactcaggagaactgacgctggaagcggaaaatattattttggccgtggggcagcacgcgcgactggataactttgcggagataaaagcgcagcataatattatcgacacgcacaattatcaaaccgacgacccggcgatctttgccgctggcgatattgttaaaggtgataagaccgtcgtttatgcggtaaaaaccggaaaagaagccgctcaggctattcatcattatttagaggaggcctgctcatgttaa

SEQ ID NO: 4360 - protein, 413 aa, Salmonella enterica subsp. enterica serovar Typhi
MPQQNYLDELTPGFTPLLAIKEASRCLLCHDAPCSQACPAQTDPGKFIRSIYFRNFKGAAETIRENNALGAVCARVCPTEKLCQRGCTRSGIDKPIDIARLQRFITDFEQQTAMQIYQPGSKTRGKVAIIGAGPAGLQASVTLTHLGYDVTIYEKQPQPGGWLRHGIPAFRLPQSVLDQEIARIVEMGVNIKCNCDVGGSLSLAQLKAEYRAVLMTVGMSCGSDLPLFEQASHVEIAVDFLQRARQADGDISVPRSALIIGGGDVAMDVASTLKILGCPSVTCVAREELAEFPASEKEFTSTQALGVSIIDGFTPVAVSGNKVTFHHVRHSGELTLEAENIILAVGQHARLDNFAEIKAQHNIIDTHNYQTDDPAIFAAGDIVKGDKTVVYAVKTGKEAAQAIHHYLEEACSC

SEQ ID NO: 4361 - DNA, 1467 bp, Deinococcus radiodurans
  CDS (1)..(1467)
atgtccaaaatcaccggctttctagaacaaccccgcgtcaaggagcagtacgcgccgattgacgcccggctcaagcactaccacgaattcatgctgccgctcgattcggcctcggcccgcctgcaagcgacgcgctgtatggactgcgggattccgttctgtaacaacggctgcccggtcaacaacatcatccccgacttcaacaacctggtgttcgaggacgactggaaagcggcgctcgacgtgctgcacgccaccaacaacttccccgagttcaccgggcgtatctgccccgccccgtgcgaggccgcctgcacgctgaacatcagcgaggacccggtgggcatcaagtccatcgaactcgccattatcgagcgcggctggcaggaaggctgggttagacctacgcccgccgaagtcaagaccggcaagaaagtcgccgtggtgggctccggccctgctgggctggccgccgcgcagcaactcgcccgcgccgggcacgacgtgacggtgttcgagaagaacgaccgagtgggcgggctggtgcgttacggcattcccgacttcaagctcgacaagtcgcacatcgaccgccgcatagagcagatgcaggccgagggcgtcaccttccgcaccggcgtcctggtgggcgactgggacgagaacagcaagatcaccaacctcagcaaagagcgcgtgacgcccgccgagctgcgcgaacagttcgacgcggtggtcctcgcgggcggcagcgaaacgccgcgtgacctgccggcaccgggccgtgagctgaacggcatccactacgcgatggagttcctgccgcagcaaaaccgggtgaacgcgggcgacaagttcaagggccagattcgcgccgacggcaagcacgtggtcgtcatcggcggcggcgacaccggcagcgactgcgtgggcaccagcaaccgccacggcgcggcgggcgtcacgcagttcgaagtgatgccgcagcctcccgagcaggaaaacaagccactcacgtggccctactggccgatgaaactccgcaccagcaccagccacgaggaaggcgccgtgcgcgagttcgccatcgccaccaaggaatttatcggcaagggcggcaaggtcacgggcgtgaggaccgtgcgggtggaaatgaaggacggcaagctggaggaaatccccggctccgaggaaacccacaaggctgacctggtgctgctggcgatgggctttaccaacccgatgcagagcgtgctcgacgcgtttggcgtggacaaagacccgcgcggcaacgtgctggcgggcaccgaggagcacggcggctacctgaccagcgttcccggcgtcttcgcggcgggcgacatgcggcgcgggcagagcctcgtcgtgtgggccatccgcgagggtcggcaagcggcgcgggcggtggaccagttcctgatgggcgagagcgtactcccgcgctga

SEQ ID NO: 4362 - protein, 488 aa, Deinococcus radiodurans
MSKITGFLEQPRVKEQYAPIDARLKHYHEFMLPLDSASARLQATRCMDCGIPFCNNGCPVNNIIPDFNNLVFEDDWKAALDVLHATNNFPEFTGRICPAPCEAACTLNISEDPVGIKSIELAIIERGWQEGWVRPTPAEVKTGKKVAVVGSGPAGLAAAQQLARAGHDVTVFEKNDRVGGLVRYGIPDFKLDKSHIDRRIEQMQAEGVTFRTGVLVGDWDENSKITNLSKERVTPAELREQFDAVVLAGGSETPRDLPAPGRELNGIHYAMEFLPQQNRVNAGDKFKGQIRADGKHVVVIGGGDTGSDCVGTSNRHGAAGVTQFEVMPQPPEQENKPLTWPYWPMKLRTSTSHEEGAVREFAIATKEFIGKGGKVTGVRTVRVEMKDGKLEEIPGSEETHKADLVLLAMGFTNPMQSVLDAFGVDKDPRGNVLAGTEEHGGYLTSVPGVFAAGDMRRGQSLVVWAIREGRQAARAVDQFLMGESVLPR

SEQ ID NO: 4363 - DNA, 1980 bp, Escherichia coli
  CDS (1)..(1980)
atgaatcgttttattatggccaacagtcagcaatgtctgggttgtcatgcttgtgaaatcgcctgtgtcatggctcacaatgatgagcaacatgtcctgagccaacaccattttcatccccgaattacggttatcaaacatcaacagcaacgtagtgcagtgacctgtcaccattgtgaagatgcgccctgcgcccgtagctgccctaatggcgcaatcagccacgttgatgacagcattcaggtcaatcagcaaaagtgtattggctgtaaatcctgcgtggtggcctgtccttttggtacgatgcaaatcgtcctgacacccgtcgcggcaggaaaagtaaaagccacggcgcataaatgcgacctttgtgcggggcgcgaaaacggtcctgcctgtgttgagaattgcccggcggacgcgctgcaactggtcactgacgtcgcactctccggcatggcgaaatcccgccgcttgcgcaccgcgcgtcaggaacatcaaccgtggcatgccagtaccgcggcgcaagaaatgccggtaatgagtaaagtcgaacaaatgcaggcaacgcccgcgcgtggcgagccggataaactggcgattgaagcgcgcaaaaccggttttgatgaaatttatctgccatttcgcgccgaccaggcacaacgggaagcctcgcgctgccttaagtgcggcgagcacagcgtttgtgaatggacctgcccgctgcataaccatataccgcagtggattgaactggtgaaagccggaaacatcgacgccgccgtcgagctttctcaccagaccaacaccctgccggaaattaccggacgcgtttgtccgcaagaccgtttgtgtgaaggtgcctgtactattcgcgatgagcacggcgcggtaactatcggcaacattgaacgctacatttcagatcaggcgttggcgaaaggttggcgtcctgacttaagccatgtcaccaaagtggacaagcgggtggcgattatcggtgcaggtccggcagggctggcctgtgcggatgttctgacccgcaatggcgtgggggtgacggtgtacgatcgccatccagaaatcggtggcttgctcactttcggcattccttctttcaaactggataaatccctgctggcacgccgtcgggaaatcttcagcgcgatggggattcacttcgaactcaattgtgaagtgggtaaagatgtctctttggattcgcttttggaacaatacgacgcggtcttcgttggcgtaggcacttaccgttccatgaaagcgggtttacccaatgaagatgcgccgggcgtttatgacgcgctgccgttcctcattgccaacactaaacaggtgatggggctcgaagagctaccggaagagccgtttatcaataccgccggacttaacgtcgtggtactgggcggcggcgacaccgcgatggactgtgtgcgtaccgcactgcgccacggcgcgagtaacgtcacctgcgcttatcgtcgtgatgaagctaacatgccaggctcgaagaaagaagtgaagaacgcccgcgaagagggggccaacttcgaatttaacgtccagccggtggcgcttgagctgaatgaacaaggtcacgtctgcgggattcgtttcctgcgcacgcgtcttggagagccggatgcccaggggcgtcggcgtccagtgccggtggaaggcagtgaatttgtcatgccagccgacgcggtgattatggcgtttggcttcaatccgcacgggatgccgtggctggagtcgcacggtgtaacggtagacaaatggggccgcatcatcgcggatgtggaaagccagtaccgttaccagaccaccaatccgaaaatcttcgctggtggtgacgccgtgcgtggtgcggatctggtggttaccgcaatggcagaaggacgtcatgcggcacaggggattattgactggctgggggtaaaatcagtcaaatctcactga

SEQ ID NO: 4364 - protein, 659 aa, Escherichia coli
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAAGKVKATAHKCDLCAGRENGPACVENCPADALQLVTDVALSGMAKSRRLRTARQEHQPWHASTAAQEMPVMSKVEQMQATPARGEPDKLAIEARKTGFDEIYLPFRADQAQREASRCLKCGEHSVCEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVGVTVYDRHPEIGGLLTFGIPSFKLDKSLLARRREIFSAMGIHFELNCEVGKDVSLDSLLEQYDAVFVGVGTYRSMKAGLPNEDAPGVYDALPFLIANTKQVMGLEELPEEPFINTAGLNVVVLGGGDTAMDCVRTALRHGASNVTCAYRRDEANMPGSKKEVKNAREEGANFEFNVQPVALELNEQGHVCGIRFLRTRLGEPDAQGRRRPVPVEGSEFVMPADAVIMAFGFNPHGMPWLESHGVTVDKWGRIIADVESQYRYQTTNPKIFAGGDAVRGADLVVTAMAEGRHAAQGIIDWLGVKSVKSH

SEQ ID NO: 4365 - DNA, 1419 bp, Pyrococcus horikoshii
  CDS (1)..(1419)
atgcctaagcttattaaggagagagttccaactcccgagaggcccgttgaggaaaggattaaggatttcaaggaggtgaacttgggttatacctttgagcttgccaagaaggaagcagagcgttgcctccagtgtccaccggaatatgccccctgtattaagggatgtccagttcacataaacattccggcttttatagctaagataaaggagggtgacatcaagggggcccttaggattatttggaatgacaacacattacccgctattactggtagggtttgtccgcaggaggatcagtgtgagggtgcttgtgtagttggtaaggttggtgatcccgtaaacatcggaaaactagagaggttcgtagcagactacgcaagagaacacggaatagaggaagaattgctccgcgaattcactgagaagtgtgatgggagcaaaggtaaagtagcggtagttggtgctggacccgctggcctaacatgtgcaggtgagctagccaagatgggatataaggttacgatctttgaggcccttcataaacccggtggagttctagcctacggaattccggagtttagattacccaaggagatattggatcacgagctaaagaagcttaaaatgctaggagtcgagataaggactgatcacgtagtaggaaagactgtaacattggatgagttgctccaggaatacgatgctgtcttcataggaactggagcaggaacgccaaagctacttaacattcctgggatactcttagataggatatactcagcaaacgagttcctcacgaggatcaacctcatgaaggcctacgaattcccagagtatgacactccgatagctgtggggaagaaggtaatagtgatcggagctggaaacactgcgatggatgcagctagatcagcattaaggcttggtgcagaggttacaatagcttacagaaggggaagggaagacatgaccgctagggaggaggagataaagcacgctgaagaggagggggtaaagttcgaattcttcctgcaacccgtcgaattcattggagatgagaacggaagagtcaaagccgttaaattcgaaaggacaaagccactagaagagcgtgatagcaaaggaaagaggaagatagtcggaaccggagagtacgtaacgttagaagccgataccgtaataatagccataggacttgagccgaacaagattataaccgaggatgggaggcttaagactaatccggatggaacgatagtagtggacgagaatcttatgacttctattcctggggttttcgctggtggtgatgcaattaggggagaagccacggtaatcctagcaatgggagatggaaagagagcggctaaagcaatagatgaatatataaggaggaagagaggtcagaattcctaa

SEQ ID NO: 4366 - protein, 472 aa, Pyrococcus horikoshii
MPKLIKERVPTPERPVEERIKDFKEVNLGYTFELAKKEAERCLQCPPEYAPCIKGCPVHINIPAFIAKIKEGDIKGALRIIWNDNTLPAITGRVCPQEDQCEGACVVGKVGDPVNIGKLERFVADYAREHGIEEELLREFTEKCDGSKGKVAVVGAGPAGLTCAGELAKMGYKVTIFEALHKPGGVLAYGIPEFRLPKEILDHELKKLKMLGVEIRTDHVVGKTVTLDELLQEYDAVFIGTGAGTPKLLNIPGILLDRIYSANEFLTRINLMKAYEFPEYDTPIAVGKKVIVIGAGNTAMDAARSALRLGAEVTIAYRRGREDMTAREEEIKHAEEEGVKFEFFLQPVEFIGDENGRVKAVKFERTKPLEERDSKGKRKIVGTGEYVTLEADTVIIAIGLEPNKIITEDGRLKTNPDGTIVVDENLMTSIPGVFAGGDAIRGEATVILAMGDGKRAAKAIDEYIRRKRGQNS

SEQ ID NO: 4367 - DNA, 1431 bp, Pyrococcus horikoshii
  CDS (1)..(1431)
atgcctaagcttattaaggagagagttccaactcccgagaggcccgttgaggagagaataaaagattttgatgaagttaatcttggttacacctgggagctagctttaaaggaggccgagcgttgcctccaatgtccggttgagtacgctccctgtattaaggggtgccccgtaaatattaacattcctgggtttatcaaagccttgagggagaacaaagataatccaagaaaggccgtgaaggaagccttaagagttatttgggcttgcaattctcttcctgctattactggtagggtttgtccgcaggaggatcagtgtgagggtgcttgtgtagttggtaaggttggtgatcccgtaaacatcggaaaactagagaggttcgtagcagactacgcaagacaacatgggattgatgatgaactgttaatggaggagattaagaatatcaagaagaatggaaagaaagttgccgttattggggccgggcccgctggcttaacatgtgccgctgaattggctaaaatgggttacgatgttaccatttatgaagcccttcatgaaccaggaggagttttagcatatggaattccagaattcaggttaccaaaagaaatactaagaaaagaactcaagaagcttagcattttgggagttaaaataaagaccgatcatatagtgggtagaactgtcacgattcctgagttattaaaggagtacgatgccattttcataggaactggagcaggaacaccaaagctattaaagatacccggtataaacttgaatggaatttattcagcaaatgaatttctgaccagaattaatctaatgaaagcttacaagttcccagagtacgataccccaataatcgtaggtaagagagttattgtgataggggctggaaacactgcaatggatgccgctagatcagcattaaggcttggagcagaggttataatcgcatatagaagaggagaagaagacatgacagcaagaatagaggaggttcagcatgccaaggaggaaggagtgaagttcatgttctttgtgaatcccgtcgaattcattggggatgagaacggaagggtcaaagctgtaaagttcgaaaagatgaagccattagaagagcgtgatagcagaggaaagaggaagataatcggaactggtgaatatgtaacggttgagacggataccgttgtcatagctataggtcagacccccaacaggataatctggaaaaccaccccaggactcaaggtaagggagaacggtactatcgttgttgatgaaaatcttatgacttctattcctggggtttttgctggtggtgatgcaattaggggagaagccacggtaatcctagcaatgggagacggaaggaaagcagctaaagcaatccatgaatacctaagcaaaaagagtgcctga

SEQ ID NO: 4368 - protein, 476 aa, Pyrococcus horikoshii
MPKLIKERVPTPERPVEERIKDFDEVNLGYTWELALKEAERCLQCPVEYAPCIKGCPVNINIPGFIKALRENKDNPRKAVKEALRVIWACNSLPAITGRVCPQEDQCEGACVVGKVGDPVNIGKLERFVADYARQHGIDDELLMEEIKNIKKNGKKVAVIGAGPAGLTCAAELAKMGYDVTIYEALHEPGGVLAYGIPEFRLPKEILRKELKKLSILGVKIKTDHIVGRTVTIPELLKEYDAIFIGTGAGTPKLLKIPGINLNGIYSANEFLTRINLMKAYKFPEYDTPIIVGKRVIVIGAGNTAMDAARSALRLGAEVIIAYRRGEEDMTARIEEVQHAKEEGVKFMFFVNPVEFIGDENGRVKAVKFEKMKPLEERDSRGKRKIIGTGEYVTVETDTVVIAIGQTPNRIIWKTTPGLKVRENGTIVVDENLMTSIPGVFAGGDAIRGEATVILAMGDGRKAAKAIHEYLSKKSA

SEQ ID NO: 4369 - DNA, 1557 bp, Treponema pallidum subsp. pallidum (syphilis spirochete)
  CDS (1)..(1557)
atgacatctgtacaaaatgtcgtaagcgatgccaagacgtgtgacgtaccggttgagtcagaaccagaagcgcgtacgtatcggccgcacgcactgctccaggaagaagcgtgccagcgcctggcgcagctccagggtaaagagctgaagatgaaggatcgcacgcagatccctttgcagcgtatgcgtatgctgccgccaaaaaagcggtcgctcctcatgcaggaggcggcgctgggttttacagagcagcaggcactggttgagtctcagcgttgtttgaattgtaaaaccaagccgtgcgtaaagggttgtccggtaggagtgccgattcctgagtttattgcgtgtgtccaaaggggagcctttaaggaagcagttgatatcattaagacgacgagtttactccctgcaatttgcggtcgtgtgtgcccgcatgagcgtcagtgtcaattgcagtgtaccgtgggaaagatgtttaaggatgtgtccaaggcggtgtcgattggtgcgcttgagcgttttgtcgctgactgggagcggcagcatggtcaaattacagttccgtactgtgcgccgtctacgcacaagaaagtggccgtcatcgggtcagggcctgcaggtcttgcagttgcctcagatacggcgcgtgcaggccattcggtaacggtgttcgaagcgctccacaaaccgggtggagtggtgacctatggtattcctgagtttcgcctgccgaaagaagtggtagtgacggaaattgaaacactcaagaaaatgggggtgacgttccggatgaactttttggtgggcagaacagcaacgctggaacagctgttctcgcagtacggttttgatgcagtttttatcgggaccggtgcgggattgccgcgctttatgaatattgagggtgaggaattgtgcggggtgtttgcagcaaacgactacctaacgcgtgcgacgctgatgaaggcgtatgacactgcgcatgcggacacgccggtgtatgcggcaaagtcagtggtggtagtcggtggagggaatgtggcggtagattcctcgcgtacggcgctccgtttaggggctgagcaggtgcactgtctgtacagaaaaacgcgtgcggatatgaccgcctgtgtggaggaaattgcacaggcagaagatgagggggtgacgtttcactttttgtgtcagaccacccgcattttgggggatgaagaggggaacgtgcgcgcggtagtgttccgcgattgtcaggaacagattgatgcaggagaacgtgtgtttctgccctgcggcgatgctgagtgtaaacttgctgcagacgcggtgatcgttgccgttgggaatggttcaaatccgctcatggcaaagacaacgcgcagtcttgcagtgagcgagcggggtactatcgtggtggacgaggatcaacggacgagcattccgggagtgtgggctgggggagacattgtcttaggagcggcaacggttattcgtgcgatggggcaggggcggcgtgcagcggcgtctataaacgcgtaccttgcgcaaaaagcgtaa

SEQ ID NO: 4370 - protein, 518 aa, Treponema pallidum subsp. pallidum (syphilis spirochete)
MTSVQNVVSDAKTCDVPVESEPEARTYRPHALLQEEACQRLAQLQGKELKMKDRTQIPLQRMRMLPPKKRSLLMQEAALGFTEQQALVESQRCLNCKTKPCVKGCPVGVPIPEFIACVQRGAFKEAVDIIKTTSLLPAICGRVCPHERQCQLQCTVGKMFKDVSKAVSIGALERFVADWERQHGQITVPYCAPSTHKKVAVIGSGPAGLAVASDTARAGHSVTVFEALHKPGGVVTYGIPEFRLPKEVVVTEIETLKKMGVTFRMNFLVGRTATLEQLFSQYGFDAVFIGTGAGLPRFMNIEGEELCGVFAANDYLTRATLMKAYDTAHADTPVYAAKSVVVVGGGNVAVDSSRTALRLGAEQVHCLYRKTRADMTACVEEIAQAEDEGVTFHFLCQTTRILGDEEGNVRAVVFRDCQEQIDAGERVFLPCGDAECKLAADAVIVAVGNGSNPLMAKTTRSLAVSERGTIVVDEDQRTSIPGVWAGGDIVLGAATVIRAMGQGRRAAASINAYLAQKA

SEQ ID NO: 4371 - DNA, 1446 bp, Campylobacter jejuni
  CDS (1)..(1446)
atgggaaatgcaagaggttttttggactttaaaagaatggattttaaaaaaattgctcctaaagaaaggattttaaattacaaagaatttactatacctttggataaaaaagaacaagaagttcaaggtggacgatgtatggattgtggggtagctttttgtcatacgggtgtgatgagcgaaggaaaagatgtgggctgtcctttaaacaatctcattcctgaatggaacgatcttgtttatcgttctttatggaaagaagcttatgaaagacttgatcttaccaatccttttcctgaatttaccggtcgtgtttgccctgctccttgtgaggattcttgtgtgtgtgcgataaatggtgttagtgtgagcataaaaaataatgaattatccattatagaaaatgcttttaaggaaaatttagtaagagtaaataaacctaagcaatacaatggcaaaaaaatcgctgtcataggaagtgggcctgctgggcttgcttgtgccaatactttaaattcactaggttataaagtaagtgtttttgaaagaagcgataaaataggcggacttttgatgtatggcatccctgatatgaagcttgataaaagtatagttcaaagacgggtggatttgcttaaaaaaagtgggattgaatttaaagtgaatgaaaatatagacagcaaagataaggtttcaaaacttctaaaagaatttgatgctttggtgctttgtacaggagcaagtaagcctatagatcttgatatagaaggtagaaagctaaaaggggttgaatttgcccttgattttttaacgcaaaataccaaaactttgttaaaaacaggcaagggtgcagatatggccaaaggtaaaaatgtcttggttataggaagcggggatacaagtgtggattgtatcgctgtagcgacaagacaaggggctaaatctatagtgcgttttgaaagaagtccaaaaagacctttgcaaagaagccaaaacaatccttggcctttaaaagctgacatttttactactgattatggtttagaagaagccattgctgtatatggcaaagatcctagggaatatcaaaaaatgacaaagaaatttttaggaaaaactcatgtagaaggtgttgaagcaaatgatttaaaacgcgagtttaaagaaggcaaagctataaatgtcgaaatttcaaattctaaaaaaacttataaagcggatttagtgcttttagctatgggttttagcgggtgcgaagaagctatctctaaaaattttggagtgaaattagatgagaaaaacaacataagcacagaaaatttccaaaccactcataaaaaaatctttgcttgtggagatgctagaaaaggacaatctttagttgtttgggctataaaagatggtatagaatgtgctttgagtttgcatcaaaatttagcaaaataa

SEQ ID NO: 4372 - protein, 481 aa, Campylobacter jejuni
MGNARGFLDFKRMDFKKIAPKERILNYKEFTIPLDKKEQEVQGGRCMDCGVAFCHTGVMSEGKDVGCPLNNLIPEWNDLVYRSLWKEAYERLDLTNPFPEFTGRVCPAPCEDSCVCAINGVSVSIKNNELSIIENAFKENLVRVNKPKQYNGKKIAVIGSGPAGLACANTLNSLGYKVSVFERSDKIGGLLMYGIPDMKLDKSIVQRRVDLLKKSGIEFKVNENIDSKDKVSKLLKEFDALVLCTGASKPIDLDIEGRKLKGVEFALDFLTQNTKTLLKTGKGADMAKGKNVLVIGSGDTSVDCIAVATRQGAKSIVRFERSPKRPLQRSQNNPWPLKADIFTTDYGLEEAIAVYGKDPREYQKMTKKFLGKTHVEGVEANDLKREFKEGKAINVEISNSKKTYKADLVLLAMGFSGCEEAISKNFGVKLDEKNNISTENFQTTHKKIFACGDARKGQSLVVWAIKDGIECALSLHQNLAK

SEQ ID NO: 4373 - DNA, 1446 bp, Caulobacter crescentus
  CDS (1)..(1446)
atggccgagcgcatgctgaaattcacgacggtggcccgcaagacgcctgaaaagcgcgcggccgctgagcgttcgggcgactttcacgagatctacgccgacttcatcgacgcaaaggccaccgagcaggcctcgcgttgctcgcagtgcggcgtgccgttctgtcagacgcactgcccgctgcacaacaacatccccgactggctgcggatgaccgccgaaggccgtctggaagaagcctacgccctgtcgcaggcgaccaattcgatgccggaggtctgcggtcgaatttgcccccaggatcgcctgtgcgaaggcaactgcgtgatcgaacagtcgggtcacggcacggtgaccatcggttcggtcgagcgctacctgaccgacaaggcctgggagatgggctgggtcaagccgctggccgccggtccggcgcgcggtcagtcggtcgggatcgtgggcgcgggccccgcaggcctggccgccgccgagaagctgcgtgaggccggctacgacgtcaccgtctatgaccgccacgatcgcgccggcgggctgctgatctatggcatccccggcttcaagctggagaaggacgtcgtcgagcgccgcacccagcgcctagccgacggcggcgtcgtcttcaagctgggcttcgaggtcggcaaggacgccacgctcgaggacctgcgcgcccagcatgacgcggtgctgatcgccgtcggcgtctacgccgcgcgcgacctgaccgttccgggcggcggcagcaagggcgtggttccagccctcgactatctgatcacctccaaccgcctgtccctgggcgacagcgttccggcctacgactcgggcgaactgaacgccgagggcaaggacgtggtcgtggtcggcggcggtgacaccgccatggactgcgtgcgcacggccatccgtcagggcgccaagtcggtcacctgcctctatcgccgcgacaaggccaatatgcccggctcgatgcgcgaagtggccaacgccgaggaagaaggcgtcaccttcgaatggctggccgcgccgcgcgccctgtctggcgaggccgaggccgtcaccggcgtgcgcgccatccgcatgcgcttgggcgcgccggacgcctcgggccgccagagccccgaggaaatccccggcggtgacttcgaccgtccggcccagctggtcgtcaaggccctgggcttcgagcccgagaacctgccagagcagtggtccgccccggacctgaaggtgacccgttggggcaccgtcaaggccgacgtccggaaccagatgaccaatctcgacggcgtgttcgccgccggcgacatcgtgcgcggcgcttcgctggtggtctgggcgatcaaggacggccgcgacgccgccgacgccatccaccgctacctgctggccaaggcgtcctcgacgctgatcgccgccgaatag

SEQ ID NO: 4374 - protein, 481 aa, Caulobacter crescentus
MAERMLKFTTVARKTPEKRAAAERSGDFHEIYADFIDAKATEQASRCSQCGVPFCQTHCPLHNNIPDWLRMTAEGRLEEAYALSQATNSMPEVCGRICPQDRLCEGNCVIEQSGHGTVTIGSVERYLTDKAWEMGWVKPLAAGPARGQSVGIVGAGPAGLAAAEKLREAGYDVTVYDRHDRAGGLLIYGIPGFKLEKDVVERRTQRLADGGVVFKLGFEVGKDATLEDLRAQHDAVLIAVGVYAARDLTVPGGGSKGVVPALDYLITSNRLSLGDSVPAYDSGELNAEGKDVVVVGGGDTAMDCVRTAIRQGAKSVTCLYRRDKANMPGSMREVANAEEEGVTFEWLAAPRALSGEAEAVTGVRAIRMRLGAPDASGRQSPEEIPGGDFDRPAQLVVKALGFEPENLPEQWSAPDLKVTRWGTVKADVRNQMTNLDGVFAAGDIVRGASLVVWAIKDGRDAADAIHRYLLAKASSTLIAAE

SEQ ID NO: 4375 - DNA, 1425 bp, Pyrococcus abyssi
  CDS (1)..(1425)
atgcccaagcttattaaggagcgtgttcctactcctgagaggtctgttgaggaaaggattagagattttaatgaggttaatcttggctatacttgggagttggctcttagggaggccgagcgttgtttacaatgtccaaaggagtacgccccgtgtattaaaggctgcccagtaaacatagacattcctgggtttattagggctttaagggagaatagagatgacccagacaaagcagtaagagaagctttaaaaataatatgggactcaaactccctcccggcaattactggtagggtttgtcctcaagaagaccaatgtgagggtgtttgcgttgtggggaaagtcggtgacccagtaaacataggaaaactcgaaagattcgtagcggattatgcaagacaacatggaatcgaagatgaactacttgaagagcaaatcaggggtattaagaggaatgggaagagggttgctgttattggtgctgggcccgctggtttaacttgtgccgccgaattggcgaagatgggttacgaagtgacaatcttcgaagccctccatgaaccaggaggagtcctagcctacggaatcccagaatttaggcttccaaaagagatagtgaagaaagaagttgagaagttgaagaggctaggggttaaaatagaaaccaacgttctcgtaggaaagacggtgacctttgaggaactaagagaggagttcgacgctatattcataggaaccggagccggaactcctaggatatatccatggccaggagttaacttaaacggtatttattcggctaatgagtttctaactagaataaacctgatgaaagcttacaagttcccagagtatgacacacccataaagattgggaagagagtggctgtaataggtgcaggaaacactgcaatggatgccgcaaggtcagccctaaggttaggagcggaggtttggatcctatatagaagaacaaggaaagagatgacagctagggaggaagaaatcaaacatgctgaggaagaaggagtcaaattcatgttcctagtttcaccaaagagattcatcggagatgaaaacggaaaccttaaggcgatagagctagaaaagatgaaacttggagagccggatgagactggaaggagaagaccgataccaactggagagacgtttgtcatggagttcgatacagcgataatagcgatagggcagactccgaacaagacattcctccagacggttccagagttgaaagtggacgagaagggaaggataatagttgatgagaatttgatgacttctattcctggggtttttgctggtggtgacgctattaggggtgaagctaccgtaatcttggcaatgggagacggaagaaaagcagcaaaagcaatacacaagtacctttcctcttcctcttaa

SEQ ID NO: 4376 - protein, 474 aa, Pyrococcus abyssi
MPKLIKERVPTPERSVEERIRDFNEVNLGYTWELALREAERCLQCPKEYAPCIKGCPVNIDIPGFIRALRENRDDPDKAVREALKIIWDSNSLPAITGRVCPQEDQCEGVCVVGKVGDPVNIGKLERFVADYARQHGIEDELLEEQIRGIKRNGKRVAVIGAGPAGLTCAAELAKMGYEVTIFEALHEPGGVLAYGIPEFRLPKEIVKKEVEKLKRLGVKIETNVLVGKTVTFEELREEFDAIFIGTGAGTPRIYPWPGVNLNGIYSANEFLTRINLMKAYKFPEYDTPIKIGKRVAVIGAGNTAMDAARSALRLGAEVWILYRRTRKEMTAREEEIKHAEEEGVKFMFLVSPKRFIGDENGNLKAIELEKMKLGEPDETGRRRPIPTGETFVMEFDTAIIAIGQTPNKTFLQTVPELKVDEKGRIIVDENLMTSIPGVFAGGDAIRGEATVILAMGDGRKAAKAIHKYLSSSS

SEQ ID NO: 4377 - DNA, 1440 bp, Lactococcus lactis subsp. lactis
  CDS (1)..(1440)
atggctgatccaaatggatttttaaattatccaagaaatgataatccttaccgtgaattagcggagcggataaaggattttgctgaactgcaagttcccttatctactgaagaacgacaaaaacaagcggcacgttgtatgcattgtgatgttcctttttgccatcaagggatattttatgggggcaaacgggctgtctcaggttgtccaaatgataatcatattccagagtggaatgatttgatttatcgaggactacaaagaaaagcctatgaacgtttgattttaaccaatccttttccagagtttactggcagagtctgtcctgctccttgtgaaaaatcttgtgccgaggccttaaacggtgcaggagtaaccattaaagataatgaacgtttcttgggtgatttaggaaatgatgaaggttgggtggctgaaattggcaaagctgcggagccgacaggttataaaatagcgattattgggtctggacctgccggtctgtcagctgcttggcgtcttaatcaattgggacatagcgttactgtttttgaaaaatcagatcgtttgggcggcttattgatgtacggcattccaaatatgaaattggataaaaaagtcgttcaaaaacgaattgatttaatgacagaacttggtgtgacttttgtcaccaatactgagattggaaagacaatcagttacgaagacctgtcagtaaattttgatagaattattttggcgattggcgcaggaattccacgtgatttaaatatttcaggccgtgaagcagttggaattcgatttgccattgattttctgacagaaacgactaaaactgtccttgaagagggcgaagataatattagtcaatcattaaaaggaaaaaaagtagtagtcattggtggtggagatacagggaacgattgtatcggaacggcagttcgtttaggagcagcttcggtttctcaattagaaatcacaccaagtttacccactgatcgtttagataacaacccttggcctgagtggccaatgaccttgagagcaggttatgggcaaaaagaagcagaatttgtgggaaatactgatttgataacctatcaaatgactgcaacagcttttcaaacaaatgctgaaggtcaacttacgggtttaaaagtagccaaagttggacctgacttcaaggcattagaagggactgaacaagtaattgaagcggatttagtcttacttgctatgggatttgttgggactgacacaggattactggataaatttggtattcaagaaatttatgatgactatcgaacaaataatgacaaagttctagttgcaggcgatgccagacgaggtccatctttggttatttgggcaatccgtgaaggaagaaaaacagccgaaattgttgatgaacaattaataaaagtcgctacagcataa

SEQ ID NO: 4378 - protein, 479 aa, Lactococcus lactis subsp. lactis
MADPNGFLNYPRNDNPYRELAERIKDFAELQVPLSTEERQKQAARCMHCDVPFCHQGIFYGGKRAVSGCPNDNHIPEWNDLIYRGLQRKAYERLILTNPFPEFTGRVCPAPCEKSCAEALNGAGVTIKDNERFLGDLGNDEGWVAEIGKAAEPTGYKIAIIGSGPAGLSAAWRLNQLGHSVTVFEKSDRLGGLLMYGIPNMKLDKKVVQKRIDLMTELGVTFVTNTEIGKTISYEDLSVNFDRIILAIGAGIPRDLNISGREAVGIRFAIDFLTETTKTVLEEGEDNISQSLKGKKVVVIGGGDTGNDCIGTAVRLGAASVSQLEITPSLPTDRLDNNPWPEWPMTLRAGYGQKEAEFVGNTDLITYQMTATAFQTNAEGQLTGLKVAKVGPDFKALEGTEQVIEADLVLLAMGFVGTDTGLLDKFGIQEIYDDYRTNNDKVLVAGDARRGPSLVIWAIREGRKTAEIVDEQLIKVATA

SEQ ID NO: 4379 - DNA, 1440 bp, Clostridium acetobutylicum
  CDS (1)..(1440)
atgggaaaggtaactggatttaaagaatacgatagagaagagtcgccatctcgtccaatcgatgagagaataaaggactacaaagatgttcatatgggacttgacaaggaaaagctgaaaattcaaggtgcaagatgtatggaatgtggtactccattttgttcatggggctgccctcttggaaatttaatgcctgactttaatgacatggtatataaaggtgagtggaaaaaggcttatgaaaggatatctttgacaagctgtttccctgaattcacaggacgtatttgtccagctttatgtgaaggttcgtgtacattaagttacaattctgatgctgtttcaataaaagaaattgaacttggaattatagaggaagcctttaaaaatggatgggtaaagcctaagattccaaaggttagaacaggcaaaagaattgcagtaataggatcaggcccagcaggactttcggcagcagaagaacttaattctgttggacacagcgtggtggtatttgaaagagctgataaggtaggaggacttttaagatacggcattcctgattttaaacttgaaaagcatgtaatagatagaagaattgacgttatggaaaagtctggaatagagtttaaaacctctactaatgtaggttttgatgtgagtgcagaagaattacttaatgattttgatgtagttcttcttacaggaggctctaccatacctagagatttaaaagttgaaggaagagagaatattaaaggggtgcattttgctgttgattacttaaaacagcagaatatgagaaatgctggaatggaaattaaagaagaggaaataactgcaaaggataaagttgttgtggtaattggaggaggagatactggttcagactgtattggtactgcaataaggcagggtgctaaaaaggtatatcagtacgagataatggataaacctccagctcaaagggatgaaactatgccttggcctttatttcctagagtgtttaaaaccactacatctcatgaagagggctgtgaaagattattcggtgtttcaactaaaaagctagaaggaaaagacggtaagcttgaactccttaaaggtgtacaagttaagtgggaaaaagatgaaaatggaaaaatgtccatgaaagagatagagggctcagagtttgaaaagaaggtggatttgatacttattgctatgggatttgtacatcctcagcataagggtatagttgaagatttacagctgaaattagattctagaggaaatgtttttactgatgaaaactttatgacaagccgagaaaatgtttttgcagcaggggatatgagaagaggtcaatcacttgtagtatgggctatgcatgagggaagacaatcagcaaaagaaatagataaataccttatgggagaaacttctcttagaggatag

SEQ ID NO: 4380 - protein, 479 aa, Clostridium acetobutylicum
MGKVTGFKEYDREESPSRPIDERIKDYKDVHMGLDKEKLKIQGARCMECGTPFCSWGCPLGNLMPDFNDMVYKGEWKKAYERISLTSCFPEFTGRICPALCEGSCTLSYNSDAVSIKEIELGIIEEAFKNGWVKPKIPKVRTGKRIAVIGSGPAGLSAAEELNSVGHSVVVFERADKVGGLLRYGIPDFKLEKHVIDRRIDVMEKSGIEFKTSTNVGFDVSAEELLNDFDVVLLTGGSTIPRDLKVEGRENIKGVHFAVDYLKQQNMRNAGMEIKEEEITAKDKVVVVIGGGDTGSDCIGTAIRQGAKKVYQYEIMDKPPAQRDETMPWPLFPRVFKTTTSHEEGCERLFGVSTKKLEGKDGKLELLKGVQVKWEKDENGKMSMKEIEGSEFEKKVDLILIAMGFVHPQHKGIVEDLQLKLDSRGNVFTDENFMTSRENVFAAGDMRRGQSLVVWAMHEGRQSAKEIDKYLMGETSLRG

SEQ ID NO: 4381 - DNA, 3099 bp, Escherichia coli
  CDS (1)..(3099)
atgggggatattatgcgtcccattccgtttgaggaacttttgacgcgcatatttgatgaataccaacaacaacgctcaatctttggtattcccgagcaacagttttactcacctgtaaaaggtaaaactgttagcgtcttcggtgaaacctgtgccactcccgtcggccctgccgctggcccgcacacgcagctcgcgcaaaatattgtcacttcctggctgactggcggacgcttcatcgaactaaaaaccgtccaaattcttgaccgcctggagctggaaaagccctgtatcgatgccgaagacgagtgctttaacaccgaatggtctaccgagtttaccctgcttaaagcctgggatgaatacctcaaagcctggtttgccctgcaccttctcgaagcgatgttccagccttctgattccggtaaatcgttcatctttaatatgagcgtcggttacaacctcgaaggtattaagcaaccgccgatgcaacagttcatcgacaatatgatggacgcatctgaccatccgaaattcgctcaatatcgcgatacgctgaataaattactccaggatgacgcatttttagctcgccacggattgcaggaaaaacgcgaaagcttgcaagccttacccgctcgcatccccaccagtatggtgcatggcgtcaccctctccaccatgcacggctgtcctccgcatgaaatcgaagccatttgccgctacatgctggaagaaaaagggctcaacacctttgtgaaacttaacccgaccttactggggtacgcgcgtgttcgtgagatcctcgatgtctgcggtttcggttacataggcttaaaagaagagtcatttgatcacgacctcaagctgacgcaagcactggaaatgctggaacgcctgatggcactggcaaaagaaaaatcactcggctttggcgtaaaactgactaacactctcggcaccatcaacaataaaggcgcactgcctggtgaagagatgtatatgtcaggccgtgcgctgttcccgctctccatcaatgttgcagcagttctctctcgcgcctttgacggcaaactgcccatttcttattccggtggtgccagtcagctgactatccgcgatatttttgatacaggtattcgccctattactatggcaaccgacctgctgaaacctggcggctatctgcgcttaagtgcctgcatgcgcgagctggaaggctccgacgcctggggacttgaccatgttgacgtcgaacgactgaacagactggcagcagatgcgttaaccatggaatacacccagaaacactggaagccagaagagcgtattgaagtggcagaagacctgccgctgaccgactgctacgttgccccctgtgttactgcctgcgctatcaagcaagatattccggaatacatccgtctgcttggcgaacaccgctatgccgacgcgctggaactcatctaccaacgcaacgctctgcccgccattaccggtcatatttgcgatcaccagtgccaatacaactgtacccgcctggattacgacagtgcgctgaatatccgcgaactgaaaaaagtcgcgctggaaaaaggttgggatgaatataagcaacgctggcacaaaccagccggttctggttcacgccatccggttgccgtgattggtgcaggtccggcgggtctggcagcaggttacttccttgccagagcgggccatccggttacgctgtttgaacgcgaagccaatgcgggcggcgtggtgaaaaatatcattcctcagttccgtattcctgcagagttaattcagcacgatatcgattttgttgccgctcacggcgtgaaatttgagtatggctgctcacccgatttaaccattgagcagttaaaaaatcagggcttccactatgttctgattgccaccggcactgataaaaatagcggtgtgaaactggcgggcgacaaccaaaatgtctggaaatcactccccttcctgcgtgaatacaacaagggtacagcgctcaagctgggcaaacatgtggtcgttgtcggggcgggtaacaccgcaatggactgcgctcgtgcggcgttacgcgttccaggcgtagaaaaagcaacgatcgtttaccgtcgttcactacaagagatgcccgcatggcgcgaagagtatgaagaagcgttgcacgacggcgtagagttccgtttcctgaataatccggaacgtttcgatgctgatggcaccttaaccttgcgcgttatgtcgcttggcgaaccggatgagaaaggtcgtcgtcgtccggttgaaaccaatgaaacagtaacactgcttgtagacagcctgatcaccgccattggtgaacagcaggatactgaagccctgaatgcgatgggcgtgccgctggacaaaaacggctggccagacgtcgaccataatggcgaaactcgtctgactgacgtctttatgatcggcgacgtacagcgcggaccatcctccattgtcgctgctgtcggaaccgcgcgtcgggcgaccgatgccatccttagtcgggaaaatatccgttcccaccagaacgataaatactggaacaacgtcaatccagcggaaatctatcaacgtaaaggcgatatctctatcacgctggtgaacagtgacgatcgtgacgcgtttgtcgcccaggaagccgctcgctgcctcgaatgtaactacgtttgcagcaagtgtgtggatgtctgcccgaaccgcgccaacgtctccattgcggtcccaggcttccagaaccgtttccagacgctgcacctcgacgcttactgtaacgaatgcggcaactgcgctcagttctgtccgtggaacggtaaaccgtacaaagacaaaatcaccgtcttcagcctggcgcaagactttgataacagcagcaacccaggcttccttgtggaagattgccgggtacgagtacgtctgaataaccaaagctgggtgttaaacatcgacagcaaaggtcagtttaacaacgtaccaccggagctgaacgatatgtgccgcatcatcagccatgtccaccagcatcatcattatctgctgggccgcgtggaggtgtaa

SEQ ID NO: 4382 - protein, 1032 aa, Escherichia coli
MGDIMRPIPFEELLTRIFDEYQQQRSIFGIPEQQFYSPVKGKTVSVFGETCATPVGPAAGPHTQLAQNIVTSWLTGGRFIELKTVQILDRLELEKPCIDAEDECFNTEWSTEFTLLKAWDEYLKAWFALHLLEAMFQPSDSGKSFIFNMSVGYNLEGIKQPPMQQFIDNMMDASDHPKFAQYRDTLNKLLQDDAFLARHGLQEKRESLQALPARIPTSMVHGVTLSTMHGCPPHEIEAICRYMLEEKGLNTFVKLNPTLLGYARVREILDVCGFGYIGLKEESFDHDLKLTQALEMLERLMALAKEKSLGFGVKLTNTLGTINNKGALPGEEMYMSGRALFPLSINVAAVLSRAFDGKLPISYSGGASQLTIRDIFDTGIRPITMATDLLKPGGYLRLSACMRELEGSDAWGLDHVDVERLNRLAADALTMEYTQKHWKPEERIEVAEDLPLTDCYVAPCVTACAIKQDIPEYIRLLGEHRYADALELIYQRNALPAITGHICDHQCQYNCTRLDYDSALNIRELKKVALEKGWDEYKQRWHKPAGSGSRHPVAVIGAGPAGLAAGYFLARAGHPVTLFEREANAGGVVKNIIPQFRIPAELIQHDIDFVAAHGVKFEYGCSPDLTIEQLKNQGFHYVLIATGTDKNSGVKLAGDNQNVWKSLPFLREYNKGTALKLGKHVVVVGAGNTAMDCARAALRVPGVEKATIVYRRSLQEMPAWREEYEEALHDGVEFRFLNNPERFDADGTLTLRVMSLGEPDEKGRRRPVETNETVTLLVDSLITAIGEQQDTEALNAMGVPLDKNGWPDVDHNGETRLTDVFMIGDVQRGPSSIVAAVGTARRATDAILSRENIRSHQNDKYWNNVNPAEIYQRKGDISITLVNSDDRDAFVAQEAARCLECNYVCSKCVDVCPNRANVSIAVPGFQNRFQTLHLDAYCNECGNCAQFCPWNGKPYKDKITVFSLAQDFDNSSNPGFLVEDCRVRVRLNNQSWVLNIDSKGQFNNVPPELNDMCRIISHVHQHHHYLLGRVEV

SEQ ID NO: 4383 - DNA, 1470 bp, Vibrio cholerae
  CDS (1)..(1470)
atgggtaaagcaaccggatttttagaatttggtcgtgaactgccgaaaaaaatcgacccggcagagcgcatcaaaaacaacaaagagtttgtccttaaccaagagtttggtaagaagatcaatcagcaagcttcacgttgtatggattgtggcgtgccgttttgtcataacggctgcccgattggcaacatcattcccgagtttaacgatgcagtgtatcgcgacagttgggaagaggcttggaatattctgagctcgaccaacaacttcccagagtttaccggtcgtgtctgccctgcaccttgtgaaaccgcctgtgtgcttggcatcaaccaagatccgatcaccatctgtaacattgaaaaaaccattgtggaacgtgcttaccaagaaggctatgccaagccgaaaacgccacgttcacgcaccggaaaaacggtcgcgatcattggctcaggccctgcggggctggccgcggcggagcagttgaatgccgcgggtcatagcgtcaccgtgtttgagcgggatgaaaaagtcggcggcttgctgcgctttggcattcccgatttcaaactcggtatggatgtgattgatcgcaaaatcaatctgatggaacaagcgggcgttaagttcgtggtcaatgcgcatatcggtgtagacatcaacgctcaacagttgcgtcaggagtttgatgcggtattgctgacgggcggctcaaccgtaccacgtgatctgagcattcccggacgtgatctgaaaggcgtttacttcgcgatgcagttcctcgcgcaaaataaccgccgagccaatggcatggatctgaaaggtgaagagatccacgctaaaggcaaacatgtggtagtgatcggaggcggcgatactggctccgactgtgtcggcacctctaaccgccacggcgctgcgagtatcactcaagtggagatcatgccgatcccaccgcaaaagcgcccagtgaatatgccttggccgcaatatccgatgattctgcgcacctctacctctcatgaagaaggctgtgagcgtcattggaacatcctcaccaaagagttcattggtaatgaacaaggtgaagtgacgggtctacgcatcgctgacatcgtttggaaagatgcagcccccggtgagcgaccaagctttgacgaagtggtgggcagtgaacgcgtcattccttgtgatatggcatttctggcgatgggcttcttgcatccagagccacacggcgtgcttgctcagttggggattaagcttgatgagcgcggcaatgtggcgacgcaagattttgcgaccaaccaaaaaggcgtattcgccgcaggtgatatgcgcacaggccaatccttggtggtgcgctgtatcaacgaaggtcgcgaatgtgcgcgagccgttgacaccttcttgatgggcaatacccatcttgaggcaaaagcggactcactcatgctgtcagcataa

SEQ ID NO: 4384 - protein, 489 aa, Vibrio cholerae
MGKATGFLEFGRELPKKIDPAERIKNNKEFVLNQEFGKKINQQASRCMDCGVPFCHNGCPIGNIIPEFNDAVYRDSWEEAWNILSSTNNFPEFTGRVCPAPCETACVLGINQDPITICNIEKTIVERAYQEGYAKPKTPRSRTGKTVAIIGSGPAGLAAAEQLNAAGHSVTVFERDEKVGGLLRFGIPDFKLGMDVIDRKINLMEQAGVKFVVNAHIGVDINAQQLRQEFDAVLLTGGSTVPRDLSIPGRDLKGVYFAMQFLAQNNRRANGMDLKGEEIHAKGKHVVVIGGGDTGSDCVGTSNRHGAASITQVEIMPIPPQKRPVNMPWPQYPMILRTSTSHEEGCERHWNILTKEFIGNEQGEVTGLRIADIVWKDAAPGERPSFDEVVGSERVIPCDMAFLAMGFLHPEPHGVLAQLGIKLDERGNVATQDFATNQKGVFAAGDMRTGQSLVVRCINEGRECARAVDTFLMGNTHLEAKADSLMLSA

SEQ ID NO: 4385 - DNA, 1467 bp, Mycobacterium leprae
  CDS (1)..(1467)
atggctgatccggctggctttttgaaatacacacagcgagaattaccgaggcgacggcctgtcccgctacggctgcgtgactggaaggaattatacgaggaattcgataaagagactttgcggaatcaggcgtcccgttgcatggactgcggtattcctttctgtcacaatgggtgtcctttgggaaatttgatcccggaatggaatgacttggtgcgtcgcggccgttggcacgatgcggttgaacgtctgcacgccacaaacaattttcccgatgtcactggccggctatgtccggcgccatgcgagtcggcgtgtgtgctcggcattaaccaggatccggtgacgatcaagcagatcgagctagagatcatcgacaaggccttcgacgaaggttgggtgcaaccactgccgccgcagcagttgaccggtaagacggttgccgtggtgggttcggggccagctggacttgctgctgcccaacaactcacccgtgcgggtcatcgcgtgacggtcttcgaacgcgacgatcgcatcggcgggttgctgcggtatggcatcccggaattcaagatggaaaagcgcttcctggagcggaggctagaccagttgcgggctgaaggcaccgaattccggtctggcgtcaacgtcggagttgacatcactgccgatcagctgtgcgctgattttgatgcggtcgtgctggccggcggcgcggccacttggcgcgaactgcccattccgggacgtgagttagatggcgttcaccaggcgatggagttcctgccctgggtcaaccgtgtccaggagggagatgacgtcctcggagacgacgggcagccgcctatcactgctaaggacaaaaaggtggtcatcatcggtggtggcgacaccggggcagactgcttgggcgcggtgcaccggcaaggtgcgatccacgtgcaccagctcgagataatgccgcgtccgccggatgcccgcgctgcatccacgccgtggccaacttacccactgatgtatcgggtatcgccggcccacgaagaaggtggcgagcgggtgttctcagttaacaccgaggagttcgtcggcaagaacgggcgggtgcacgcgctcaaggctcatgaagtgacgatgcaagacggccggtttgtcaaggttgagaactccgttttcgagctcgaggccgatctagtgttgctggcgatgggattcgttggtccggaaaagccgggcctgctcaccgacctgggtgtgaagttcaccgaccgcggcaacgtcgcacgtggcgccgactttgatacttcggttcctggtgttttcgttgcgggcgacatgggacgtggccagtcgttgatcgtttgggcgattgctgagggtcgggctgccgcggcggctgtggatcgatttttgatgggcgcaaccgcgttgccggcacccgtcaagccgtcgtctttaccacttcagtag

SEQ ID NO: 4386 - protein, 488 aa, Mycobacterium leprae
MADPAGFLKYTQRELPRRRPVPLRLRDWKELYEEFDKETLRNQASRCMDCGIPFCHNGCPLGNLIPEWNDLVRRGRWHDAVERLHATNNFPDVTGRLCPAPCESACVLGINQDPVTIKQIELEIIDKAFDEGWVQPLPPQQLTGKTVAVVGSGPAGLAAAQQLTRAGHRVTVFERDDRIGGLLRYGIPEFKMEKRFLERRLDQLRAEGTEFRSGVNVGVDITADQLCADFDAVVLAGGAATWRELPIPGRELDGVHQAMEFLPWVNRVQEGDDVLGDDGQPPITAKDKKVVIIGGGDTGADCLGAVHRQGAIHVHQLEIMPRPPDARAASTPWPTYPLMYRVSPAHEEGGERVFSVNTEEFVGKNGRVHALKAHEVTMQDGRFVKVENSVFELEADLVLLAMGFVGPEKPGLLTDLGVKFTDRGNVARGADFDTSVPGVFVAGDMGRGQSLIVWAIAEGRAAAAAVDRFLMGATALPAPVKPSSLPLQ

SEQ ID NO: 4387 - DNA, 1935 bp, Escherichia coli
  CDS (1)..(1935)
atgaaagggatgcaaatgaataagtttattgctgctgaagctgcggaatgtataggctgtcatgcttgtgaaattgcctgtgcggtggcacacaatcaagaaaactggccgctgagtcacagtgactttcgaccgcgtatccacgttgtagggaaaggccaggctgcgaatccggtggcctgccatcactgcaacaatgccccttgcgttacggcttgtccggttaatgctctgactttccagtccgatagcgtacaactggacgagcaaaaatgtattggttgtaaaagatgcgcaatcgcttgcccctttggcgtcgttgagatggtcgatacgattgcgcagaaatgcgacctttgtaaccagcgcagttccggcacgcaagcctgtattgaagtttgcccaacacaggcgttacgactgatggacgataaagggttgcagcagataaaggtggcccgccagcgcaaaacggcagcaggaaaagcgtcatcagacgctcagccatctcgcagtgcagcgttgctccccgttaactcgcgtaaaggcgcagataaaatttcagcgagtgaacggaaaacccactttggcgaaatatattgcgggctggatccacaacaagcgacttatgagagtgaccgctgtgtttattgtgccgaaaaagctaactgcaactggcattgcccgctgcataacgctattccggattacatccgtctggtacaggaaggaaagattattgaagcggcagaactttgccaccagaccagttccttaccagaaatttgcggcagggtatgtccacaggaccgtctttgtgaaggcgcatgtactttgaaagatcactcgggcgcagtctctatcggtaatctggaacgctacatcaccgataccgcgctggcgatgggctggcgtcccgatgtcagcaaagttgttccccgtagcgaaaaagtggcggtgattggcgctgggcctgcagggttagggtgtgctgatattctggcgcgcgcaggagttcaggtcgatgtctttgatcgccatccagaaattggcggtatgctgacttttggcattcctcctttcaaactcgataaaacggtattaagccagcggcgagagatattcaccgcaatgggaatcgactttcatcttaactgtgaaattggccgcgatattacctttagcgatttaacttctgaatatgatgcagttttcatcggcgtggggacttacgggatgatgcgagcagatctgccgcatgaagatgcgcccggtgtcattcaggctctaccgttcctgactgcccatacccgccagctcatgggattgccggagtctgaagagtatccgctgacggacgtggaaggtaagcgagtcgtggtattgggcggtggcgatacgacaatggattgtttgcggacttccatccgcctcaatgccgccagcgtgacctgcgcgtatcgtcgtgatgaagtcagtatgccgggctcgcgcaaagaggtggttaatgcgcgcgaggaaggtgtcgagtttcagttcaatgttcaaccgcaatatatcgcttgtgacgaagatgggcgtttaactgcggtgggcctgattcgtaccgccatgggtgagccggggccggatggtcgccgtcgtcctcgtccggtagcgggttcagagtttgaattgcccgccgatgttctgattatggcctttggtttccaggcgcatgccatgccgtggttgcagggcagcggaattaaactcgataaatggggcctgattcaaaccggtgacgtcgggtatttacctacccagacgcatctgaaaaaagtctttgctggtggtgatgcagttcatggcgcggatctggttgtcactgcaatggccgcaggaaggcaggcggcgcgcgatatgttaactctgtttgatacgaaggcatcgtga

SEQ ID NO: 4388 - protein, 644 aa, Escherichia coli
MKGMQMNKFIAAEAAECIGCHACEIACAVAHNQENWPLSHSDFRPRIHVVGKGQAANPVACHHCNNAPCVTACPVNALTFQSDSVQLDEQKCIGCKRCAIACPFGVVEMVDTIAQKCDLCNQRSSGTQACIEVCPTQALRLMDDKGLQQIKVARQRKTAAGKASSDAQPSRSAALLPVNSRKGADKISASERKTHFGEIYCGLDPQQATYESDRCVYCAEKANCNWHCPLHNAIPDYIRLVQEGKIIEAAELCHQTSSLPEICGRVCPQDRLCEGACTLKDHSGAVSIGNLERYITDTALAMGWRPDVSKVVPRSEKVAVIGAGPAGLGCADILARAGVQVDVFDRHPEIGGMLTFGIPPFKLDKTVLSQRREIFTAMGIDFHLNCEIGRDITFSDLTSEYDAVFIGVGTYGMMRADLPHEDAPGVIQALPFLTAHTRQLMGLPESEEYPLTDVEGKRVVVLGGGDTTMDCLRTSIRLNAASVTCAYRRDEVSMPGSRKEVVNAREEGVEFQFNVQPQYIACDEDGRLTAVGLIRTAMGEPGPDGRRRPRPVAGSEFELPADVLIMAFGFQAHAMPWLQGSGIKLDKWGLIQTGDVGYLPTQTHLKKVFAGGDAVHGADLVVTAMAAGRQAARDMLTLFDTKAS

SEQ ID NO: 4389 - DNA, 1857 bp, Thermotoga maritima
  CDS (1)..(1857)
atgagaaaaatggcagtccagaagctaccagaaaaggatttctttgctcctctgaaggcatggaaatttcttgtcagaaaaccggttacaatagaggttccaaacaaaatcaggagagaagcttcggaaagatacagaggattccacgtgaacgactggggaaagtgcatagggtgcggtacatgcgcaaagatctgcccaaccgatgccataaccatggtggaggtcccggatctcactcaagaagatggaaaacttccgcaaagacccgtcatagattacggcaggtgttctttctgtgcgctctgcgttgacatctgcacaacgggttcactcaagatgacgagggaatacatccacatctcggaagatccggaagacttcatctttatgccaacggataagggattgaacgcgaaaaaaggtctctacgaatttggaaaggcacccctcggctgggtgagggatgagaactctgagctgctcgatctcgaaagaatagaaatgcccgtggaaccaccggaagtcaggatcaaatctttcatagaaatcgtgaaaggatacagtagagaacaggccatgcaggaggccgccaggtgtgtggagtgcggtgtgtgtacctacacctgtcccgaacacatggacataccccagtacataaaatccgtgtacgaggacaatctggaagaaggactgagatggctctacagaacgaatcctctctcaatggtctgtggaagggtctgtactcacaggtgtgaaaccgcctgttctgtgggagtcagaggagaacccgttgcgattcagtggttgaaaaggtacatagtggacagcattcctctcgagagatacggagagatcctggacataaaaccggagagaaaaggaaagagtgtgggaatcataggatcgggtcccgctgggctcgccgcagcctactttcttgccaccatgggatacgatgttaccatatacgaatcggaatcaaaacctggtggtgtgatgaggtacggtattccaaaataccgacttcccgatgaagcgctggacaaggatatcgcattcatcgaggcgctcggggtgaaaattctactcaacacgagagtcgtccaggatgtgtctttcgaagatgtcagaaagagacacgatgttgtctttcttgcaacaggcttcggtcttggaaggtcaacgggtgttccggggaccgatcacccagatgtgaaacaggcactccccttgctcaagatgataagggactacctgaggggagatggtccaaagccaccggtcccagagagactcgttgtcatcggtggaggaaacgtcgcgatggatatctccaggtcgatggcaagacttcagttcatggagtacggaagggtgaacgttcaggtgctttcacttgaaggatgcttcgaggacatgccggctgatatggaagaaatagaagaggctctcgaagagggtatcgtcataaatccaggatggggaccgatggaagtcgtgatagagaacgacaggataaaaggtgtgaaattcaaaaaatgtgtcagtgtgttcgacggcgaaggacggttcaatccacagtttgacgaaaaagaacaaatctttgtagaagcggacatggtcgtagaagcgattggacaggcaccagattattcctacttacccgaagaaatacgaagcaaactcgaatttttcagaggaagaatcaaaacaaacgagtacaatcagacctctgtggaatggttgtttgcaggaggagacatcgttcacggaccggatatcattcacggtattgcagatggatacgccgcggcaaaagggatagacatgtacctgagaaaggaaaaatga

SEQ ID NO: 4390 - protein, 618 aa, Thermotoga maritima
MRKMAVQKLPEKDFFAPLKAWKFLVRKPVTIEVPNKIRREASERYRGFHVNDWGKCIGCGTCAKICPTDAITMVEVPDLTQEDGKLPQRPVIDYGRCSFCALCVDICTTGSLKMTREYIHISEDPEDFIFMPTDKGLNAKKGLYEFGKAPLGWVRDENSELLDLERIEMPVEPPEVRIKSFIEIVKGYSREQAMQEAARCVECGVCTYTCPEHMDIPQYIKSVYEDNLEEGLRWLYRTNPLSMVCGRVCTHRCETACSVGVRGEPVAIQWLKRYIVDSIPLERYGEILDIKPERKGKSVGIIGSGPAGLAAAYFLATMGYDVTIYESESKPGGVMRYGIPKYRLPDEALDKDIAFIEALGVKILLNTRVVQDVSFEDVRKRHDVVFLATGFGLGRSTGVPGTDHPDVKQALPLLKMIRDYLRGDGPKPPVPERLVVIGGGNVAMDISRSMARLQFMEYGRVNVQVLSLEGCFEDMPADMEEIEEALEEGIVINPGWGPMEVVIENDRIKGVKFKKCVSVFDGEGRFNPQFDEKEQIFVEADMVVEAIGQAPDYSYLPEEIRSKLEFFRGRIKTNEYNQTSVEWLFAGGDIVHGPDIIHGIADGYAAAKGIDMYLRKEK

SEQ ID NO: 4391 - DNA, 1416 bp, Vibrio cholerae
  CDS (1)..(1416)
atgatgagccaaaacgtttaccaatttatcgatgtcaatcgtgtggatccggccaaaaaaccgctgcacatccgcaaaattgagtttgtcgaaatttacgagccctttactaagcaacaagccactgcgcaggccgatcgctgcctcgattgtggtaacccttactgtgaatggaagtgcccagtacacaactacattccgcagtggttaaagctcgccaatgaaggacgcatcctcgaagcggccgatttggcgcaccagaccaacagcctgcctgaagtgtgtggccgagtttgcccgcaagataggctgtgcgaaggttcatgtaccttgaatgcggatttcggtgccgtcaccattggcaacatcgaaaaatacattacggataccgccttcgaaatgggctggaaacccgacatgtccaacgtggtctggaccgacaaaaaagtcgcgatcatcggcgcgggcccagctggtcttgccgccgcggacattctggttcgcaacggtgtacgacctgtcgtgtttgatcgctatcccgaaatcggcggtctgctcacctttggcattccctcattcaaacttgaaaaaggggtgatggaaaatcgtcgccgcatttttagcgagatgggtatcgagtttcgtctcaatgtcgaagtcggccaagacatcacactgcaacaactgctggatgagtacgatgcggtttttctcggcgtcggcacttatcaatatatgcgtgctggcttagccaacgaagacgcccccggcgtttatgatgcactgccgtttttgatctccaacacctataaagtgatggaacttaacaacgaggcgccattcattgatatggcaggaaaaaatgtcgtagtgctcggcggtggtgatacggcgatggactgcgtgcgcacctcgattcgccaaggcgcatctcgcgtgatttgtgcttatcgccgtgacgaagaaaacatgcccggctcacgccgtgaagtgaaaaacgccaaagaagaaggcgttgaatttatgtttaacttgcagccgctgggaattgaagtgaatgcccaaggccaagtgactggcgtgaaagtggtcaaaaccgcgcttggagaaccggatgcggcaggtcgtcgcaaacctgaaccggtcgcaggcagcgagcacgtcttgcctgccgatgccgtcatcatggcgtttggtttccaaccgcacaaaatggcttggttagagccgtttgatgtcgagctcgatcagtggggacgcatcaaagcccctgccaagcagacttaccagtatcaaaccaccaatcccaagatttttgctggtggtgatgcggttcgcggctcggatctggtggtcacggccattgatgaaggacgcaaagctgccgagggaattctcgactatcttggagtctag

SEQ ID NO: 4392 - protein, 471 aa, Vibrio cholerae
MMSQNVYQFIDVNRVDPAKKPLHIRKIEFVEIYEPFTKQQATAQADRCLDCGNPYCEWKCPVHNYIPQWLKLANEGRILEAADLAHQTNSLPEVCGRVCPQDRLCEGSCTLNADFGAVTIGNIEKYITDTAFEMGWKPDMSNVVWTDKKVAIIGAGPAGLAAADILVRNGVRPVVFDRYPEIGGLLTFGIPSFKLEKGVMENRRRIFSEMGIEFRLNVEVGQDITLQQLLDEYDAVFLGVGTYQYMRAGLANEDAPGVYDALPFLISNTYKVMELNNEAPFIDMAGKNVVVLGGGDTAMDCVRTSIRQGASRVICAYRRDEENMPGSRREVKNAKEEGVEFMFNLQPLGIEVNAQGQVTGVKVVKTALGEPDAAGRRKPEPVAGSEHVLPADAVIMAFGFQPHKMAWLEPFDVELDQWGRIKAPAKQTYQYQTTNPKIFAGGDAVRGSDLVVTAIDEGRKAAEGILDYLGV

SEQ ID NO: 4393 - DNA, 1434 bp, Pseudomonas aeruginosa
  CDS (1)..(1434)
atgtctgaacgtctgaattccgaccgcctgaacaacgacttccagttcatcgaagtcgggcgcaaggacccgaagaagaagctgctgcgccagcgcaagcgcgagttcgtggagatccacgacctgttcaagccgcagcaggccgccgaccaggcccaccgctgcctgggctgcggcaacccgtactgcgagtggaaatgcccggtgcacaacttcatccctaactggctgaagctggtttccgaaggcaacatcctggccgccgccgaactgtcgcaccagaccaacaccctgccggaagtctgcggccgggtctgcccgcaggatcgcctctgcgagggcgcctgcaccctcaacgacggttttggcgcggtgaccatcggctcggtggagaagtacatcaccgatacggccttcgccatgggctggcgtccggacctgtccaaggtcaagccgaccggcaggcgcgtcgcggtgatcggcgccggcccggccggcctcggctgcgccgacgtgctggtgcgcaacggcgtgaccccggtggtgttcgaccgcaacccggagatcggcggcctgctgaccttcggcattcccgagttcaagctggagaagcacgtcctcagccgtcgccgcgaggtgttcaccggcatgggcatcgagtttcgcctgaacaccgagatcggcaaggacgtgaccatggagcagttgctcgatgagtacgatgccgtgttcatggggatgggcacctacacctacatgaagggcggtttccccggcgaggacctgccgggcgtacacgacgccctggacttcctgatcgccaacgtgaaccgcaacctcggcttcgagaagtcggccgaggacttcgtcgacatgaagggcaagcgcgtggtggtcctgggcggcggcgacaccgcgatggactgcaaccgcacttcgatccgccagggcgccaagtcggtgacctgtgcctatcgccgtgacgaagaaaacatgccgggctcgcgcaaggaagtgaagaacgccaaggaagagggcgtgaagttcctcttcaaccgccagcccatcgccatcgtcggcgaggaccgggtggaaggcgtgaaggtggtcgagacccgtctcggcgagccggacgcccgcggccgccgcagccccgaaccgatccccggttccgaggagatcatcccggcggaagccgtgctgatcgccttcggcttccggccgagtccggcgccgtggttcgagcgcttcgagatcgccaccgacagccagggccgcgtggtggctccggcgcaggcgcagttcaagcaccagaccagcaacccgaagatcttcgccggtggcgacatggtccgtggttccgacctggtggtgacggcgatcttcgaaggacgtaccgcggccgaaggcatcctcgactaccttggcgtctga

SEQ ID NO: 4394 - protein, 477 aa, Pseudomonas aeruginosa
MSERLNSDRLNNDFQFIEVGRKDPKKKLLRQRKREFVEIHDLFKPQQAADQAHRCLGCGNPYCEWKCPVHNFIPNWLKLVSEGNILAAAELSHQTNTLPEVCGRVCPQDRLCEGACTLNDGFGAVTIGSVEKYITDTAFAMGWRPDLSKVKPTGRRVAVIGAGPAGLGCADVLVRNGVTPVVFDRNPEIGGLLTFGIPEFKLEKHVLSRRREVFTGMGIEFRLNTEIGKDVTMEQLLDEYDAVFMGMGTYTYMKGGFPGEDLPGVHDALDFLIANVNRNLGFEKSAEDFVDMKGKRVVVLGGGDTAMDCNRTSIRQGAKSVTCAYRRDEENMPGSRKEVKNAKEEGVKFLFNRQPIAIVGEDRVEGVKVVETRLGEPDARGRRSPEPIPGSEEIIPAEAVLIAFGFRPSPAPWFERFEIATDSQGRVVAPAQAQFKHQTSNPKIFAGGDMVRGSDLVVTAIFEGRTAAEGILDYLGV

SEQ ID NO: 4395 - DNA, 1368 bp, Pseudomonas aeruginosa
  CDS (1)..(1368)
atgatcgattccctgaaccacctcccccgtccggacgccggcgcggacacgctcgccgagcgcttcgccgacctcgcgccgccgctcaacgcccgccaggccgccctggaaagcgcccgctgcctgtactgctacgacgcgccctgcgtcaacgcctgcccgaccgagatcgacatccccgggttcatccgcagcatcgcccaggagaatgtccagggcgcggcgcagaagatcctctcggcgaacatcctcggcggcagctgcgcccgcgtctgccccacggaaatcctctgccagcgggcctgcgtacgcaacaacgcccaggaatgcgcaccggtgctgatcggccagttgcaacgctacgccctcgaccacgccggcttcgacgaacatccgttcaagcgctcgccggccaccggcaagcgcatcgccgtggtcggcgccgggccggccgggctgtcctgcgcccaccgcctggccatgcacggccacgacgtggtgctcttcgaggcccgcaccaaggccggcggcctcaacgagtacggcatcgcccgctacaagctggtggacgacttcgcccggcgcgaagtggaattcctcctgcagatcggcggtatcgaactgcgccacggccagcgtctcggcgacaacctggcgctcggcgccctgcacgacgagtacgacgcggtgttcctcggcatcggcctggccgccagcaagcgcctcggcctggaagacgaggacgcccccggcctgctcgccgccaccgactacatccgcgaactgcggcagagcgacgacctgctcgacctgcccgtcgccgaccgttgcatcgtcatcggcgccggcaacaccgccatcgacatggcggtgcagatgagccggctcggcgcccgcgacgtcaacctggtctaccgccgtggcttcgaggaaatgggcgccaccggccatgagcaggagatcgccaaggccagccaggtgcgcctgctgacctgggcccgaccggaacgggtactgctcgacgagcacggccgggtgcgcggcatgcgcttcgcccgcacgcgcctggagaacggtcgcctgggcgacaccggcgagcacttcgaactggccgccgacgccatcttcaaggccatcggccaggccttcgaaggcgccagcctgggcgatccgctggcagcgcaactgcggcgcgacggcgagcgcatccaggtcgacggacagatgcgcaccagcatccccggcatctacgccggcggcgactgcgtggcgctcggcgaggacctcaccgtgcaggcggtgcagcacggcaaactggcggcggaagcgatccacgcccaactcatgctcaacgtggaggctgcgtga

SEQ ID NO: 4396 - protein, 455 aa, Pseudomonas aeruginosa
MIDSLNHLPRPDAGADTLAERFADLAPPLNARQAALESARCLYCYDAPCVNACPTEIDIPGFIRSIAQENVQGAAQKILSANILGGSCARVCPTEILCQRACVRNNAQECAPVLIGQLQRYALDHAGFDEHPFKRSPATGKRIAVVGAGPAGLSCAHRLAMHGHDVVLFEARTKAGGLNEYGIARYKLVDDFARREVEFLLQIGGIELRHGQRLGDNLALGALHDEYDAVFLGIGLAASKRLGLEDEDAPGLLAATDYIRELRQSDDLLDLPVADRCIVIGAGNTAIDMAVQMSRLGARDVNLVYRRGFEEMGATGHEQEIAKASQVRLLTWARPERVLLDEHGRVRGMRFARTRLENGRLGDTGEHFELAADAIFKAIGQAFEGASLGDPLAAQLRRDGERIQVDGQMRTSIPGIYAGGDCVALGEDLTVQAVQHGKLAAEAIHAQLMLNVEAA

SEQ ID NO: 4397 - DNA, 1455 bp, Agrobacterium tumefaciens
  CDS (1)..(1455)
atgggcaaggttacaggttttctggagatcgaccggcaggtgggcaagtatcagcccgcatcggatcgtatccgccatttccgcgaattcaccattccgatgtcggatgccgaggtgcagaagcaggcggcgcgctgtatggattgcggaattccctactgtcacggcccgacgggctgtcccgtgcacaaccagatcccggactggaacgatctggtctataacaacaattgggaagaggcgatccgcaacctccattccaccaacaacttcccggaatttaccggccgcgtctgtccggcaccctgcgaagaagcgtgcacgctgaatctcgaggatgcgccggtcgccatcaagacggtcgagcaggctatcgcagacaaggcttatgagctgggcttcatcgtgccgaagccggcgacgatccacaccggcaagaaggtcgccatcatcggttccggcccctcgggcatggcggctgcgcagcagcttggccgcgccggtcacgaggttcacgtttatgagcgtgaatcgaaggctgggggcctgctgcgttacggcattccggacttcaagatggagaagaacttcatcgaccgccgcgtcgagcagatcaagggtgaaggcgtcaccttccattgcggcgttaatgtcggtgtggatgtgacggtcgaagcgcttctggccgatcatgatgccgttctttattgcggcggttcggaaaccccgcgcccggccggcatcggtggcgccgattttaatggcgtttatgatgccatgccttacctcgtgcagcagaaccgccgcgtcggccgcgaaaacatcgacagcgtcggctggcccgccgatccgatccttgctggcggcaagcatgtcgtggtcgtcggcggcggcgataccgcatctgactgcgtcggcacggcgttccgtcaaggtgcggtaaaggtcacccaactcgacatccgtccgatgccgccggaaaaggaagacaagcttgcggtctggcccttctgggcaaccaagatgcgtacctcgtcctcgcaggccgaaggcgcgattcgcgagttccaggtggcgacgcttgaattcgtcggcgaagacggcgtgttgacgggcgtgaaatgctgtcaggtagatgaccgccgcaagccgatcgccggcacggaattcatcatcaaggccgatctcgccttcatcgccatcggcttctccggtcccttcaccgatagcgtgctgaaggaaatggaaggcaagctgacgctcaacaccgatcgtcgcggctccacaaatgttgtcgccaacgaaacggactacaggacctcggtcgataagctgtggacggcgggcgacgttcgccgtggtcagtcgctggtggtctgggcgatccgcgaaggccggcaggcggcacgggcaatcgatgaagcgctgatgggagccaccgttctgccgcgctga

SEQ ID NO: 4398 - protein, 484 aa, Agrobacterium tumefaciens
MGKVTGFLEIDRQVGKYQPASDRIRHFREFTIPMSDAEVQKQAARCMDCGIPYCHGPTGCPVHNQIPDWNDLVYNNNWEEAIRNLHSTNNFPEFTGRVCPAPCEEACTLNLEDAPVAIKTVEQAIADKAYELGFIVPKPATIHTGKKVAIIGSGPSGMAAAQQLGRAGHEVHVYERESKAGGLLRYGIPDFKMEKNFIDRRVEQIKGEGVTFHCGVNVGVDVTVEALLADHDAVLYCGGSETPRPAGIGGADFNGVYDAMPYLVQQNRRVGRENIDSVGWPADPILAGGKHVVVVGGGDTASDCVGTAFRQGAVKVTQLDIRPMPPEKEDKLAVWPFWATKMRTSSSQAEGAIREFQVATLEFVGEDGVLTGVKCCQVDDRRKPIAGTEFIIKADLAFIAIGFSGPFTDSVLKEMEGKLTLNTDRRGSTNVVANETDYRTSVDKLWTAGDVRRGQSLVVWAIREGRQAARAIDEALMGATVLPR

SEQ ID NO: 4399 - DNA, 1482 bp, Bacillus subtilis
  CDS (1)..(1482)
atggggaaaccaactggatttatggagatcaaacgagaaaaacctgcggagcgggaccctctcactcgcttaaaggattggaaagaatattctgctcctttttcagaagaagcatcgaaacggcaaggggcgcggtgtatggattgcggtacaccgttttgccagatcggtgcggacattaacggatttacatccggctgtccgatttacaacttaattcctgaatggaatgatcttgtctaccggggcagatggaaggaagcattggaacgtctgttgaaaacaaacaactttcctgaattcacagggcgggtatgccccgctccttgtgaaggatcatgcactttagcgatttcagatccggccgtatcaattaaaaacatcgagcggaccattatcgataaaggatttgagaacggctggattcaacctagaattccaaaaaaacgaacaggcaaaaaagtggccatcgtcgggtcaggcccagccggactggcgagtgctgaccagctgaatcaagcgggacattccgtcactgtttttgaacgagcagacagagcgggcggccttttaacatacggcattccaaacatgaagcttgagaagggcattgtagaacgccgaattaaattgctgacgcaagagggaattgattttgtcacgaacacagaaatcggtgttgacattacagctgatgagctaaaggagcaatttgatgctgtgatcttatgcacaggcgctcaaaaacagcgggacctcttaatcgaaggacgcgactcaaaaggagtccattacgcaatggactacctcacacttgcaacaaaaagctatttagattctaattttaaagacaagcaattcattgatgccaaagggaaagatgtcatcgtaatcggaggcggagatacaggagctgactgtgtggctaccgctctgcgtcaaaaagccaaaagcgtgcaccaattcggcaaacacccgaaacttccgccagcccgcacgaatgacaatatgtggcctgaacagccacacgtctttacgcttgaatatgcatacgaggaacgagaagcaaaattcggaagagatccgagagaatactccattcaaacgacaaaaatggtcgcggataaaaacggaaagctgaaagagcttcataccatccaaatggaaaaagtgaaaaatgagcatggaaaatacgagttccgcgagctgcctggaacggaaaaagtatggcctgctcagcttgtctttatcgctatcggctttgaaggcacagaacagccgctgttgaaacagttcggtgttaattcagtaaataacaaaatcagtgcagcatatggggattatcaaacaaatatcgatggtgtattcgccgcaggggatgcaagaagagggcaaagcttaatcgtatgggcgattaatgaaggccgtgaagtggcgcgtgaagtggatcgatatttgatggggagttcagttcttccgtaa

SEQ ID NO: 4400 - protein, 493 aa, Bacillus subtilis
MGKPTGFMEIKREKPAERDPLTRLKDWKEYSAPFSEEASKRQGARCMDCGTPFCQIGADINGFTSGCPIYNLIPEWNDLVYRGRWKEALERLLKTNNFPEFTGRVCPAPCEGSCTLAISDPAVSIKNIERTIIDKGFENGWIQPRIPKKRTGKKVAIVGSGPAGLASADQLNQAGHSVTVFERADRAGGLLTYGIPNMKLEKGIVERRIKLLTQEGIDFVTNTEIGVDITADELKEQFDAVILCTGAQKQRDLLIEGRDSKGVHYAMDYLTLATKSYLDSNFKDKQFIDAKGKDVIVIGGGDTGADCVATALRQKAKSVHQFGKHPKLPPARTNDNMWPEQPHVFTLEYAYEEREAKFGRDPREYSIQTTKMVADKNGKLKELHTIQMEKVKNEHGKYEFRELPGTEKVWPAQLVFIAIGFEGTEQPLLKQFGVNSVNNKISAAYGDYQTNIDGVFAAGDARRGQSLIVWAINEGREVAREVDRYLMGSSVLP

SEQ ID NO: 4401 - DNA, 1407 bp, Thermotoga maritima
  CDS (1)..(1407)
atgaaaaacagaaaaactccgatgaaggaacaatcgccggaatcgaggagaaggaacttcgaggaagtggcgctcggctacacgctcgaagaggctttggaggaggctcagaggtgtcttcagtgtcccacacatccgtgcgtctccggctgtcctgtggaaatcgacattcccggcttcataaggaaactcagagatggaaaactcgaggaatcttacagaattctcaaaagctacaacaaccttcccgcagtctgtggaagagtctgtccccaggaagttcagtgtgagtcgaggtgtgtcgtgggaaagatgaaagacagcgaacccgttgcgatcggaagactggaacgattcgttgcggactgggcggctgagaacctcgaggaggatgtgaaacctctggccgggtcaaaaaaggagaaagtcgccgtcgttggttcaggtcccgcgggactgacagccgcagcggatctcgcgaagatgggataccacgttgacatcttcgaagcttttcacaaaccgggtggtgttctcgtgtatggaattccggagtttcgtcttccaaagaggatcgtcgaaagagaagtcagctacataaggaaactcggggttaacttccacctcaacacggtcgttggtaagaccgtcaaggtgaaagagctcctttcggagtacgacgccgtcttcataggtaccggtgcggggacaccgaagttcatgggaattccgggaacgaatctgaacggggtatactccgcaaacgagtttctcacgagggtcaatctcatgaaagcctatctctttcctgagtacgacacacccatccgtgtgggaaagaaggtagctgtgataggagctggaaacactgctatggatgcggcaagaagcgctctcagattgggagccgaaaaggtgtacattgtctacaggagaacggaacgtgagatgcctgccagaagagaggaataccaccatgcacttgaggaaggaatcgagtttctgtggctcaccctcccgatacggtacatcggtgacgccaacggaaacgtggaagccatggagtgcgtaaggatggagctgaaagaagcagacggttcgggaaggccaagacccgttcccatcgagggaagcaatttcgttctcgaggttgacatggtgatagaggccatagggcagggtccaaacagggtgcttctctctgagttcccaggcttggaactgaatgagcgtggatacatcaaagcagacgaggacacaggagcaacgagcgtgaaaggcgtcttcgcaggtggagatatcgtgacgggtgcagcgacggtgataaaggctatgggagctggaaagaaagcggcgcagttcatccactcttacctcacgggggaatggaatccgtggcaaaagtga

SEQ ID NO: 4402 - protein, 468 aa, Thermotoga maritima
MKNRKTPMKEQSPESRRRNFEEVALGYTLEEALEEAQRCLQCPTHPCVSGCPVEIDIPGFIRKLRDGKLEESYRILKSYNNLPAVCGRVCPQEVQCESRCVVGKMKDSEPVAIGRLERFVADWAAENLEEDVKPLAGSKKEKVAVVGSGPAGLTAAADLAKMGYHVDIFEAFHKPGGVLVYGIPEFRLPKRIVEREVSYIRKLGVNFHLNTVVGKTVKVKELLSEYDAVFIGTGAGTPKFMGIPGTNLNGVYSANEFLTRVNLMKAYLFPEYDTPIRVGKKVAVIGAGNTAMDAARSALRLGAEKVYIVYRRTEREMPARREEYHHALEEGIEFLWLTLPIRYIGDANGNVEAMECVRMELKEADGSGRPRPVPIEGSNFVLEVDMVIEAIGQGPNRVLLSEFPGLELNERGYIKADEDTGATSVKGVFAGGDIVTGAATVIKAMGAGKKAAQFIHSYLTGEWNPWQK

SEQ ID NO: 4403 - DNA, 1485 bp, Xylella fastidiosa
  CDS (1)..(1485)
atgagtcgcaagcacgctttccaatttctcgatttgcctcggcagatgcctcaacgcatcccggtggagctgcgtacttccggggattggcgggagttatacggtaagttcgataaggccgaagcgcagtaccaagccggtcgctgtttggactgcggtaatccatattgcagttggaagtgtccggtgcataacgccatcccgcagtggttgcagttagtgcaggaaaatcgcattgatgaggccgcagcgttgtgccatgcaaccaacccgcttcctgaagtgtgcggtcgggtgtgtccgcaggaccgtctctgtgaaggcagttgcacgctggaggagtttggtgcggttaccatcggtgcggtggaaaagtacattgtggataccgcgttgcagcaggggtggcgtcccgatttgagccatgtgcaaccgacgggttggcgtgtggcggtggtcggtgcagggcctgccggccttgcatgtgcggatcggttggcgcgtgctggggttcaggcggtggtgtatgaccgctatgagcagatcggtgggttgctgcagttcgggattcccagttttaagcttgataaggcggtgatgagtacgcgccgcaaagtgcttgagggcatgggcgtagagtttcgattgggtgtggagattggaaaggatctggggattgaagcgttgctggagcactacgatgcagtgttccttggcgtcggtgcgtatcgctacacggacggtggcttgccgggtcaggacttgaaaaacgtgttgccggcattaccgtttttggttcagaacggacgtatcgtttctggcaatgatccgtatggccgtccgattgccggttgggaggatcaggtgcagttgccggatgtgacggggaagtctgtggttgtactcggtggcggtgataccggcatggattgtgtacggagtgcgatccgtttaggtgcaactaaagtcacctgtatctatcggcgtgatgaggcgaatatgcctggttcggcgcgcgaggttgctaacgcgcgggaagagggggtgcgctttctgttcaatcgtcagccattgtcgattcaatccggtaccgacaaacaagccattggtgtcactgtggtggaaacgaagcttgccgagccggatgccaatggtcgtcgcaacgcagtgcctatccagggcactgaagcggtgctggaagcggatgtggtgattatcgctttcggtttctcgccgatgttgccggagtggttaactgcgcagggtatacaagcgtcgagcaacggtcgcattgtggtggcgttgtctgatactggcgatggactgacctatcagacaacgcatccgaagttgtttgctggtggtgattgtgtgcgtggtgccgatttagttgtcactgccgtggccgaagggcgcgacgcggctgagagcattgtgcggtggttgcgtgcgacggcacaggtgatggatgttgcggtgatctga

SEQ ID NO: 4404 - protein, 494 aa, Xylella fastidiosa
MSRKHAFQFLDLPRQMPQRIPVELRTSGDWRELYGKFDKAEAQYQAGRCLDCGNPYCSWKCPVHNAIPQWLQLVQENRIDEAAALCHATNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRKVLEGMGVEFRLGVEIGKDLGIEALLEHYDAVFLGVGAYRYTDGGLPGQDLKNVLPALPFLVQNGRIVSGNDPYGRPIAGWEDQVQLPDVTGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLPEWLTAQGIQASSNGRIVVALSDTGDGLTYQTTHPKLFAGGDCVRGADLVVTAVAEGRDAAESIVRWLRATAQVMDVAVI

SEQ ID NO: 4405 - DNA, 2065 bp, Thiobacillus ferrooxidans
  CDS (336)..(1733)
gatctcatcctcggcccggtcggcgtgaatttcggggcgggcatgaccggcggcctcgccttcgtccgcgatcaggcccgccagttccctgatcaagtgaatggtgagctggtgaattaccacgggatcgaaaccgaatccatgcgcggctacgaggccctcctgcggcgccatatcgaggcccatgtggcggccaccggcagcgattatgccgcggggctactcaaggactggacccactttatccgcgatgtctggctggtggtgcccaaggccgccaaactggatgtcctgctcgaagaagcgagctgaccgcgtcaccctgaggaaaaaccatgagtcatttttcattcatcgaagacccgcggcaggaccccaaaaagctggacgtagaagaacgccgcgaagcctttagggaaatctaccagagctttgacctgggcagtgcccagcttcaggccgaccgctgcctgcattgcggcaacccgtattgtgaatggaagtgcccggtgcacaactatattcccaactggctgcaactcattgtcgagaatcgtctggaagaagcggccacgctgtcccatcagaccaataccctgccggaaatctgcggccgcatctgccctcaggatcgcctgtgtgaaggtgcctgtaccctcaatgcaacgggcggcgccgtcaccatcggcaatctggaaaggttcgtcaccgaagaagcgctggcccgtgcgtggcagccggatatgcccgacatcctccccaatggcaaacgggtcgccgtagtgggtgggggtccggcaggcctcggctgtgcggacatcctcaaccgcgcaggcaccgaagtggtcgtctttgaccgctatccggcggttggtggtctgctcaccttcggcatcccgtccttcaaactggagaaggcagtggttgcacgccgcgccaacctgctccaggaaatgggtatccgttttcagctcgacacggaggttggcagagatatttccctgggtaagctcctggaagattttgacgccgtgttcctggggatgggcacctataccgccaagaccggcgacttccccggcgagaaactgccaggcgtcctcaaggcgctgtcctacctgatcgcgaacacccgtcacctgatgcagttgccggacccgacactcccctatatcagcctttccggcaagcgggttgtggtgctgggtggcggtgataccgccatggactgtctgcgtacggccatccgccagggtgcccgccaggtgacctgtgtctatcgccgcgatgaagagaacatgcccggctcacgccgggaagtcgccaatgcccgcgaggaaggcgtccactttcttttccatcgtcagcccgtcgaagtggtcggagatgctgcatcggggagcccagggcgtgcgtctggtggagacccgtctggcgagcccgatgccaggggccggcgtcacccggaaatcattcccggctcggaacaagtgctggatgccgatgtcgtgatcatcgcttttggttttgatccctcccctgctccctggtttgcggaacaccacatcactacggacagccgggggcggatcagcaccaacgcgcagttccagaccagcaacccgcgcatttttgccgggggagacatgcgacgaggctccgacctggtggtcactgcggtggacgaagggcgccgcgcggcgcagggtatcctcgactatctgggggtatagacggtgaaacccacattgcagaacgataatttcctgcgcgcctgcctgcgtcagccggtggatcacgtacccgtctggctgatgcgtcaggccgggcggtacctgcctgagtaccgcgccacccggcccgggccggcgattttctcagcctctgcaccacgccggaactggcctgcgaggtcactttacagcccatcaaccgcttccccctggatgccgccatccttttttcggatatcctgaccatcccctatgtcatgggactcgggctggaatttcaggaaggagaaggtccggtttttgcacgccccttgcgcagcgctgccgatatc

SEQ ID NO: 4406 - protein, 465 aa, Thiobacillus ferrooxidans
MSHFSFIEDPRQDPKKLDVEERREAFREIYQSFDLGSAQLQADRCLHCGNPYCEWKCPVHNYIPNWLQLIVENRLEEAATLSHQTNTLPEICGRICPQDRLCEGACTLNATGGAVTIGNLERFVTEEALARAWQPDMPDILPNGKRVAVVGGGPAGLGCADILNRAGTEVVVFDRYPAVGGLLTFGIPSFKLEKAVVARRANLLQEMGIRFQLDTEVGRDISLGKLLEDFDAVFLGMGTYTAKTGDFPGEKLPGVLKALSYLIANTRHLMQLPDPTLPYISLSGKRVVVLGGGDTAMDCLRTAIRQGARQVTCVYRRDEENMPGSRREVANAREEGVHFLFHRQPVEVVGDAASGSPGRASGGDPSGEPDARGRRHPEIIPGSEQVLDADVVIIAFGFDPSPAPWFAEHHITTDSRGRISTNAQFQTSNPRIFAGGDMRRGSDLVVTAVDEGRRAAQGILDYLGV

SEQ ID NO: 4407 - DNA, 7174 bp, Medicago sativa (alfalfa)
  CDS (228)..(6812)
ctctgtcttgtttttttctctcttgttgctgttttagttttttcagtttttcagattcgaatctccacataaccacttctcaaaaatctggatcttattgttcttcagtttcatcaatctcagatctgttacatttaataacaaacaaaactgaataacagttagaaaaagccaaaactcgaaaacgcgaatcaacaatttttgaataattttaattttaatctccaatgtcgaattctctttcgttaacgtttacggcgttaaacaatcctcagataaacgctataagtaaccctaacgctcgtttgcgtccgttagcgagggttacgcgatgttctgccacgtgtgtcgagaggaagagatggttagggacgaaattgcgaagtggtggtggtttggagaggattcagttatgggaatccggtggattagggaggttgccgaagctcagagtggcggttaagtcgtcgttttcggctgtgccggataaaccgatgggactttatgatccggcttttgataaagattcttgtggtgttggatttgttgctgaattgaacggtcaaagtagtcgaaaaacggtaactgatgctttggagatgttggttaggatgacacatagaggtgcttgtggatgtgaagcaaataccggtgatggtgctggtatacttgtggctttgcctcatggcttctaccaagaggttgtggattttcagcttcctcctcaaggaaactatgcagttggcatgtttttcttacctaaatccgatagtcggagaaaggaaagcaaaaatatatttactaaggttgccgagtctcttggtcacaaggttcttggttggcgttctgtgcccacggataacacagggttgggcaaatcagcccagctgaccgaaccagtgattgaacaagtgtttcttacaccaagttctgactcaaaagttgatttggagaaacagatgtacatattaaggaagctcagcatggtttctattacatctgcattaaacctccaaagcgatggaattacagatttctatatctgttcactttcatctaggactgttatttacaaaggtcagctaacaccagctcagttgggtgaatattattatgcagatcttggcaatgaaaggtttacgagctacatggccctgatacattcccgattctctacaaatactttccctagttgggatcgtgcccaaccttttcgtgtattgggccacaacggggaaatcaacacactcagaggcaatgttaactggataaaagcacgtgagggcctactgaaatgcaaggaacttggcttatcagagaatgatttaaagaagtttttaccgattgtggacgcaaattcatcagattcaggatgttttgatggtgtcctcgagtttttgcttcattccggaaaaagtcttccagaagctgttatgatgatgattcctgaagcatggcagaacgacaagaacatggaccctcagcgtaaagcattttatgaatactattcagctctgatggagccatgggatgggccagctcttatctcatttaccgatggtcactatctaggagctacattagataggaatggactacgacctggccgcttctatgtcacccacagtggacgggttataatggcaagtgaagttggcgttgtagatattcctccagaagatgtgtgcaggaaaggaagactaaatccaggcatgatgcttctggtggattttgagaagcaaatagttgtgaacgatgacgccttaaaagagcaatactcattggcaagaccgtacggagattggcttgaaaagcagaaaatcgaactgaaggacataattgactctgttcatgaatctgatattgtgccaccaaccatatcaggagtgcctccactgtctaatgatgatgtggacatggaaaatatgggaattcaaggtttgctggctccattgaaagcttttgggtattctgtagaatcattggaaattctattacttcccatggcaaaggatggtgtcgaagcacttggttcaatgggaaatgatactccattagctgtcatgtctaatagagaaaaactcacttttgagtatttcaaacaaatgtttgctcaagtgacaaatcctcctatcgatcctattcgagagaaaatagtcacttctatgcgatgtatggttggtccagaaggtgatctaacagaaaccactgaggaacaatgccaccgcctttcactaaaaggtccccttttatccactaaggaaatggaagccatcaaaaaaatgaattataggggatggaggagcaaagttatagacattacttactcaaaggaacgtggtacgaaagggttggaggaagccttagacaggatatgcacagaagcacacaatgcaattagtgaaggctacaccacccttgttctttctgatagagccttctcaaagaaacatgttgctgtgagctctcttttggctgttggtgcagtccaccaacatctagttaaaacacttgagcgcacaagagttgctctaatggttgaatctgctgagccacgtgaagtgcaccatttctgcacacttgttggttttggcgctgatgctatatgcccatatttggctatagaggcaatttggcgactgcaggttgacggaaagatcccaccaaaagcaagtggtgatttcaactcaaaagatgagttggtcaagaagtatttcaaagcaagcacctatgggatgatgaaggttcttgccaagatgggaatatcaactttggcatcatataaaggtgctcagatatttgaagctctgggtctttcttcagaagtgattgaaaagtgctttgctggaactccaagtcgagttgagggtgcaacatttgagatgcttgctcaagatgcacttcatctgcatgagttggcttttccttctcggattttctctcctggaagtgcagaagcagtagcattgccaaaccctggagattatcattggagaaaaggtggtgaagttcatctgaatgatccacttgctattgcaaagcttcaagaggctgccagaactaacagcgtagatgcatataaacagtattccaagaccattcatgaattgaataaggcttgcaatttgcgaggactcctgaagtttaaagatgcagcaagtaaggttcctattagcgaagtcgaacctgctagtgaaattgttaaacggttttgcactggcgccatgagttatgggtcaatatctttggaggcccacacagcattagcaacggcaatgaacacaattggaggaaaatccaacacaggtgagggaggtgaacaaccatctcgtatggagcctcttgctgatggctcaaggaatcccaaaaggagtgccattaagcaggttgctagtgggagatttggtgtttcaagttactaccttacaaatgctgatgagcttcagataaagatggcccagggagcaaaacctggtgaaggaggtgaacttcctggccacaaggttataggagacattgctatcactaggaattcaacagccggagtaggtctcatcagtccacctccccatcacgatatttattcaattgaagatcttgctcaattgattcatgatctcaagaatgccaacccagctgctcgaattagtgtgaaactagtatctgaagcaggagttggggtaattgctagtggagttgttaaaggtcatgctgagcatgtcttgatctcaggtcatgatggaggtacaggagcatccagatggactggtataaagagtgctggactgccttgggaacttggtctggctgagacccaccaaacattggttgctaatgacctacgtggtcgtacaactctgcaaactgacgggcaactaaaaaccggaagagatgtggccatagccgcccttcttggtgcagaagagtatggtttcagtactgctcccctcattactcttggctgcatcatgatgcggaagtgccacaagaacacctgtcctgttggaattgctactcaagatccagtacttagagagaaatttgctggagaacctgagcacgttattaacttcttttttatggtggcagaagagatgagagaaattatgtcccaacttgggtttagaacagtcaatgaaatggttggccgttcagatatgctcgaagttgataaagaagttgttaagggaaatgcaaaactagagaatattgatctctctctattgcttagacctgcagctgaactgcggccagaagctgcccaatactgtgttcaaaagcaagatcatggtttggacatggctttggataataagctcataagtctgtccaatgctgctttggaaaagggtcttccagtatacattgaaacaccgatctgcaataccaaccgtgctgtgggaactatgcttagccacgaggttactaagaggtacaatttagctggtcttccagccgataccatccatatccaatttactggtagtgcaggccaaagctttggtgcattcctttgtcctggaatcacattggaacttgaaggtgatagcaatgactacattggtaaaggattatcaggtggaaaagttgtagtatatcctccaaaaggaagcaattttgaccccaaagacaacatcttaattggcaatgtggcactgtatggggcaacacgtggtgaggcatatttcaatgggatggcagcagaaagattttgtgtgcgtaattctggggctctggctgtagttgaaggtgttggtgatcatggatgtgagtacatgactggtgggaccgttgttgttcttgggaaaactggtagaaattttgctgcaggtatgagtggtggaatcgcttatgttcttgacgtggatggaacattccagtctcggtgcaacctggagcttgtagatctggataaggttgaagaggaagaggacattattactcttaggatgttgatacagcaacatcaacgtcacacaaacagtttgcttgccaaggaagtgcttgttgattttgaaaatcttcttcctaaatttgtcaaggtgttccctcgggagtataaacgtgttcttgcaagtatgaagtctgatgcagcctctaaagatgcagtggagcgggctgcggaagatgtagatgaacaagacgatgaagcccaagcagtggagaaagatgcttttgaagagctcaagaagctggcaactgcatctttgaatgagaaaccaagtgaggctcccaagaggccaagtcaggtcactgatgctgttaaacatagaggttttgttgcttacgagcgtgagggtgttcagtatagggatcctaatgttcgcctgaatgattggaatgaggtgatgatggagacaaagccgggtccacttttgaaaacacagtctgcccgttgcatggactgtggtactccattttgtcatcaggaaaattctggatgtcctcttgggaacaaaataccggaatttaatgagctagtgtatcaaaataggtggcaagaagcactagagaggcttcttgaaacaaacaactttcctgagttcactgggcgggtttgccctgcaccttgtgaaggttcttgtgtcctcggtattattgagaatccagtttctattaaaaatattgaatgtgctatcattgacaaggcttttgaggagggttggatgattccacgacctcctgtcaagagaactggaaaaagagtagccattgttggaagtggaccatcaggcttggcagctgcagatcagctaaataaaatgggtcatatagtaacagtgtttgaaagagctgatcgcattggtggccttatgatgtatggagttccaaacatgaaaactgacaaagtggatatagttcaaaggcgagtcaatctaatggctgaggaaggaataaattttgtggtgaatgcaaacattgggcttgatcctttatactctcttgaacgacttagagaggaaaacgatgccattgtcttggctgttggagctacaaagccaagggatcttcctgtgcctggaagggagctatcaggagttcattttgccatggagtttcttcatgcaaacactaaaagtttgcttgatagcaatttacaggatggtaactacatctctgccaagggcaagaaggttgtggtcattggcgggggtgacacgggcacagattgcattggaacatccattcgtcatggttgtactgctgttgtcaatctagaacttctccctcagccaccaccaactagggccccaggcaacccatggcctcagtggcctcgcatattccgtgttgattatggtcaccaagaagcggaaactaaatttggaaaagatcccagaacatatgaggtactcactaagaggtttgtgggagatgaaaatggagttgttaaaggacttgaagtggtacgtgtttgctgggagaaagatgaaactggcaagtttcaatttaaagaaattgagggcagtgaggagattattgaggctgacctagttttactagccatgggattccttggccccgaggcgactatagcagaaaagttgggtgtggaacgagacaacaggtcaaacttcaaagctgattatggccgcttctcgaccagtgttgatggggtatttgcagcaggtgactgtcggcgtggtcagtcgcttgtggtatgggctatttcagagggaaggcaagctgccgcacaagtggacagctacctcaccaatgaagaccacggtattgatgggaatcaggatgaatttgtcaagaggcaacaagacctcaacaagaagcacagcaaacacacagtgatgacttaggatgcttttttgattttacaagttcctcgagttcctaaagcaaatgcacataataaaagaaaaaggaatgttgaatgttacattttaggcattcttggttggcaggtagtaagccgaatgggcgaaataagaacgaaaacaataaagataaataatttagtgtaaggaaagcaagaggttgtcttggtttttggtggtattagggtaagatttgagtgttgttcatagttcttatttggattttattgttgggaaggctagcttagttatggttttgtggaaatgaaatgtacagtttggtaattaattatttattctgatgtacaattgtttctgcaattttgagctactgtgtttgttcc

SEQ ID NO: 4408 - protein, 2194 aa, Medicago sativa (alfalfa)
MSNSLSLTFTALNNPQINAISNPNARLRPLARVTRCSATCVERKRWLGTKLRSGGGLERIQLWESGGLGRLPKLRVAVKSSFSAVPDKPMGLYDPAFDKDSCGVGFVAELNGQSSRKTVTDALEMLVRMTHRGACGCEANTGDGAGILVALPHGFYQEVVDFQLPPQGNYAVGMFFLPKSDSRRKESKNIFTKVAESLGHKVLGWRSVPTDNTGLGKSAQLTEPVIEQVFLTPSSDSKVDLEKQMYILRKLSMVSITSALNLQSDGITDFYICSLSSRTVIYKGQLTPAQLGEYYYADLGNERFTSYMALIHSRFSTNTFPSWDRAQPFRVLGHNGEINTLRGNVNWIKAREGLLKCKELGLSENDLKKFLPIVDANSSDSGCFDGVLEFLLHSGKSLPEAVMMMIPEAWQNDKNMDPQRKAFYEYYSALMEPWDGPALISFTDGHYLGATLDRNGLRPGRFYVTHSGRVIMASEVGVVDIPPEDVCRKGRLNPGMMLLVDFEKQIVVNDDALKEQYSLARPYGDWLEKQKIELKDIIDSVHESDIVPPTISGVPPLSNDDVDMENMGIQGLLAPLKAFGYSVESLEILLLPMAKDGVEALGSMGNDTPLAVMSNREKLTFEYFKQMFAQVTNPPIDPIREKIVTSMRCMVGPEGDLTETTEEQCHRLSLKGPLLSTKEMEAIKKMNYRGWRSKVIDITYSKERGTKGLEEALDRICTEAHNAISEGYTTLVLSDRAFSKKHVAVSSLLAVGAVHQHLVKTLERTRVALMVESAEPREVHHFCTLVGFGADAICPYLAIEAIWRLQVDGKIPPKASGDFNSKDELVKKYFKASTYGMMKVLAKMGISTLASYKGAQIFEALGLSSEVIEKCFAGTPSRVEGATFEMLAQDALHLHELAFPSRIFSPGSAEAVALPNPGDYHWRKGGEVHLNDPLAIAKLQEAARTNSVDAYKQYSKTIHELNKACNLRGLLKFKDAASKVPISEVEPASEIVKRFCTGAMSYGSISLEAHTALATAMNTIGGKSNTGEGGEQPSRMEPLADGSRNPKRSAIKQVASGRFGVSSYYLTNADELQIKMAQGAKPGEGGELPGHKVIGDIAITRNSTAGVGLISPPPHHDIYSIEDLAQLIHDLKNANPAARISVKLVSEAGVGVIASGVVKGHAEHVLISGHDGGTGASRWTGIKSAGLPWELGLAETHQTLVANDLRGRTTLQTDGQLKTGRDVAIAALLGAEEYGFSTAPLITLGCIMMRKCHKNTCPVGIATQDPVLREKFAGEPEHVINFFFMVAEEMREIMSQLGFRTVNEMVGRSDMLEVDKEVVKGNAKLENIDLSLLLRPAAELRPEAAQYCVQKQDHGLDMALDNKLISLSNAALEKGLPVYIETPICNTNRAVGTMLSHEVTKRYNLAGLPADTIHIQFTGSAGQSFGAFLCPGITLELEGDSNDYIGKGLSGGKVVVYPPKGSNFDPKDNILIGNVALYGATRGEAYFNGMAAERFCVRNSGALAVVEGVGDHGCEYMTGGTVVVLGKTGRNFAAGMSGGIAYVLDVDGTFQSRCNLELVDLDKVEEEEDIITLRMLIQQHQRHTNSLLAKEVLVDFENLLPKFVKVFPREYKRVLASMKSDAASKDAVERAAEDVDEQDDEAQAVEKDAFEELKKLATASLNEKPSEAPKRPSQVTDAVKHRGFVAYEREGVQYRDPNVRLNDWNEVMMETKPGPLLKTQSARCMDCGTPFCHQENSGCPLGNKIPEFNELVYQNRWQEALERLLETNNFPEFTGRVCPAPCEGSCVLGIIENPVSIKNIECAIIDKAFEEGWMIPRPPVKRTGKRVAIVGSGPSGLAAADQLNKMGHIVTVFERADRIGGLMMYGVPNMKTDKVDIVQRRVNLMAEEGINFVVNANIGLDPLYSLERLREENDAIVLAVGATKPRDLPVPGRELSGVHFAMEFLHANTKSLLDSNLQDGNYISAKGKKVVVIGGGDTGTDCIGTSIRHGCTAVVNLELLPQPPPTRAPGNPWPQWPRIFRVDYGHQEAETKFGKDPRTYEVLTKRFVGDENGVVKGLEVVRVCWEKDETGKFQFKEIEGSEEIIEADLVLLAMGFLGPEATIAEKLGVERDNRSNFKADYGRFSTSVDGVFAAGDCRRGQSLVVWAISEGRQAAAQVDSYLTNEDHGIDGNQDEFVKRQQDLNKKHSKHTVMT

SEQ ID NO: 4409 - DNA, 7231 bp, Saccharomyces cerevisiae
  CDS (678)..(7115)
acctcactttaaaaaactttgttttcttggcatccatacatgaacaataacaacaattctatatcatcttaagtaagactcttattgtaatttctttttctttgatgactcagaccctggtagccctaccgttcaaccctatacagcgcaaatttggtcctaatacacttcggttttaatgcgtcaatccgattggctccgataagcttttgcacatttttcaagtcatatgtcacgacgaacgtgatgcccgcaaaacgtaaaaaaaagaagcaataaattgcccaaaaaaaaaatataaactgcttttcttagtcattcataagttctgatggtcttccttatcttattgtatttttcgtcctattgtttcatttcttaccaaattaatcaattcttatatcttacttgataacacaccaaactaatcgtctccacatcataggaagataggaaattgctatctcagtcctatactacgcagacggatactctcagttgctctttcttccccttcttttagctcattgaggtagtgattaacgtttaacttatttatttatttttctgcttcagtttttttttatttatttttgtctttctactctctcttttttcttaatctatttgccatttatttattttgaagaactagaaaaagaattagaaaagaaagcatgccagtgttgaaatcagacaatttcgatccattggaagaagcttacgaaggtgggacaattcaaaactataacgatgaacaccatcttcataaatcttgggcaaatgtgattccggacaaacgaggactttacgaccctgattatgaacatgacgcttgtggtgtcggtttcgtagcaaataagcatggtgaacagtctcacaagattgttactgacgctagatatcttttagtgaatatgacacatcgtggtgccgtctcatctgatgggaacggtgacggtgccggtattctgctaggtattcctcacgaatttatgaaaagagaattcaagttagatcttgatctagacatacctgagatgggcaaatacgccgtaggtaacgtcttcttcaagaagaacgaaaaaaataacaagaaaaatttaattaagtgtcagaagattttcgaggatttagctgcatccttcaacttatccgtattaggttggagaaacgtccccgtagattctactattttaggagacgttgcattatctcgtgaacctactattctacagccattattggttccattgtatgatgaaaaacaaccggagtttaatgaaactaaatttagaactcaattgtatcttttaaggaaggaggcctctcttcaaataggactggaaaactggttctatgtttgttccctaaacaataccaccattgtttacaagggtcaattgacgccagctcaagtgtataactactatcccgacttgactaatgcgcatttcaaatcccacatggcgttggtccattcaagattttccactaatactttcccctcttgggatagagctcaacctttacgttggctagctcataatggtgaaattaacaccttaagaggtaacaagaattggatgcgctccagagaaggtgtgatgaattcagcaactttcaaagatgagttagacaaactatacccaattatcgaagaaggtggttctgattcagctgcattggataacgttttagaactattgactattaatggcacattatctctacctgaagctgttatgatgatggttcctgaagcgtatcataaggatatggattctgacctaaaagcatggtacgactgggctgcatgtctgatggaaccttgggatggtccagctttgttaactttcactgatggacgttactgtggtgctatattggatagaaatggtttaagaccttgtcgttattacatcactagtgatgacagagttatctgtgcttcagaggtaggtgtcattcctatcgaaaattcattggttgttcaaaaaggtaaactgaagccaggtgatttattcctagtggatactcaattgggtgaaatggtcgatactaaaaagttaaaatctcaaatctcaaaaagacaagattttaagtcttggttatccaaagtcatcaagttagacgacttgttatcaaaaaccgctaatttggttcctaaagaatttatatcacaggattcattgtctttgaaagttcaaagtgacccacgtctattggccaatggttataccttcgaacaagtcacatttctgttaactccaatggctttaacaggtaaagaagctttaggttcgatgggtaacgatgcgccactggcttgtttaaatgaaaatcctgtcttactttatgattatttcagacaattgtttgctcaagtgaccaatcctccaattgacccaattcgtgaagcaaatgttatgtcgttagaatgttatgtcggacctcaaggcaaccttttggaaatgcattcatctcaatgtgatcgtttattattgaaatctcctattttgcattggaatgagttccaagctttgaaaaacattgaagctgcttacccatcatggtctgtagcagaaattgatatcacattcgacaagagtgagggtctattgggctataccgacacaattgataaaatcactaagttagcgagcgaagcaattgatgatggtaaaaagatcttaataattactgacaggaaaatgggtgccaaccgtgtttccatctcctctttgattgcaatttcatgtattcatcatcacctaatcagaaacaagcagcgttcccaagttgctttgattttggaaacaggtgaagccagagaaattcaccatttctgtgtcctactaggttatggttgtgatggtgtttatccatacttagccatggaaactttggtcagaatgaatagagaaggtctacttcgtaatgtcaacaatgacaatgatacacttgaggaagggcaaatactagaaaattacaagcacgctattgatgcaggtatcttgaaggttatgtctaaaatgggtatctccactctagcatcctacaaaggtgctcaaatttttgaagccctaggtttagataactctattgttgatttgtgtttcacaggtacttcttccagaattagaggtgtaactttcgagtatttggctcaagatgccttttctttacatgagcgtggttatccatccagacaaaccattagtaaatctgttaacttaccagaaagtggtgaataccactttagggatggtggttacaaacacgtcaacgaaccaaccgcaattgcttcgttacaagatactgtcagaaacaaaaatgatgtctcttggcaattatatgtaaagaaggaaatggaagcaattagagactgtacactaagaggactgttagaattagattttgaaaattctgtcagtatccctctagaacaagttgaaccatggactgaaattgccagaagatttgcgtcaggtgcaatgtcttatggttctatttctatggaagctcactctacattggctattgccatgaatcgtttaggggccaaatccaattgtggtgaaggtggtgaagacgcagaacgttctgctgttcaagaaaacggtgatactatgagatctgctatcaaacaagttgcttccgctagattcggtgtaacttcatactacttgtcagatgctgatgaaatccaaattaagattgctcagggtgctaagccgggtgaaggtggtgaactaccagcccacaaagtgtctaaggatatcgcaaaaaccaggcactccacccctaatgttgggttaatctctcctcctcctcatcacgatatttattccattgaagatttgaaacaactgatttatgatttgaaatgtgctaatccaagagcgggaatttctgtaaagttggtttccgaagttggtgttggtattgttgcctctggtgtagctaaggctaaagccgatcatatcttagtttctggtcatgatggtggtacaggtgctgcaagatggacgagtgtcaaatatgcgggtttgccatgggaattaggtctagctgaaactcaccagactttagtcttgaatgatttaagacgtaatgttgttgtccaaaccgatggtcaattgagaactgggtttgatattgctgttgcagttttattaggggcagaatcttttaccttggcaacagttccattaattgctatgggttgtgttatgttaagaagatgtcacttgaactcttgtgctgttggtattgccacacaagatccatatttgagaagtaagtttaagggtcagcccgaacatgttatcaacttcttctattacttgatccaagatttaagacaaatcatggccaagttaggattccgtaccattgacgaaatggtgggtcattctgaaaaattaaagaaaagggacgacgtaaatgccaaagccataaatatcgatttatctcctattttgaccccagcacatgttattcgtccaggtgttccaaccaagttcactaagaaacaagaccacaaactccacacccgtctagataataagttaatcgatgaggctgaagttactttggatcgtggcttaccagtgaatattgacgcctctataatcaatactgatcgtgcactcggttctactttatcttacagagtctcgaagaaatttggtgaagatggtttgccaaaggacaccgttgtcgttaacatagaaggttcagcgggtcaatcttttggtgctttcctagcttctggtatcacttttatcttgaatggtgatgctaatgattatgttggtaaaggtttatccggtggtattattgtcattaaaccaccaaaggattctaaattcaagagtgatgaaaatgtaattgttggtaacacttgtttctatggtgctacttctggtactgcattcatttcaggtagtgccggtgagcgtttcggtgtcagaaactctggtgccaccatcgttgttgagagaattaagggtaacaatgcctttgagtatatgactggtggtcgtgccattgtcttatcacaaatggaatccctaaacgccttctctggtgctactggtggtattgcatactgtttaacttccgattacgacgattttgttggaaagattaacaaagatactgttgagttagaatcattatgtgacccggtcgagattgcgtttgttaagaatttgatccaggagcattggaactacacacaatctgatctagcagccaggattctcggtaatttcaaccattatttgaaagatttcgttaaagtcattccaactgattataagaaagttttgttgaaggagaaagcagaagctgccaaggcaaaggctaaggcaacttcagaatacttaaagaagtttagatcgaaccaagaagttgatgacgaagtcaatactctattgattgctaatcaaaaagctaaagagcaagaaaaaaagaagagtattactatttcaaataaggccactttgaaggagcctaaggttgttgatttagaagatgcagttccagattccaaacagctagagaagaatagcgaaaggattgaaaaaacacgtggttttatgatccacaaacgtcgtcatgagacacacagagatccaagaaccagagttaatgactggaaagaatttactaaccctattaccaagaaggatgccaaatatcaaactgcgagatgtatggattgtggtacaccattctgtttatctgataccggttgtcccctatctaacattatccccaagtttaatgaattgttattcaagaaccaatggaagttggcactggacaaattgctagagacaaacaatttcccagaattcactggaagagtatgtccagcaccctgtgagggagcttgtacactaggtattattgaagacccagtcggcataaaatcggttgaaagaattatcattgacaatgctttcaaggaaggatggattaagccttgtccaccaagtacacgcactggctttacagtgggtgtcattggttctggtccagcaggtttagcgtgtgctgatatgttgaaccgtgccggacatacggtcactgtttatgaaagatccgaccgttgtggtgggttattgatgtatggtattccaaacatgaagttggataaggctatagtgcaacgtcgtattgatctattgagtgccgaaggtattgactttgttaccaacaccgaaattggtaaaaccataagcatggatgagctaaagaacaagcacaatgcagtagtgtatgctatcggttctaccattccacgtgacttacctattaagggtcgtgaattgaagaatattgattttgccatgcagttgttggaatctaacacaaaagctttattgaacaaagatctggaaatcattcgtgaaaagatccaaggtaagaaagtaattgttgtcggtggtggtgacacaggtaacgattgtttaggtacatctgtaagacacggtgcagcatcagttttgaatttcgaattgttgcctgagccaccagtggaacgtgccaaagacaatccatggcctcaatggccgcgtgtcatgagagtggactacggtcatgctgaagtgaaagagcattatggtagagaccctcgtgaatactgcatcttgtccaaggaatttatcggtaacgatgagggtgaagtcactgccatcagaactgtgcgcgtagaatggaagaagtcacaaagtggcgtatggcaaatggtagaaattcccaacagtgaagagatctttgaagccgatatcattttgttgtctatgggtttcgtgggtcctgaattgatcaatggcaacgataacgaagttaagaagacaagacgtggtacgattgccacactcgacgactcctcatactctattgatggaggaaagacttttgcatgtggtgactgtagaagagggcaatctttgattgtctgggccatccaagaaggtagaaaatgtgctgcctctgtcgataagttcctaatggacggcactacgtatctaccaagtaatggtggtatcgttcaacgtgattacaaactattgaaagaattagctagtcaagtctaaaaagcttgagttattatttattttatgatcgtatattatttatttatttatttatttatttatttatttatttatttatttatttattttatttagtttattaattttgctgatga

SEQ ID NO: 4410 - protein, 2145 aa, Saccharomyces cerevisiae
MPVLKSDNFDPLEEAYEGGTIQNYNDEHHLHKSWANVIPDKRGLYDPDYEHDACGVGFVANKHGEQSHKIVTDARYLLVNMTHRGAVSSDGNGDGAGILLGIPHEFMKREFKLDLDLDIPEMGKYAVGNVFFKKNEKNNKKNLIKCQKIFEDLAASFNLSVLGWRNVPVDSTILGDVALSREPTILQPLLVPLYDEKQPEFNETKFRTQLYLLRKEASLQIGLENWFYVCSLNNTTIVYKGQLTPAQVYNYYPDLTNAHFKSHMALVHSRFSTNTFPSWDRAQPLRWLAHNGEINTLRGNKNWMRSREGVMNSATFKDELDKLYPIIEEGGSDSAALDNVLELLTINGTLSLPEAVMMMVPEAYHKDMDSDLKAWYDWAACLMEPWDGPALLTFTDGRYCGAILDRNGLRPCRYYITSDDRVICASEVGVIPIENSLVVQKGKLKPGDLFLVDTQLGEMVDTKKLKSQISKRQDFKSWLSKVIKLDDLLSKTANLVPKEFISQDSLSLKVQSDPRLLANGYTFEQVTFLLTPMALTGKEALGSMGNDAPLACLNENPVLLYDYFRQLFAQVTNPPIDPIREANVMSLECYVGPQGNLLEMHSSQCDRLLLKSPILHWNEFQALKNIEAAYPSWSVAEIDITFDKSEGLLGYTDTIDKITKLASEAIDDGKKILIITDRKMGANRVSISSLIAISCIHHHLIRNKQRSQVALILETGEAREIHHFCVLLGYGCDGVYPYLAMETLVRMNREGLLRNVNNDNDTLEEGQILENYKHAIDAGILKVMSKMGISTLASYKGAQIFEALGLDNSIVDLCFTGTSSRIRGVTFEYLAQDAFSLHERGYPSRQTISKSVNLPESGEYHFRDGGYKHVNEPTAIASLQDTVRNKNDVSWQLYVKKEMEAIRDCTLRGLLELDFENSVSIPLEQVEPWTEIARRFASGAMSYGSISMEAHSTLAIAMNRLGAKSNCGEGGEDAERSAVQENGDTMRSAIKQVASARFGVTSYYLSDADEIQIKIAQGAKPGEGGELPAHKVSKDIAKTRHSTPNVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAVLLGAESFTLATVPLIAMGCVMLRRCHLNSCAVGIATQDPYLRSKFKGQPEHVINFFYYLIQDLRQIMAKLGFRTIDEMVGHSEKLKKRDDVNAKAINIDLSPILTPAHVIRPGVPTKFTKKQDHKLHTRLDNKLIDEAEVTLDRGLPVNIDASIINTDRALGSTLSYRVSKKFGEDGLPKDTVVVNIEGSAGQSFGAFLASGITFILNGDANDYVGKGLSGGIIVIKPPKDSKFKSDENVIVGNTCFYGATSGTAFISGSAGERFGVRNSGATIVVERIKGNNAFEYMTGGRAIVLSQMESLNAFSGATGGIAYCLTSDYDDFVGKINKDTVELESLCDPVEIAFVKNLIQEHWNYTQSDLAARILGNFNHYLKDFVKVIPTDYKKVLLKEKAEAAKAKAKATSEYLKKFRSNQEVDDEVNTLLIANQKAKEQEKKKSITISNKATLKEPKVVDLEDAVPDSKQLEKNSERIEKTRGFMIHKRRHETHRDPRTRVNDWKEFTNPITKKDAKYQTARCMDCGTPFCLSDTGCPLSNIIPKFNELLFKNQWKLALDKLLETNNFPEFTGRVCPAPCEGACTLGIIEDPVGIKSVERIIIDNAFKEGWIKPCPPSTRTGFTVGVIGSGPAGLACADMLNRAGHTVTVYERSDRCGGLLMYGIPNMKLDKAIVQRRIDLLSAEGIDFVTNTEIGKTISMDELKNKHNAVVYAIGSTIPRDLPIKGRELKNIDFAMQLLESNTKALLNKDLEIIREKIQGKKVIVVGGGDTGNDCLGTSVRHGAASVLNFELLPEPPVERAKDNPWPQWPRVMRVDYGHAEVKEHYGRDPREYCILSKEFIGNDEGEVTAIRTVRVEWKKSQSGVWQMVEIPNSEEIFEADIILLSMGFVGPELINGNDNEVKKTRRGTIATLDDSSYSIDGGKTFACGDCRRGQSLIVWAIQEGRKCAASVDKFLMDGTTYLPSNGGIVQRDYKLLKELASQV

SEQ ID NO: 4411 - DNA, 1485 bp, Synechocystis sp
  CDS (1)..(1485)
atgggcaaacccactggttttctggaatatacccgcgaaattccccaagagttaagccccggcgatcgcctgaggaattgggacgaattccatgtgaccatgcccgataagcaggtggaaacccagggagcccgttgcatggattgcggcacgcccttttgtcacaccggtagtttgatcagtggcatggccagtggttgcccaatcaataacctcatcccggaatttaatgacctagtctatcgggggctgtggcgggaagctttagatcggcttcacaagactaataactttcctgaatttactggccgggtttgtcccgctccctgcgaaggctcctgtgtgttgggcatcaataatcctccggtgaccatcaaaaatattgaatattccatcatcgaaaagggttggcaggaaggttgggtaacgccggaaccgcccgcaaaacgcacggggaaaaaagtagccgtagttggttctggccccgctggtttagccgccgccgcccagttaaacaaagccggtcattgggtaacggtttatgaacgggaagaccgccccggcggtttgcttatgtacggcattcccaatatgaagctggataaggaagaagtggtgctacgccgcttaaacgtgctggaagcagagggagtcacctttgtttgcaatacggaaattggcaaggatttacccccggaaaccctactcaaggactacgacgcggtggtgctctgtaccggtgccactaagcccagggatttggcgatcgccggtcgggaactggaaggcatccacttcgccatggaatttttgaccgccaacactaaggcaattttagataaaactcccggcccgaatttcattagtgccaaggataaagacgtggtaattatcggtggaggggacaccggcaccgactgtgtgggtacttccctccgccacggttgcagaagcctagtgcaattggaaattatgcccaaacccccggaggaacgggccgccaacaacccctggccagaatggcccaaggtttacaaaatggactacggccaggaagaagccgccgccgtctatggccatgatccccgcagttacctcaccactgccaccaaaattgaaggggatgaccaggggcgggtcaaagcagtccataccgtcgatgtccgttgggaaaaggatgggcagggacgatttattccccagcaagtggctggcacggaacaggtcagaccagctcaattagtcttgctagccatggggtttgtgggaccagaaagtcaactgctggatgcaatgaaattggataaagatgcccggggcaatattaaagctgaatacggtcagtatgaaaccagtattcccggggtatttgcggcgggggactgtcgccggggccaaagtttggtggtctgggctttcaacgaaggtcggggggcagccaaagcctgtgacctttacttaatgggggaaacagacctcccctag

SEQ ID NO: 4412 - protein, 494 aa, Synechocystis sp
MGKPTGFLEYTREIPQELSPGDRLRNWDEFHVTMPDKQVETQGARCMDCGTPFCHTGSLISGMASGCPINNLIPEFNDLVYRGLWREALDRLHKTNNFPEFTGRVCPAPCEGSCVLGINNPPVTIKNIEYSIIEKGWQEGWVTPEPPAKRTGKKVAVVGSGPAGLAAAAQLNKAGHWVTVYEREDRPGGLLMYGIPNMKLDKEEVVLRRLNVLEAEGVTFVCNTEIGKDLPPETLLKDYDAVVLCTGATKPRDLAIAGRELEGIHFAMEFLTANTKAILDKTPGPNFISAKDKDVVIIGGGDTGTDCVGTSLRHGCRSLVQLEIMPKPPEERAANNPWPEWPKVYKMDYGQEEAAAVYGHDPRSYLTTATKIEGDDQGRVKAVHTVDVRWEKDGQGRFIPQQVAGTEQVRPAQLVLLAMGFVGPESQLLDAMKLDKDARGNIKAEYGQYETSIPGVFAAGDCRRGQSLVVWAFNEGRGAAKACDLYLMGETDLP

SEQ ID NO: 4413 - DNA, 3255 bp, Caenorhabditis elegans
  CDS (1)..(3255)
atgtcgtacgacttttatgcgttttgtttgtcaattttcatattttgtaaatttttcaacatcatatttacagccatgactccaaagccaaatactactagtccaaccaataatcttcctcttctcagcaaggactccccggatatcgagagtctcctcatcttgaacccaaaagtacaagacaaggcaaatgcagttccaagtgcggtgacaaagaaaaacaagcacaactggaagagaaacgaggagaaaggatgtggatctacctgcggagaatctaagctcaagaatgacttccgagacatcaagcacactacgctcagtgagcgcggagctttgaaggaagcgatgagatgtttgaaatgcgccgacgctccttgccaaaaaagttgcccaacccaattggatgtcaaaagcttcataactagcatttcaaacaaaaactactacggagcagctcgtcaaattctttctgacaacccactgggtctgacctgtggaatgatttgcccaacatcggatctttgtgttggatcgtgtaacttgcaagcaagtgaagaaggcgctatcaacattggtggtcttcagcagtatgcttgtgacgtgttcaagcaaatgaatgttcgtcaaatcgtatcaaaggaagttcgggagaaccgcaacgcttctcataaggagcaagttgctcttatcggatgcggaccggccagtatttcatgtgcatcgtttttggctcgtttaggatatacagatattactatctatgaaaagagagcttacatcggagggctttcatctgctgaaattccacagttccgtcttccttatgacgttgttgactttgaaattcagcttgccagagacattggagtccagattgaaacaaacagacctttaggaaaagacggtctaacacttgccaaattgaaggaacaaggagctgccgctgtttttattggtatcggaaacccagaaccaaaaattgatcctctctttgaaggattgacaattgagaatggattttatactagcaaaaattatcttccagctgtcgcggctgctagcaaacctggtatgtgcggatgtaagagaactccacttccaacaatgagaggacgtgtcgttgtgctcggagcaggagatactgcaatggactgtgcaacatctgctctccgttgtggtgcatctcgtgtcaccattgctttccgcaaaggtttcactggaatccgtgctgttcctgaagagatggaagcagccaaggaagaaaaatgtgagttccttccattctcagcgccacgaaaaatcaacgtgaaggacgggcgcattgtctcgatcgaattcaacaagaccgaacaagatgacaacggcaagtggtacgaggatgaggaacagattgttatcttgaaatgcgactatgtgatttccgcatttggatccacgttgaaagaagacgcagttttgtcggctttgcaaccatgccagttgaataagtggggaggaattgaagtagattcaacaacacaacaaacttcggaaaaatgggtatttgctggaggagatgtggcaggagtcgcagaaacaaccgtcgaatctgtcaatgatggaaagattgccgcctggaatatgcatcgctacattcaatctcttcacggcaaccaggtgtccgagaccccagaacttccacaattcttcaccccaatcgacgaggttgatatctccgttgacatgtgcggcgttaaattcgaaaatccattcggactggcttctgctcctccaaccacttctggaccaatgtgtcgccgtgctttcgaacaaggatggggattcattctcaccaaaacatatggattggacaaggacttggtcaccaatgtctctccacgtattgtccgaggatctaccagtggaccactttatggaccaaaccaaggatcattcatgaatattgagcttatctcagagaaatcctgtgaatactggcttcaatgtattagggagttgaaacgtgaccatccaactaaaattgtcatcgcatcgatcatgtgcgtctataacaaggctgattggattgagcttgcaacaaagagtgaggaagctggagcagatattcttgagctcaacctctcttgtccacatggaatgggagaaaagggaatgggattggcttgtggacaaagccccgaaattgtaaaggaaatttgtagatgggttcgcgcttgtgtcaagatcccattcttcccaaaaatgactccaaatatcactgacgttcgtgagatcgccagagctgctagagacggaggcgcaagtggagtgactgcaacaaataccgtttcctcacttatgcacatgaaggctgatggaaatgcttggccagcaattggatcaacaaaaagaaccacatacggaggaatgtccgggtcggctattcgtccaatcgctatgaaggctgtctcatcaatcgctaacgaactagatggtttcccaatcatggcgaccggtggaattgaaagcgcagagactggactcggattcttgatggcaggagcttcagtcctccaagtttgctccgcagttcagaatcaagatttcacagttgtcgacgattactgtactggactcaaggcacttctttatctttctggcgctgagtcactcaaaaactgggatggacaatcgccaccaatcgaaaaacatcaaaaaggaaaacctatcttgcttcaaggacaaaagaaaatgccattcttcggaaagtacagggatgaacgtgaaaagcttgaggctattaaactgtcagaaagcaaccttttggacaccgaaaactatcactttgcttcgagaccagacactcaagtttcgcgtgtcccaactgttgaagatgtcattggaaaagccctgccacgtattggcccatatgtcacactcgacaaccaagagcagaaggttgcaattattgatgatgatatgtgcatcaattgtggaaagtgttatatgacatgcaatgattctggataccaagctatcacttttgatccagtcacccatcagccacatgttacggaagacgattgtactggatgtactctttgctacagtgtgtgcccgattccggaatgtatagaaatggtgccaagaactgggccatggaaggctccaaaacgtggtgtgaagccatcggtcgagccaggaactccaaaagtcgtcaaagttgaccaacgtggaagagttatcctagatactactggtggaatgcagtaa

SEQ ID NO: 4414 - protein, 1084 aa, Caenorhabditis elegans
MSYDFYAFCLSIFIFCKFFNIIFTAMTPKPNTTSPTNNLPLLSKDSPDIESLLILNPKVQDKANAVPSAVTKKNKHNWKRNEEKGCGSTCGESKLKNDFRDIKHTTLSERGALKEAMRCLKCADAPCQKSCPTQLDVKSFITSISNKNYYGAARQILSDNPLGLTCGMICPTSDLCVGSCNLQASEEGAINIGGLQQYACDVFKQMNVRQIVSKEVRENRNASHKEQVALIGCGPASISCASFLARLGYTDITIYEKRAYIGGLSSAEIPQFRLPYDVVDFEIQLARDIGVQIETNRPLGKDGLTLAKLKEQGAAAVFIGIGNPEPKIDPLFEGLTIENGFYTSKNYLPAVAAASKPGMCGCKRTPLPTMRGRVVVLGAGDTAMDCATSALRCGASRVTIAFRKGFTGIRAVPEEMEAAKEEKCEFLPFSAPRKINVKDGRIVSIEFNKTEQDDNGKWYEDEEQIVILKCDYVISAFGSTLKEDAVLSALQPCQLNKWGGIEVDSTTQQTSEKWVFAGGDVAGVAETTVESVNDGKIAAWNMHRYIQSLHGNQVSETPELPQFFTPIDEVDISVDMCGVKFENPFGLASAPPTTSGPMCRRAFEQGWGFILTKTYGLDKDLVTNVSPRIVRGSTSGPLYGPNQGSFMNIELISEKSCEYWLQCIRELKRDHPTKIVIASIMCVYNKADWIELATKSEEAGADILELNLSCPHGMGEKGMGLACGQSPEIVKEICRWVRACVKIPFFPKMTPNITDVREIARAARDGGASGVTATNTVSSLMHMKADGNAWPAIGSTKRTTYGGMSGSAIRPIAMKAVSSIANELDGFPIMATGGIESAETGLGFLMAGASVLQVCSAVQNQDFTVVDDYCTGLKALLYLSGAESLKNWDGQSPPIEKHQKGKPILLQGQKKMPFFGKYRDEREKLEAIKLSESNLLDTENYHFASRPDTQVSRVPTVEDVIGKALPRIGPYVTLDNQEQKVAIIDDDMCINCGKCYMTCNDSGYQAITFDPVTHQPHVTEDDCTGCTLCYSVCPIPECIEMVPRTGPWKAPKRGVKPSVEPGTPKVVKVDQRGRVILDTTGGMQ

SEQ ID NO: 4415 - DNA, 6624 bp, Caenorhabditis elegans
  CDS (1)..(6624)
atgtgctgcttttttcgacatcgtgagtcaatgcccattgctccaaattacgtcccggtatattgtatactaaaacaaaaatctcacggtttgataatggttattctaaccaaggaacagcagcaagaagccgccaacacgggactgtggctaccacaacttgaacgcgatgcgtgcggagtcggattcgtctgctccatcaagggaaccacgtccagcaaaatcatgtcggatgcccgtactatgctcgagagaatggctcatcgcggagcttgtggctgtgacaacgattcgggtgacggtgccggtgtcttgactgctatacccgatgatctctacagaaaatcggttaaggagcaggatggatctgatctcccaccattgggtcaatacgccacgggaattctatttcttgaagctgaatcgtacaagcaggcaaaggaggctttccaggatttggcccgagcttgcggtttgcgggttgttgcctggcgcaagctaggaaccaatcgtgaatgcatcggagaggaggcaaagaagacggagccactgattcgtcaagtttttgtcagtgctgactatgctgagagcgatccagctaaattcgagagaagtgtttacttgcttcgcaagcaggctgttaacagcatgaccaagcaagaaattgaatgttatgtgtgctcattgagtacctctaccatcgtttacaaaggacagttcaacactcatcagttgttcaaattttacgatgatttgaccaatccagaatatcaaacacatctggcccttgtccactcgcgtttctcgactaacactttcccaagttggaatcgtgctcaacccaacagaattttggctcataatggagaaatcaacactcttcggggaaacattaacttgatgcgtgctcgtgagggagtgatgaagagcaaatactaccgtgacgacctccagaagctgtttccgattgtggaagagggtctcaccgactctggatgtctcgacaacgtcatggagttcctggttcgcgctggtggaagatctttgccggaagcagcaatgacaatggtgccggaggcgtgggagaaggacgacgatatgtcgacggaaaagaagcacttttaccgttgggctgcaatgagcatggagccgtgggatggacctgcgcttcttgccttttcggatggaagatacattggcgccattcttgaccgcaacggacttcgacctgccagatactacttgacggatgatgatcatctatatttgagttcggaagttggcgtcaacgacattccaattgagaaagttgtcaaaaaggatcgtctcaaacccggacgcatgctccttgtggacacacatctcaaaaagatcgagctcgatgaggaccttaagacaagaattgctttgtcaagacctcataagcaactttccgcatcgagaatctacttggacttgattcgcaaggatgatgtgctctctcacggtgccgtcaccaatgaataccttaatcgtcttcatttggagcaggtgaaccctggtcttatgaagaaaaaggatgttcatctagactctgaccgtcgtctggccttgtatgcctatacccatgacactttcagcttgctcttagttccaatgatcaaggagaagaaggaagctctcgggtcaatggggaatgatgctgcgttggcttgtctgtctgattacagcccgctgttgttcagttatttccagcaactcttcgcccaggtcaccaacccaccaattgaccctttccgtgaacaaatcgtcatgtcgttgagatgcccaattggacctgagtctaacatgcttgagccagacaccgaacttgccagtcggctcatcttggagcagccagttctttcaatggttgatatggaggtcatcaaacgaactatgtacaagggatggaaagcaaaggaaattgacatcacttacccagtcaaatatggagtgaaaggactggtccctggtcttgacgccatgtgctgtgtcgcctgcactgctgcccttgatggatatcaaatcttggtattgtccgatagaaatgccagttccgaacgtgttccgatcccatcacttctcgccgtcggtgccattcatcagtgccttattcgtcatcggcttcgtatgaaggttgcgatcgttgtggaaactggagaggctcgagtcgttcacgacttctgtgtccttctgggattcggagctgacgcaatctgtccgtacatggtctacgagactatgcaccgtctgcgcaacttaggacttttggataaggaactcaatgatgatcaagtttatcaaggatatcgtcagggagtggaacgaggaatctttaaggtcatggcaaagatgggcatttctacgctccactcgtacaagcacgctcaaatcttcgagattgtgggactcgcaaaggatgttgtcgacatgtgctttaaaaacacagtctctcgtcttggtggcgccacgtttgagattctcgcggcggaagccttgaaaagacataggtcggctttccctacgacgagcgacgcgtcattcggtgactcaaaaacactggttgcaagtggaacgttccattggagagctggaggagagaagcatattaacgagccactggctattgccaaacttcaggctgccgctcgtctgaacaactccaagacattccaagagtactcactagcttcaaatatggctcaacgttggtgcactctgcgtggacaattggagatcaaaactagtaagaagattcaaatcccattgtcggaggtcgaaccagcaagcgagattgtcaagaagtttgtcactggagctatgtcatttggatctatttcctgggagactcacactgcgctcgccattgccatgaatcgcatcggtggaaaatcaaatactggtgaaggaggagagaaaccggaaagatatcgaaaggatcaggatccaaaccagaatcttcgctcggctatcaagcaagttgcgtctgctcgatttggagttacctcgtcttacttggctaacgccgacgagcttcagattaaaatggctcaaggtgcaaaaccaggagagggaggagaacttccagggcacaaggttactcaagatattgctgacacgagaaagtctacagccggagttggtctcatttcgccaccacctcatcatgatatttacagtattgaggatcttgctcagctcatctacgacttaaagtgcgctaacccggtggctcgtgtcagtgtgaaacttgtctcagaagctggagttggaatcgttgctgccggtgtggccaagggaaatgctgatcatatcaccgtttcgggacacgatggtggaactggagcttcgagttggactggtattaaacacgcaggattgccatgggagttgggagttgctgagacacatcaggtgctcacgatgaacaacctgcgttcacgcgtcgttcttcaagctgatggacaaattcgtactggacgtgacgtcatgattgctgcccttctaggagcagatgagtttggaatgtcaacagctcctcttattgttctcggatgtactatgatgagaaaatgtcacttgaacacctgcccggttggagtcgctactcaagatcctgttctccgtgcaaagtttgatggaaagccagaacacgttgtcaactatatgttcatggttgccgaagaggttcgctatttcctctccaaactcggtcttcgcaagttagaggacgcagttggaagaactgatcttctttatgcttcttctaatcctgtcaacaagaaggctactatgctcgagttcggatccattcttaagaacgcccaacaaatgttccctaacatctctatcaaaggaggaagtgtgaaacaagtgattgagctcggagctctggagacgagaatgctgactgaacttgatggtgttttcaatgatgctggagaacacaaagtatttgaaaacgagtacatcactaatattgatcgtactttcggaacgagaatttcgtatgagatttccaaacgttatggagagctcggattggaaggatcccgctcgataactattggcctcaagggacacgctggacagtcattctgtgcattcctcgctaagggagttagtgtcacgttggaaggagatgccaatgactatgttggaaaatgtctctctggtggaaaaattgtaattttcccaccgaaagctgcttcttacaaatctgaagagaattctgttattggaaatgttgccttatacggagctacttctggagactgttggtttagaggagttgctggagagagatttgctgtcagaaactcaggagctaacgtgattgtagaggcagttggagaccacggttgtgagtacatgactggtggacgtgtcatagttcttggatccataggaagaaactttgccgctgcgatgagtggaggaattgcatatctttttgcacaggaggataacttctctcgtctaatcaacgcagccaccgtcgatctcgatgatgcttccactgaagatctcatttttgttaaggcaaagattgaagagtttgtcaaacttactggatctgagcttggacagcgcattcttactaactggcaaaaggagcatcagaaaatcattaaggtgttcccgcgtgattacaaacgtgtgctcgccgagcaagaagaagctcgtaagaagcaagctgaattggataaggccaaccaggacatgagtcttctttcggtggatgatacaaagccccgtactagaactttgtcgatggacatgcaaattgcaccaacaatccgtcctcacaacaagaagcagaagactgcattgagaaagactagtttgctcggagacaagcgtaagcaacgtcgactttcaaagagtctgagaccacaggatatggctggttttgagaatgaggaggatcttcaagatgctgctgatatggaagaagaggaagagtccaagtctgatcttgaagatcactctgatgaggaggagttcgtcgagaagaaggccagcgtagatattgagtctcttggcattccagctcatcttcgtaagaaggacgagccactagacaaacttcgcggatttgttaagtacaaccgtcagaaaaaaatgtaccgtgatccaaaagagcgtctcaatgattgggacgaagtgtacgacttcgaggccgttcgcagcaacattcgtgagcaagctgctcgttgcatggactgtggagttccattctgccaaggacactcgggatgcccactcggaaacatcattccaaaatggaatgactttgtcttcaaaaagaactggcgccaagctcttgaacaacttcttcagaccaataacttcccagagtttactggaagagtatgtccagctccttgcgaaggggcgtgtactcttggaattggctcaccagcagtcactatcaagtcaattgaatgtgcaatcattgattatgctttcatgcaaggttggatgaagccatgcaagcctgcattcaacactggaaagagaattgcaatcattggatccggaccctccggactcggtgctgctgcccaattggtgaaggttggacacacggttgttgtctatgaacgcaaaaacagagttggtggacttctcagatacggaatcccaactatgaagctagacaagttcgtcgtggatcgtcgtgtatcgcttctggagcaagaaggagtacgattccttaccaacactgaaattggaaagcatgtgccagccgacttcttgcttaaggagaacgacgcaatcattgtttgcactggttccacaactgctcgtgatttgaacgttgaaggacgcgacgccaagggagtttgctttgctatggagtaccttgagaagagtcaacgccggcgtgcaggagatgatgtctcgtgggaaggacttgacccagccaacaagaaggttatcattctgggaggcggagacacggctactgactgtattgctactagcaacagacttggatgcaagactgttggtgctttcgaaattctgccacagccaggaccaaatcgtaagccggagaatccatggccagagtggccactcattttccgagtggactatggacacgaggaagcaaaagagatgactggctccgatccaagaacttactctgtttctactaagcgtttcctcacaactaccaacgccgccggtatcactgttctcactggacttgaaattgtggatgttgaatgggaaaaggatgacaagggtgcttggaagcttattgagaagaatgagactattcgcacaattgaatgcgatctctgcattctggctatgggattcgtcgggcccgaaaaatcggtaattgagcagttgaatctgaaaactgacccaagatccaacattctcactccaaaggacaaatacgattctgatgtggcaaaggtgttcgctgctggagattgtcgtcgtggacagtcactcgtggtgtgggccattcacgaaggacgtcaagctgcccgacaagttgacgagtatctaatgggcaagacaacattggcaggaccgggaggaattgtgaccgctacaattcaactgaagaatgccatttaa

SEQ ID NO: 4416 - protein, 2207 aa, Caenorhabditis elegans
MCCFFRHRESMPIAPNYVPVYCILKQKSHGLIMVILTKEQQQEAANTGLWLPQLERDACGVGFVCSIKGTTSSKIMSDARTMLERMAHRGACGCDNDSGDGAGVLTAIPDDLYRKSVKEQDGSDLPPLGQYATGILFLEAESYKQAKEAFQDLARACGLRVVAWRKLGTNRECIGEEAKKTEPLIRQVFVSADYAESDPAKFERSVYLLRKQAVNSMTKQEIECYVCSLSTSTIVYKGQFNTHQLFKFYDDLTNPEYQTHLALVHSRFSTNTFPSWNRAQPNRILAHNGEINTLRGNINLMRAREGVMKSKYYRDDLQKLFPIVEEGLTDSGCLDNVMEFLVRAGGRSLPEAAMTMVPEAWEKDDDMSTEKKHFYRWAAMSMEPWDGPALLAFSDGRYIGAILDRNGLRPARYYLTDDDHLYLSSEVGVNDIPIEKVVKKDRLKPGRMLLVDTHLKKIELDEDLKTRIALSRPHKQLSASRIYLDLIRKDDVLSHGAVTNEYLNRLHLEQVNPGLMKKKDVHLDSDRRLALYAYTHDTFSLLLVPMIKEKKEALGSMGNDAALACLSDYSPLLFSYFQQLFAQVTNPPIDPFREQIVMSLRCPIGPESNMLEPDTELASRLILEQPVLSMVDMEVIKRTMYKGWKAKEIDITYPVKYGVKGLVPGLDAMCCVACTAALDGYQILVLSDRNASSERVPIPSLLAVGAIHQCLIRHRLRMKVAIVVETGEARVVHDFCVLLGFGADAICPYMVYETMHRLRNLGLLDKELNDDQVYQGYRQGVERGIFKVMAKMGISTLHSYKHAQIFEIVGLAKDVVDMCFKNTVSRLGGATFEILAAEALKRHRSAFPTTSDASFGDSKTLVASGTFHWRAGGEKHINEPLAIAKLQAAARLNNSKTFQEYSLASNMAQRWCTLRGQLEIKTSKKIQIPLSEVEPASEIVKKFVTGAMSFGSISWETHTALAIAMNRIGGKSNTGEGGEKPERYRKDQDPNQNLRSAIKQVASARFGVTSSYLANADELQIKMAQGAKPGEGGELPGHKVTQDIADTRKSTAGVGLISPPPHHDIYSIEDLAQLIYDLKCANPVARVSVKLVSEAGVGIVAAGVAKGNADHITVSGHDGGTGASSWTGIKHAGLPWELGVAETHQVLTMNNLRSRVVLQADGQIRTGRDVMIAALLGADEFGMSTAPLIVLGCTMMRKCHLNTCPVGVATQDPVLRAKFDGKPEHVVNYMFMVAEEVRYFLSKLGLRKLEDAVGRTDLLYASSNPVNKKATMLEFGSILKNAQQMFPNISIKGGSVKQVIELGALETRMLTELDGVFNDAGEHKVFENEYITNIDRTFGTRISYEISKRYGELGLEGSRSITIGLKGHAGQSFCAFLAKGVSVTLEGDANDYVGKCLSGGKIVIFPPKAASYKSEENSVIGNVALYGATSGDCWFRGVAGERFAVRNSGANVIVEAVGDHGCEYMTGGRVIVLGSIGRNFAAAMSGGIAYLFAQEDNFSRLINAATVDLDDASTEDLIFVKAKIEEFVKLTGSELGQRILTNWQKEHQKIIKVFPRDYKRVLAEQEEARKKQAELDKANQDMSLLSVDDTKPRTRTLSMDMQIAPTIRPHNKKQKTALRKTSLLGDKRKQRRLSKSLRPQDMAGFENEEDLQDAADMEEEEESKSDLEDHSDEEEFVEKKASVDIESLGIPAHLRKKDEPLDKLRGFVKYNRQKKMYRDPKERLNDWDEVYDFEAVRSNIREQAARCMDCGVPFCQGHSGCPLGNIIPKWNDFVFKKNWRQALEQLLQTNNFPEFTGRVCPAPCEGACTLGIGSPAVTIKSIECAIIDYAFMQGWMKPCKPAFNTGKRIAIIGSGPSGLGAAAQLVKVGHTVVVYERKNRVGGLLRYGIPTMKLDKFVVDRRVSLLEQEGVRFLTNTEIGKHVPADFLLKENDAIIVCTGSTTARDLNVEGRDAKGVCFAMEYLEKSQRRRAGDDVSWEGLDPANKKVIILGGGDTATDCIATSNRLGCKTVGAFEILPQPGPNRKPENPWPEWPLIFRVDYGHEEAKEMTGSDPRTYSVSTKRFLTTTNAAGITVLTGLEIVDVEWEKDDKGAWKLIEKNETIRTIECDLCILAMGFVGPEKSVIEQLNLKTDPRSNILTPKDKYDSDVAKVFAAGDCRRGQSLVVWAIHEGRQAARQVDEYLMGKTTLAGPGGIVTATIQLKNAI

SEQ ID NO: 4417 - DNA, 6351 bp, Neurospora crassa
  CDS (1)..(6351)
atgggcgctatcgaggatttcgacgaccgacaagtgcatcttgaaacagagaaagagcagtatcatccctatgaataccaaacagagaataactcttcgtgggctggcgccttgccggtgaagcagggactgtacgatcccgagctcgaaaaggatgcctgtggtgtaggttttgcttgccatatcaagggcaagcccagtcacaagattgtcagcgatgcacgaaacctgctctgcaacatgacccatcgtggtgccgtgggctctgacgcacgcgatggcgatggtgcgggtgtcatgacatcgatcccccacaagttcttcgtgaagaacttcgcgcgcgatgtgggagttacgcttcctccactcggccagtatgctgtgggaaacttgttcttcaaacccgatccagagacactgcaggagtcgaagcggcagttggaagagattgccgagtcgttgggcttgagagttctaggatggcgagagcctcccgtggattcgactttgcttggccctgctgctctttcccgagagccttccattctgcagcctttcgttgtgctagcgtctgcttacgggcccggcaatgaaccagaaacaaccgatcccgagaagtttgacgagaggctgtttgagcggcagctctatgtcctccggaagagagctacacacacgattgggctgcagaactggttctacatctgctccctttccaacaagaacattgtctacaagggtcagctggcgccgattcaggtttaccaatactacaatgatttggtgaactatgactatgaggctcactttgccttggtgcattcgcgtttctccaccaacaccttcccctcttgggatcgtgcccagcctctccgatgggctgctcacaacggtgaaataaacacccttcgcggcaacaagaattggatgcgtgcccgtgagggagtcatgcagtctgatgtctttggagatgagctggaacttctctaccctattgttgaggctggcggttccgactctgctgccttcgataacgtgttggagctcctcaccatcaacggcgttctctctcttcccgaggccgtgatgctgatggtgcccgaggcttggcaaggaaaccagagcatggatcccaagaaggccgccttctatgagtgggcagcttgccaaatggagccctgggatggccctgcgctctttacgttcgctgatggtcgtttttgcggtgccaacttggatcgtaacggtctcagaccttgccgttattatgtgatggacgacgatcgcattatctgcgcgtctgaggtcggcactatccccgttgagcccgagaagatcattcagaagggccgtctccaacctggccgcatgcttctcgttgatactcgcgccggtcgcatcattgatgattccgagttgaaggctgctgtctctagccgggaggacttcaggtcatggctcgacaacgaactcatcaccatgcctcaggtgctcgagacgctttccgggagccagagcattgagcttgctgccaagcctgataacaccaagatccaggaggaccccctgttgcacgcttttggatacacctttgagcaggtgagcttgctgcttggccccatggcctcggatgaaaaggaggctcttggttccatgggcaacgatgctccgcttgcctgtctgtccgatgctcccaagttgctgtacgaatatttccgtcagctgttcgctcaggtcaccaacccgcccatcgatcccatcagagagtcgattgtcatgtctcttgaatgctacgttggtccccagggcaaccttctcgaaatggactcgtcccaatgtggaagactcctgcttcctagccccatcctctccattcctgagttcaatgcacttaagaacatgtctactatccatcccgagtggactgtcaagaccattgacttgacattccccaagaaggaaggcattgagggctacattagacaccttgactatatttgtatggaggctactgccgctattgaagctagtgatcgtatcattgtgctgtctgaccgcaacacctccaaggaccgtgtcgctgtttctgctctcctcgctggtggcatggttcaccatcaccttgtcagcaacaagtggcgtgcaatggcagccattgtcgctgagacggccgaggctcgtgaggttcaccacatgtgcgtcctccttggctacggtgttgacgccatcaatccctaccttgccatggagtgcatcatcaagctcaacaaggagaagcttatcaagaagaagctgactgatgatgagctgatctacaactacaagcactcctgtgatggtggtatcctcaaggtcatgagcaagatgggtatctctaccttggccagttacaaaggtgcccagatctttgaggccttgggtgtcgatgacagcgtggttgagcgctgcttcaaaggtactgcctcccgtatcaagggtattacttttgaacttatcgctgaggatgccttccgtttgcacgagcgcggtttcccgtcgcgttataccgttgctgttcctggacttcccgagtctggtgagtaccactggcgtgacaatggcgaggcacatgtcaacgatcctacttctattgcaaacatccaggatgccgtccgtaccaagaacgacaagtcttacgaggcctactcactctccgagtacgagcagatcaaatcctgcacgcttcgtggtatgcttgacttcaattttgaagactgctctcctatccctattgaccaggttgagccttggaccgagattgttcgccgattctgcactggtgctatgtcgtatggttctatctccctcgaatctcactctaccctggccgttgccatgaacaggcttggtggcaagtccaacaccggtgaaggtggtgaggatcctgaacggtcccaaagactaccgaacggcgataccatgcgctcagccatcaaacaggtggcctcgggtcgctttggtgttacatctgcttatctggccgactctgacgaacttcagatcaagatggcacagggtgccaagcctggtgagggtggtgagcttcctggccacaaggtttccaagtccattgcccgcactcgtcactctacccctggcgtcggcctcatctcgccacctcctcatcacgatatctactcgattgaagacttgaagcagctcatttatgaccttaagtgctcgagtcctcgttctcgcgtttccgtcaagcttgtgtctgagactggtgttggtatcgtcgcctcgggtgtcgctaaggctaaggcagaccacattctcatctctggtcatgacggtggcactggtgcctctcgctggactggtatcaagtacgccggtctcccctgggagttgggtcttgctgaaactcatcagaccttggtgcttaacgacctgcgtgggcgcgttgttgttcagactgatggtcagcttcgtaccggccgtgatgtcgccattgcttgcttgctgggcgctgaagaatgggggttcgcgaccactcctctcattgccatgggctgcatcatgatgcgcaagtgccatttgaatacctgccctgttggtattgccactcaggaccctgaacttcgcaagaagttcactggtacgcctgagcatgtgatcaacttcttctactacgtagcgaacgagctccgtgctatcatggccaggcttggtttccgcaccatcaatgagatggttggtcatgttgaggtgctcaaggttcgtgaggatctcaggaccaagaagacctccaacattgacctatctctcatcttgactcccgcccataaactccgtcccggggtggcaactttcaatgtccgcaagcaggatcacaagctttacgttcgcttggacaacaagcttattactgaggctgagttgacccttgataagggactgccttcacgtattgagtgtgatatcgttaacactgaccgcgccatgggcacttcactgtcctaccaaatttccaaacgatatggcgagaagggactgcccgatgacactgtccatgtcaatattaagggttctgcgggccagtccttcggtgctttccttgctccgggtgtcacactcgaattggagggcgatgccaacgattacgttggcaagggtttgtccggtggtagactgattgtctacccccctcgctccgctgtattcaaggctgaggagaacattatcgttggtaacgtgtgcttgtacggagccactagcggtacctgcttcttccgcggcgttgcagctgagcgtttcgctgtacgcaactctggtgccaccgccgttgtcgagggtgttggtgatcacggctgcgagtacatgacgggtggtcgggtcgtgatcctgggaagtactggccgtaactttgctgctggtatgtctggtggaatcgcctacatcttggatattcagggcgacttcttgaccaagctcaacaccgagatggttgaagccagcactcttgaggaggcggagcctgaagagatcgcattcatccgcagtctcgttgaggatcatcaccactacactggttccgagcttgctgctcgtattctggttgacttttcccgtgccctcaagcgcttcatcaaggtgctacccgtcgactacaagcgcgtactggaggaggagaaggccaaggctgtcaagcaggccgccgagaccaagcgggctgagtacagccttcctgcggctgcgagaaaggagaaggatcctcatgcgcccaagcttcaggatattgaggagagcattaccgataacgctatcagcaagaagaaggcccttgtattggacaagacgcgcggttttatgaagtatcagcgtcgtgctgagaagtaccggaagcccgcgactcgtgtcaaggattgggctgaactgtctcagcgtcttgatgaggacgaactcaagtaccagtctgcccgttgcatggactgcggtgttcccttctgccaatccgatagcggctgcccaatttccaacattatccccaagtggaatgagctggtcttccagggtcagtggcgagatgcattgaaccgcctgttaatgaccaacaacttccccgagtttactggtcgcgtttgccctgctccttgcgagggtgcttgcgtcttgggcatcaacgagcagcctgttggaatcaagtcgatcgagtgcgccatcattgaccgtggtttcgagatgggatggatggtaccggagccccctaagattcgcacaggcaagaacgttgccatcatcggatctggtcccgctggtctcgctgccgccgaccagctgaacaaggctggtcacaacgttactgtgtatgagcgcgccgaccgtcttggtggtctgctcatgtatggcattcccaacatgaaattggacaagcgcatcgtcaagagacgtactgatttcatggctgctgagggtgtccagttcaagactggcgttgcgattggcgaggatataacactcgtggatctcaagaagcaaaatgatgctgtcatcattgctaccggtgctactgtcgcccgcgaccttcctatcaagaaccgcaatcttgagggcattcatttcgctatggagttcctgcacaagaacaccaagtctcttcttgattccgaactggccgacggttcctacatctctgccaaggataagcatgtcattgttattggtggtggtgataccggtaacgactgcattggtacctctgtccgccacggtgccaagtcggtcatcaactttgagcttctccccaagcctcccccggctcgcggccgcgacaacccgtggccgcagtggccccgcgtgtaccgcgtggactacggccacgatgaggtcaagcaacacacgggcaaggatcctcgtgaatactgcatcatgtcggaggagtttgtcgatgacggcaacggaaaggtgaggggcatcaacacgatccgcgtggagtggaccaagtctgccagcggcggttgggacatgaagaagatcgagggctcgcagcagttcttccctgccgatcttgtcctgctgtccatgggctttttgggacctgaggctcgtgtgctcggcgatgaaatcgagaaggatcctcgcaagaacgtaaagactcctcccggcaagtatagcaccaacgtcgagggcgtgttcgctgccggtgattgccgtcggggacagtcgctcatcgtctggggtatcaacgaaggtcgccaggctgctcgcgaggtggatctctacctcgagaagagcacatgtttgcctgttactggcggtatcgtcaagcgcaccgctgaggaggtgttcgccgctgccgccgcagcttaa

SEQ ID NO: 4418 - protein, 2116 aa, Neurospora crassa
MGAIEDFDDRQVHLETEKEQYHPYEYQTENNSSWAGALPVKQGLYDPELEKDACGVGFACHIKGKPSHKIVSDARNLLCNMTHRGAVGSDARDGDGAGVMTSIPHKFFVKNFARDVGVTLPPLGQYAVGNLFFKPDPETLQESKRQLEEIAESLGLRVLGWREPPVDSTLLGPAALSREPSILQPFVVLASAYGPGNEPETTDPEKFDERLFERQLYVLRKRATHTIGLQNWFYICSLSNKNIVYKGQLAPIQVYQYYNDLVNYDYEAHFALVHSRFSTNTFPSWDRAQPLRWAAHNGEINTLRGNKNWMRAREGVMQSDVFGDELELLYPIVEAGGSDSAAFDNVLELLTINGVLSLPEAVMLMVPEAWQGNQSMDPKKAAFYEWAACQMEPWDGPALFTFADGRFCGANLDRNGLRPCRYYVMDDDRIICASEVGTIPVEPEKIIQKGRLQPGRMLLVDTRAGRIIDDSELKAAVSSREDFRSWLDNELITMPQVLETLSGSQSIELAAKPDNTKIQEDPLLHAFGYTFEQVSLLLGPMASDEKEALGSMGNDAPLACLSDAPKLLYEYFRQLFAQVTNPPIDPIRESIVMSLECYVGPQGNLLEMDSSQCGRLLLPSPILSIPEFNALKNMSTIHPEWTVKTIDLTFPKKEGIEGYIRHLDYICMEATAAIEASDRIIVLSDRNTSKDRVAVSALLAGGMVHHHLVSNKWRAMAAIVAETAEAREVHHMCVLLGYGVDAINPYLAMECIIKLNKEKLIKKKLTDDELIYNYKHSCDGGILKVMSKMGISTLASYKGAQIFEALGVDDSVVERCFKGTASRIKGITFELIAEDAFRLHERGFPSRYTVAVPGLPESGEYHWRDNGEAHVNDPTSIANIQDAVRTKNDKSYEAYSLSEYEQIKSCTLRGMLDFNFEDCSPIPIDQVEPWTEIVRRFCTGAMSYGSISLESHSTLAVAMNRLGGKSNTGEGGEDPERSQRLPNGDTMRSAIKQVASGRFGVTSAYLADSDELQIKMAQGAKPGEGGELPGHKVSKSIARTRHSTPGVGLISPPPHHDIYSIEDLKQLIYDLKCSSPRSRVSVKLVSETGVGIVASGVAKAKADHILISGHDGGTGASRWTGIKYAGLPWELGLAETHQTLVLNDLRGRVVVQTDGQLRTGRDVAIACLLGAEEWGFATTPLIAMGCIMMRKCHLNTCPVGIATQDPELRKKFTGTPEHVINFFYYVANELRAIMARLGFRTINEMVGHVEVLKVREDLRTKKTSNIDLSLILTPAHKLRPGVATFNVRKQDHKLYVRLDNKLITEAELTLDKGLPSRIECDIVNTDRAMGTSLSYQISKRYGEKGLPDDTVHVNIKGSAGQSFGAFLAPGVTLELEGDANDYVGKGLSGGRLIVYPPRSAVFKAEENIIVGNVCLYGATSGTCFFRGVAAERFAVRNSGATAVVEGVGDHGCEYMTGGRVVILGSTGRNFAAGMSGGIAYILDIQGDFLTKLNTEMVEASTLEEAEPEEIAFIRSLVEDHHHYTGSELAARILVDFSRALKRFIKVLPVDYKRVLEEEKAKAVKQAAETKRAEYSLPAAARKEKDPHAPKLQDIEESITDNAISKKKALVLDKTRGFMKYQRRAEKYRKPATRVKDWAELSQRLDEDELKYQSARCMDCGVPFCQSDSGCPISNIIPKWNELVFQGQWRDALNRLLMTNNFPEFTGRVCPAPCEGACVLGINEQPVGIKSIECAIIDRGFEMGWMVPEPPKIRTGKNVAIIGSGPAGLAAADQLNKAGHNVTVYERADRLGGLLMYGIPNMKLDKRIVKRRTDFMAAEGVQFKTGVAIGEDITLVDLKKQNDAVIIATGATVARDLPIKNRNLEGIHFAMEFLHKNTKSLLDSELADGSYISAKDKHVIVIGGGDTGNDCIGTSVRHGAKSVINFELLPKPPPARGRDNPWPQWPRVYRVDYGHDEVKQHTGKDPREYCIMSEEFVDDGNGKVRGINTIRVEWTKSASGGWDMKKIEGSQQFFPADLVLLSMGFLGPEARVLGDEIEKDPRKNVKTPPGKYSTNVEGVFAAGDCRRGQSLIVWGINEGRQAAREVDLYLEKSTCLPVTGGIVKRTAEEVFAAAAAA

SEQ ID NO: 4419 - DNA, 2387 bp, Rhodobacter sphaeroides
  CDS (587)..(1828)
gtcgaccggatggcgccggagccccgctatgacgatgcgatggacctgccgctgaacgtggcgctgaagatcggcttcatccagtgtctcgccatggtgccgggcgtgtcccgctcgggcgcgaccatcgtcggcgggctgatgctgggcgcgggcaagcgcgcggcggcggagttctccttcttcctctccatgcccaccatggccggcgccttcgccttcgacctcttcaagaatcgcgacgtgctggacgcttcggctctgggcgagattgcggtaggcttcgtggcagccttcgttgcggcggttctcgtggtgcgctggctgctcggctatgtgagccggcatggctacgcgctgttcggctggtggcgaatcgcagtgggatcggtggctctggcggcattgctggcaggctactgagaggttgggtcagtttagatgacctaaaatctgcggaaattggcggcgaccgggccgcgtcagcgaaaaatcgacaaataggtcagccttgctgacttttatgcccgccggacctggagtaacacgaccgcaccccgcagtcggcctcgagggaggcgtaagcatggcaaaagaaccgatgctccagttcgtcaagatggcgagggagacccccgagaaacgtccgcgttcgctgcgttctcaggactttcacgagatctgcggccggatctgcccgcaggaccgtctctgcgaggggaactgcgtgatcgagcagtcgggccacggcaccgtcaccatcggcgccgtcgagaaatacatcaccgacaccgcttgggaaaacggctgggtcgtgcccggcaagcccgcctacgagcggtcggagtcggtcggcatcatcggcgcgggtccgggcggcctcgccgcggccgacgcgctgcgccgcgcgggccttcaggtcacggtctacgaccgctacgaccgcgcgggcggcctgctgacctacggcatccccggcttcaagctcgagaaggacgtggtcgcgcgccgcgtcgagcagctcgagcaggcgggcgtccagttcgtgctgaactgcaacgtgggcgaggatctgagcttcgatgcgatccgcggccagcacgatgcggtgctgatcgcgaccggcgtctacaagcagcgcgacctcgcggcccccggtgtgggctcggcaggcgtggtgcaggcgctgtcctacctcaccgcctcgaaccgccgcagcttcggcgacgaggtggacgatgacggtctcgatgccagcggcaagcgcgtcgtggtgatcggcggcggcgacacggccatggactgcgtccgcaccgcgatccggcagggcgccaccagcgtgaagtgtctctaccgtcgcgaccgggccaacatgccggggtcgcagcgcgaggtggccaatgccgaggaggagggcgtggagttcgtctggctctcggcgccgcgcggcttcattgcgggcgatgcggtcgagggcgtgatcgtgcagaagatgcggctcggcgagccggatgcgacagggcggcagatgcccgagatcatcgagggcgccgactatgtcgaacctgccgatctcgcgatcatggcgctcgggttcgagcccgaggacctgccgacactctggggcgtgcccgacctgaccgtgacccgctggggcacgatcaaggccgacttccgcacccatgccacgagccttcccggcgtctatgccgtgggcgacatcgtgcggggcgcgagcctcgtcgtctgggcgatccgcgacggccgcgatgcggcgcagtcgatcctcgactatctggcgcaaccggccgtcgtcgcggccgaatagcgcctctgcgggatgcgaccgcccggaaggtcccgggcggccggtgcgggccgggcctctggagaggcgggcgcgaggtgatgggaccatgggcatgactcttctgacgaagatcctggcgggagggctcgcgctgatcgcggccgcccccgctttcggctcggggcagaccttcacgccgcccgagggctgcaccgcctttctcaccgtgcagtcgcgcggctgccgcgtgtcgcaccactaccgctgcgacaaggatcctgcgggcgacaagtggcgcgtggatttcgatcaggagggcatcttcttctcctcccacatcgaccgcgaggcgcagtgggtcgagagctacgagatgtttccgaccgtgcggcaggcgctcgacccggacccggccgacccggcctccttcaccgagcttctgagcggggcggacagctatgatttcggcctgacccgcagcacgggcgagcggagccgcgtgaccggctacgaccggctgaccggccgaagcttcaccatcgacgggattgtgcttcaggagaccgagttcgaattc

SEQ ID NO: 4420 - protein, 413 aa, Rhodobacter sphaeroides
MAKEPMLQFVKMARETPEKRPRSLRSQDFHEICGRICPQDRLCEGNCVIEQSGHGTVTIGAVEKYITDTAWENGWVVPGKPAYERSESVGIIGAGPGGLAAADALRRAGLQVTVYDRYDRAGGLLTYGIPGFKLEKDVVARRVEQLEQAGVQFVLNCNVGEDLSFDAIRGQHDAVLIATGVYKQRDLAAPGVGSAGVVQALSYLTASNRRSFGDEVDDDGLDASGKRVVVIGGGDTAMDCVRTAIRQGATSVKCLYRRDRANMPGSQREVANAEEEGVEFVWLSAPRGFIAGDAVEGVIVQKMRLGEPDATGRQMPEIIEGADYVEPADLAIMALGFEPEDLPTLWGVPDLTVTRWGTIKADFRTHATSLPGVYAVGDIVRGASLVVWAIRDGRDAAQSILDYLAQPAVVAAE

SEQ ID NO: 4421 - DNA, 1800 bp, Pyrococcus sp
  CDS (144)..(1589)
gcctgcatcgacgggcctgggttcgacgcctataaggtcgactgggacgagctgatacacaggacgggtttctacgccccgcttgagaggctcgcccttgagcactatctaaagcaactccaggcccagggaggtgagcagtgatgccgagaaggaagctcatcaaggagagggttccgacccccgagaggcccccggaggagaggattaaggacttcaaggaagtaaacctcggctacaccttcgaactggccgttaaggaagccgagcgctgtctgcagtgcccctacgagtatgcaccctgtatcaagggctgtccggttcacatcaacattcctggattcataagcaagctcgttgagtaccgcgacgatcctgacaaggccgttaaggaagccctcaacgtcatctgggcctgcaactcactcccagctacgaccggtcgtgtctgcccgcaggaagaccagtgtgaaatgaactgtgtcatgggcaaggtcggcgacaagataaacatcggcaagcttgagcgctttgttgctgactacgcccgcgagaagggcattgatgaggagcttctctttgagataatcccgaagatcgagaagaagggccagaaggtcgctatcatcggagctgggccagctggcctcaccgccgccggagagctggcgaagctcggctacgatgttaccatctacgaggccctccacgagcccggaggagtcctgatgtacggtatccccgagttcagacttccgaaggagattgtgaacaaggagattgagaagctcagaaagctcggcgtcaagatactcaccgaccacgttgttggcaggacagttaccatcgaagagctcctccaagagtacgatgctgtcttcattggttccggtgctggaactccgaggctaatcaacgccccgggaatcaacctcaacggaatctacaccgccaacgagttcctcacgagggtcaacctcatgaaggcctatctcttccctgaatacgacacaccggtttacgttggcaagaaggtcatcgttatcggcgctggaaacaccgcaatggacgccgctaggagcgccaggcgcttcggtgcagaggtgaccatagcctaccgccgcggtgaggaggacgtctcggccagggaggaagaggtcgagcacgccaaggaggagggcatcaagttcgtctacttcgtcaacccggtcgagttcataggcgacgagaatggcagggtcaaggcagtcaagttcgagaagatgaaggctctcgatgagagggacgccaggggcaagaggaagatagtcggtaccggcgagtacgtaaccctcgaagcggacaccgtcattatcgccattggaaagcacccgaacaggctcatcatcaacacacctggcctcaaggtcgagcgcggaaagatcgtcgttgatgagaacctcatgaccagcattccgggcgttttcgccggtggagatgccataaggggagaggcaaccgtcatcctggcgatgggtgatgggaggaaggccgcgaaggccatccacgagtacctcacgaagaagaggcaggaaaaggcgaacgcctgatttcttttcttcccctttgtggtaccgtatgctttttatgtctggaaaacctggcggtgaaaagacttataatgtcctattttgggagctattgagtgataccatggcatctgtttcagctgttataaggaatttccggccgcttgagggccgggcatacatcggtctcattggtctggcgatactgatgaatgcaaagtgggttagtcgt

SEQ ID NO: 4422 - protein, 481 aa, Pyrococcus sp
MPRRKLIKERVPTPERPPEERIKDFKEVNLGYTFELAVKEAERCLQCPYEYAPCIKGCPVHINIPGFISKLVEYRDDPDKAVKEALNVIWACNSLPATTGRVCPQEDQCEMNCVMGKVGDKINIGKLERFVADYAREKGIDEELLFEIIPKIEKKGQKVAIIGAGPAGLTAAGELAKLGYDVTIYEALHEPGGVLMYGIPEFRLPKEIVNKEIEKLRKLGVKILTDHVVGRTVTIEELLQEYDAVFIGSGAGTPRLINAPGINLNGIYTANEFLTRVNLMKAYLFPEYDTPVYVGKKVIVIGAGNTAMDAARSARRFGAEVTIAYRRGEEDVSAREEEVEHAKEEGIKFVYFVNPVEFIGDENGRVKAVKFEKMKALDERDARGKRKIVGTGEYVTLEADTVIIAIGKHPNRLIINTPGLKVERGKIVVDENLMTSIPGVFAGGDAIRGEATVILAMGDGRKAAKAIHEYLTKKRQEKANA

SEQ ID NO: 4423 - DNA, 1332 bp, Rhodobacter capsulatus
  CDS (1)..(1332)
atgaccacaagccagtttcgacccggggtgcaccccgggcgtcttccgcccgaggggtattgcacggcctttgccgatgtggcgccgcctttgacggcgcatcaggcgcaggtggccgccgcgcgctgctatttctgcgccgaggcgccctgcaccacggcctgcccgtccgacatcgacgtgccgctgttcatccggcagatcctgaccggcacgccggaggccgcggcaaggacgatcctgtcgcagaatatcatgggcggcatgtgcgcccgggtctgcccgaccgaaaccctgtgcgagggcgcctgcgtgcgcgaggccgccgagggcatgccggtcgagatcggcgcgctgcagcgctttgccaccgaccggctgcaggccgcgggcgtgcatcccttcacgcgcgcgccgcgcacggaaaagtctgtcgccgtggtgggggcggggcctgcgggtctggcctgcgcgcatcggctggcgatgctgggccatgaggtcaccgtttatgacgcgcggctgaaaccgggcgggctgaatgaatatggcattgccgcctacaaggcgccgggcggctttgcggccagggaagtggcctggcttttgcagatcggcggcatcgcggtgctggaaaactggaaactcggccgcaacggttcggtggcggatctgctggccgagcatgacgcggtgtttctgggcatggggctggcgggcgtgaatgcgctgaccattcccggcgccgaacatgccacccccgcgaccgagttcatcgcgcatctgcgtcaggccggggatctggcgacggtgccggtggggcggcgcgtcgtggtgatcggcggcggcatgaccgcggtcgatgcggcggtgcaggcgaaacttctgggcgcggagacggccagcatcgtctatcgccgttcgcaagccgagatgcccgcctcggcgcatgaacaggagcatgcgcaaaagaacggcgtgcggatcgtgccgaatgcggcgcccgtggcgatccgcaaggacgatcagggctatgaggtcgaattcgcccgcaccgagacccagggcggcaagctggtgcagctggacgacaccttgcgcatcaaggccgaccagatcttcaccgcgatcggccagacgcttgggccggtgcccgaggggctgacgatcaccggcggcaagatcgagatcgacgcgcaggggcgcaccgggatggcgcatgtctgggcgggcggcgattgcgccacaggcggcgaagatctgacggtgaccgccgtcgcgcagggccgcgatgcggccgaagacatccacgcttttctgatgggggcctga

SEQ ID NO: 4424 - protein, 443 aa, Rhodobacter capsulatus
MTTSQFRPGVHPGRLPPEGYCTAFADVAPPLTAHQAQVAAARCYFCAEAPCTTACPSDIDVPLFIRQILTGTPEAAARTILSQNIMGGMCARVCPTETLCEGACVREAAEGMPVEIGALQRFATDRLQAAGVHPFTRAPRTEKSVAVVGAGPAGLACAHRLAMLGHEVTVYDARLKPGGLNEYGIAAYKAPGGFAAREVAWLLQIGGIAVLENWKLGRNGSVADLLAEHDAVFLGMGLAGVNALTIPGAEHATPATEFIAHLRQAGDLATVPVGRRVVVIGGGMTAVDAAVQAKLLGAETASIVYRRSQAEMPASAHEQEHAQKNGVRIVPNAAPVAIRKDDQGYEVEFARTETQGGKLVQLDDTLRIKADQIFTAIGQTLGPVPEGLTITGGKIEIDAQGRTGMAHVWAGGDCATGGEDLTVTAVAQGRDAAEDIHAFLMGA

SEQ ID NO: 4425 - DNA, 4358 bp, Rattus norvegicus
  CDS (59)..(3136)
aattcccgcagtggagggagggtcagtgtgcgggagactgaggccagaaagcgttgccatggcgggtgtgctgagcagggacgcgccggacatcgagagtatcctggctttaaatcctcgaatacaagctcatgcgactcttcgttccaccatggccaagaaactagacaagaaacattggaaaaggaacactgataagaactgctttatctgtgagaagctggagaataattttgatgacatcaagcacacgactcttggtgagcgaggggctctccgagaagcagtgagatgcttgaaatgtgcagatgctccctgccagaagagttgtcccacgtctcttgacattaagtcattcatcacaagtatcgccaacaagaactactatggtgcagctaagctgattttttccgataatcctcttggtcttacttgcggaatggtttgtccaacatctgacctctgtgtcggaggatgcaacttacatgctactgaagaggggccaattaatattggtggactgcagcagtttgctaccgaggtgttcaaagcgatgaacatcccacagatcagaagcccgttgctgcctcctccggaacatatgccggaagcttactcagcaaaaattgcgctgtttggagctgggcctgcgagtataagctgtgcctcctttctggctcgactgggctattccgacatcaccatatttgaaaagcaagaatacgttggtggcttaagcacttctgaaatccctcagtttcggctcccatatgatgtcgtgaattttgagattgagctcatgaaggaccttggtgtcaagataatttgtggtaaaagcatttccacagatgaaatgactcttagtactttgaaagaaaatggctacaaagctgcttttattggaataggtttgccagaacccaaaaaggaccatattttccaaggcttgacacaagtccagggattttacacatccaaagactttttgccacttgtcgccaaaggtagcaaaccaggaatgtgcgcctgtcactctccattgccatccgtgaggggagccgtgattgtactcggagctggggacactgcgtttgactgtgcaacatccgctctgcgctgcggagcacgtcgcgtgttcatcgtcttcagaaagggctttgctaatattcgagctgttccagaggagatggagcttgctaaggaagagaaatgtgaatttttgcctttcctttccccacggaaggttatagtcaaagatggaaagattgtaggaatgcagtttgttcgaactgagcaggatgaaaccggaaactgggtcgaagatgaagagcagatagtgcgtttgaaggctgatgtggttattagcccctttggatctgtcttggatgatcccaaagtgatagaagcattgagtcccatcaagtttaacagatggggtctccctgaagtaaacccagaaaccatgcaaaccagtgagccatgggtatttgcaggtggtgatgttgtgggtatggctaacaccacagtggaatctgtcaacgatggaaaacaggcttcatggtacattcacgagtacatacaggcacaatatggagccttggtgccttcccagcctacactgcccctgttttacactcctgttgacctcgtggacatcagtgtggaaatggcagggttgaggttccccaatccctttggccttgccagtgcgacaccagccactagcacaccaatgattcgaagggcctttgaagcaggatggggttttgctttgaccaaaactttctctcttgataaggacatcgtgacaaacgtctcacccagaatcatccgagggaccacttctggccccttgtatggccctggacaaagctctttcctcaacattgagctcatcagtgagaaaacagctgcatattggtgtcacagtgtcaccgaactaaaggctgacttcccggacaacatcctgatcgccagcatcatgtgcagttacaacaaaaatgactggatggaactctccaaaatggctgaggcttctggagcagatgccctggagttaaatttatcctgtccacatggcatgggggagagaggaatgggtctggcttgtgggcaggatccagagctggtgaggaacatctgtcgctgggtgagacaatctgttcgggttccattttttgccaagttgaccccaaatgtcactgatattgtaagcatcgcaagagcagcaaaggaaggtggtgcagatggcgttacagccaccaacactgtctcaggcctgatgggactgaaagctgatggttcaccctggccttcggtgggcagtggaaagaggactacatatggaggagtatcaggaactaccatcaggcctattgctttgagagctgtgaccgccattgcccgcgctttgcctgggtttcctatactggccacaggtggaattgactcagctgaaagtggacttcagtttcttcatagtggtgcttcagttctccaggtatgcagtgctattcagaatcaggacttcactgtgattgaagattactgcactggcctcaaagctctgctttatctgaagagtattgaagagttatcagactgggatgggcagagtccacccactatgagtcatcagaaagggaaaccagttccacacattgctgagctcatgggacagaaacttccaagctttggaccgtaccttgaacggcgcaagaaaatcctagcagcaagtaaaatcagagagaatgatcaaaacagagcttgctcacctctccagagaaagcactttaactcccaaaagccgattcctgccatcaaggatgtaattggaaaatcactgcaatacctggggacgtttggtgagctgaacatcatggagcaagttgtggccctgatcgatgaggaaatgtgtatcaattgcggcaaatgttacatgacctgtaatgactctggctaccaggctatacagttcgatccagaaactcacctgcctactgttagcgacacatgtacaggctgcactctctgcctcagcgtctgccctattatggactgtatcaggatggtttccagggcaacaccttatgaaccaaagagaggcctaccattagccgtgaagccggtgtgttaaggtgatttgtaagacagctgctgtgaactttgatgttaccaacacaggctgatctttaaaacaataacaattgtaatcattatgatcagttctttccaaatttgatagctatgcatatataatttctaaataagcgtctaaattggaaaacaatgtctaatgccagtgaccaattaatggtcataaaatggaataattcttctctgaagtagctggtgagtaactgtggaccagttaattggatatgctcggtcagttgtctgctgtgaaaaattaactttttcatggcaattagtgtgacaatttctaaattgccctatgccgtgctcactctttgatttctaattgtaagcgaaatgaactattttggaacggagtgcgctttcatatacaggaaactgtttccaaggaaacactttgtaattaaaaattacctgtaattttaacactgcttctaaggacatgcaattagccccattaagaacaattgaagagagtcacgtcattatttactatgacaaggggaacacaacctggcagagggttttctagagttttcttacatccccctttgctgaagtaactcactctttggtgctggacactggaagggagattatttcctgactaaaatactgttcaccactcatccctgaaacaggtgtcagactgcccaggaatggagcacaggtcatttttatttgaatagcaaagctgtgctcctgatgaaataagatataaagatggatatctagtgaaggccacactgtcactgggcacagaccactcggtctgcttctcatagtcaccttcattatgagagcaattaacgttcaaacaagggctagattacacagcactgagccataggcttcacgctacaacagcaaaaacatcgtatctgaaatttatacataatgagacaaatgggtctgacgacgcttgaatgctcgtatgatttcaaaattgttgaaatcgacgtgtacttttaaatattgataaatattttctgtctctttatttttataatcaataaatagcatcatatgaactcatttattccttctttatgacatactttaaaatgaatctataggaaataagtgagaaataacagtctgtggcatatttctatgataaatgcacgatatctgcaagtgcactttaaaaatgtgtatgactaaataatcacaaataaaattttatgatttattgtggaatt

SEQ ID NO: 4426 - protein, 1025 aa, Rattus norvegicus
MAGVLSRDAPDIESILALNPRIQAHATLRSTMAKKLDKKHWKRNTDKNCFICEKLENNFDDIKHTTLGERGALREAVRCLKCADAPCQKSCPTSLDIKSFITSIANKNYYGAAKLIFSDNPLGLTCGMVCPTSDLCVGGCNLHATEEGPINIGGLQQFATEVFKAMNIPQIRSPLLPPPEHMPEAYSAKIALFGAGPASISCASFLARLGYSDITIFEKQEYVGGLSTSEIPQFRLPYDVVNFEIELMKDLGVKIICGKSISTDEMTLSTLKENGYKAAFIGIGLPEPKKDHIFQGLTQVQGFYTSKDFLPLVAKGSKPGMCACHSPLPSVRGAVIVLGAGDTAFDCATSALRCGARRVFIVFRKGFANIRAVPEEMELAKEEKCEFLPFLSPRKVIVKDGKIVGMQFVRTEQDETGNWVEDEEQIVRLKADVVISPFGSVLDDPKVIEALSPIKFNRWGLPEVNPETMQTSEPWVFAGGDVVGMANTTVESVNDGKQASWYIHEYIQAQYGALVPSQPTLPLFYTPVDLVDISVEMAGLRFPNPFGLASATPATSTPMIRRAFEAGWGFALTKTFSLDKDIVTNVSPRIIRGTTSGPLYGPGQSSFLNIELISEKTAAYWCHSVTELKADFPDNILIASIMCSYNKNDWMELSKMAEASGADALELNLSCPHGMGERGMGLACGQDPELVRNICRWVRQSVRVPFFAKLTPNVTDIVSIARAAKEGGADGVTATNTVSGLMGLKADGSPWPSVGSGKRTTYGGVSGTTIRPIALRAVTAIARALPGFPILATGGIDSAESGLQFLHSGASVLQVCSAIQNQDFTVIEDYCTGLKALLYLKSIEELSDWDGQSPPTMSHQKGKPVPHIAELMGQKLPSFGPYLERRKKILAASKIRENDQNRACSPLQRKHFNSQKPIPAIKDVIGKSLQYLGTFGELNIMEQVVALIDEEMCINCGKCYMTCNDSGYQAIQFDPETHLPTVSDTCTGCTLCLSVCPIMDCIRMVSRATPYEPKRGLPLAVKPVC

SEQ ID NO: 4427 - DNA, 2124 bp, Moorella thermoacetica
  CDS (1)..(2124)
atgggagaggtggtatttagcacctggggaggaaaagttgtcgatcaccggggcggtccgtcggggggaggaccgtcctgggccggggaatttggcggtcggcagttaaaggcctttattggctgggatggtctcgtagtcaccgacccggccgtagacctgctggctgctttacaggcttactaccaggccgtccagggggaatcctgcggccgctgcgtaccctgccgggtagggaccagggttatttacaatgtcctggtacgcatcgccgggggcgaaggccttccctccgatttagaccttctccgacgggtggcctggattgtacgggatggttctctgtgcgagctcggccaggctggggccaaagctgttcttgattttttagattattatagcgaggccttgcgacctttcctggaggatagcggcagggtcgccgggggtcaacggagaccagggcctggaggccgggtgcaggttctggcttccggacgggtcctggtggggaacgaccgcggaaagggagcggccgccgcttccccggcagccggtttaacctataaaccttttgttactgcgccctgcctcaagcggtgcccggcccacctggacatcccggcttatattgacgccattaaggatggccgctatgaggaatccctggccatcatccgccagcggaccgccctggccggtgtcctgggacgggtctgcgtccacccgtgtgaagaaaactgccgccgcggcaatgttgacgaacccctggccatccggggcctgaagcgcttcgtagccgattatgaggtgaaacgcggccgccggccggtcgccgtctgcgggggtaatctctttacgggaccctggcggccggcaggacaggccggtggggaagaaacaacggccgtcacttcaggcaagaaggtagccatcatcggtgccggaccggcgggtctcagcgccgcctaccagctcgccggtcggggctataaagtgactattttcgaggccttgccggtggccggcggtatgctggcggtgggtattcccagctaccggttgccacgggatatcctggctggagagatcgaggccatcaaggctctgggcgtaaccatcaacctcaacacccgggtcggcgtcgacgtgaccatggaccaattacagcgcgattacgacgccgtctttattgctaccggcctccatgccagctcccgcatgggagtagccggcgaggatgaaggctatggaggatttatccccggggtcaagttcctgcgagatttgaacctggaccggtgtccttccctggagggcaaggtggtggccgtcgtcggcggcggcaatgtagcgatggattgcgcccgttccgccctgcgccggggggcccgggaggtgcaccttatttaccggcgttcccgggcggaaatgccggcccatgcgaccgaggtcagggatgccgaggccgagggggttatttatcacttcctggttaatcccaccgccctggtagcggaaaaaggcaatatcaagggtatgcagtgcgtccggatgaaacttggcgagccggacgattctggccggcgccggcccgtacccgtgccgggaacggagtttttcctgccctgcgatattgtggtgccggctatcggccaggcggccgacctgtctttcctggacggccggatcgaggtgggcaaacgtggtaccatcagtgttgacccggtgaccctggctaccagtgtccccggcgtcttcgccggcggcgatatcgtcctgggggccaggacggtagttgaggccgtggcccagggcaaccgggcggcagtttccattgaccagtacctgcgccaggggaccaccagtcccacggtagaggacgagctggacgcgtggctggaaaaggtcggcgtctatgacccggaagaggatgtaggaatctacggcggccggccgcggcaggcagaaagggtggcgccgttggccgagcgggtaaaggacttccgggaagttgaaggcggcttcgatttctacgcaggcagggccgaagccgaacgctgcctgcgctgttaccgggtcgggatgatggtcctggccggagagggggagagtaatggttaa

SEQ ID NO: 4428 - protein, 707 aa, Moorella thermoacetica
MGEVVFSTWGGKVVDHRGGPSGGGPSWAGEFGGRQLKAFIGWDGLVVTDPAVDLLAALQAYYQAVQGESCGRCVPCRVGTRVIYNVLVRIAGGEGLPSDLDLLRRVAWIVRDGSLCELGQAGAKAVLDFLDYYSEALRPFLEDSGRVAGGQRRPGPGGRVQVLASGRVLVGNDRGKGAAAASPAAGLTYKPFVTAPCLKRCPAHLDIPAYIDAIKDGRYEESLAIIRQRTALAGVLGRVCVHPCEENCRRGNVDEPLAIRGLKRFVADYEVKRGRRPVAVCGGNLFTGPWRPAGQAGGEETTAVTSGKKVAIIGAGPAGLSAAYQLAGRGYKVTIFEALPVAGGMLAVGIPSYRLPRDILAGEIEAIKALGVTINLNTRVGVDVTMDQLQRDYDAVFIATGLHASSRMGVAGEDEGYGGFIPGVKFLRDLNLDRCPSLEGKVVAVVGGGNVAMDCARSALRRGAREVHLIYRRSRAEMPAHATEVRDAEAEGVIYHFLVNPTALVAEKGNIKGMQCVRMKLGEPDDSGRRRPVPVPGTEFFLPCDIVVPAIGQAADLSFLDGRIEVGKRGTISVDPVTLATSVPGVFAGGDIVLGARTVVEAVAQGNRAAVSIDQYLRQGTTSPTVEDELDAWLEKVGVYDPEEDVGIYGGRPRQAERVAPLAERVKDFREVEGGFDFYAGRAEAERCLRCYRVGMMVLAGEGESNG

SEQ ID NO: 4429 - DNA, 1479 bp, Plectonema boryanum
  CDS (1)..(1479)
atgggaaaaccaactggattcatcgaatatctgcgcgaacttccttccgaactcgcaccactcgatcgcattcgcaattgggacgaattccacctctccatgcctgaggaaaatcttcgcactcaaggcgcgcgctgtatggattgcggcattccgttttgccatacgggaaccttaattagcggcatggcgagcggctgcccaatcaacaatctcattcctgaatggaatgatttgatctatcgcggactctggaaagaagcactcgatcgcttacataaaaccaacaatttccccgaattcactgggcgggtctgtcctgctccttgtgaagggtcgtgtgtactcggcattcacaatccacccgtcacgatcaagaacattgaatactcgatcgcagaaaaaggctggaacgaaggctggatcaagcccgaacctcctgccaaaagaacaggtaagaaaattgcgatcgtaggatctgggcctgctggactttctgctgcggctcagctcaataaagtcggacattgggtaactgtgtttgaacgggctgatcgtcccggtggcttgctcatgtatggcattcccaacatgaagctcgacaaacaagaagtcgtgatgcggcgattaaacatcctcgaagccgaaggtgtgaaattcgtttgcaatactgaaatcggaaaagatctgcctgctgaagacttgctgagagattttgatgcagttgtactctgcacaggtgcgacgaaaccgcgtgatttaccgatcgaaggtcgccaacttaaaggcattcacttcgcaatggactttctcaccgcgaacactcaagctgtactagaccaaaccgagccagcgattaccgctcaaggcaaagatgttgtgatcattggtggaggagacaccggaacggactgtgttgggacttcgattcgacacggctgtaacggtcttgtccaactcgaaatcttacctcaaccacccgaagaacgcgctcccaacaatccttggcctgaatatccaaaagtctacaaaatggactatggacaagaagaagctgccgcaaaattcggaggtgatcctcgggcttatctgagaacggcaacgcactttgaaggcgatgagcagggcaatgtcaaagcagttcacacggtcgaggtgcaatgggaacgcaatgaacaaggacagttcattcctaagcaaattccgggaactgagaaaatcattccggctcagttagtactactcgcaatgggatttttaggacctgagcaacctttactcgatgcaatgggactcgatcgcgatgcccgtagtaacatcaaatccgaatacggtagatacacgaccagtattcccaaggtgtttgcagccggagattgccgtcgaggacaaagtttagttgtctgggcattcaatgaaggtcgtggcgcggcgagagaatgcgatctctatctgatgggcgaaactaatctaccctaa

SEQ ID NO: 4430 - protein, 492 aa, Plectonema boryanum
MGKPTGFIEYLRELPSELAPLDRIRNWDEFHLSMPEENLRTQGARCMDCGIPFCHTGTLISGMASGCPINNLIPEWNDLIYRGLWKEALDRLHKTNNFPEFTGRVCPAPCEGSCVLGIHNPPVTIKNIEYSIAEKGWNEGWIKPEPPAKRTGKKIAIVGSGPAGLSAAAQLNKVGHWVTVFERADRPGGLLMYGIPNMKLDKQEVVMRRLNILEAEGVKFVCNTEIGKDLPAEDLLRDFDAVVLCTGATKPRDLPIEGRQLKGIHFAMDFLTANTQAVLDQTEPAITAQGKDVVIIGGGDTGTDCVGTSIRHGCNGLVQLEILPQPPEERAPNNPWPEYPKVYKMDYGQEEAAAKFGGDPRAYLRTATHFEGDEQGNVKAVHTVEVQWERNEQGQFIPKQIPGTEKIIPAQLVLLAMGFLGPEQPLLDAMGLDRDARSNIKSEYGRYTTSIPKVFAAGDCRRGQSLVVWAFNEGRGAARECDLYLMGETNLP

SEQ ID NO: 4431 - DNA, 2016 bp, Yersinia pseudotuberculosis IP 32953
  CDS (1)..(2016)
atgaatccatttattgttgctgacgctgagagctgtattggttgtcggagttgtgaagtggcttgtgtggtcgcccatcatgagggccagtttcctgataaaccggaatatttcaccccacgggtgaaagtattcaaaggcgatcaatgtgcgacggcagtattttgccatcattgtgaagatgccccttgtgccagcacctgcccgaatggtgccattgttgaattgaataatagtattcaggtgattcaggaaaaatgtattggctgtaaaacctgtatgatcgcctgcccgtttggcatgatgaccgtggtcaccgaaacggttcaacccgccagccaccgcttagcggatgtctatcggcgtacagaagcacaaaaatgtgacctttgtcttgatcagcctgatggcccagcctgtattaaaacctgccctacgcaggctctgaccttggtggaccaacaatatttactgcatcaacagcagcaaaagcgccaacacatggcgctgaatgagcacaatggccgcttgttcagtcgcgcggtggtacaggcggccagtgcatcgtcaaataaaagcatccgcgacgcaacaccggttaacctcttgcagcggccacgggcaccacgtctggagccgaaaaaaattccgttggcagagcgtaaaacgggttttgctgaaatctatctgccatttaccgaaagccaaatccatgaacaggctgaacgctgcctggaatgcggtgataaaaccatctgtcagtggacatgcccactgcataacgccatcccgaaatggatctcgctggcccatcaggggcggatccatgaagcagcagaattatcccatcaaaccagcagcttgcccgaagtgtgtggccgggtatgcccgcaagatcgcttatgtgagcagtcctgtacgctgaatgaccacgatggcgcggtcactatcgggcagattgagcggcatatcacggaaacggcactggcgaccggctggcggcctgatctgtcacaggtgaaacccagcggtaaacgggtcgctattattggcgctggcccagcaggtttgggctgtgcggatattctggtacgtaatggcatcacgccagtggtgtttgatcgttatcccgaaattggcggtttgctgacatttggtattccggctttcaagctggaaaaatcggtgatgactcggcggagagaaattttcaccgagatgggcgtggagttttgcctgaatacagaaattggccgcgatatcaccatggaaaacctgctccacgacttcgatgctctgttcctcggggttgggacctaccgttccatgcgctcaggattagaaaatgaggatgctcagggcgtttacgatgccttgccattcctgatcggtaacacccagcatttgatgggttacaccgccaatggcgctcacccttatgtcagtatgcaggaccaacgcgtggtggtgttggggggcggtgataccgccatggattgtgttcgaacctccctgcgtcagggggcaagccgcgtagtgtgcgcgtatcggcgtgatgagaagaatatgcctggttctaaacgtgaggtgaaaaatgcgcgtgaggagggggctgaatttatgttcaacctccagccgatgagcattgtggtcgatgaatcgggacaggtgacgggtatcaagatggttcgcactgaaatgggacaggcagatgcccaagggcggcgacaagccctgcctatcgccggttccgagcatcttattcctgctgatgccgtgatcatggcctttggtttcagcccgcaccggatgtcatggctggcagaacataacgtggtgctggataaacaggggcgcgtggttgcgccgactatctccggctatccctatcaaaccagtaatcccaaaatttttgccggtggcgacattgtgcgaggagctgacttgattgtgaccgccatcgcggaggggcgcaaagcggcagagagtattgcgtattatttgaacgttttataa

SEQ ID NO: 4432 - protein, 671 aa, Yersinia pseudotuberculosis IP 32953
MNPFIVADAESCIGCRSCEVACVVAHHEGQFPDKPEYFTPRVKVFKGDQCATAVFCHHCEDAPCASTCPNGAIVELNNSIQVIQEKCIGCKTCMIACPFGMMTVVTETVQPASHRLADVYRRTEAQKCDLCLDQPDGPACIKTCPTQALTLVDQQYLLHQQQQKRQHMALNEHNGRLFSRAVVQAASASSNKSIRDATPVNLLQRPRAPRLEPKKIPLAERKTGFAEIYLPFTESQIHEQAERCLECGDKTICQWTCPLHNAIPKWISLAHQGRIHEAAELSHQTSSLPEVCGRVCPQDRLCEQSCTLNDHDGAVTIGQIERHITETALATGWRPDLSQVKPSGKRVAIIGAGPAGLGCADILVRNGITPVVFDRYPEIGGLLTFGIPAFKLEKSVMTRRREIFTEMGVEFCLNTEIGRDITMENLLHDFDALFLGVGTYRSMRSGLENEDAQGVYDALPFLIGNTQHLMGYTANGAHPYVSMQDQRVVVLGGGDTAMDCVRTSLRQGASRVVCAYRRDEKNMPGSKREVKNAREEGAEFMFNLQPMSIVVDESGQVTGIKMVRTEMGQADAQGRRQALPIAGSEHLIPADAVIMAFGFSPHRMSWLAEHNVVLDKQGRVVAPTISGYPYQTSNPKIFAGGDIVRGADLIVTAIAEGRKAAESIAYYLNVL

SEQ ID NO: 4433 - DNA, 4160 bp, Xenopus laevis
  CDS (101)..(2923)
cccacgcgtccggccttgggtctacttctgcacttgtgctagtgattcatatatattttttaaaagccattgcacggcagaactgcagaaaacaaataccatgtctcgtatgctgagcagggacccgctggatattgagaacattttggccttgaatcccagaacaccaactcatgcctccttgtattcaacaacagccaagaagcagtctaaaaagctttggaagcggaaccctgacaaaagttgctcaaaatgcgagaaactagaaaacaattttgatgacatcaaacatacaactcttggtgaaagaggagcattgcgagaagcaatgaggtgcctaaaatgtgcagatgctccttgccagaagagctgcccaacaaacttagatatcaagtcatttatcacaagcattgcaaacaagaattactatggcgctgccaaagccattttttctgataacccacttggcttgacgtgcggtatggtatgtccaacgtcggacctctgtgttggaggatgtaatttatacgcatcagaagaaggaccaattaacataggaggacttcagcagtttgcaactgagattttcaaaactatgaacattcctcagatcagaaatccattgcttccttcaaccgaggccatgccagctcaatacacgactaaaattgcccttattggtgctggaccagctagtattagctgtgctaccttcttagctcggctgggatattcagatattactatttttgagaagcaaacatattttggaggattaagcacatcagaaatccctcagttccgcttgccatatgacgttgtcagttttgaaattgagcttatgaaggacctcggagttaaggtaattgagggcaagggcctgggaatgaatggaatgaatatcagatctttgaaggaagaaggttttaaagcaatattcattggtataggactaccacagccaaagatagatgatgttttcactggcctcacaatagaacatggcttttatacatccaaggacttcttaccactagtatcaaaagcaagcaaacaaggtatgtgtgcatgccactctccacttccatccattaaaggagcggtcattgtactcggtgctggagatacagcatttgactgtgcaacttctgccttgcgttgtggtgctcgcagggtttttgtggtgttcagaaaaggattcactaacatacgggcagttcctgaagaggtggagctggcaaaagaagaaaaatgtgaattccttcctttcctctctcctcgtaaagtgactttaaaaggtgggaaaataagtggtatggagtttgttcgtacagaacaagacgatgatggaaactggattgaggatgaagatcagaaaattcagctgaaagcagaagtggttatcagtgcgtttggttctgtgctaacagattctgcagttctagaagccatgataccaatcaaattcaacagatggggccttcctgaagctgatccagagacaatgcaaaccagtgaagctggagtttttgtgggtggagacattgctggcttagcaaatacaactgtggagtcagtgaatgatggaaaacaggcatcttggcatatgcacaaatatatacagtctctacatggagtgtctatcaataacaagcctgagcttcctttgtttaacactccaattgatttggttgatataagtgtggaaatggttgggctcaaattcctaaatccttttggcttggcgagtgctcctccaacaacaagtgccccaatgatacgtagagcctttgaagcaggatggggttttgctctcaccaaaaccttctcccttgaaaaggatatagtaacaaacgtatctccgagaatcatacgtggaactacctctggctccatatatggccctggtcaaggatctttcctcaatattgaacttatcagtgaaaagaccgctgcatactggtgtcaaagcatcactgagcttaaagctgactttccaaagcatattattattgccagcatcatgtgcagctacaacaaggatgactggacagagctttctctaatggcagaggcttctggtgccaatgctctggagttaaatctttcttgcccccatggaatgggagagaggggcatgggtctggcttgtggacaggatccagagctggtacgaaacatctgccgctgggttagacaagctgtcaaaattccattctttgcaaagctgaccccaaatgtcacagatgttgtgaaaattgcaatggctgcacaggaaggtggtgcagatggggttactgcaaccaatacagtttcaggtctgatgggacttaaagcagatgcaacaccttggcctgcagttggaagtgggagtaggaccacatatggtggagtgtctggaaatgccattaggccgattgctctaagagctgtatctgccattgcccgtgctcttccaggatttcccattttagctactggtggaattgattcagcagaaagtggcctgcagtttcttcacagtggagcttcagttttacaggtttgcagtgcagtgcaaaatcaagactttactgtgattgaagactattgcacagggctgaaagcactcctgtacctcaaaagtattgatgagcttcaagactgggatgggcaaagtccaccaactattcgccatcaaaaaggaaagccagtacctacaattgcagaaatcaaagaaacgaaacttccaagctttggcccatttttggaaaaacgcaaaagaatcttagctgaaaataaaatgaatgaattaacctccagcacaagtcctgcatcaaaggagaagactcattttgcgccaaagaaacctgttccctcagtcaaggatgtcattggaagagctttgcaatacattggatcttatagtcaattgaacatataagaacaagttgtagccctgattgatgaggaaatgtgcataaactgtggcaaatgctacatgacctgcaatgattctggttaccaggcgattgagtttgatccagagactcacctgccgacagtcaccgacacctgcactggctgcaccctgtgtcttagcgtctgtcctataattgactgcatcaaaatggttaccaggacgattccttatgtaccaaagagaggcttgcccttaactgttaatccagtttgttgaggtgaatagttcagcggttaatgtgaacctcatgtatactgctgctgacttagtatctcattatagtacattatgtggaatcagatcataatatagaaaaatagtgggtttttttttaattacacttgtatatggcagccatagcaatgcaagtatccttctgcaatgggctctaatatttacaaatcttattaactctctttcaatatggccattacattgcgtgccttaaagtagagcccattgtttcctaatttttacgacattaaagccggttaattcagcacaaatgataacataacagagcaaatgttttataatgcaattaaagtgccttgtttttccttcttcatattttctttttagttagaaaccgtgagccataattagtggcactaaaaacaaaaaattaagagaagaattactgtttgtaaacagacgatagatttacagtggggatttaactctggattaagttctttgtgcagagcgtccactgacaaaacataatgcatttcttaagccctagtacattaatgctcataatggacactgtataatgcataactattaaccctttagagcagtcagaattcactggagattttgtttttcatgtttgtacttgaaaaatgcctctgcttcattccctgtgctgttaaattgcattggttttattcaattaacattaaagggaattcctgtcctacatacaaaattgcaatatcaaactgcagagtaatagtctttcaccactcaaaggccataacttaaagtttgttttagtgtaggagatattttattgaatatatgtatgtttataggaatatgatgaatatataagtacatcaatagctgcacggtatagcctggggatcaatatgtgccatgtaatcaatggagttttttctcttatcaatatctatataaaattataaaataattaaagtctattaagccttaaaaaaaaaaaaaaaaaaaa

SEQ ID NO: 4434 - protein, 940 aa, Xenopus laevis
MSRMLSRDPLDIENILALNPRTPTHASLYSTTAKKQSKKLWKRNPDKSCSKCEKLENNFDDIKHTTLGERGALREAMRCLKCADAPCQKSCPTNLDIKSFITSIANKNYYGAAKAIFSDNPLGLTCGMVCPTSDLCVGGCNLYASEEGPINIGGLQQFATEIFKTMNIPQIRNPLLPSTEAMPAQYTTKIALIGAGPASISCATFLARLGYSDITIFEKQTYFGGLSTSEIPQFRLPYDVVSFEIELMKDLGVKVIEGKGLGMNGMNIRSLKEEGFKAIFIGIGLPQPKIDDVFTGLTIEHGFYTSKDFLPLVSKASKQGMCACHSPLPSIKGAVIVLGAGDTAFDCATSALRCGARRVFVVFRKGFTNIRAVPEEVELAKEEKCEFLPFLSPRKVTLKGGKISGMEFVRTEQDDDGNWIEDEDQKIQLKAEVVISAFGSVLTDSAVLEAMIPIKFNRWGLPEADPETMQTSEAGVFVGGDIAGLANTTVESVNDGKQASWHMHKYIQSLHGVSINNKPELPLFNTPIDLVDISVEMVGLKFLNPFGLASAPPTTSAPMIRRAFEAGWGFALTKTFSLEKDIVTNVSPRIIRGTTSGSIYGPGQGSFLNIELISEKTAAYWCQSITELKADFPKHIIIASIMCSYNKDDWTELSLMAEASGANALELNLSCPHGMGERGMGLACGQDPELVRNICRWVRQAVKIPFFAKLTPNVTDVVKIAMAAQEGGADGVTATNTVSGLMGLKADATPWPAVGSGSRTTYGGVSGNAIRPIALRAVSAIARALPGFPILATGGIDSAESGLQFLHSGASVLQVCSAVQNQDFTVIEDYCTGLKALLYLKSIDELQDWDGQSPPTIRHQKGKPVPTIAEIKETKLPSFGPFLEKRKRILAENKMNELTSSTSPASKEKTHFAPKKPVPSVKDVIGRALQYIGSYSQLNI

SEQ ID NO: 4435 - DNA, 2550 bp, Azoarcus sp
  CDS (1)..(2550)
atggaagccgtacagacatcggaaatcaggtggtggaaggcgagcaagccggtcggcatggccgagttcggcgcgccggtaaagctgagcatcgacggcgtcgaggtcgaggcgccggccggtgcgtcggtcctgaatgcggcgactgccgcgggtctctacattccggcgctgtgcgcgcaccccgatcttcctcctgccgggcagcgcggcgcgggtgagggcggctgcaacctgtgcatggtcgagatcgagggcacggacggcctttcgaaggcctgttcgaccactgtcacggccggcatggtcgtgacgacccagtcggcggcgatccagaccgtgcgccaggccaacctggcgaaggtcctcggtccgcacccgcatgtctgcctcacctgtccgcagcgcgacggctgttcgcgctcgcagtgctcctacggcaacccgcaggaaacgcgctgctgcacgattttctcgtcctgtgagctgcgcaaggtctccgactacatcggcatcccgaacaccaccccgccgtacaagcccgcgcagcttccgatcatcaaggacgagccgttcttcgatcgcgactacaacctctgtatcgactgccgccgctgcctcgtcgcctgtaacgacgtacgcggcgtgggctgtctcgaggtgaaggaagtcgagacgccgcagggcaagcgcacctacgtcggcacgattgcgccgacgctgctcgaatccggctgtaccttctgccaggcctgtgtgaccgtgtgcccgaccggcgcgctgatggaccgcacgctcgaccccgcgaagcgcgaggagtcgatggtgccgtgcaagagcgcctgcccggcggggatcgacgtgccgcgttacgtgcagctcgccgcagagggcaagtacggcgaggcgatcgccgtggtgcgcgagcggctcccgttcccgggtattctcggccgcgcctgttttgcaatgtgcgagtcggcctgccggcgcaaggatctcgacgacccgctgtcgatccgcaatctcaagcggattgctgccgataacgacacgggcctgtggcgcgagcatgctaagaagctgccggcgacgggcaagaaggctgcggtgatcggcgccggtccggccggcctgacggtggcgtactacctcgccaagcagggccacggcgtgaccatcttcgatgcgcagccggccgcgggcggcatggcgcgctacggtatcccgtcctaccgcgttccggccgaagtcatcgacaacgaggtcgcggaggtttctgctctgggcgtcgagttccgctacggtgccaaggtcgagagtgtcgatacgctcttcaacgatggctacggcgcggtgtttgtcggcatcggcgcgcagggcggcgacaatctgggtatccccggcgacgatctgcccggcgtggtcgatagcccgacctacctcaaggccgtgacgatgggcctcgtgaatacccccgagggcatccagaccggcaggaaggtggccgtgatcggcggcggcaacgtcgcgaccgacaacgcacgcagctcgcgccgcttcggcgccgaggtcgacatggtgtatcgccgcacccgcgaggagatgccggcacgcctggaggagttcgagggctgcgtggaggagggcgtgaatatccgctacttgctcgcgccgaagaagatcgagccgggcaccaacggtttccggctgcagatcacctacgcgaagatggcgctcggcgaggccgacgcgtccgggcgccgccgcccggtcgagaccggcgaggaagtcgtcgagggggtcgatctggtgatcgccgcgatcggccagttcccgaaccgtttcggaggtttcggcgtggagacggatcgcaagggccgcatcacggtgcgcgaggattcgatgctgacgagccggcccaaggtgtatgccggcggcgactgcgtgctcggaccttcgacgctgatcgaatcggttgcccagggccgcactgcggcctccgcgatggacatcgtgctaggcggcgacggcgacatctccgaagtgctgctgcgcagcggttgggagaccaacccgcgcatcggccgcaaggacggcttcaacacgacgcgcaagttccacccgatcatgctggcgccggagcagcgcaccggctgggacgaggtggagctcggcttcgacgatgcgacggcccgtgccgaagcggcccgctgcttcaagtgcaacctcgcgccgaagattgccgaagcgatcctgccgcccgagtcctcgctgaagttcgacgaggcgacgatcgcatccgtgccaaccgagtcgggcgtgttccaactgctcgatggcgacaagaacgtgctgatgatcaagggcgtcgagaatctgcgcgacgggctcatggaacagctcgaacgtggcggcgacgcgactaacttcgtgttcgaggaagcggcgctcttcacctcgcgtgaaagccagatgatccaggcttacctgcagcagtacggaaagatgccgggcggcgggtccgacgagctggacgacctgttctga

SEQ ID NO: 4436 - protein, 849 aa, Azoarcus sp
MEAVQTSEIRWWKASKPVGMAEFGAPVKLSIDGVEVEAPAGASVLNAATAAGLYIPALCAHPDLPPAGQRGAGEGGCNLCMVEIEGTDGLSKACSTTVTAGMVVTTQSAAIQTVRQANLAKVLGPHPHVCLTCPQRDGCSRSQCSYGNPQETRCCTIFSSCELRKVSDYIGIPNTTPPYKPAQLPIIKDEPFFDRDYNLCIDCRRCLVACNDVRGVGCLEVKEVETPQGKRTYVGTIAPTLLESGCTFCQACVTVCPTGALMDRTLDPAKREESMVPCKSACPAGIDVPRYVQLAAEGKYGEAIAVVRERLPFPGILGRACFAMCESACRRKDLDDPLSIRNLKRIAADNDTGLWREHAKKLPATGKKAAVIGAGPAGLTVAYYLAKQGHGVTIFDAQPAAGGMARYGIPSYRVPAEVIDNEVAEVSALGVEFRYGAKVESVDTLFNDGYGAVFVGIGAQGGDNLGIPGDDLPGVVDSPTYLKAVTMGLVNTPEGIQTGRKVAVIGGGNVATDNARSSRRFGAEVDMVYRRTREEMPARLEEFEGCVEEGVNIRYLLAPKKIEPGTNGFRLQITYAKMALGEADASGRRRPVETGEEVVEGVDLVIAAIGQFPNRFGGFGVETDRKGRITVREDSMLTSRPKVYAGGDCVLGPSTLIESVAQGRTAASAMDIVLGGDGDISEVLLRSGWETNPRIGRKDGFNTTRKFHPIMLAPEQRTGWDEVELGFDDATARAEAARCFKCNLAPKIAEAILPPESSLKFDEATIASVPTESGVFQLLDGDKNVLMIKGVENLRDGLMEQLERGGDATNFVFEEAALFTSRESQMIQAYLQQYGKMPGGGSDELDDLF

SEQ ID NO: 4437 - DNA, 1473 bp, Propionibacterium acnes
  CDS (1)..(1473)
atggctgatctgcacggctttatgaatgtgactcgacaggaggcggagcgtcgtccagtcgaagagcgcgtccaggactggaaagaggtctacccaggcggacctggtcacgctctgctgcccatcattacagaccaagcgagccggtgcatggactgtggtgtgcccttctgccataccggctgtccgttgggtaatctcatccctgactggaacgacctcatctggcgagacgaatggcgcgaggctctcagctgtttgcagaccaccaacaactttccagagttcaccggtcgattgtgccccgctccatgcgagacggcgtgtgtcgaagggcttaaccgcgccccggtcacgattaggaacgttgaggttgccatcattgataaggcctgggaagaccgccgcgtcattccggtggtgcctgagtggcattcactcaagacggctgcagtggtcggatctggccccgcaggactggcaaccgcccagcagctcacccgtgcggggcatacggtcgtcgtctacgagcgtgacgacgccatcggcgggttgctgcgttatggcatcccggattttaagatggaaaaatcggttctcgaccgccggattaagcagatggtgttggagggtaccgtcttcaagacgaatactgagatcggcgtcgatatcactggcgagcagttacgcgagcggtttgacgccgtcgtcttggctaccggtgccaccgttccacgcatgctggatgctccaggtattgagctcgacggggtctgttatgccatggagtacctcactcagcaaaaccgcgtcgtggcgggggcagaggtgcttgatcagatccacgctgacggtaagcatgttgtcatcatcggtggcggagatactgccaccgactgtgtaggcaccgcagtgcgtcagggcgcggcctcaattacccagctgcagtacaacccggagccgcccaaggaccgatcggctaactatccctggcccacttatccgctcattttacgggtctccagctccaatgaagagggcggacagcgggtgtactcgaccaacaccgtcgagatcgtcagtaatgaccggggccacgtcaaggcagttcgggtggtctcaggccatcgcgatgagaaccgggtgtttattgcggacgagggcagcgaacatgatctgccggccgacctagtgatctttgcgatgggattcgctcatccggagtatgacggtgttgttgccgagctggggctggaacttgacggacggggcaatattatcagaaatgatgcgtatgagactaatgtgccgggggttttcgcctgtggtgacgctggccgcgggcagtccctcgtggtgtgggccatcgcggagggacgcgcagctgctcacggtgttgatgcgtatctcaaaggatcaccgtcggtgctaccgaagccggtaaaaccgtcggatcgtcagatgacggtgtag

SEQ ID NO: 4438 - protein, 490 aa, Propionibacterium acnes
MADLHGFMNVTRQEAERRPVEERVQDWKEVYPGGPGHALLPIITDQASRCMDCGVPFCHTGCPLGNLIPDWNDLIWRDEWREALSCLQTTNNFPEFTGRLCPAPCETACVEGLNRAPVTIRNVEVAIIDKAWEDRRVIPVVPEWHSLKTAAVVGSGPAGLATAQQLTRAGHTVVVYERDDAIGGLLRYGIPDFKMEKSVLDRRIKQMVLEGTVFKTNTEIGVDITGEQLRERFDAVVLATGATVPRMLDAPGIELDGVCYAMEYLTQQNRVVAGAEVLDQIHADGKHVVIIGGGDTATDCVGTAVRQGAASITQLQYNPEPPKDRSANYPWPTYPLILRVSSSNEEGGQRVYSTNTVEIVSNDRGHVKAVRVVSGHRDENRVFIADEGSEHDLPADLVIFAMGFAHPEYDGVVAELGLELDGRGNIIRNDAYETNVPGVFACGDAGRGQSLVVWAIAEGRAAAHGVDAYLKGSPSVLPKPVKPSDRQMTV

SEQ ID NO: 4439 - DNA, 1458 bp, Leifsonia xyli
  CDS (1)..(1458)
atggctgatcccaaagggttcttgaagacgaccgagcgggagctgccgaagcgccgccccgtcccggtccggctgatggactggaaagaggtctacgaggccggggaaccggcccagctgcgccgccaggccgggcgctgcatggactgcggcattccgttctgccaccagggttgtccgctcgggaacctcattccggagtggaacgacctcatgtggcgtggggagggtcgccaagcaatcgagcgtctgcacgccaccaacaacttcccggagttcaccgggcggctgtgcccggccccctgcgagtcctcgtgcgtactgggcatcaaccagcccgccgtgaccatcaagcaggtcgaggtgtcgatcatcgaccaggcttggcagcacggctgggtgcagccgcacccgccggagcgcctcaccggcaagaccgttgcggtcgtcggctccgggcccgcgggtctggccgccgcccagcagctcacgcgcgccgggcacacggtcgccgtgtacgagcgggacgaccggatcggcggtctgcttcgctacggaatcccggacttcaagatggagaagaagcatctggaggcgcgcatcggtcagatgaccgccgagggcacgcgtttccgcgccggggtgacgattggtgtcgacatcggctgggacgatctgcgggcgcgttacgacgcgatcgttgtcgccaccggtgcgatggtgccgcgggatctgcccatcccgggccgcgacctcgcaggcgttcacttcgcgatggagtacctcgtccagcagaaccgggcgggtgcgggtgaccaggtcgccgcccagatcaccgcggacagcaagcgcgtcgtcgtcctcggcggcggcgacaccggtgcggactgcatcggcaccgcccaccgccagggtgctgcgagcgtgaccactctcgccatcggcaaacagccgccgagcgagcgtccgggtcaccagccctggccgctgaccccggctctgttcgaagtccagtcggcgcacgaggagggcggtcagcgcgagtacctcgtctcgacggtcgagttcctcgcgaatgagcacggcgaggtgcgcgcggtgcgggtggccgagaccgagcatgtcgatggccaccgcgtgccgaaggccggcaccgagcgggagatccccgcggatctcgtccttctcgctctgggcttcaccggtccggagcaggacggactctcctcccagctgaacctgccgttcgatgagcggggcagcctcgagcgtgacggcggctaccagaccagcgaggctggcgtgttcgtcgccggggacgctggccgcggtcagtcgctcatcgtctgggccatcgccgagggccgtgcagcggccgccgccgtggaccggtatcttgaaggggagacacaactgccggcgccggtccgtcccacggaccgcggcatcctggtctga

SEQ ID NO: 4440 - protein, 485 aa, Leifsonia xyli
MADPKGFLKTTERELPKRRPVPVRLMDWKEVYEAGEPAQLRRQAGRCMDCGIPFCHQGCPLGNLIPEWNDLMWRGEGRQAIERLHATNNFPEFTGRLCPAPCESSCVLGINQPAVTIKQVEVSIIDQAWQHGWVQPHPPERLTGKTVAVVGSGPAGLAAAQQLTRAGHTVAVYERDDRIGGLLRYGIPDFKMEKKHLEARIGQMTAEGTRFRAGVTIGVDIGWDDLRARYDAIVVATGAMVPRDLPIPGRDLAGVHFAMEYLVQQNRAGAGDQVAAQITADSKRVVVLGGGDTGADCIGTAHRQGAASVTTLAIGKQPPSERPGHQPWPLTPALFEVQSAHEEGGQREYLVSTVEFLANEHGEVRAVRVAETEHVDGHRVPKAGTEREIPADLVLLALGFTGPEQDGLSSQLNLPFDERGSLERDGGYQTSEAGVFVAGDAGRGQSLIVWAIAEGRAAAAAVDRYLEGETQLPAPVRPTDRGILV

SEQ ID NO: 4441 - DNA, 2328 bp, Desulfotalea psychrophila
  CDS (1)..(2328)
atgacaagaactgtgataaacggcctcgatgaaaacggtcgtcgaataagctctatggagtttgagaaaatggtccgggctgctgccagcagctcagccaatatccatctcaactcctacgggcaacataatataggtattagattagagcacaaagagggactcaacatcaccgttgaaggcccttctggacagcgtcttggttgcatgggacttcccggcaccaagattgtctgtaagggcgccacctccgatgatgtcggctacctgaatattggtgctgaaatcaccgtcctcggtgacgccaccaacggtgcctgtaatgccatggccatgggcaaggtctatattggtggctccattggtgcccgtggtctgaccatgaccaagtggaacccggagtatgaaaaacctgaactgtgggtacttggctccaccggcgattcttttgccgaattcaactgtggtggtattgctgtcgtctgtggcatcaagcccaaaaccccgaaaaatatactcggctatcgaccatgtgtcggaatggttggcggctcgatctacttccgtggaccaatagatgactcttactcaagacttaatgccaagctctgcaaactagatgaccagcaatggcagtggctccttgaaaatatgccgacctttctcggcaatatccaaagagaagatcttagtgaagaactcaccatccgggaagattggcatgtcctgagctccattaccacccaagagcgggctcttatgtgggcaggtcccatgcccatggcagaatttcgccgtgaacactgggataaaacctttggcggtgaccccctacgtgatattgcccctggccttgaccgtagtcccattaatgccatcaccaccggagaacttcgtcgcaaaaagccctactgggccaacaacgaatattctgctccctgcacatactactgtccaattcacattccaaccgtggaacgcctgcgtcttctccgagagggaagggcagatgaggcctacgaactactgctccgctacacgcctcttcccgcctctgtctgcggcgctatttgtcctaaccagtgcattcagaattgttcaagaaaaggtgttgatgaggccattgacacccaaattcttggtcgggcagctggacattttccggcgcctaaaccagcagctgccacaggcaaaagagttgccatcattggtggtggccccggcggcatgaatgcagcatggcaacttgcccttaaaggtattgaggcccatatctttgagcaagatgacaaactcggcggcaagctggcaggagtaatcccctgggagcgcctgccacaggcaacatggcagtatgaaatcgatcgtttcacctccatggaggggatcgaactgcacctgaataccaccatgaccaagggaaagtttgccgagctgcaaagagattatgactacgttatcgtagccgtaggaacccacgagccacgaagcattccatttccaggacatgagaaggtgatcccggccctccacttcttaaaggatgccaaaaacgccagccaccctccacaggtaggcagagaagtcgtgatcatcggcgcaggcaatgtcggctgtgatgtagcctgtgaggcctatcgcctcggcgcggaaaaggttaccctgatagatatccaaaagccgctggcctttggtaacgaaaaagaggcagccgaagcactgggcgctcaatttcgttggccaataaccacaaaggaggtaacggatcagggtattatcaccacggatggcgaactgatacctgctcagaccgttattgtctctattggtgatgttcccgccctctccttcctgccggattccgtggagaccatgaccgttggtggcgcagattgggtaaccaccaacgaggcatatgttacctcaaacaagaaggtacttgccgtaggcgatgtaaaacgaccagggcttgcaaccaacgccttgggtgctggcaaagacgccgcagagtacattcttgccaccgaaaaaggcgagaagtgggagcccttcagcaaaccactcattgcccaatccgccctgaccatcactcattacgcgccgatagcaaaggaagcaacagaggcaaatcaggccgaccgttgtctctcctgtgcctcctgccgtgattgccatctctgtgaaaccatctgtccagagggtgccatttcacgggaagatctgggcaacggagagtatcgctatgtctccaacgacgataaatgtatcgcctgtggtttttgcgccgacacctgtccctgtggtatctgggtcatgaacccctactag

SEQ ID NO: 4442 - protein, 775 aa, Desulfotalea psychrophila
MTRTVINGLDENGRRISSMEFEKMVRAAASSSANIHLNSYGQHNIGIRLEHKEGLNITVEGPSGQRLGCMGLPGTKIVCKGATSDDVGYLNIGAEITVLGDATNGACNAMAMGKVYIGGSIGARGLTMTKWNPEYEKPELWVLGSTGDSFAEFNCGGIAVVCGIKPKTPKNILGYRPCVGMVGGSIYFRGPIDDSYSRLNAKLCKLDDQQWQWLLENMPTFLGNIQREDLSEELTIREDWHVLSSITTQERALMWAGPMPMAEFRREHWDKTFGGDPLRDIAPGLDRSPINAITTGELRRKKPYWANNEYSAPCTYYCPIHIPTVERLRLLREGRADEAYELLLRYTPLPASVCGAICPNQCIQNCSRKGVDEAIDTQILGRAAGHFPAPKPAAATGKRVAIIGGGPGGMNAAWQLALKGIEAHIFEQDDKLGGKLAGVIPWERLPQATWQYEIDRFTSMEGIELHLNTTMTKGKFAELQRDYDYVIVAVGTHEPRSIPFPGHEKVIPALHFLKDAKNASHPPQVGREVVIIGAGNVGCDVACEAYRLGAEKVTLIDIQKPLAFGNEKEAAEALGAQFRWPITTKEVTDQGIITTDGELIPAQTVIVSIGDVPALSFLPDSVETMTVGGADWVTTNEAYVTSNKKVLAVGDVKRPGLATNALGAGKDAAEYILATEKGEKWEPFSKPLIAQSALTITHYAPIAKEATEANQADRCLSCASCRDCHLCETICPEGAISREDLGNGEYRYVSNDDKCIACGFCADTCPCGIWVMNPY

SEQ ID NO: 4443 - DNA, 1764 bp, Desulfotalea psychrophila
  CDS (1)..(1764)
atgaaaccaactgacataaaaaaaccggaatatttccacaaaattatagactgccaatacgcctgtcccacccacacccccgtacctcaatacatacagcatattgcccggagggagtacgaccaggcatatataataaactggatatcaaacgtatttcccggagtactgggaagaatatgcgatcgcccctgtgaacccgcctgtagacgaggacgaatcgaggaaacccctgttgccatctgcaggttaaaacgcctggcagcagacaaaaagagcagcattgatattctgccaacaaaatgccgggccccaaacggcaaaaaaatcgccctcattggcggcggcccggcctccctgaccgttgctcgggatctgcgccttcttggttacgaaatccatctctttgaccaacaaaaaaaggccggtggtttcattcgcacccaggtcccctccttccgcctgcccgaaaaaatccttgaagaggaggttgatatcattctcaacatgggcgttatcacccacttcaatggttatatcagcagtctcaaaagcatacttggacagaacttcgatgccgtttttgtcggcaccggtgccccccgcggtcgcgacctggccaagctaccaggcagggaggcgggcagaaagaacattgccatcggcactgaatggctggcggccgttctctaccggcatgtaaaaaagataggcccccgggtactggtccttggtggaggaaatacagccatggattgctgtcgcactgcccgacgcctcgggggcgagaatgtctccattattgttcgcagccctaaagagacgatgaaggcctccctctgggaaattgaagaggccctcctggagggggttcacctcatagacaaccatctccccctagcctttgtcacggaaggtgacagactgacaggcatgaactttgaccgggtagaggccaggcaaaacgatagaggcgagagagagctcatctccagcggagaggcaccggtctttatcccctgcgacgatgttatcctggcggtggggcaggagaatgcctttccttggatagaaagagatatcggtctgcactacaaaaatgggctgccactgatcgaccctgaaacactgcagtccaacatcccccgactgttctttggtggcgatgccgcctttggccccaaaaacgtaattaccgccgtagcccatggacatcaagccgccatctccattgatctcttttgccaggggcagagtttggatgagcgccctcctaccctcctcagcctgagcagccaaaaaatgggcctgcaggagtgggcctatgacaacgatatatccatcgcccaccgcaacaaggtaccaagagaaagccctgtcaaatcaattcgaaacagactcatggaggtggaacttggctttgatcaggaggtgggcctgcaagaggcctcacgttgcctcaactgtgacattcaaaccgtcttcgaggcagccacctgcatagagtgcgatgcctgcgtagatatctgccctgtttcctgtattaacttcatggacagcacagagaatgagctcagaacctctctccggataccggctgaaaatctcagtcaggctctctatgtctcggagcccacccccattggtcacatcatggtaaaggatgaaaatgtctgcctgcactgcgccctctgcgcgaatagatgccccacatcctcctggcaaatgcttaaatcgaccctctcctatccaggacaaaaatga

SEQ ID NO: 4444 - protein, 587 aa, Desulfotalea psychrophila
MKPTDIKKPEYFHKIIDCQYACPTHTPVPQYIQHIARREYDQAYIINWISNVFPGVLGRICDRPCEPACRRGRIEETPVAICRLKRLAADKKSSIDILPTKCRAPNGKKIALIGGGPASLTVARDLRLLGYEIHLFDQQKKAGGFIRTQVPSFRLPEKILEEEVDIILNMGVITHFNGYISSLKSILGQNFDAVFVGTGAPRGRDLAKLPGREAGRKNIAIGTEWLAAVLYRHVKKIGPRVLVLGGGNTAMDCCRTARRLGGENVSIIVRSPKETMKASLWEIEEALLEGVHLIDNHLPLAFVTEGDRLTGMNFDRVEARQNDRGERELISSGEAPVFIPCDDVILAVGQENAFPWIERDIGLHYKNGLPLIDPETLQSNIPRLFFGGDAAFGPKNVITAVAHGHQAAISIDLFCQGQSLDERPPTLLSLSSQKMGLQEWAYDNDISIAHRNKVPRESPVKSIRNRLMEVELGFDQEVGLQEASRCLNCDIQTVFEAATCIECDACVDICPVSCINFMDSTENELRTSLRIPAENLSQALYVSEPTPIGHIMVKDENVCLHCALCANRCPTSSWQMLKSTLSYPGQK

SEQ ID NO: 4445 - DNA, 2226 bp, Desulfotalea psychrophila
  CDS (1)..(2226)
atgtttgagatcgtagaaaacagcatcatcgcccctaatgttcaccgccttatcatcaaagctcctcgagtggcaaaatcccgtaagccgggacaatttgttatcgtccatgaagagggtggcgaacgcattccccttaccattgccgacgagaacattgaaaacggtacaatcaccttaattattcaagccgttggcgagggcaccaagcaaattgtcagcaagcaggccggagaatttatccgtgacattgccggcccccttggtaaggcttcagaaattgaaaaagtcggtaaggtggtctgtattggtggcggggtaggtaccgctgtactctttcccctggccaaggcccttgccgcagcaggcaatgatctgacaaccatcatcggtggtcgttcagagtcctttgtcattctcaaagacgagctcgccgtattttctactcaactaaagataaccacggaagatggttctctcggtgataagggctttgttaccggccccctcgctgaaatacttgaagacgagaccagacgcccagagattatctatgccatcggccccgttcctatgatggcggccatctgtgaacagacccgtccctacggcgtcaagaccattgtcagcctcaatcctattatggtagacggcacaggcatgtgtggcggttgtcgggtaaccgtcgccaacaaggtaaaatttgcctgcgtcgacggccctgaatttgacggtcatgaggttgactttaaagagcttgctgccagacagcgccagtatgtcggccacgaccacgatcgccataaatgtcgcatggacgcagtaaagatagagacaatcagcataaaagaacgcatggcaattccccgggcccatatgcccgagcaggacgccaagatcagggcaaccaacttcactgaggtaaatctggggatctctgaagaggtggccatccgtgaggcccaacgctgccttaactgcaagacccgtccctgtgtctccggttgtcccgtcggtgtccgtatccctgaatacctgcaggaagttgccaagggcgatttcgccgcagctgccaagatactccgtgaagacaacgccctgcccgccaccaccggccgggtctgcccacaggaatctcaatgcgagcagaaatgtgttcggggtaaaaagggcgatgccgttgccctcggttggctggaacgctttgtcgctgactgggctgcccaaaaccttaaacccgaagtaccctgcatagagaagacggggaaaaaggtcgccattatcggcagtggtcccggaggtctgaccgccgccggagaacttgcccgtagggggcacgatgtcacagtttttgaggcattacataccgccggtggtgtacttcgttatggtattcctgagtttcgtctgccaaaaaatattgtcgatcacgaggtggaaaaccttgtcgccctcggggttaagtttgaattcaacgtcatcattggccaaaccctgactattaaggagataatggcagaatttgacagctgttttatcgccaacggtgccggactgcctatcttcctcaatttaccaggtgaaaacctcaacggtgtctactcgtcaaacgaatacctcacccgggtaaacctgatgaacgcctataagaagggcagtgcaactccaattgtcactggtcctaccaccgtcgtctttggtggtggcaacacagccatggattcagccagaacagctaaacgcatgggcagtgaacgagtaatccttgcctatcgccgtggccgtgacgagatgcctgcccgtctggaagaggtcattcatgcggaacaggagggtatcgagttcatgttcctggtcgcacctctttctattggtggcaccgaagatggctgggtggaaaatgttcacctgcaaaaaatggaacttggcgaaccagatgcctcgggcagaagacgccctgttgccatagagggaagtgaatttaaagtagaggctgatattgttatcatgtccatcggtaccacctcaaatccactcctcacctccacatgtcctgagctggaactcaacaagtggggtaatattgtggtggacgaaaagcagatgagctccatgcagggtgtctttgccgggggcgatatcgtccgaggcggcgccactgttatcctcgccatgggcgatggtaaaaatgcagctcagtccattcatgattatctacaaaaatag

SEQ ID NO: 4446 - protein, 741 aa, Desulfotalea psychrophila
MFEIVENSIIAPNVHRLIIKAPRVAKSRKPGQFVIVHEEGGERIPLTIADENIENGTITLIIQAVGEGTKQIVSKQAGEFIRDIAGPLGKASEIEKVGKVVCIGGGVGTAVLFPLAKALAAAGNDLTTIIGGRSESFVILKDELAVFSTQLKITTEDGSLGDKGFVTGPLAEILEDETRRPEIIYAIGPVPMMAAICEQTRPYGVKTIVSLNPIMVDGTGMCGGCRVTVANKVKFACVDGPEFDGHEVDFKELAARQRQYVGHDHDRHKCRMDAVKIETISIKERMAIPRAHMPEQDAKIRATNFTEVNLGISEEVAIREAQRCLNCKTRPCVSGCPVGVRIPEYLQEVAKGDFAAAAKILREDNALPATTGRVCPQESQCEQKCVRGKKGDAVALGWLERFVADWAAQNLKPEVPCIEKTGKKVAIIGSGPGGLTAAGELARRGHDVTVFEALHTAGGVLRYGIPEFRLPKNIVDHEVENLVALGVKFEFNVIIGQTLTIKEIMAEFDSCFIANGAGLPIFLNLPGENLNGVYSSNEYLTRVNLMNAYKKGSATPIVTGPTTVVFGGGNTAMDSARTAKRMGSERVILAYRRGRDEMPARLEEVIHAEQEGIEFMFLVAPLSIGGTEDGWVENVHLQKMELGEPDASGRRRPVAIEGSEFKVEADIVIMSIGTTSNPLLTSTCPELELNKWGNIVVDEKQMSSMQGVFAGGDIVRGGATVILAMGDGKNAAQSIHDYLQK

SEQ ID NO: 4447 - DNA, 6360 bp, Yarrowia lipolytica CLIB99
  CDS (1)..(6360)
atggatcacgaagaacaacaagaatacaaccccatctcatacaacgagaacaatggctcgtgggcaggcgcgctccccaccaaacagggcctgtacgaccccgagtacgaaaaagatgcctgtggtgtcggttttgcctgtaacatcaagggccaacaatcgcacaagatcatttccgacgccaagaatctgctctgcaacatgacccaccgaggagccgtgggatccgacgcacgagacggagatggagcaggagtcatgacctccatcccccacaagttcatcaaaaaggagtttaagcggctctacgacttcgagctgcctcccatgggtcagtacgcctgcggtaacctcttcttcaaaaacgaccaggacgtgctggcgaagtccaaggacacgtttgagtccattgccaagtctctgggccttgaggtgctcggctggcgattcgtcccccgagactcctctattcttggtcccgctgctctgtctcgagagcctctgatcctgcagccggtggttgtgctgtctgaggccttcaagtcaggccctcacactgaggacgaatgggactccaagttcgagaagctgtttgagttgcagctttacgtgctccgaaagcagtccactcacaccattggtttgcacaactggttctacatttgttcgctgtcgaacaagaacatggtctacaagggccagcttgctcccgtccaggtctacaactactactacgatctgctcaacgtcgactacgagggccactttgctctggtccactcgcgattctccacaaacactttcccctcttgggaccgagcccagcctctgcgatgggccgcacacaacggtgagatcaacaccctgcgaggaaacaagaactggatgcgagcccgagagggaatgatgaaatctggtctgtttggagacgaacttgagcgactctaccccattgtcgaggagggaggatccgattccgctgcctttgataacgtccttgagctgctggtcatcaatggtgtcctgtccatgcccgaggccgttatgatgatgattccagaggcctggcagaacaacaccaccatggactccaagaagcgagctttctacgagtgggctgcttgccttatggagccctgggacggccctgctcttttcacttttgccgacggacggtactgtggtgctaacctcgatcgaaacggtctacgaccctgccgatactacatcaccgacgacgaccgaatgatctgtgcctctgaggtgggtgtcattctgatcgagtccgagaaggtgatccagaagggccgactccgaccaggacgaatgctgctggttgataccaaggagggacgagtcgttgatgaccgagagctcaaaaagaagattgctggccgagtggacttcaagtcgtggatccacgccaacgtcatcaccatggaggacatgcgacagaaggttgagtccaagatgccctccattctcgaggtcaagatcgacgagctctctgtccagagcgatccccgtctccctgcgttcggatacactgctgagcagctttctctgctgctggcacccatggctgccactgccaaggaggctcttggatctatgggtaacgacggacctctggcttgcctcgcaaagcagcccaaggtgctgtttgactacttccgacagctgtttgctcaggtcactaaccctcccatcgatcccattcgagaggctattgtcatgtccctggagtgctacgttggaccccagggtaacgtgcttgagatgaaccccagccagtgcaaccgtctgctgcttccctctcctattctgaccatccaggagactgcaatgctgcacgagatgcacagacactaccccaagtggaccacagataccattgatatcacttttgacaaatctgagggccccgctggctacctgaaggctcttgacagaatctgtgaggaggcctccaactccatccacgccaagcaccagatcatcatcctatccgacaagaagacttctgctgaccgagtccctgtctcttctgttgtggcctgtggtgctgttcaccaccaccttgtgcagcagaagcagcgatctcgagttgccctgattgtcgagactgccgaggcccgagaggtacaccacttctgtgttctgctcggatacggcgctgacgctatcaacccctacttggctatcgagacccttgccaagatgaaccgggagggtcttatcaaggaacctctttctgacgaccagattgtggccaactacaagacagccgttgacggcggtattctgaaggtcatgtccaagatgggtatctctactctcgcgtcttacaagggtgcccagatctttgagattcttggtatcgacaactctgtagtcgacaagtgcttcgccggtactgcttcgcgaatcaagggtatcacctttgacttcattgcagaggatgccattgcccttcacgagcgaggtttcccctcgcgagagactgtcaagaccaagtctctgcccgagtctggagagtaccactaccgagatggtggagacccccacgtcaacacccccgttgccatctcgaacatccaggatgctgttcgaaacaagaacgagaaggcttatgaggcttactctaaggccgagtacgaagccatcaaggactgtactctccgaggtctgcttgatttcgacttcgatgccgctacccctgtccccattgatcaggttgagccctggaccgagattgttcgacgattcgtcactggtgccatgtcctacggttccatctcaatggagtcccattctactcttgccgttgccatgaaccgacttggtggtaagtccaacaccggtgagggtggtgaggaccccgagcgatccgctgttgctgagaatggagacactatgagatctgccatcaagcagattgcctctggtcgatttggtgtcacttcgtactacctttctgacgccgatgagctccagatcaagatggctcagggtgccaaacccggtgagggtggtgagcttcccggacacaaggtgtctgagcagattggtaagactcgacactccactcctggtgtcggtctcatttctcctcctccccaccacgacatttactctattgaggatctcaagcagcttatctacgacctcaagtgctctaaccctcgatctcgagtctctgtgaagctggtgtccgaagtcggtgtcggtatcattgcctccggtgttgccaaggctaaggctgaccacattctcatttctggtcacgatggtggaactggtgcctctcgatggaccggtatcaagtacgccggtctcccctgggagttgggtcttgctgagactcaccagactctggttctgaacgatctgcgaggtcgagtcactgtccagaccgatggtcagatccgaaccggtcgagatgttgccattgcctgtcttctcggagccgaggagtggggatttgctactactcctctcattgccatgggctgcatcatgatgcgaaagtgccatctcaacacttgtcccgtcggtattgccacccaggaccccgagctgcgacagaagttcaagggtacccccgagcatgtgatcaacttcttctactacattgccaatgagcttcgaggaatcatggctcagcttggattccgaaccattgacgagatggttggccacgccgagatgctgcgagtccgagacgatcttcgaaaccacaagaccaagaacctggatctgactcccattctcactcctgctcacacccttcgacctggtgttgctacccgaaaggttcgaaagcaggaccaccgactccatgtccgactcgacaacaagctcattgacgaggctgaggtcactctggacaagggtcttcccgtcaccattgactgtgacatcatcaacactgatcgatctcttggttccacactctcctaccgaatctccaagcggtttggtgaggctggactgcctgacgacactgttcacgtcaatgtcaagggttctgcgggtcagtcgtttggtgccttcctggcacccggtatcactctggaactggagggagactgtaacgattacgttggtaagggtctttctggaggccgaatcgtcgtctatcctcccaagaactctgttttcaaggctgaggagaatatcatcgttggtaacacttgtttgtacggtgctacttccggtacttgtttcttccgaggtgttggtgccgagcgtttcggtgtccgaaactccggtgccactgccgttgttgagggctgtggagaccacggctgcgagtacatgactggaggtcgtgttgttgttctcggctccactggccgaaactttgccgccggtatgtctggtggtattgcctacgtgcttgacatgggccaggagtttgtcaacaacgtcaactccgagactgttgagctgggccctgtctctgatccccaggagattgctttcctgcgaggcctgattgaggaccaccgacactacaccggttccgagctggctgaccgagttctcacagacttcaaccgaatcttgccccggtttgtcaaggtactgcccaccgattacgctcgagttctggaggagcaagctgccaaggttgctgaggccaagaagcgagaggtctctggctacatgcatgccatcaaggaggaccctgacgccgacatcaccaacggtgagctcaagcgagctgctacccccaagccttgtgccactcctcggtcccgaaaggagcctcctgttcaggatctggaggacgccattctcgaccacaacgccacaaaggccaaggcttccaagctggtcaagctcgataagacccgaggtttcatgaagtacactcgacgtgctgagaagtatcgagatgccaagaaccgaaccaaggactgggacgagatgaacacccgactgaccaaggaggagctgaagtatcagactgcccgatgcatggactgtggtgtccccttctgccagtctgacactggatgccctatttccaacgtcatccccaagtggaacgagctcgtgttccaggaccgatggcaggatgctctcgacagacttctgatgaccaacaacttccccgagttcactggacgaatctgtcccgctccttgtgagggtgcctgtgttctgggtatcaacgaggaccctgttggtatcaagtccatcgagtgtgccattatcgatcacggtttcgagcagggctggattaagcccaagccccccgccactcgaactggtaagaccattgccattattggttctggtcctgcgggtctggctgctgccgatcagctcaataaggcaggccactctgtgactgtctacgagcgagctgaccgaattggaggtctcctcatgtacggtatccccaacatgaagctggacaagcgggttgttgagcgacgagtccagttgatgcgagacgagggtgtcacttttattaccaacaccgaggtcggtgaggacaaggaagtttctgtgtctggtctgcgagctgacaatgatgctgtcgttctgtgtgtcggatccaccattcctcgagacttgcccatcaagaaccgatctctcaacaacatcaatttcgccatgcagttgctccgatggaacacgaagtctctgcttgacggtgacatggatgaggttcgagagtccctcaaggacaagcacgttgttgtcattggtggtggagacactggtaacgattgtctgggtacttctactcgacacggagcgaagtccgtcaccaacttcgagctgcttccacgacctacccctgctcgacccaaggacaacccctggccccagtggcctcgaatcttccgagtcgactatggtcacactgaagtggctgctcactacggcaaggatccccgagagtacggtatcctgtccaaggagtttgttgacgacggagagggcaatgtcaagggtatcaagactgttcgagttgagtggaagcagtctgagtctggcgcctggcagatgagcgagattcccggctctgaggagttcttccccgccgacgtggttctgctgtccatgggtttcgttggtcccgaggcccaggagctcgctgctgagcgagacggacgaggaaacatcaagactcagaccggcgatgtcaaggatcttggactctacaaggtccaggacaacctgttcactgccggtgactgtcgacgaggacagtctctggttgtctggggtatccaagagggtcgacagtgtgctcgagctgttgatcacttccttatgggatgcactcgactgcccggtaacggttccattgagcagcgagatctcaagctcaaatag

SEQ ID NO: 4448 - protein, 2119 aa, Yarrowia lipolytica CLIB99
MDHEEQQEYNPISYNENNGSWAGALPTKQGLYDPEYEKDACGVGFACNIKGQQSHKIISDAKNLLCNMTHRGAVGSDARDGDGAGVMTSIPHKFIKKEFKRLYDFELPPMGQYACGNLFFKNDQDVLAKSKDTFESIAKSLGLEVLGWRFVPRDSSILGPAALSREPLILQPVVVLSEAFKSGPHTEDEWDSKFEKLFELQLYVLRKQSTHTIGLHNWFYICSLSNKNMVYKGQLAPVQVYNYYYDLLNVDYEGHFALVHSRFSTNTFPSWDRAQPLRWAAHNGEINTLRGNKNWMRAREGMMKSGLFGDELERLYPIVEEGGSDSAAFDNVLELLVINGVLSMPEAVMMMIPEAWQNNTTMDSKKRAFYEWAACLMEPWDGPALFTFADGRYCGANLDRNGLRPCRYYITDDDRMICASEVGVILIESEKVIQKGRLRPGRMLLVDTKEGRVVDDRELKKKIAGRVDFKSWIHANVITMEDMRQKVESKMPSILEVKIDELSVQSDPRLPAFGYTAEQLSLLLAPMAATAKEALGSMGNDGPLACLAKQPKVLFDYFRQLFAQVTNPPIDPIREAIVMSLECYVGPQGNVLEMNPSQCNRLLLPSPILTIQETAMLHEMHRHYPKWTTDTIDITFDKSEGPAGYLKALDRICEEASNSIHAKHQIIILSDKKTSADRVPVSSVVACGAVHHHLVQQKQRSRVALIVETAEAREVHHFCVLLGYGADAINPYLAIETLAKMNREGLIKEPLSDDQIVANYKTAVDGGILKVMSKMGISTLASYKGAQIFEILGIDNSVVDKCFAGTASRIKGITFDFIAEDAIALHERGFPSRETVKTKSLPESGEYHYRDGGDPHVNTPVAISNIQDAVRNKNEKAYEAYSKAEYEAIKDCTLRGLLDFDFDAATPVPIDQVEPWTEIVRRFVTGAMSYGSISMESHSTLAVAMNRLGGKSNTGEGGEDPERSAVAENGDTMRSAIKQIASGRFGVTSYYLSDADELQIKMAQGAKPGEGGELPGHKVSEQIGKTRHSTPGVGLISPPPHHDIYSIEDLKQLIYDLKCSNPRSRVSVKLVSEVGVGIIASGVAKAKADHILISGHDGGTGASRWTGIKYAGLPWELGLAETHQTLVLNDLRGRVTVQTDGQIRTGRDVAIACLLGAEEWGFATTPLIAMGCIMMRKCHLNTCPVGIATQDPELRQKFKGTPEHVINFFYYIANELRGIMAQLGFRTIDEMVGHAEMLRVRDDLRNHKTKNLDLTPILTPAHTLRPGVATRKVRKQDHRLHVRLDNKLIDEAEVTLDKGLPVTIDCDIINTDRSLGSTLSYRISKRFGEAGLPDDTVHVNVKGSAGQSFGAFLAPGITLELEGDCNDYVGKGLSGGRIVVYPPKNSVFKAEENIIVGNTCLYGATSGTCFFRGVGAERFGVRNSGATAVVEGCGDHGCEYMTGGRVVVLGSTGRNFAAGMSGGIAYVLDMGQEFVNNVNSETVELGPVSDPQEIAFLRGLIEDHRHYTGSELADRVLTDFNRILPRFVKVLPTDYARVLEEQAAKVAEAKKREVSGYMHAIKEDPDADITNGELKRAATPKPCATPRSRKEPPVQDLEDAILDHNATKAKASKLVKLDKTRGFMKYTRRAEKYRDAKNRTKDWDEMNTRLTKEELKYQTARCMDCGVPFCQSDTGCPISNVIPKWNELVFQDRWQDALDRLLMTNNFPEFTGRICPAPCEGACVLGINEDPVGIKSIECAIIDHGFEQGWIKPKPPATRTGKTIAIIGSGPAGLAAADQLNKAGHSVTVYERADRIGGLLMYGIPNMKLDKRVVERRVQLMRDEGVTFITNTEVGEDKEVSVSGLRADNDAVVLCVGSTIPRDLPIKNRSLNNINFAMQLLRWNTKSLLDGDMDEVRESLKDKHVVVIGGGDTGNDCLGTSTRHGAKSVTNFELLPRPTPARPKDNPWPQWPRIFRVDYGHTEVAAHYGKDPREYGILSKEFVDDGEGNVKGIKTVRVEWKQSESGAWQMSEIPGSEEFFPADVVLLSMGFVGPEAQELAAERDGRGNIKTQTGDVKDLGLYKVQDNLFTAGDCRRGQSLVVWGIQEGRQCARAVDHFLMGCTRLPGNGSIEQRDLKLK

SEQ ID NO: 4449 - DNA, 6426 bp, Kluyveromyces lactis NRRL Y
  CDS (1)..(6426)
atgatttcttctgggaaatatgatcctttagaagaatcgtacgatggcggttgttctttagatgaaagacctttatcaaagaaagcacatgtttataagtcctgggctaatgtcataccggacaaacagggtctatatgaccctgaatttgagaaagacgcctgcggtgttggttttgtagctaacatcaaaggtgtgtcatcccataagatcgtttctgatgcgcggttcttactctgtaacatgacacacagaggagctgtttcctcagatgggaacggtgatggtgcagggatcttgaccggtatcccacatgagtttatgcagagagagttcaaattggatgtagggatcgatattccagatcaatctcagtacgcggtagggaacgttttcttcaagaaagattctcccgaagcgttggtaaattccaagagaacgtttgaacaattggctgattctttggacttgaaagttctaggttggagagttgtaccacatgattcttccattcttggtgctgtcgcactgtcccgagaaccagaaattttgcaacctttagtagtgttgaaagaattattttccgagtcatcttcatcttcttccatctctaaggatgaattccaatccacatgcgaaaccaagtttaagactagcttgtacattcttcggaaacaggcttctacatcgatcggtcttcaaaactggttttatgtttgttccttggataacaaaactatagtttacaaaggacagcttaccccatcacaggtgtacaattactaccatgatttaactaatgctcatttcaaatcgcatatggcactagtgcattctcgtttttcaacaaatacattcccatcatgggaccgtgctcaacctctacgttggttggctcataacggtgaaattaatactttgagaggtaataagaattggatgagagccagagaaggtgttatggcttctgaggtgtttggtgaacaattggataaattgtacccgattgtggaagaaggtggttctgattctgccgcattggataacgttctggagcttttgatgatgaacggtgttctttcccttccagaagctattatactgatggtcccagaagcctatcacaaggacatggactcggatttgaaggcgtggttcgattgggcgtcatgccttatggaaccatgggatggtccagctttgctaaccttcactgatggtcgcttcactggtgccactttggacaggaacggtttaagaccatgccgttactatattacatccgatgaccgtgtcatttgtggttcagaagtcggtgttattcctgtggagaattcattggtcattcagaagggtaagttgaaaccaggtgatatgttgctagttgatacggaatctggagaaatggtcgacacaaagcaattaaagcataagttcgccaagagaaaggatttcaagtcgtggttatcaaaagttattaaagtggaagatgtgttagagaagacttccaaattcttaccgccaagtttcatttcagattataacttgaaagctcaaactgatccaaggctattggcattaggatacacatatgaacaggtttcgatgatccttgtaccaatggcgcttggaggtaaggaagctctaggatccatgggtaatgatgctccattggcttgtctaaatgaagacccagtactattatatgattatttcagagagcttttcgcccaggtgacaaaccctccaattgatccaattcgtgaggccaacgtcatgtccttggaatgtttcgtaggacctcaagggaaccttttggaaatgcatccttctcaatgcgatcgtttagttttaaaatcgccaattttacattgggacgaatttgaagccttgaaaaatattgaaaaggcacatcctacttggtctacttcgaacatagacattactttccctaaagaagaaggtctattaggctacacggctaccattgacagaatcacacaggaagccagtgatgctattgatcaaggaaagaagattttgttcattagcgacagactgttatctgcggatcgggtctcaatctcttcgttgatcgctattggtgccattcatcaccatcttgttcgcaacaaacagcgttctcaggtggctttgatcttggaaactggtgaagctcgcgaggtgcatcatttctgtgttctattaggttatggttgtgatggtattttcccttacctagccatggagaccttggtcagaatgaatcatgaaggattagtccgaaatgtcaacaacgatgattcatcaattgacgataagactttattagataattacaaacacgcggttgatggtggtatcttcaaagttatgtcaaagatgggtatctctactcttgcatcttacaaaggtgcccagatctttgaagctttaggcattgataattcggtcgttgatctatgttttgctggtactgcctctagaatcaaaggtgttacatttgaatacttggcacaagattcgttctctatgcatgaacgcgggttcccatctagattaacgatacaaaaatcggtaaatttgcctgagtccggtgaatatcattggagagatggtggctacaagcatatcaatgatcctactgccattgctgccctacaggactccgtgagaaacaaaaacgaagatgcatgggaaatgtacgttaagaaagaaatggaggctatcaaagactgtactctaagaggtctcttggaattggattattctgattcggaatcaatcccattggaacaagttgaaccttggacggagatcgcaagaagatttgctactggtgctatgtcgtatgggtcaatttccatggaagctcactccacattagcagttgcaatgaaccgtttaggtgccaagagtaactgtggtgaaggtggtgaagatccagagagatctattgtaaactccaacggtgacaccatgagatctgccatcaagcaagtcgcatctgcgaggttcggtgtaacatcattctatttatcagatgctgacgaaattcaaattaagatagctcaaggtgctaagccaggtgaaggtggtgaattacctgctcacaaggtttccaaagaaattgccaaaactagacattctacgccttatgtgggtttgatttctccacctcctcaccatgacatttattccatagaagatttgaagcagttaatctatgatttgaagtgctctaatccaagagcaggcatctcagttaaattagtctctgaagtcggtgttggtattgtggcctctggtgtcgctaaagccaaagctgatcatattttagtatctggtcatgatggtggtacaggtgcatccagatggaccggtatcaagtatgctggtttaccatgggaacttggtttagctgaaacacaccaaacattagttttgaatgatttgagaggaaacgtcgttgttcaaactgatggtcaattgagaacaggattcgatattgctgttgcaattttattaggtgccgaatctttcactttggcgaccgttcctttgattgctatgggctgtattatgttgagaaaatgtcatttgaacgcatgtgcagttggtattgccactcaagaccccgttttgagagacaaattcaaaggtcaacctgaacatgtcatcaacttcttctattatttgatccaagatttgagaaggataatggcaaagttgggcttcagaactgttgacgaaatggtgggacactctgagaagttgagaaaaagagacaacgtcaagaccaaagcgttgaatattgacttatctccaatcttgactcctgcccacttgatcagaccaggagttgcaacaaagtttaccaaaaagcaggatcacaagttacacactagactcgacaataagttaatcgacgaagctgaaattactctagataagggtttgccagttaccattgatgccaacatcatcaacactgatcgtgctttggggtcaacactgtcatacagagtctctaaaaggttcggtgaaaatggtctacctcaggatacggtggtggttaatatatctggttcagctggtcagtcattcggtgcattcctaactgctggtttgaccttcattttagatggtgatgccaacgattatgtaggaaagggtttgtctggtggtagattagtcatcagaccaccaaaggactccagatttaagtctgatgagaatgttatcgtcggtaatacctgtttctacggtgcaacgtctggttatgcattcatttctggttgtgctggtgaacgttttgccgttcgtaactctggtgctactgttgttgtggagagaatcaaaggtaacaatgcctttgaatatatgactggtggtagggctgttgttctttctcaaatggaatctcttaacgctttctctggtgcaactggtggtattgcttattgtttgacatcagattatgatgatttcgttggtaaaatcaatcatgacaccgttgaaatgcaaagtttagttgatcctgttgaaatagcgtttgtgaagaacttgatccaagaacattacaactataccaaatctgatcttgctaaaaagattctgaataaatttaatcattacttgaataatttcgtaaaggttatacctacggactacaagaaggttcttgagaatgaagcaaaggaaaaggttaaagcggagaaacaatctactgctgatttcttgaagaagttcaacagctcaacggattccgctgttgatgcaactaacggagaagtcgatctgctcagatcatctgtatctcataaatcgactttggctgaacctaaggtacttgatcttgaggatgccgtacaggatactaataatttgaaaaaagccgaggaaaagttggagaaaattcgtggtttcatgaagtataaaatgaaacacgaaaagtacagatctcccgcggcaagaactaaagactggaaagagctttctaatgcaatcacaaagaaggacgctagacaacagactgctagatgtatggactgtggtgttccattctgtacatcagatacgggatgtccaatttccaatattatcccaaaattcaatgagcttgtgttcaaaaaccaatggaaattagcattggacaaactattggaaactaacaatttccctgaatttactggtagagtttgtcccgctccatgtcaaggttcttgtaccttggctatcattgacgatccagtcggcatcaagtctgttgaaagattgattatcgataacgctttcaaagaaggatggattaaaccttgtccacctgaagtcagaacaggtaagattgttgccgttatcggctctggccctgcaggtatggcttgcgcagaccaattgaacagagctggtcattcagtagttgtttacgagagggctgatcgttgcggtggtttgttgatgtacggtattccaaatatgaaattggacaagtcaattgttcaaagacgtttggatctattagcagccgaaggtgttcaattcatcacaaacactgaggttggtaaagatatctccgttgaggaattgaaatctaagttcgatgctattgtttacaccgttggctcgaccattcctagagacttgagaattcctggtcgtgaattgaaaaacatcgactttgcaatgactttgctaaagagcaacacgcaagctttattagacagagacttagaaacaattaagaaacaaatcaaggggaagaaagttattgttattggtggtggtgataccggtaatgattgtttaggtacttctgtcagacatggcgctgcgtcagttctaaactttgagttgttaccacaaccacctaacgaacgttctaaggacaatccttggcctcaatggccacgtatcatgagaattgattacgggcatgcggaagtgaaagaacattacggaagagatcctcgtgagtactgcatcttatccaaggagtttattggaaatgaaaatggtgaagtgaaagccattaaaaccgttcgtgtcgaatggaagaaatctcaatctggtgtttggcaaatggtagatgtaccaggttctgaacaaatatttgaagctgacatcgttctattatccatgggtttcgtcggccctgaagtaatcgaagaccctacctttgtcaaatccaaaagaggtaccatcactacgttgtcagattcctcgtactctgttgacggagacaaggtatttgcagcaggtgactgtaggagaggtcaatctctaatcgtgtgggctatccaagagggaagaaagtgtgctacagccattgacacattcttgatggggtccacaaacttacctggaaatggtggtattgtcaaacgtgactacaaactcttggaagaactagcctccacaatttaa

SEQ ID NO: 4450 - protein, 2141 aa, Kluyveromyces lactis NRRL Y
MISSGKYDPLEESYDGGCSLDERPLSKKAHVYKSWANVIPDKQGLYDPEFEKDACGVGFVANIKGVSSHKIVSDARFLLCNMTHRGAVSSDGNGDGAGILTGIPHEFMQREFKLDVGIDIPDQSQYAVGNVFFKKDSPEALVNSKRTFEQLADSLDLKVLGWRVVPHDSSILGAVALSREPEILQPLVVLKELFSESSSSSSISKDEFQSTCETKFKTSLYILRKQASTSIGLQNWFYVCSLDNKTIVYKGQLTPSQVYNYYHDLTNAHFKSHMALVHSRFSTNTFPSWDRAQPLRWLAHNGEINTLRGNKNWMRAREGVMASEVFGEQLDKLYPIVEEGGSDSAALDNVLELLMMNGVLSLPEAIILMVPEAYHKDMDSDLKAWFDWASCLMEPWDGPALLTFTDGRFTGATLDRNGLRPCRYYITSDDRVICGSEVGVIPVENSLVIQKGKLKPGDMLLVDTESGEMVDTKQLKHKFAKRKDFKSWLSKVIKVEDVLEKTSKFLPPSFISDYNLKAQTDPRLLALGYTYEQVSMILVPMALGGKEALGSMGNDAPLACLNEDPVLLYDYFRELFAQVTNPPIDPIREANVMSLECFVGPQGNLLEMHPSQCDRLVLKSPILHWDEFEALKNIEKAHPTWSTSNIDITFPKEEGLLGYTATIDRITQEASDAIDQGKKILFISDRLLSADRVSISSLIAIGAIHHHLVRNKQRSQVALILETGEAREVHHFCVLLGYGCDGIFPYLAMETLVRMNHEGLVRNVNNDDSSIDDKTLLDNYKHAVDGGIFKVMSKMGISTLASYKGAQIFEALGIDNSVVDLCFAGTASRIKGVTFEYLAQDSFSMHERGFPSRLTIQKSVNLPESGEYHWRDGGYKHINDPTAIAALQDSVRNKNEDAWEMYVKKEMEAIKDCTLRGLLELDYSDSESIPLEQVEPWTEIARRFATGAMSYGSISMEAHSTLAVAMNRLGAKSNCGEGGEDPERSIVNSNGDTMRSAIKQVASARFGVTSFYLSDADEIQIKIAQGAKPGEGGELPAHKVSKEIAKTRHSTPYVGLISPPPHHDIYSIEDLKQLIYDLKCSNPRAGISVKLVSEVGVGIVASGVAKAKADHILVSGHDGGTGASRWTGIKYAGLPWELGLAETHQTLVLNDLRGNVVVQTDGQLRTGFDIAVAILLGAESFTLATVPLIAMGCIMLRKCHLNACAVGIATQDPVLRDKFKGQPEHVINFFYYLIQDLRRIMAKLGFRTVDEMVGHSEKLRKRDNVKTKALNIDLSPILTPAHLIRPGVATKFTKKQDHKLHTRLDNKLIDEAEITLDKGLPVTIDANIINTDRALGSTLSYRVSKRFGENGLPQDTVVVNISGSAGQSFGAFLTAGLTFILDGDANDYVGKGLSGGRLVIRPPKDSRFKSDENVIVGNTCFYGATSGYAFISGCAGERFAVRNSGATVVVERIKGNNAFEYMTGGRAVVLSQMESLNAFSGATGGIAYCLTSDYDDFVGKINHDTVEMQSLVDPVEIAFVKNLIQEHYNYTKSDLAKKILNKFNHYLNNFVKVIPTDYKKVLENEAKEKVKAEKQSTADFLKKFNSSTDSAVDATNGEVDLLRSSVSHKSTLAEPKVLDLEDAVQDTNNLKKAEEKLEKIRGFMKYKMKHEKYRSPAARTKDWKELSNAITKKDARQQTARCMDCGVPFCTSDTGCPISNIIPKFNELVFKNQWKLALDKLLETNNFPEFTGRVCPAPCQGSCTLAIIDDPVGIKSVERLIIDNAFKEGWIKPCPPEVRTGKIVAVIGSGPAGMACADQLNRAGHSVVVYERADRCGGLLMYGIPNMKLDKSIVQRRLDLLAAEGVQFITNTEVGKDISVEELKSKFDAIVYTVGSTIPRDLRIPGRELKNIDFAMTLLKSNTQALLDRDLETIKKQIKGKKVIVIGGGDTGNDCLGTSVRHGAASVLNFELLPQPPNERSKDNPWPQWPRIMRIDYGHAEVKEHYGRDPREYCILSKEFIGNENGEVKAIKTVRVEWKKSQSGVWQMVDVPGSEQIFEADIVLLSMGFVGPEVIEDPTFVKSKRGTITTLSDSSYSVDGDKVFAAGDCRRGQSLIVWAIQEGRKCATAIDTFLMGSTNLPGNGGIVKRDYKLLEELASTI

SEQ ID NO: 4451 - DNA, 2025 bp, Erwinia carotovora
  CDS (1)..(2025)
atgaaccgatttgttattgccagtactcaagactgtatggggtgccatgcatgtgaaatcgcctgtgtgatttcacacaatgacgaacagtatccagatagcaccgcggtgtttcagcccagaatcaaggcgttcaatacgccaacactgcgggctgccgtgacatgccgccactgtgaagatgcaccctgtgccagcgtgtgcccaacgcaggccttgatcaaaaaagacaatagcattcagctcgttcaggaaaagtgcatcggctgcaaaagctgtgtactggcttgcccattcggtgcaatgtccatggtgacaaatcccatggacaacagcgccatagcccataaatgtgacctctgcgccgatcgccctgaagggcaagcgtgcgtggaagcttgcccaactcaggcattgcagctcatcagtgaacacacgttaacagcacgccgtcaggagaaacagcagctgatggcgctgcgttccgccgctcactggcagcgtgaaacacctgtactgaaaacgctgacgacccatccgctcaacaaaagaaaaaactggccgcgccgggatgcggagaaaaaaccgctgacgcagagaacgtccacctttgatgaaatctaccatggcttctccgtacagcagacggaagatcaggctgatcgctgcctctcctgcggcaaacgagcagtctgcgagtggacttgcccgttgcataacaatattcccgagctgctgagtctggcgaagcaggggcgcatttttgaagccgtagagctatcacatcaaaccagcagcctgccagaaatctgtggccgagtatgtccgcaggatcggctatgcgaaggggcttgtacgctgggtaaagagtacggtgccatcacgatcggcaacattgagcgctacattaccgataccgcgatggccatggggtggtcacccgatatgacgcgtgtcgttcccagcggcaaacgcgccgcaatcgtcggggctggcccggctgggttagcctgtgccgatgtgctggcacgcaatggcgtgcaggccgtcgtgttcgatcgccacccggaaattggtggattgctcacgttcggaattccgtcgttcaagctggataaagacgtcctgattcatcgtcgtaaagtattcagcaccatgggaatcgaattccagctgaataccgaagtggggaaagacatttctctggctcagcttctggacgactatgacaccgttttcctcggcgtgggcacctaccgctccatgaaggccaacattgataatgaagatgcccccggcgtcttcgatgcacttcctttccttattgccaataccaaacacgttatggggctacctgaattagacgatgagccctatatctcgatggcaggaaaacgcgtcgtagtactcggcggtggggataccgcaatggactgcctgcgcacgtccgtccggcaaggtgcaatatccgtaacctgcgcatatcgccgcgatgaagccaacatgcccggctcgaaaaaagaggttaaaaactcccgcgaagagggcgtggatttcatgtttaacgttcagccacaaaaaatctgtctcaacgaacagggcgaagtgtgcggtatcagcctggttcgcactgaactgggtgaaccagatgctagcggccgtcgtcgcccacgccccattcctagttcggaattcgtacagcccgcggaagccgtaataaccgcatttggctttcagtcgcacagtatgccgtggctggaagatgccgatattggtctggataactggggacacatcaccgccccccttgatagtcagacaccttgccagactaatcatccgcgtatttttgctggtggcgatgccgtgcgcggtgccgatctggtggttaccgcgattgccgatgggcgcaaagccgcattggggatgattgagacgatggggctgaccgccgtcacaggtgccattcccgcacatccgcagcgtcccgaaatgaatgcaacccgcgaggagctacgctcatga

SEQ ID NO: 4452 - protein, 674 aa, Erwinia carotovora
MNRFVIASTQDCMGCHACEIACVISHNDEQYPDSTAVFQPRIKAFNTPTLRAAVTCRHCEDAPCASVCPTQALIKKDNSIQLVQEKCIGCKSCVLACPFGAMSMVTNPMDNSAIAHKCDLCADRPEGQACVEACPTQALQLISEHTLTARRQEKQQLMALRSAAHWQRETPVLKTLTTHPLNKRKNWPRRDAEKKPLTQRTSTFDEIYHGFSVQQTEDQADRCLSCGKRAVCEWTCPLHNNIPELLSLAKQGRIFEAVELSHQTSSLPEICGRVCPQDRLCEGACTLGKEYGAITIGNIERYITDTAMAMGWSPDMTRVVPSGKRAAIVGAGPAGLACADVLARNGVQAVVFDRHPEIGGLLTFGIPSFKLDKDVLIHRRKVFSTMGIEFQLNTEVGKDISLAQLLDDYDTVFLGVGTYRSMKANIDNEDAPGVFDALPFLIANTKHVMGLPELDDEPYISMAGKRVVVLGGGDTAMDCLRTSVRQGAISVTCAYRRDEANMPGSKKEVKNSREEGVDFMFNVQPQKICLNEQGEVCGISLVRTELGEPDASGRRRPRPIPSSEFVQPAEAVITAFGFQSHSMPWLEDADIGLDNWGHITAPLDSQTPCQTNHPRIFAGGDAVRGADLVVTAIADGRKAALGMIETMGLTAVTGAIPAHPQRPEMNATREELRS

SEQ ID NO: 4453 - DNA, 1419 bp, Erwinia carotovora
  CDS (1)..(1419)
atgagtcagaatgtttaccagtttatcgacttacagcgcgttgatccgcccaagaagccgctgaagattcgtaaaattgaatttgttgagatctacgagccgttctcagaaagccagtccaaagcccaggcagatcgctgcctgtcatgcggaaacccttactgtgaatggaaatgtccagtacataactacatcccgaactggctgaagctggcgaacgaaggccgcattatcgaagcggctgagttatcgcaccagactaacagcctgccggaagtgtgcggccgcgtatgcccgcaggatcgtctgtgtgaagggtcttgtacgctgaatgacgagttcggagcggtcaccatcggcaacatcgagcgctatatcaatgataaagcgatagagatgggctggaagccgagcgttgccaacgtcataccgacaggtaaacgcgtcgcgatcatcggcgctggccctgctgggctggcctgtgccgatgtgctggcacgcagtggcgtacaggccgtcgttttcgatcgtcaccctgagatcggtggcctactgaccttcggcatcccctctttcaagctggaaaaagaggtgatggtgaaacgccgtgaaatcttcaccgagatggggatcgaattccgtctgaataccgaagtcggcaaagacgtacagatgaaagcgctgctggacgagtacgatgcggtattcctcggtgtcggcacctatcagtctatgcgtggcggattggacaatgaagacgctcagggcgtctacgatgctctgccgttcctgatcgccaacactaagcagctaatgggctttgaagccgcaacagacgaaccttacatcagcatgcaggggagacgcgttgtcgtgctgggcggtggtgataccgcgatggactgcgtgcgaacctcaattcgtcaggccgcaacgcacgttacctgtgcctatcgtcgtgatgaagagaacatgcctggctccaagcgcgaagtgaaaaatgcacgtgaagaaggcgtcgagttcaaattcaacctgcaaccgctgagcgtcgaggtcaatggcgcaggcaaagtgtgcggtgtgaaaatggcgcgaactgcactgggcgtacctgatgccaatggacgtcgtcgtcctgaaatcgtagagggttccgagcacgtactggaagccgatgcggtcatcatggcgttcggcttccgtccgcacaaaatggcgtggctggcagaacatgacgtcaagctggacgatcaagggcgtattgtcgcaccggaaagctgcgataacgccttccaaaccagcaacccgaaaatttttgcgggcggcgatgcagtacgcggttcagatctggtggttaccgccatcgcagaaggtcgtaaagctgctgacggcatcatgaactatctggaagtgtag

SEQ ID NO: 4454 - protein, 472 aa, Erwinia carotovora
MSQNVYQFIDLQRVDPPKKPLKIRKIEFVEIYEPFSESQSKAQADRCLSCGNPYCEWKCPVHNYIPNWLKLANEGRIIEAAELSHQTNSLPEVCGRVCPQDRLCEGSCTLNDEFGAVTIGNIERYINDKAIEMGWKPSVANVIPTGKRVAIIGAGPAGLACADVLARSGVQAVVFDRHPEIGGLLTFGIPSFKLEKEVMVKRREIFTEMGIEFRLNTEVGKDVQMKALLDEYDAVFLGVGTYQSMRGGLDNEDAQGVYDALPFLIANTKQLMGFEAATDEPYISMQGRRVVVLGGGDTAMDCVRTSIRQAATHVTCAYRRDEENMPGSKREVKNAREEGVEFKFNLQPLSVEVNGAGKVCGVKMARTALGVPDANGRRRPEIVEGSEHVLEADAVIMAFGFRPHKMAWLAEHDVKLDDQGRIVAPESCDNAFQTSNPKIFAGGDAVRGSDLVVTAIAEGRKAADGIMNYLEV

SEQ ID NO: 4455 - DNA, 1422 bp, Acinetobacter sp
  CDS (1)..(1422)
atggcagagcgcctaaataatgactttcagtttctggatgtagcacgccaagatccagagaaaaaagatattgatgtccgcaaatctgagtttgtggaaatttacaaaccatttactgctgaagttgctgcaaatcagacgcatcgttgtttgggctgtggtaatccgtactgtgaatggaaatgcccagtacataactatattccaaactggttgaagttgattgcagagggccgtatttttcaggcggctgaattgtgtcatcaaaccaatactttgcctgaagtgtgtggtcgtgtttgtccgcaagaccgcttgtgtgaaggtgcatgtacattgaatgacggctttggtgctgtcacaattggtaatgcagaaaaatatattaatgacaccgcttttgcattgggctggcgtccagatatgtcttcagttaaatggaccaataaaaaagttgcgattattggtgcaggccctgcgggcttgggctgtgcagatattctggtgcgtaatggtgtaaagccagtggtatttgacaagcgtccagaaattggtggattgctgacctttggtattccagaattcaagatggaaaaagatgttatgaaacgccgccgtgaaattttcacgggtatgggggttgagttccgtctaaatgttgaaattggtaaagatgtcacaatcgagcaattgcttgaagactatgatgctgtattcatgggtatgggcacctacacctatatgaaaggtggcttcccaggtgaagacttagatggcgtatacgatgcactcgactttttgattgccaatgttaaccgtactcagggctgggagcaaaatccgagcgattatattagtgttgaaggcaaaaaagtgattgtattgggtggcggtgatacagcgatggactgtaaccgtacctccattcgtcaaggtgctgaagaagtaacgtgtgcataccgtcgtgacgaagccaatatgccaggttcacgtcgtgaagtacaaaatgcacgtgaagaaggcgtcaacttcctgtttaatcgccagcctatcgagattgtaggtgaaaatggtcaggtgacaggcgtaaaagtggtcactactcagcttggagctccagacagccgtggccgtcgtagtccagagccaattccaggttcggaagaagtgcttgcagccgatgcggtgctacttgcttttggtttccgtcctagtccagcagattggtttgcatcatcaagtattaacttggatggttcaggtcgtgtagtggcagcagaacagcaacaatataaattccagacatctaacccaaaaatctttgcgggtggcgatatggtacgtggttctgatctggtggtaactgcaatttgggaaggccgtgaggccgcagaaggtattttggattaccttgatgtctaa

SEQ ID NO: 4456 - protein, 473 aa, Acinetobacter sp
MAERLNNDFQFLDVARQDPEKKDIDVRKSEFVEIYKPFTAEVAANQTHRCLGCGNPYCEWKCPVHNYIPNWLKLIAEGRIFQAAELCHQTNTLPEVCGRVCPQDRLCEGACTLNDGFGAVTIGNAEKYINDTAFALGWRPDMSSVKWTNKKVAIIGAGPAGLGCADILVRNGVKPVVFDKRPEIGGLLTFGIPEFKMEKDVMKRRREIFTGMGVEFRLNVEIGKDVTIEQLLEDYDAVFMGMGTYTYMKGGFPGEDLDGVYDALDFLIANVNRTQGWEQNPSDYISVEGKKVIVLGGGDTAMDCNRTSIRQGAEEVTCAYRRDEANMPGSRREVQNAREEGVNFLFNRQPIEIVGENGQVTGVKVVTTQLGAPDSRGRRSPEPIPGSEEVLAADAVLLAFGFRPSPADWFASSSINLDGSGRVVAAEQQQYKFQTSNPKIFAGGDMVRGSDLVVTAIWEGREAAEGILDYLDV

SEQ ID NO: 4457 - DNA, 6459 bp, Candida glabrata CBS138
  CDS (1)..(6459)
atgctgtcgtctgacccatacgatcctatggaggatgcgtatgagaccagtggcaacattccggactacgctcacgatgagctatatcataatagtgaaaacaagtcctggggtcaagtggtacctggtaaagtaggactgtatgacccagactacgaacacgatgcctgtggtgtcggttttgttgcaaatgtcaacggcttgcaatcgcataagattgtctctgatgcaagatcgctattatgcaacatgactcatcgtggtgctgtttcttctgatggtaatggtgatggtgcgggtattctggtcggtattccacatggcttcatcaaaagagaattcaagttagatctaggcatcgaagtacctgaacgtggtcagtatgctgttggtaacgttttcttcaaaaaggatgactccgatgacgaaacgttgagtgagaaaagcaaagctgaaattagagtaatgcaacaaaaattcgaagacaccgcacgtaacttcaacttaaatgtggtgggatggagaaatgttccccatgactcttctattcttggagatgtagcattatcccgtgaacctgtcatattgcaaacattggtggtaccactagactccaacgaattagtggaattcaacgaaaccgtgtttaagacaaacttatacttgttcagaaagtttatcacaaagcaattcaagcctgaagattgtttctacgtttgctctttgagcaattccacaattgtctacaaaggtcaattaactccaaatcaagtttacaactactatcatgatttaacgaatgcgcatttcgaatcccatatggctttagtccattcaagattttcaactaatactttcccatcatgggatagagcacaaccattaaggtgggtggctcacaatggtgaaatcaacactttaagaggtaataagaattggatgcgttctagagaaggtgttatggtctctgaaactttcaaagataaattggattctttgtatccaattattgaagaaggtggctctgattctgctgcattagataatgtcctagaacttttaacaattaacggcactctttcattacctgaagctatcatgatgatggtgcctgaggcttatcactctgatatggactcagacttgaaggcatggtatgattgggctgcttgtctaatggaaccatgggatggccctgctctactaacttttacagatggtagatactgtggtgccattttagatagaaatggtctgagaccatgtcgttactatgttacttccgatgatagagttatctgcgcctctgaagtaggtgttatcccaattgacaactccttggttcttcagaaaggtaagctgaaacctggcgatgttttcctagtcgacactcaacaaggacaaattgtcgatacaaagaaacttaaaagtgatttctccaagagagaagatttcaagtcttggttatctaaggttatcaagttggaagatttacttcagaagacagaaaactgtgaaccagaggattttgtgctgaatgctccttcactgaaagttcaaagtgatccaagattactagctcatggctacactttcgaacaattttcaatgctacttactccaatggcactaacaggcaaagaagctcttggttctatgggtaatgatgctccattagcttgcctgaaccaagatcctgttttattatatgaatatttcagacaattattcgcacaagtgacaaatccaccaatcgaccctattcgtgaagcaaatgttatgtctttagattgttacgttggaccccaaggtaacttactagaaatgcatccatcccaatgtgaacgtctgttattgaagtccccaatattaaaatggaatgaattcaaagctattcaaaatattgaaaaagtaaatccttcatggagtgttgctaatatagatataacatttgaaaaatctgaaggtattgaaggctatatcaatgctgtcgaacgtattactaaagatgcaagtattgcaattgaagaaggtaagaagattcttattatatccgatagaagaatgggtgaacaccgtgttgcattgtcttcattactagcggttagttcgatacatcaccatttgattagaaataaacagcgtaccgaagttgcattaattttggagactggtgaagcaagagaaattcatcacttctgtgttttacttggttatggttgtgatggtattttcccttacttagcaatggaaacactaatcagaatgaacagagaaggtttagtacgtaatgttaacaatgacgaccatgatcttactgatcaagaactggtcgagaactataaacatgccatcgatagtggtatcttgaaagttatgtctaaaatgggtatttccactttggcatcatacaaaggtgcccaaatttttgaagctcttggtattgattcatccgttattgacttatgctttactggtacttcttcaagaattaagggtgtaacctttgagtatattgcacaagatgccttctcctttcacgaaaagggttatccatcaagaatgacaatcactagatctgtcaatttacctgaaactggtgaatatcactggagagatggtggatacaagcatgttaatgatccaacagccattgctgcactacaggactctgtaagacacaagaatgacgatgcttggagtttatatgtcaagaaggaaatggaagcaattaaggactgtactttaagagggttgcttgaactggattttgaaaattctacacctattcctatcgaacaagttgaaccatggactgaaattgctagaaggtttgcgtcaggtgctatgtcttatggttctatttccatggaagcgcattcaacactagcaatcgccatgaaccgtctcggtgccaaatctaactgtggtgaaggtggtgaagatgcagaacgttcattggttcatccaaatggtgacaccatgagatcagcaattaagcaagttgcttcagctagattcggtgttacttctcattatctttctgatgctgacgaaattcaaattaaaattgcacaaggtgccaagcctggtgaaggtggtgaattaccagctcataaagtatctaaaagcattgccaagactagacactccaccccaaatgttggtttgatatctccacctccacatcacgatatttactctattgaagatttgaaacaattggtgtacgatctgaaatgtgctaatccaagagccggcgtatcagtgaaattagtttctgaagtcggtgttggtattgtggcatcaggtgtagctaaagcaaaggctgaccacatcttaatttcaggtcatgatggtggtactggtgcctctagatggaccagtattaagtatgccggtttaccttgggaattaggtctagctgaaactcatcagaccctagtgttgaatgatttgagacgtaatgttgttgtccaaacagatggtcaattaaggacaggttttgacattgctgttgctgtattgttaggtgctgaatcatttacactagctacaattccattgattgttatgggttgtgtcatgctaagaagatgtcataccaacacatgtgcagttggtattgctactcaagacccttacttaagaagcaagttcaaaggtcaaccagaacatgttatcaactttttctactatctaattcaagacttaagacaaatcatggccagattgggcttcagaacaattgatgaaatggttggtcactccgaaaaattaagaagaagagcggatgctaatccaaaggtgataaatattgacttgacaccaattttaacaccagctcatactattcgacctggtgttgctacaagattcaccaagaaacaagaccataaacttcatacacgtttggataacaaactaattgatgaggccgaagttactttagataaaggtctacctgttaatattgatgccaacatcgttaacactgaccgtgccctaggttcgacactttcttaccgtgtatctaagagatttggtgagaatggtctcccaagggataccattgtcgcaaatatcaatggttctgctggccaatcatttggtgcatttttggcttcaggtatcacatttatccttgacggtgatgctaacgattatgttggtaagggtttatcaggtggtattattgttgttagacctccaaagaattccaagtttaagagtgatgagaatgttatcgttggtaatacatgtttctatggagctacttcaggtaccgcattcattgctggtagtgcaggtgaacgtttcgctgttagaaactctggtgccacaattgtagtggaaagagttaaaggtaataacgcatttgaatatatgacaggcggtagagccttagttctttctcaattagaatccattaatgccttctcgggtgcaactggtggtattgcttattgtttgacatctgattatgatgcattcctatctaagataaacaaagaaacaatcgaacttgaacatttagaggaccctgttgaaattgcttatgtcaagaacttgattcaagaacattacaactttacgaagtccgaattagcatccaatattttaggcaacttcaaccattacttgaaaaaatttgttaaagttattccaagtgattacaagaaggtgttactaaaggaagccgaagaaaaagcaaaggaaaaagaaaatgcaacagctgaatatctaaagaagctaggttctcctgcagaacctggtttggatgctacaaatggagaggttgcaaaaatgcaggcagccaagcgccaagctatttcccgtgctgtgatttccaacaagtccacattacatgaacctaaggtgttagacttggaggaagctgttcctgatgctaagcaaatggagaaaaatgctgaaaaggttgtaaagatgaatggttttatgaaatacaatgttcgccacgaaggacatagagatcctgccactagaacaaaagattggaaggaattcacaaagcctgtctccaagcgtgacgcaaaataccaaactgctagatgtatggattgtggtactccattttgtcaatctgatactggttgtcctttatcaaatattattccaaagttcaatgaacttgttttcaagaaccaatggaagcttgctctagacaagttgttagaaaccaacaatttcccagaatttacaggtagagtttgtcctgccccatgtgaaggtgcttgcaccctgggaatcattgaagatccagttggtatcaaatctattgaaagaatcattattgataatggtttcaaggaaggttggattattccaactcctccttccacgaggactggtcgtcgcgttgcaattattggttccggccctgcaggtatggcttgtgctgacatgttaaacagagcaggccattcagtgactgtgtttgagagagctgatcgctgtggtggtttactgatgtacggtattccaaatatgaaactggataaatctattgttcaacgtagactagatttactctcagctgaaggtattgaattcgttaccaacacagagataggtaaagatatcaccgttgatgaactgaagagtaactacgactctgttgtgtatgcaattggttcaactattccaagagatttgccaataaaaggtcgtgaattgaagaatattgattacgcaatgaacctccttactgaaaatacaaaggcattattatcaaacgatcttgagactatcaggaagcagattgaaggtaagagagttctcgtcattggtggtggtgacacaggtaatgactgtttgggtacctctgttagacatggcgctaaatctgttgttaattttgaactgctaccacaaccaccaaacgagcgtgccaaggataacccatggccacaatggccacgtataatgcgtgtagactatggtcatgctgaagttaaggaacattacggtagagatcctcgagaatactgtatcttatctaaggagttcattggtgatgaagagggtaatgttacaggtattaaaactgcacgtgttgaatggaagaaatcacaaagtggtgtttggcagatggttgaagtccctaacagtgaggaactgtatgaagctgatattgtgttactatctatgggtttcgttggaccagaattactgaacaacgatactaacatcaagaagactagaagaggtacaattgaaacactatcacattcatcatacaatattgacggcggtaaaatgtttgctgctggtgattgtagaagaggtcagtcattgattgtctgggccattcaagaaggtcgtaagtgtgctgccgctgttgacgaatttttaatgggcgatacttacctcccaggtagcggtggtattgtgaaacgtgattacaggttattagaggaactagctgccacagtatga

SEQ ID NO: 4458 - protein, 2152 aa, Candida glabrata CBS138
MLSSDPYDPMEDAYETSGNIPDYAHDELYHNSENKSWGQVVPGKVGLYDPDYEHDACGVGFVANVNGLQSHKIVSDARSLLCNMTHRGAVSSDGNGDGAGILVGIPHGFIKREFKLDLGIEVPERGQYAVGNVFFKKDDSDDETLSEKSKAEIRVMQQKFEDTARNFNLNVVGWRNVPHDSSILGDVALSREPVILQTLVVPLDSNELVEFNETVFKTNLYLFRKFITKQFKPEDCFYVCSLSNSTIVYKGQLTPNQVYNYYHDLTNAHFESHMALVHSRFSTNTFPSWDRAQPLRWVAHNGEINTLRGNKNWMRSREGVMVSETFKDKLDSLYPIIEEGGSDSAALDNVLELLTINGTLSLPEAIMMMVPEAYHSDMDSDLKAWYDWAACLMEPWDGPALLTFTDGRYCGAILDRNGLRPCRYYVTSDDRVICASEVGVIPIDNSLVLQKGKLKPGDVFLVDTQQGQIVDTKKLKSDFSKREDFKSWLSKVIKLEDLLQKTENCEPEDFVLNAPSLKVQSDPRLLAHGYTFEQFSMLLTPMALTGKEALGSMGNDAPLACLNQDPVLLYEYFRQLFAQVTNPPIDPIREANVMSLDCYVGPQGNLLEMHPSQCERLLLKSPILKWNEFKAIQNIEKVNPSWSVANIDITFEKSEGIEGYINAVERITKDASIAIEEGKKILIISDRRMGEHRVALSSLLAVSSIHHHLIRNKQRTEVALILETGEAREIHHFCVLLGYGCDGIFPYLAMETLIRMNREGLVRNVNNDDHDLTDQELVENYKHAIDSGILKVMSKMGISTLASYKGAQIFEALGIDSSVIDLCFTGTSSRIKGVTFEYIAQDAFSFHEKGYPSRMTITRSVNLPETGEYHWRDGGYKHVNDPTAIAALQDSVRHKNDDAWSLYVKKEMEAIKDCTLRGLLELDFENSTPIPIEQVEPWTEIARRFASGAMSYGSISMEAHSTLAIAMNRLGAKSNCGEGGEDAERSLVHPNGDTMRSAIKQVASARFGVTSHYLSDADEIQIKIAQGAKPGEGGELPAHKVSKSIAKTRHSTPNVGLISPPPHHDIYSIEDLKQLVYDLKCANPRAGVSVKLVSEVGVGIVASGVAKAKADHILISGHDGGTGASRWTSIKYAGLPWELGLAETHQTLVLNDLRRNVVVQTDGQLRTGFDIAVAVLLGAESFTLATIPLIVMGCVMLRRCHTNTCAVGIATQDPYLRSKFKGQPEHVINFFYYLIQDLRQIMARLGFRTIDEMVGHSEKLRRRADANPKVINIDLTPILTPAHTIRPGVATRFTKKQDHKLHTRLDNKLIDEAEVTLDKGLPVNIDANIVNTDRALGSTLSYRVSKRFGENGLPRDTIVANINGSAGQSFGAFLASGITFILDGDANDYVGKGLSGGIIVVRPPKNSKFKSDENVIVGNTCFYGATSGTAFIAGSAGERFAVRNSGATIVVERVKGNNAFEYMTGGRALVLSQLESINAFSGATGGIAYCLTSDYDAFLSKINKETIELEHLEDPVEIAYVKNLIQEHYNFTKSELASNILGNFNHYLKKFVKVIPSDYKKVLLKEAEEKAKEKENATAEYLKKLGSPAEPGLDATNGEVAKMQAAKRQAISRAVISNKSTLHEPKVLDLEEAVPDAKQMEKNAEKVVKMNGFMKYNVRHEGHRDPATRTKDWKEFTKPVSKRDAKYQTARCMDCGTPFCQSDTGCPLSNIIPKFNELVFKNQWKLALDKLLETNNFPEFTGRVCPAPCEGACTLGIIEDPVGIKSIERIIIDNGFKEGWIIPTPPSTRTGRRVAIIGSGPAGMACADMLNRAGHSVTVFERADRCGGLLMYGIPNMKLDKSIVQRRLDLLSAEGIEFVTNTEIGKDITVDELKSNYDSVVYAIGSTIPRDLPIKGRELKNIDYAMNLLTENTKALLSNDLETIRKQIEGKRVLVIGGGDTGNDCLGTSVRHGAKSVVNFELLPQPPNERAKDNPWPQWPRIMRVDYGHAEVKEHYGRDPREYCILSKEFIGDEEGNVTGIKTARVEWKKSQSGVWQMVEVPNSEELYEADIVLLSMGFVGPELLNNDTNIKKTRRGTIETLSHSSYNIDGGKMFAAGDCRRGQSLIVWAIQEGRKCAAAVDEFLMGDTYLPGSGGIVKRDYRLLEELAATV

SEQ ID NO: 4459 - DNA, 1464 bp, Staphylococcus aureus
  CDS (1)..(1464)
atgggtgaatttaaaggatttatgaagtatgacaaacagtacttaggtgaattatcactggtagaccgtttgaagcatcataaagcatatcaacaacgatttactaaagaagatgcctctatccaaggtgcacgatgtatggattgtggaacgccgttttgtcaaaccggacaacagtatggtagggaaacaataggttgtccaattggaaactacattcctgaatggaacgacttagtgtatcatcaagattttaaaactgcttatgaacgcttaagcgaaacaaataactttcctgactttacagggcgtgtatgtcctgcaccatgcgaaagtgcttgtgtgatgaagattaatagagaatcgattgcgattaaaggtattgaacgcacaattattgatgaagcttttgaaaatggttgggtagcgccgaaagttccgagtcgccgtagagatgaaaaagtggcaatcgttggaagcggtccagcaggattagctgctgctgaagaacttaatctactaggatatcaagtaactatttatgaacgtgctagagaatcaggcggtttattaatgtatggtattccgaatatgaaacttgataaagatgtggttcgacgtcgtattaagttaatggaagaagcgggcattactttcattaatggtgttgaagtcggtgttgatattgataaagcaacgttagaatctgagtatgatgccattatattatgtactggtgcacaaaaaggtagagatttacctttagaaggacgcatgggtgatggtatacatttcgctatggattatttaactgaacaaacgcagttgttaaatggagaaattgatgatataacaataactgcaaaagataagaatgtcattatcattggtgctggtgatacaggggcagactgtgtagcgacagcattaagagaaaattgtaaatcgattgttcaatttaataaatatacgaaattgccagaagcaattacatttacagaaaatgcatcatggcctttagcaatgccggtgtttaaaatggactatgcgcaccaagagtacgaagctaagtttggtaaggaaccacgtgcatatggtgttcaaacaatgcgttacgatgttgacgataaaggacacatacgtggtttgtatactcaaattttagagcaaggcgaaaatggtatggtcatgaaagaaggacctgaaagattttggcctgctgaccttgtattattatcaatcggcttcgaaggtacagaaccaacagtaccgaatgcttttaacattaaaacggatagaaatcgaatcgtggcggatgatacaaactatcaaactaataatgaaaaggtatttgctgctggagatgctagacgtggtcaaagtttagttgtatgggcaattaaagaaggtagaggcgtagcgaaagcagtagatcagtatttagctagtaaagtttgtgtatag

SEQ ID NO: 4460 - protein, 487 aa, Staphylococcus aureus
MGEFKGFMKYDKQYLGELSLVDRLKHHKAYQQRFTKEDASIQGARCMDCGTPFCQTGQQYGRETIGCPIGNYIPEWNDLVYHQDFKTAYERLSETNNFPDFTGRVCPAPCESACVMKINRESIAIKGIERTIIDEAFENGWVAPKVPSRRRDEKVAIVGSGPAGLAAAEELNLLGYQVTIYERARESGGLLMYGIPNMKLDKDVVRRRIKLMEEAGITFINGVEVGVDIDKATLESEYDAIILCTGAQKGRDLPLEGRMGDGIHFAMDYLTEQTQLLNGEIDDITITAKDKNVIIIGAGDTGADCVATALRENCKSIVQFNKYTKLPEAITFTENASWPLAMPVFKMDYAHQEYEAKFGKEPRAYGVQTMRYDVDDKGHIRGLYTQILEQGENGMVMKEGPERFWPADLVLLSIGFEGTEPTVPNAFNIKTDRNRIVADDTNYQTNNEKVFAAGDARRGQSLVVWAIKEGRGVAKAVDQYLASKVCV

SEQ ID NO: 4461 - DNA, 1830 bp, Oryza sativa
  CDS (1)..(1830)
atgatgatacaacagcacagacttcatacacaaagtgatttggccagagatatactcttgaattttgatactctcctcccaaaatttataaaagtatatccaagggattacaagcgggttttggataaactaaaagaagagaaggctgctaaagaagcagagcaaaaggcaagagaagtggtggataagaagccagttgaagtaattcaagctccaaatggcatttcagtaaagacagagaaagtaatgaacgaagagccatcaagccgaccatcacgagtttcaaatgctgtaaagtaccgaggtttcataaaatatgagcgagagggtacttcttacagagatccaaatgagcgtgtaaaagattggaatgaagttgcaattgaattggttcctgggccactgctaaagacgcaatctgctcggtgcatggattgtggcactcctttctgtcatcaggagggttctggtgctggttgtcctcttggaaataagattcctgaattcaatgaattggttcatcagaatagatggcatgaagccttggatcggctacttgagacaaacaatttccctgagtttactggacgagtttgtcctgctccttgtgagggttcgtgcgtacttggcattatagacaatccagtatccataaaaagcatagagtgcgccatcatagacaaaggatttgaagagggatggatggtaccacggcctccacttcggagaacaggaaagagagttgctattgttggcagtggcccagctggtctagctgctgcagaccaactgaacaaaatgggccatttcgtgactgtctttgaacgtgctgaccgtattggaggactgatgatgtatggggttccaaatatgaaggctgacaaagagggcattgttcagcgacgtgtcgagttgatggctaaggagggggttcaattcattgtgaatgcccatgttggaagtgaccctttatactccgttgaaaagctccgctctgagaatgatgccattattttggcctgtggagctacaaagccaaaagatctccctattcctggacgggagttggcaggcatccatttcgctatggaatttcttcatgccaataccaaaagtttacttgacagcaacttggaggatggtaactacatatcagcccaagggagaaaggtggttgtcattggtggtggagacacaggcacagattgcattgggacatccattaggcatggttgcaccaaccttgtaaatcttgaacttttgccagagccaccaagaaagagggcacctgacaacccctggccccagtggcccaggatcttccgtgttgattatgggcaccaggaagcaactagcaagtttggaaaagatccaagaagttacaaagtcctgacgaagcgatttatcggagatgagaatggaaatgtgaaggcccttgaggtaatacgtgttgaatggggaaaggtgaacggaaggttccaattcaaggaagttgaaggatcagaagaaattattgaggccgatcttgtcctcttagctatgggattcctgggtcccgaagcgactgttgctaacaagctgggtctagaacaagacatgaggtcaaacttcaaagctcaatttggaaactttgcgaccaatgtggaaggtgtatttgctgctggagactgcagacgtgggcaatcactggttgtttgggccatcacagaggggcgccaagctgcagcagccgtagacaattacctgtcgaaggatgatgaaggtgaaaccaatggcacagaggacattgctgtctcaagtgaaggtctggtccaacccgtagttgcatag

SEQ ID NO: 4462 - protein, 609 aa, Oryza sativa
MMIQQHRLHTQSDLARDILLNFDTLLPKFIKVYPRDYKRVLDKLKEEKAAKEAEQKAREVVDKKPVEVIQAPNGISVKTEKVMNEEPSSRPSRVSNAVKYRGFIKYEREGTSYRDPNERVKDWNEVAIELVPGPLLKTQSARCMDCGTPFCHQEGSGAGCPLGNKIPEFNELVHQNRWHEALDRLLETNNFPEFTGRVCPAPCEGSCVLGIIDNPVSIKSIECAIIDKGFEEGWMVPRPPLRRTGKRVAIVGSGPAGLAAADQLNKMGHFVTVFERADRIGGLMMYGVPNMKADKEGIVQRRVELMAKEGVQFIVNAHVGSDPLYSVEKLRSENDAIILACGATKPKDLPIPGRELAGIHFAMEFLHANTKSLLDSNLEDGNYISAQGRKVVVIGGGDTGTDCIGTSIRHGCTNLVNLELLPEPPRKRAPDNPWPQWPRIFRVDYGHQEATSKFGKDPRSYKVLTKRFIGDENGNVKALEVIRVEWGKVNGRFQFKEVEGSEEIIEADLVLLAMGFLGPEATVANKLGLEQDMRSNFKAQFGNFATNVEGVFAAGDCRRGQSLVVWAITEGRQAAAAVDNYLSKDDEGETNGTEDIAVSSEGLVQPVVA

SEQ ID NO: 4463 - DNA, 4185 bp, Photobacterium profundum
  CDS (1)..(4185)
atgccgagaaccataaagaggcaatcaatgataaatgtcacgatagatggacaaaaattccccgtaaacgcgcaacaaaccctactcgaagctgcagctgactgtaatattgaaataccgtcactttgtggtctcaataaaaatggcgagaaagtgccttgtgaactttgtgtcgtcgatgtagctgggcaaggtattcaacgtgcctgtgaaattttacccgttgaaaacatgattgtgaccactgtttctgaagaactgtcttcgctacgtcaaacagcactaaaccgtattctttctgatcactatgccgattgtgaggcgccgtgccaaacagcatgtcctgctggcgtagatattcaatcttatctttaccatatttctcaagatgatcatgttaaagcggtggaagtcattaaacgaacactgcctatgccgttatccattggccgtgtttgccctgcattttgtgaaactgaatgccgtcgtggtttagtcgatgaaccaatcgccattcgccagcttaaacgacatgcagccgatatagatcttgctgcacaagaaaattatgtaccgccaaagaaagcatcaaaaggtatgtccattgcagttgtaggtagtggccctggcggcttaacgtgtggctattatctaacaaacgaaggttacgatgtaacagtatttgaatcgatgcctgaagcgggtggttggttacgttacggtatacctgaataccgtttgcctaaggctattttggcaaaagaaattgagctaatgtgccgaaacggcatgcaagtactgacctcgaagaagttaggcgatgatttcacactcacgcaactaacagaagattatgatgcggtatgccttgcagttggtgcttctcaagccgtagaaatgaattataccggtagtgatcttaatggttgttatttgggcgttgattacctgaaagattacgtcactgaaggttgttacattacgggtaaaaaagtagccgttattggtggaggtaatactgccattgactgtgcacgaacagctgtacgtgatggtgccgataccacgcttatttaccgtcgtacacgtgatgaaatgcccgctgaagattatgaaattgtagaggccgagcatgaaggcgttaaatttcacttcttgacaaacccagttgagaatattgctgacgcgaatggtcacgtgtgtgaaattaagctagagaaaatggcattgggtgaggctgatgcatctggtcgtcgtcgaccggaaccgacaggtaaatactttaccgaagcgtttgataccgttattgccgcggtttcgcaaaagcctgatttaagcttcatggataaagaagaattagatctgccattaacgcgctggaatactcaagatgctaatccgaataccatgcactcaggtttaggtaatgtattcagtattggtgatttccgtcgtggacccgcaacagccattgaggcggttgcagatgggcgcattgctgcagaggcgattgaccgcttcttcgacggtgatatggaaaacattccagttaagctttttaattcacaaaaagagcgcaagttgaaacaggttgctcctgagcagtttgtagagattaaaaaagtaatgcgctctgtaatgccagaattgagcacgaaagagcgagagttaagctttagtgaagttgaaacggggtttaacaatgacgaagcaatgcgcgaagctgcacgttgtttagagtgcggttgccaagcaaacaccgattgtaagttacgtgactatgcgaccgaatatgatgttgcagaaaccgaattaaccaatgagagttgccagaagttccatgtagatgatagctctgaattcatcgtgttcgacgctaaccgttgcattagttgtggtcagtgtgttgaagcctgtaatgaaaaagcggttcatggcacgctaagttttgcaaaaaatgctgatggttcaagtgcgagccgccctgaatgccgccctggctttgataagggctacagtatgggtgactctaattgtgttcaatgtggggcatgtgttcaagtgtgtcctactggcgcactggtcgataagcgagataagtcgcaaggtcgaatcgaaatgctgaagccggttgagacgatttgtacctattgtggtgtgggttgtaagctgacgatgtatgtcgatgaatcattaaatcagattcgttatgtacaaggcgtaaaagattcgccagtaaaccaaggtatgttatgtgttaaaggacgctttggttttgattttgtaaatagcaaagagcgtttaacaaccccgctaattcgtaaaaatggtgaattacagccagccagttgggaagaggctatttcgctggtcgctgataaattcaatgcgattaaagccgatagaggcggcaatgcgttagcgggtttctcatcggcgaaaaccaccaacgaagataactttgcattccaaaagtttattcgtcgagaattagaaacgaataacgtcgatcactgtgcacgtttgtgtcacgcatcaacagtaacaggattagaagcgtcaattggtagtggcgcaatgaccaatgacattccaagcattaagttctctgatgtggtgtttatcattggttccgatacgaccgcggcgcacccgatcattgcatcacatatcaagcaagcgattcgtacgggtaaaacacgtttaatcgtggcagatcctaaacgtattgatattgccgatcattccgatttgtatgttgcacatcgtccgggtacggatgtgatgctaatgaacggcatcatgcagcaaattatcaaaaacgactggcatgataaaacgtatatcaatgagcgaacagaaggctttgaagcattaaaagcagaagtgatgctcgatagctatgcaccagataaagtggaattggtcacgggtgtgaaagcgcaagacgttatcaaaatagcgcagatgattggtactgctaatcgtactgccgtgtattactcgatgggtattacgcagcatacaacgggccatgataatgtacgttctgtggctaacttgcagatgttgtgcggtaacattggcatcgaaggtggtggtattaatccactacgtggtcaatctaatgtgcaaggtgcctgtgatatgggcgcactaccaaacaacttccctggttaccagaaagtacaggtgccagaaattcatgccaaatttgccaaagcatggaataaacccaacttaccgaaagaggatgggttaaccctaaccgagattatcgatgctgcatgtcatgatcaggtgaaaggtttgtatgtaatgggggaaaacccggtattgagtgatccaaaccaagcccatgtaatagaagggttagagaagttggatttcttagtggtgcaagacattttcttaactgaaactgcgcaatatgcggatgtcgttttaccgtcgtgttctttcgcagaaaaatcgggtcatttcacgaatactgaacgccgcgttcaacgtatttcacctgcggttaatcctccaggggaagcgaaggaagattggtggatcattcaaagtatcgcaaatgcaatggggagtgattgggcgtatcaatcggtaaaagacattactgaagagatcacccagttaacaccacaatatgcgggtattcactgggatcgtgtcggtagagatggccttcaatggccgtgtaacgacaacgcacctgatggtacgcgtgttatgcacacatctcagtttacccgtggtaaaggggagatggctgcaatcccgttccgttatgcggctgagttgcctgatgcagaatatcctcttattttgacaacagggcgtttattagaacaattccacactggcagcatgacaagaaaaaccaaagggttggataacctggctggccctcgtgcaatgatttcggtcgttgatgcagagcgtcttggtgtgcgtaatggtgaaatgcttaaagtgtcgacgcgtcgtggaagcattgaaacccctgcgtttgttactaagcgtatgcaagaaggtgtggtatttgtaccgttccattttgctgaagcgcctgccaaccgtttaacgacgacggcaacggatccccatgcgaagatccccgagttcaaagtggcagcggttaaaattgaaaaagtacgggtgttagtagagacctgctga

SEQ ID NO: 4464 - protein, 1394 aa, Photobacterium profundum
MPRTIKRQSMINVTIDGQKFPVNAQQTLLEAAADCNIEIPSLCGLNKNGEKVPCELCVVDVAGQGIQRACEILPVENMIVTTVSEELSSLRQTALNRILSDHYADCEAPCQTACPAGVDIQSYLYHISQDDHVKAVEVIKRTLPMPLSIGRVCPAFCETECRRGLVDEPIAIRQLKRHAADIDLAAQENYVPPKKASKGMSIAVVGSGPGGLTCGYYLTNEGYDVTVFESMPEAGGWLRYGIPEYRLPKAILAKEIELMCRNGMQVLTSKKLGDDFTLTQLTEDYDAVCLAVGASQAVEMNYTGSDLNGCYLGVDYLKDYVTEGCYITGKKVAVIGGGNTAIDCARTAVRDGADTTLIYRRTRDEMPAEDYEIVEAEHEGVKFHFLTNPVENIADANGHVCEIKLEKMALGEADASGRRRPEPTGKYFTEAFDTVIAAVSQKPDLSFMDKEELDLPLTRWNTQDANPNTMHSGLGNVFSIGDFRRGPATAIEAVADGRIAAEAIDRFFDGDMENIPVKLFNSQKERKLKQVAPEQFVEIKKVMRSVMPELSTKERELSFSEVETGFNNDEAMREAARCLECGCQANTDCKLRDYATEYDVAETELTNESCQKFHVDDSSEFIVFDANRCISCGQCVEACNEKAVHGTLSFAKNADGSSASRPECRPGFDKGYSMGDSNCVQCGACVQVCPTGALVDKRDKSQGRIEMLKPVETICTYCGVGCKLTMYVDESLNQIRYVQGVKDSPVNQGMLCVKGRFGFDFVNSKERLTTPLIRKNGELQPASWEEAISLVADKFNAIKADRGGNALAGFSSAKTTNEDNFAFQKFIRRELETNNVDHCARLCHASTVTGLEASIGSGAMTNDIPSIKFSDVVFIIGSDTTAAHPIIASHIKQAIRTGKTRLIVADPKRIDIADHSDLYVAHRPGTDVMLMNGIMQQIIKNDWHDKTYINERTEGFEALKAEVMLDSYAPDKVELVTGVKAQDVIKIAQMIGTANRTAVYYSMGITQHTTGHDNVRSVANLQMLCGNIGIEGGGINPLRGQSNVQGACDMGALPNNFPGYQKVQVPEIHAKFAKAWNKPNLPKEDGLTLTEIIDAACHDQVKGLYVMGENPVLSDPNQAHVIEGLEKLDFLVVQDIFLTETAQYADVVLPSCSFAEKSGHFTNTERRVQRISPAVNPPGEAKEDWWIIQSIANAMGSDWAYQSVKDITEEITQLTPQYAGIHWDRVGRDGLQWPCNDNAPDGTRVMHTSQFTRGKGEMAAIPFRYAAELPDAEYPLILTTGRLLEQFHTGSMTRKTKGLDNLAGPRAMISVVDAERLGVRNGEMLKVSTRRGSIETPAFVTKRMQEGVVFVPFHFAEAPANRLTTTATDPHAKIPEFKVAAVKIEKVRVLVETC

SEQ ID NO: 4465 - DNA, 1611 bp, Photobacterium profundum
  CDS (1)..(1611)
atgaccttacccccagaccttaaaatgaaaaaagggtcaggggccattcgtacaaaacttcctatctattccaattccttaccaccttgtaatcacgcctgtcctaccgggagtaatatacaagaatggctatccctcgctcagtcagagcactatgaagatgcttttcaagcgttaatcaaaaataacccaatgcctgcgattcatggtcgtgtgtgttaccacccgtgcgaatcggcgtgtaaccgtaccaacgtggatcaagcggtgagtattcatgccgttgaacgttatttaggtgatcaagcgttagtcaataattggcaagtacgttttcaggccgagccaaccggtaaacgtgtattggttgttggcgcgggtcctagtggtttagcgacggcgtatcacctcaagcgtaaagggcatgaggttgaaatacgtgattcagcaccaatggctggcggcatgatgcactttggtattcctgcataccgtttaccgcgtgatattttagagaatgaaattgcacgcatcgaagccatgggcatcaagattatattgaaccacaaagtggaaaatttactggccgaaaaagtgaaagggcagtttgatgcggttttcctagcgattggtgcacatgtcggtcgtggagttgatattccgaacgatgagcctggaaaggtcaatgatgcggtttcatatttacgcgatgttgaaatgggcaccgcccccatattaggtaaacgtgttgcagtctatggcggcggtaatactgcgatggatgccgcccgaactgcccgtcgtttaggggccgatgtgacggtgatttaccgtcgtgatcgtgcacacatgcccgcccatgattttgaatgtgtcgaagcaatggaagaaggcgtgactttccattggcagcggaccattaaagaaatcgatggtacggcgtttacgttggaaaaaatggcgattgatgacaatggtcgtccgcaaccgactggcgaatttgaaacagtgaaagcggattcattgattctggctctgggtcagaatattgataccaagttgaccgaatcgataccgtgtgttgaacacaaacacgatggaaccgtgatcgtaaatgaacaaatgatgacgggttacaaagggctgtttgcgggcggtgatatggtaccaagcgaccgcaccgttaccattgctgttgggcacggaaagaaagccgctgcacacattgatgctttcctcaatcaccgtagtttcaacaaaatcagcaagcaaccgctgatccgctttgataagttacacctgtggtacaaaaccgatgccgagcagagtgagcaacccgcgatcccagtgatccagcgtgcgacttcatttgatgaagtggtgggtgggttaaccgaagaagaagccttatacgaggcacagcgttgttattcttgcggtaactgctttgaatgtaatggttgtttgggggcttgtccgcaaggtgcgattacccatcttgggaagggcaaaggctataaggtggattacgacaagtgcactggctgtgaagcctgctattcccaatgtccttgtcatgcgatcgaaatggtcgcggcactaacggaatag

SEQ ID NO: 4466 - protein, 536 aa, Photobacterium profundum
MTLPPDLKMKKGSGAIRTKLPIYSNSLPPCNHACPTGSNIQEWLSLAQSEHYEDAFQALIKNNPMPAIHGRVCYHPCESACNRTNVDQAVSIHAVERYLGDQALVNNWQVRFQAEPTGKRVLVVGAGPSGLATAYHLKRKGHEVEIRDSAPMAGGMMHFGIPAYRLPRDILENEIARIEAMGIKIILNHKVENLLAEKVKGQFDAVFLAIGAHVGRGVDIPNDEPGKVNDAVSYLRDVEMGTAPILGKRVAVYGGGNTAMDAARTARRLGADVTVIYRRDRAHMPAHDFECVEAMEEGVTFHWQRTIKEIDGTAFTLEKMAIDDNGRPQPTGEFETVKADSLILALGQNIDTKLTESIPCVEHKHDGTVIVNEQMMTGYKGLFAGGDMVPSDRTVTIAVGHGKKAAAHIDAFLNHRSFNKISKQPLIRFDKLHLWYKTDAEQSEQPAIPVIQRATSFDEVVGGLTEEEALYEAQRCYSCGNCFECNGCLGACPQGAITHLGKGKGYKVDYDKCTGCEACYSQCPCHAIEMVAALTE

SEQ ID NO: 4467 - DNA, 3144 bp, Photobacterium profundum
  CDS (1)..(3144)
atgggagacatcatgcgtcccgttccatttggcgagcttctcaatcgtatgtttagcgaatacaaagagagcaagtccatttttggaatcccatcgaagcagttttatcgaaaagaaaatgctaagagcttatccgtttggggcgaacattgtgaaacacctgtagggccagcagccggtccacacacgcagttggcacaaaacattgtttgttcgtggctagcgggcggacgtttcatggaacttaaaactgtccagaaattggatcagttagaaatcgctaaaccgtgtattgatgcagaagatgagtgcttcaatacggaatggtctaccgaattcactttggtaaaagcgtacgatgaatacttaaaagcgtggattgcacttcacctacttgaagaggtgtttgaccctcgtacagaaggggaagataagtcatttgttttcaatatgagcgttggttatgacttggccggtattgaaactgctccaatgcaaaaatatatcgatgatatggtcgattctagccaacatgaaaatttccatgcgtatgttgcagagctaaaaaccttcattaacgatcctgaattcattaaaacctacggatttgagcaccgtcttgcacgtttagagaacttacccgccagtatttcgactcaactaacacgtggcgttacgttatcgaccatgcacggttgtcctccgaatgaaatcgaagcaatttgtcgttatatgattgccgataaacatatcaatactttcgtaaaattaaacccaacgttgcttggttacacgcgtgttcgtagcattatggataacgctggctttgattacattgccttaagtgaagagtcatttagtcacgatttacaaattgaacccgcgaaagccatgcttcaccgtttggttgatttaggcaaagaaaaaggcatcggttttggtgttaaattaaccaacacattaggtacgctgaataaaaaaggacgcttgccagacaaagaaatgtacatgtctggtcgtgctttgttcccattgtcgattaatgtcgcgctcgaattgtcacgtgaatttaatggtacgttgcctatttcatattctggcggcgcaagtaaattcaatatcaaagagatttttgaaacgggtattcgtcctatcaccatggcaaccgatctgttgaagcctggtggttatttgcgtttagccgattgtgccaaagagctggaaacaagcagcgaatggggcatgggtaaagttgatttggtgaaactggaagccttagctgctaaatcattagtggcggaatacacgcaaaaagaatggcgtggaccagaagaaatcagtgtgaaaaaagcgctgccattaaccgactgttacgttgcgccttgtgtaacggcatgtcctatcagccaagacatacctgaatatattcgtttaatgggtttaagccagtataccgaagctctggaagtaatttattcacgtaatgcgctacctgcaattactgggcatatttgtgatcaccagtgccagtacaactgtacccgtcgtgattacgaaggtgcattgaacattcgtgaaatgaaaaaggttgcccttgcaaaaggctgggaaggctataaagccaaatggcatgcaccggatctagacagcgaaaaacatccgattgccgtgattggtgcgggtccttcaggtttatctgcggcctactttatggcgcgtgcgggtcatcctgtaacggtttttgagaaagaacataatgcaggtggtgtggttaaaaatatcattcctcaattccgtattcctgccgaagtgattcaacatgatattgactttgtgcaagatcatggtgtgaatatcgagtacggctgtaatccacatatgacggtggatacactgaaatcgagtggctttaaatatgtatgtttgggtataggggcagataaaggcaaccctatgtcgttaacgggtgataacaccaatgtgttcaagtcgttagagttcttacgtagttttaatgatggcgagtttacgcctagccctgaacacgcaccaatgcatacattaggtaagcatgttgccgttgttggcgcaggcaatacagcgatggacagtgcaagagcggcattgcaagttgatggcgttgaaacagttacggtattgtaccgtcgtacattggctgaaatgccagcttataaagatgaatatgatgaagccgttgaagatggtgtgaagttcatgttcttgactaacccagaagagtttaatgctgacggtacggtagttgcccgcgttatgaaattgggtgagcctgatgaaaaagggcgtcgtcgtccggttgcaaccgatgaaacggttgagctgcatgtagatgcgcttattaccgctgttggtgagcaaagcaatcgcgatgcacttacccgtattggtattccgatgggcgaagatggttggcctgtcgtaaatagtgaaacaggtgaaaccagtgtcgagaatgtattcctaatgggcgatgcaagtacaggcccgtcatccattgtttcggctatttctggtggacgcaaagctgcaacaacgattcttgcgcgagaagctcaaaatgatgagttaattgccgtgaaatcagatgtgcaagtggacgatatttatgcccgtaaaggggagattcaagtcaagctgattgaagcgaatacgcttgaaattgatgaccatgaagcgtttatccaacaagaatcacagcgttgcttagagtgctcgtatgtttgtagcaagtgtgtcgacgtatgtcctaaccgtgcaaacatttctctacctattccgggcttccgtgatcagttccaaacaatacacctcgatgcttactgtaatgaatgtggtaactgtgcccagttctgcccatgggacagcaaaccgtacaaagataagtttactctgtttaacctacgcgatgattttaccaatagcacaaatgcaggcttctatatcgaaggaactgaagtgctagtacgttctgaaggggaaatttacaccttcagcatcaatgagcaaagtgaactcgatatgccagagtcgttagccgatgaagcaaccattattagctacgtgcatgcacatcatagctacctacttggcaaagtggacgtatag

SEQ ID NO: 4468 - protein, 1047 aa, Photobacterium profundum
MGDIMRPVPFGELLNRMFSEYKESKSIFGIPSKQFYRKENAKSLSVWGEHCETPVGPAAGPHTQLAQNIVCSWLAGGRFMELKTVQKLDQLEIAKPCIDAEDECFNTEWSTEFTLVKAYDEYLKAWIALHLLEEVFDPRTEGEDKSFVFNMSVGYDLAGIETAPMQKYIDDMVDSSQHENFHAYVAELKTFINDPEFIKTYGFEHRLARLENLPASISTQLTRGVTLSTMHGCPPNEIEAICRYMIADKHINTFVKLNPTLLGYTRVRSIMDNAGFDYIALSEESFSHDLQIEPAKAMLHRLVDLGKEKGIGFGVKLTNTLGTLNKKGRLPDKEMYMSGRALFPLSINVALELSREFNGTLPISYSGGASKFNIKEIFETGIRPITMATDLLKPGGYLRLADCAKELETSSEWGMGKVDLVKLEALAAKSLVAEYTQKEWRGPEEISVKKALPLTDCYVAPCVTACPISQDIPEYIRLMGLSQYTEALEVIYSRNALPAITGHICDHQCQYNCTRRDYEGALNIREMKKVALAKGWEGYKAKWHAPDLDSEKHPIAVIGAGPSGLSAAYFMARAGHPVTVFEKEHNAGGVVKNIIPQFRIPAEVIQHDIDFVQDHGVNIEYGCNPHMTVDTLKSSGFKYVCLGIGADKGNPMSLTGDNTNVFKSLEFLRSFNDGEFTPSPEHAPMHTLGKHVAVVGAGNTAMDSARAALQVDGVETVTVLYRRTLAEMPAYKDEYDEAVEDGVKFMFLTNPEEFNADGTVVARVMKLGEPDEKGRRRPVATDETVELHVDALITAVGEQSNRDALTRIGIPMGEDGWPVVNSETGETSVENVFLMGDASTGPSSIVSAISGGRKAATTILAREAQNDELIAVKSDVQVDDIYARKGEIQVKLIEANTLEIDDHEAFIQQESQRCLECSYVCSKCVDVCPNRANISLPIPGFRDQFQTIHLDAYCNECGNCAQFCPWDSKPYKDKFTLFNLRDDFTNSTNAGFYIEGTEVLVRSEGEIYTFSINEQSELDMPESLADEATIISYVHAHHSYLLGKVDV

SEQ ID NO: 4469 - DNA, 1473 bp, Photobacterium profundum
  CDS (1)..(1473)
atgggtaagcctacaggatttttagaatttggtcgtgagctaccacaaaaggtagatccaagcgttcgtattcaagataacaaagaatttgttcttaatgacgactttggcgataagatcaatactcaagcatcacgttgcatggattgcggcgtacctttctgtcacaacgcgtgcccgattggtaacatcatcccagagttcaacgatgccgttttccgagatagctgggaagaagcgtggaacattttaagttcaaccaataacttccctgaatttactggtcgtgtatgtccagctccttgtgaaagtggctgtgtattgggtatcaaccaagatccaatcacgatttgtaatatcgagaaaaccattgtcgaaacagcctatcgtgaaggatatgcaaaaccgaaaacaccacgcacacgtacaggcaaaaccattgctatcatcggttctggtcctgcgggtctatccgctgccgagcagttaaacagcgcgggtcattgtgtgacggtttttgagcgtgatgaaaaggtcgggggactattacgttttgggatccctgacttcaaattaggcatggatatcattgatcgtaaaatcgacttaatgagcgatgcaggcgtaaaatttgaggttaatgctcacattggtgtcacggtaaatgctcagcaattacgtcacgagtttgatgtggtattactaacaggcggatcaaccgtaccgcgtaatttaccgattccaggtcgtgaactaactggtgtacattttgcaatggaattccttgcgcaaaataatcgccgggctaacgacatggatttaaaaaccgaagaaattcacgccaaaggcaagcatattgtcgtggttggtggtggtgatacgggttctgactgtgtgggtacatctaaccgtcatggtgctgcaagcattactcaagtggaaattatgccaataccacctgggcagcgcccaacgaatcagccttggccgtcttacccaatgatcatgaaaacatcgacttcgcatgaagaaggttgtgatcgtcattggaatattctgactaaagagttcatcggtgatgaggcgggtaatgtaaaagcattgcgtatcgccgatattcagtggcaagaagccaagcctggtgaacgtcctggttttgatgaaatcgcagggtctgagcgtattattccatgtgatatggcgttcttagcgatgggcttcttacatccagaaccaacaggcgttattgctcaactggatattaagttggatgagcgcggtaatattgcaaccacgggttttgcaactagccagaaaggtgtttttgccgcaggcgatatgcgtacaggccaatctttggtggtacgttgtatcaacgaaggtcgtgaatgtgcacgtgaaattgatgactttttaatgggtaattctaacttagaagcaaaagatgattcactgatgctatctcaagcctaa

SEQ ID NO: 4470 - protein, 490 aa, Photobacterium profundum
MGKPTGFLEFGRELPQKVDPSVRIQDNKEFVLNDDFGDKINTQASRCMDCGVPFCHNACPIGNIIPEFNDAVFRDSWEEAWNILSSTNNFPEFTGRVCPAPCESGCVLGINQDPITICNIEKTIVETAYREGYAKPKTPRTRTGKTIAIIGSGPAGLSAAEQLNSAGHCVTVFERDEKVGGLLRFGIPDFKLGMDIIDRKIDLMSDAGVKFEVNAHIGVTVNAQQLRHEFDVVLLTGGSTVPRNLPIPGRELTGVHFAMEFLAQNNRRANDMDLKTEEIHAKGKHIVVVGGGDTGSDCVGTSNRHGAASITQVEIMPIPPGQRPTNQPWPSYPMIMKTSTSHEEGCDRHWNILTKEFIGDEAGNVKALRIADIQWQEAKPGERPGFDEIAGSERIIPCDMAFLAMGFLHPEPTGVIAQLDIKLDERGNIATTGFATSQKGVFAAGDMRTGQSLVVRCINEGRECAREIDDFLMGNSNLEAKDDSLMLSQA

SEQ ID NO: 4471 - DNA, 1413 bp, Photobacterium profundum
  CDS (1)..(1413)
atgagccagaacgtataccaattcattgatgtcgcgcgtgttgatcctgcaaaaaaaccgcttaacatccgtaagattgagttcgttgaaatctacgaaccctttacacaacagcaagctggggctcaagctgatcgctgccttgactgtggtaacccatattgtgaatggaaatgcccagtacataactacattccacaatggttaaaattagccaatgaaggacgcatattagaagctgtcgaacttgcccaccaaaccaatacactacctgaagtgtgtggtcgagtatgcccacaagatcgtttatgcgaagggtcttgtacacttaatgaggattttggtgccgtcgctattggtaacgttgaaaaatacattactgataaagcgtttgaaatgggctggaaacccgacatgtcgcatgttgaatggacagataaaaaagtggcgattattggtgccggtcctgcaggattatcttgcgctgatatcttagtgcgtaacggcgtaaaacccgtggtatttgatcgttacccagaaattggcggtttactcacgtttggtatcccctctttcaagcttgaaaaagaggtgatgattaaccgccgtaaagtgttcactgaaatgggcgttgagttccaactcaataccgagatcggaaaagacattcagatgaatgacttgctcaaaggctatgatgctgttttccttggggtcggaacgtataaaaacatgcgtgctggtttggaaaacgaaaatgcagccggtgtttacgatgccctgccatttctcgtatcgaatacctacaaagtgatgaacctaaacaccgaaattgattttactgacatgaaaggaaaacgcgttgttgtgttagggggtggtgataccgcgatggactgtgtacgcacctctattcgtcaaaacgccaaaaatgtaatttgtgcttaccgccgtaacgcagccaatatgccaggttcaagacgtgaagtaaaaaatgcacgtgaagaaggcgtgaaattcatgtttaacctacaaccattaagtataaaaattaatgaccaaggccaagcaactggggtgaatgtcgttaaaacaaagctcggtgaaccagacgaagcaggacgtcgtcaccctgaattggttgaaggcagtgaacatttacttgaagccgatgccgttattatggcctttggttttcagcctcacgccatgccatggttagaaaaatacgctgtcgacattgatcaaagagggcgtattaaagcgcctgaaactgccaccttcccatttcaaacctctaacgagaaaatctttgctggcggcgatgccgtacggggttcagacctcgtcgtcaccgcaattaatgaagggcgtttagccgctcaaggtattcttgattaccttgaggtgtaa

SEQ ID NO: 4472 - protein, 470 aa, Photobacterium profundum
MSQNVYQFIDVARVDPAKKPLNIRKIEFVEIYEPFTQQQAGAQADRCLDCGNPYCEWKCPVHNYIPQWLKLANEGRILEAVELAHQTNTLPEVCGRVCPQDRLCEGSCTLNEDFGAVAIGNVEKYITDKAFEMGWKPDMSHVEWTDKKVAIIGAGPAGLSCADILVRNGVKPVVFDRYPEIGGLLTFGIPSFKLEKEVMINRRKVFTEMGVEFQLNTEIGKDIQMNDLLKGYDAVFLGVGTYKNMRAGLENENAAGVYDALPFLVSNTYKVMNLNTEIDFTDMKGKRVVVLGGGDTAMDCVRTSIRQNAKNVICAYRRNAANMPGSRREVKNAREEGVKFMFNLQPLSIKINDQGQATGVNVVKTKLGEPDEAGRRHPELVEGSEHLLEADAVIMAFGFQPHAMPWLEKYAVDIDQRGRIKAPETATFPFQTSNEKIFAGGDAVRGSDLVVTAINEGRLAAQGILDYLEV

SEQ ID NO: 4473 - DNA, 2835 bp, Rhodopseudomonas palustris
  CDS (1)..(2835)
atgagcgacgtcaccggaacggtctccagcgacgtgctgcgctaccagcaggcgcgcagcacgctggaaagctccaagagcgaactggaagagctgcagaacagcgaagctgtcggcgtcttccagaagcagctcgcgctgctgcagaagcgcctggtcaacgacccggcgtcgctgcggaacatgttcatcgcggacggcacccaggccatcgtctgggaattccaacagccggagctgggtgaagccttcaccaccacgctgtggaatctgctcgcccgcggcgacgacatgtcgatcatactgcagcgcttcatctgggcgctgccgctgaagttcaagcgcaagttcatcaaggcgatcgacgtgcatctgcgcggtcgctacccgatgttcgagaacctgtcggaaggctggccgggcgaagcgttcatcccgccctacatccgtccggcggaagagcgcgcgatcgacttcgagctcgtgaaccagggctatctcggctaccagtcgatcggctactcggtgcgcgagtgtgagctgttcgtctggctcgaggtgatgcgcgacaagcagtgcgacgacaagccgtgcgaactcggcgtgctgatccagggcaagaaggaagccaagggcggctgcccggtgaagatccacatccccgagatgctggacctgctcggcaacggcaagcatcgcgaagccttggaactgatcgagagctgcaacccgctgccgaacgtcaccggccgcgtctgcccgcaggaactgcagtgccagggcgtctgcacccataccaagcggccgatcgagatcggccagctcgaatggtatctgcccgagcatcagaagctcaccaacccgaacgccaatgagcgcttcgccggccggatctcgccgtgggctgcggccgtgaagccgccgatcgcggtggtcggctccggcccgtcgggtctgatcaacgcgtacttgctggcggtcgagggcttcccggtcacgatcttcgaggcattccacgacctcggcggcgtgctgcgctacggcattcctgaattccgcctgcccaacacgctgatcgacgacgtggtcgagaagatcatcctgctcggcggccgcttcgtgaagaacttcgtggtcggcaagaccgcgacgctggaagacctcaaggccgaaggcttctggaagatcttcgtcggcaccggcgcgggtcttccgaccttcatgaacgtgcccggcgagcatctgctcggggtgatgtcggccaacgagttcctgacccgcgtcaacctgatgcgtggtctggacgatcgctacgagacgccgctgcccgaggtgaaggacaagaacgtgttcgtgatcggcggcggcaacaccgcgatggacgcggcgcgcaccgccaagcggctcggcggcaacgtcaccatcgtgtatcgccgcaccaagagcgagatgccggcccgcgtcgaggagctgcatcacgcgctggaagagaacatcaatctcgcggtgctgcgcgcgccgcgcgaattcatcggcgacgaccacacccacttcgtcacccacgcgctgctcgacgtcaacgagctcggcgagcccgacaagtccggccgccgcagcccgaagccgaccgggcagatcgagcgggtgccggtcgacctcgtgatcatggcgctgggcaacaccgccaacccgatcatgaaggacgccgagcccggcctgaagaccaacaaatggggcaccatcgaggtcgaagaaggctcgcagcggacctcgatcaagaacgtctacaccggcggcgacgctgcgcgcggcggctccaccgcgatccgcgcggccggcgacggccaggcggcagcgcgcgagatcgtcggcgagatcccgttcacgccggctgagatcaaggaccgcgtcgaacgcgccgccaagtacaccgagctcggccagatcgaacagacgatcgtgggcaaggtgccgctggccggcggcatcgtcgagttcaccgtgcgggccccgatggtggcgcgctcggccaaagccggacagttcgtccgcgtgctgccgtgggaaaagggcgaactgatcccgctgacgctggccgattgggacgccgagaagggcaccatcgatctggtggtgcagggcatgggcacctcgtcgctggagatcaaccggatggcgatcggcgatgcgttttctggcatcgccggcccgctcggccgcgccagcgagctgcaccgctacgaaggcaaccagaccgtggtgttctgcgctggcggcgtcggcctgccgccggtgtatccgatcatgcgcgagcacctgcggctcggaaaccacgtgacgctgatctccggcttccgcgccaaggagttcctgttctggaccggcgacgacgagcgcgtcggcaagctgaagaaggagttcggcgaccagctgtcgctgatctacaccaccaatgacggctcctacggcgtcaaaggcttcgtcaccggcccactcgaggagatgatgaaagccaaccaggagggcaagggccgcagcatcgccgaggtgatcgcgatcggcccgccgctgatgatgcgggcggtctccgacctcaccaagccgtatggcgtcaagaccgtggcgagcctcaactcgatcatggtggatgcgacagggatgtgcggcgcctgcatggtgccggtgacgatcgacggcaagatggtgcgcaagcacgcctgcatcgacggcccggaaatcgacgcccacatcatcgactgggacaagttcctgccccgcttcaacgccttcaaggcgcaggaactggagagcaagaagaagcacggcttcgcgtaa

SEQ ID NO: 4474 - protein, 944 aa, Rhodopseudomonas palustris
MSDVTGTVSSDVLRYQQARSTLESSKSELEELQNSEAVGVFQKQLALLQKRLVNDPASLRNMFIADGTQAIVWEFQQPELGEAFTTTLWNLLARGDDMSIILQRFIWALPLKFKRKFIKAIDVHLRGRYPMFENLSEGWPGEAFIPPYIRPAEERAIDFELVNQGYLGYQSIGYSVRECELFVWLEVMRDKQCDDKPCELGVLIQGKKEAKGGCPVKIHIPEMLDLLGNGKHREALELIESCNPLPNVTGRVCPQELQCQGVCTHTKRPIEIGQLEWYLPEHQKLTNPNANERFAGRISPWAAAVKPPIAVVGSGPSGLINAYLLAVEGFPVTIFEAFHDLGGVLRYGIPEFRLPNTLIDDVVEKIILLGGRFVKNFVVGKTATLEDLKAEGFWKIFVGTGAGLPTFMNVPGEHLLGVMSANEFLTRVNLMRGLDDRYETPLPEVKDKNVFVIGGGNTAMDAARTAKRLGGNVTIVYRRTKSEMPARVEELHHALEENINLAVLRAPREFIGDDHTHFVTHALLDVNELGEPDKSGRRSPKPTGQIERVPVDLVIMALGNTANPIMKDAEPGLKTNKWGTIEVEEGSQRTSIKNVYTGGDAARGGSTAIRAAGDGQAAAREIVGEIPFTPAEIKDRVERAAKYTELGQIEQTIVGKVPLAGGIVEFTVRAPMVARSAKAGQFVRVLPWEKGELIPLTLADWDAEKGTIDLVVQGMGTSSLEINRMAIGDAFSGIAGPLGRASELHRYEGNQTVVFCAGGVGLPPVYPIMREHLRLGNHVTLISGFRAKEFLFWTGDDERVGKLKKEFGDQLSLIYTTNDGSYGVKGFVTGPLEEMMKANQEGKGRSIAEVIAIGPPLMMRAVSDLTKPYGVKTVASLNSIMVDATGMCGACMVPVTIDGKMVRKHACIDGPEIDAHIIDWDKFLPRFNAFKAQELESKKKHGFA

SEQ ID NO: 4475 - DNA, 1455 bp, Rhodopseudomonas palustris
  CDS (1)..(1455)
atgggcaaggtcacggggtttctggaaatcgagcggcacgatcgcgtttatgcgccggtcaccgatcgggtgaagaactacaacgagttcgtggttccgctcagcgagaaagacctgcgcgaccaggccgcccgctgcatgaactgcggcatcccgtattgccacggcaccggttcggcgcagccgggcgcgacgggctgtcccgtcaacaaccagatccccgactggaacgacctggtttacaacggctattggcaggaggccgcgcgcaccctgcactcgaccaacaactttccggaattcaccggccggatctgcccggcgccgtgtgaagcgtcgtgcacgctgaacatcgacgacaacccggtcaccatcaagacgatcgaatgcgcgatcgtcgacaccgcgttcgacaacggctgggtcacgccggagattgcggcggtcaagactggccagagcgtcgcggtcgtcggcgccggcccggcgggcctcgcctgcgcccagcagttggcgcgcgccggccacgacgtccacgtctatgagaagttcgccaaggccggcggcctgcttcgctacggcatcccggacttcaagatggagaagactctgatcgaccgccgcgtcgctcagatggaagccgaaggcgtcaccttccactacggcgcgccggtcggcggcagcgctccgggcgcagtcgatccggccgagttgctcaagcagtacgacgccgtcgcgctgaccggcggtgccgaagcgccgcgcgatctgccgatcccgggccgcgagctcggcggcatccatttcgcgatggacttcctcacccagcagaaccgccgggtctccggcgaagccgtgaacggcaccgacattctcgccgccggcaagaatgtggtggtgatcggtggcggcgacaccggttcggactgcatcggcacctcgatccgtcagggcgccaagtcggtgacccagatcgaaatcatgccggcgccgccggagcgcgagaacaaggcgctgacatggccgaactggccgatgaagatgcgcacctcctcgagccaggccgaaggcgccgcgcgcgaattcgccgtgatgacgcagtcgttcgaaggcgagggcggtgtcgtcaagaagctgaactgcgtccgcgttgacgccaagttccagccgatccccggcactgaattcacgttggaagccgacctcgtgctgctggcgatgggcttcgtctcgccggtgaaggaaggtctgctgacccagcttggcgtcgcgctcgacccgcgcggcaacgttgccgccgacctgtcgcacttcacaacctcggtcgacaaggtgttcgccgccggcgatatgcgtcgcggccagtccctggtcgtgtgggcaatccgcgaagggcgcctctgcgcccaggcgatcgaccgcttcctgatgggcgcgacgacgctgccgcggtaa

SEQ ID NO: 4476 - protein, 484 aa, Rhodopseudomonas palustris
MGKVTGFLEIERHDRVYAPVTDRVKNYNEFVVPLSEKDLRDQAARCMNCGIPYCHGTGSAQPGATGCPVNNQIPDWNDLVYNGYWQEAARTLHSTNNFPEFTGRICPAPCEASCTLNIDDNPVTIKTIECAIVDTAFDNGWVTPEIAAVKTGQSVAVVGAGPAGLACAQQLARAGHDVHVYEKFAKAGGLLRYGIPDFKMEKTLIDRRVAQMEAEGVTFHYGAPVGGSAPGAVDPAELLKQYDAVALTGGAEAPRDLPIPGRELGGIHFAMDFLTQQNRRVSGEAVNGTDILAAGKNVVVIGGGDTGSDCIGTSIRQGAKSVTQIEIMPAPPERENKALTWPNWPMKMRTSSSQAEGAAREFAVMTQSFEGEGGVVKKLNCVRVDAKFQPIPGTEFTLEADLVLLAMGFVSPVKEGLLTQLGVALDPRGNVAADLSHFTTSVDKVFAAGDMRRGQSLVVWAIREGRLCAQAIDRFLMGATTLPR

SEQ ID NO: 4477 - DNA, 3108 bp, Rhodopseudomonas palustris
  CDS (1)..(3108)
atgcggcaccggaccggacatgaccgaagtcaaatcaatttggcgctcgttggctattttgggccgctttcccttcacctttcgacgccgttcgccggcctcggaccaatctgtgctgtcaccatgtatcgtattgtgcgacgcgagcagttctcggacgcgacctttctgtgggacgtcgaggcgccggatatcgcggcttcggccgagcccggccatttcgtgatgctgcgtctctacgacggtgccgaacgcattccgctcaccgttgccgatttcgatcgcgacaagggactggtgaccgtcgtcgtccaggcgctcggcaagaccacgcgggagatgcgcgacaagttcaaggaaggtgaggcgttcgaggatttcgtcgggccgctcggtctgccgcaacacatcgacaaggtcgatcacgtggtgttcgtcggcggcggcctcggcgtcgcgccgatcttcccgcagcttcgcgccttcaagcaatccggcgcgcgcaccaccgcgatcatgggcttccgcaccaaggatctggtgttttgggaagacaagttccgcgagttcgccgacgaactgatcatttgcaccgatgacggcagctacggcgagcccggcctcgtcacggcagcgctggagcgggtaatcacccagcagaagcccgacaaggtggtggcgatcggcccgatgccgatgatgcacgcttgcgtcgagaccacgcgcccacacggtgtgaagaccatggtgtcgctcaacaccatcatggtcgatggcaccggcatgtgcggttcgtgccgcgtcacggtcggtggcgaagtgaagttcgcctgtgtcgacggcccggatttcgacggccacaaggtcgacttccacgagttgcatgcgcgccagaagcggttcaagaccgaggaagacaaggcgaacgaacacttcgcccatgtctgtaatctcgaaaaacagctgatcgtcgagggcaagcgcaactacaagaagctggcgacgctgccgccgcatcagacgccgatgccggagcgcgatgcccacgagcgcgccaccaacttcaaggaagtcaatctcggctattcggtcgaggaagccctgcaggaagccgagcgctgcatccagtgcatcacaccgacctgcgtcgccggctgcccggtcgggatcgacattccggtgttcatccgcaacatcctcttccgcgatttcgacgccgcgctggagacgatctatcagtcgagcatcttcccatcgatctgcggtcgggtctgcccgcaggagacgcagtgcgaagcgcagtgcatcatccgcaaatacaagaagcatgagccggtcgcgatcggccggcttgagcgcttcatcggcgacaatgcgcgggcgccgaagagcaagccgatcgatctcagcaaagccatcggcaaggtcgcgatcgtcggctccggtccggctggcctcgccgccgccgctgatctcacccgctacaatgtcgagaccacggtgtacgaggcgctgcacgtgctcggcggcgtgctgcaatacggcattccgtcgttccggctgccgcgcgacatcatcgatcgcgaaatccagcggctgaaggacatcggcgtcaagttcgagaccaacaaggtcgtcggcaagaccttcaccatcgaacagttgatgaatggacgcggcttcgacgcggtgttcgtggcggcgggcgccggtgcgccgaccttcctgggcattcccggtgagtttgctggccgggtttattcggccaacgagttcctcactcggatcaacctcatgggcggcgaccgcttcccgtatctcgatacgccggtcagcgtcggcaacagcgttatcgtgatcggtgccggcaacaccgcgatggactgcctgcgcgtcgcccgccgcgtcggcgccgcgacggtgcgctgcgtgtatcgccggtcggaagccgaagcgccggcccgcatcgaggaaatccgccacgccaaggaggagggcgtcgatttcttcttcctgcactcgccggtggagattctagtcaccgaaagcggcgacgttcgtgcggtgcggctgcagaaaatggagctcggcgaggccgacgagcgcggccgccgcaagccggtgccgctcgacgagtttatcgagctcgaatgcgacaccgtgatctacgcactcggcaccaagcccaatccgatcatcggccaggcgacacccggtctcgcgctcaacaagtggggtaacatcgcagccgatgacgacacccagtcgaccaacatgccgggcgtgttcgccggcggcgatatcgtcaccggtggcgcgactgtgatcttggcgatgagcgcgggtcgccgcgccgccaagtcgatcgcggcctggctgcggctgaacaagaccaaatggcctatcaccgcgcaggacgccgacgacttcgtcgccggcaagctggcgcctgcgatcgaggaggatggcgtggcgcattgcccgaagtgtcaccagccgctggaaggctccgaagagtacatctgctgcgctgattcggagctgcaatggcgctgcgacgactgtgccaaggtcagcgaaggcttcgcgttcccctatggcatgtgcccgcactgcggtggcaagctgcagccgctcgatcgcgccggcgtcagcgatgaggccggacttggggcgatccgcaccgcgttcgagatcgagctcggcggccgtgcattctatgcccgtgccgcgaaggaaacgtccgatccgacattgcaggagctgttcctcagcttcgccgcgatggaagaggagcacatgaccacgctggccaatcgctaccatgtggcgattccgcaggcgaccgagggcttccatctcggcaccgcggcgatcatggccggcgtcaaaggccggattggcgatccgactacgctgttcgaagccgcgatcgagtttgaacggcgcgccgcctcgttcttcaagacccgggtcggcgagacgccggacggttcggtcgagcgccagctgtatcgcgagctcgccgccgaagaggacgagcacgtctcggtgctgcagaccgaattcgcgcgctggaaggaaggcaagcgcgggctgctgacgtaa

SEQ ID NO: 4478 - protein, 1035 aa, Rhodopseudomonas palustris
MRHRTGHDRSQINLALVGYFGPLSLHLSTPFAGLGPICAVTMYRIVRREQFSDATFLWDVEAPDIAASAEPGHFVMLRLYDGAERIPLTVADFDRDKGLVTVVVQALGKTTREMRDKFKEGEAFEDFVGPLGLPQHIDKVDHVVFVGGGLGVAPIFPQLRAFKQSGARTTAIMGFRTKDLVFWEDKFREFADELIICTDDGSYGEPGLVTAALERVITQQKPDKVVAIGPMPMMHACVETTRPHGVKTMVSLNTIMVDGTGMCGSCRVTVGGEVKFACVDGPDFDGHKVDFHELHARQKRFKTEEDKANEHFAHVCNLEKQLIVEGKRNYKKLATLPPHQTPMPERDAHERATNFKEVNLGYSVEEALQEAERCIQCITPTCVAGCPVGIDIPVFIRNILFRDFDAALETIYQSSIFPSICGRVCPQETQCEAQCIIRKYKKHEPVAIGRLERFIGDNARAPKSKPIDLSKAIGKVAIVGSGPAGLAAAADLTRYNVETTVYEALHVLGGVLQYGIPSFRLPRDIIDREIQRLKDIGVKFETNKVVGKTFTIEQLMNGRGFDAVFVAAGAGAPTFLGIPGEFAGRVYSANEFLTRINLMGGDRFPYLDTPVSVGNSVIVIGAGNTAMDCLRVARRVGAATVRCVYRRSEAEAPARIEEIRHAKEEGVDFFFLHSPVEILVTESGDVRAVRLQKMELGEADERGRRKPVPLDEFIELECDTVIYALGTKPNPIIGQATPGLALNKWGNIAADDDTQSTNMPGVFAGGDIVTGGATVILAMSAGRRAAKSIAAWLRLNKTKWPITAQDADDFVAGKLAPAIEEDGVAHCPKCHQPLEGSEEYICCADSELQWRCDDCAKVSEGFAFPYGMCPHCGGKLQPLDRAGVSDEAGLGAIRTAFEIELGGRAFYARAAKETSDPTLQELFLSFAAMEEEHMTTLANRYHVAIPQATEGFHLGTAAIMAGVKGRIGDPTTLFEAAIEFERRAASFFKTRVGETPDGSVERQLYRELAAEEDEHVSVLQTEFARWKEGKRGLLT

SEQ ID NO: 4479 - DNA, 2022 bp, Rhodopseudomonas palustris
  CDS (1)..(2022)
atgcgggcagtaccctggggcggggtcgagatgacgcaggtggtgtacggggtctgggacggcgtcgcctatgattcacgggcggccgaggctcgggcggcggactacgcgctggcaaacttcgacgagttcgacgagggcaacgcgatccgcgctttcatcgccgatcgcgggttcttcgtgttcgatcccacggtttcgctggtcgatgcgctattccactacctgaaagccgccgccgaacagtcctgcggtgcctgtacgccctgtcggatcggcaccgtgctggtccgcgatgcgctcgatcagatgcgccgcggtctggacgccgcgctgacgctcgacgacatcgtgatgctcggcgagcaaatccggcagacctcgctgtgcggactggggcagacctgcgcggtggcgctgctggcggtgctgcgggactttcgcgaacggatcgaacaggagctggcgcagcaccggccaatcccggctcagcacggcatggcctatgtgacagcgccgtgtatcgaggcctgcccgtccaaggtcaacgtgccgcgctacatcgactacatccgggatggtaagcccgagaactcgctcggcgtgctgctgcagaaatacccgatggccgcgacctgcggccgggtctgcgtccgctattgcgagcaggcgtgccggcgcaaatttgtcgacgaagccgtcggcatcaagacgctgaagcgctatgtcgctgaccagcagagcggtccgcacgcgctgaagttcacccgcgacatgatccgcaagccgctcgccgacgggatgcgggtggcggtggtcggcgccggcccggccggcatctcctgcgcctatcacctgttgttgcgcggctatcacgtcgacgtcttcgacaaggccggccaggccggcggcatggcgcagatcggcattccgagctaccggctgcccaaggacacgctggcgctggagaccgacatcatcgtcgacctcggcggccggttcctgttcgatcagcgcctcggccgcgacttctcggtcgacgacctgtttgcgcgcggctatcgcgcggtgttcctgggccttggctgtcagcagggcgcccggctcggcgtcgatggcgaagacgccgcacatggcggctacttcagcggcatcgatttcctgctcaaggttcacgaccacgtcgacggcatcgctccgctggtattgcagggcgaggtggtggtggtcggaggcggcaacgtcgcaatggactgcgtgcgttcggcgatccggcttggcgccgagaaggtccacgtcgtctatcgtcgcaccctcgccgacatgccggccgacccggccgagatcgaagcggcgcgcgccgaaggcgtcgaattccatgtgctcaccgcgccggccgagatcgtcaccgaccacggcaaggtcaccggcgtggtgctgaccaggatgcaggcgagcgagcccgatgccggtgggcggcggtcggtgaagccggtcccaggcagcgagacatcgatgcgctgcgacgtgctgatcgcggcgatcggccagcaggtcgaggacggtccgctgatcgagagcgacggcattgcgttcgaccgctggcgctgcgtcgcgaccgatcgggtgctcgcgacctcgcggccgggagtttttgccggcggcgattgcgtcaccggtccgtcgacgcttgtttacgcgatggctgcaggactgaaggcggcgcgcaacatcgacgattggattcaacggggctcggtgcggttcttcaagcggtcgcgcatgcgcaagctgatcgccgacaatcatatgctggccaacgagatcgtcgcagccccggtgcgcaacgcctatcgggtgcacaatcccgaaatcgatcccgaactgcgcaagcatatgttcggcgaagtcgagcagaccatcgacgcccgcgccgcctatgcggagacccagcgctgcatgcgctgttatcgcgtctattccgtcgtcaccaagcatccgatcccggaaggagcggcttga

SEQ ID NO: 4480 - protein, 673 aa, Rhodopseudomonas palustris
MRAVPWGGVEMTQVVYGVWDGVAYDSRAAEARAADYALANFDEFDEGNAIRAFIADRGFFVFDPTVSLVDALFHYLKAAAEQSCGACTPCRIGTVLVRDALDQMRRGLDAALTLDDIVMLGEQIRQTSLCGLGQTCAVALLAVLRDFRERIEQELAQHRPIPAQHGMAYVTAPCIEACPSKVNVPRYIDYIRDGKPENSLGVLLQKYPMAATCGRVCVRYCEQACRRKFVDEAVGIKTLKRYVADQQSGPHALKFTRDMIRKPLADGMRVAVVGAGPAGISCAYHLLLRGYHVDVFDKAGQAGGMAQIGIPSYRLPKDTLALETDIIVDLGGRFLFDQRLGRDFSVDDLFARGYRAVFLGLGCQQGARLGVDGEDAAHGGYFSGIDFLLKVHDHVDGIAPLVLQGEVVVVGGGNVAMDCVRSAIRLGAEKVHVVYRRTLADMPADPAEIEAARAEGVEFHVLTAPAEIVTDHGKVTGVVLTRMQASEPDAGGRRSVKPVPGSETSMRCDVLIAAIGQQVEDGPLIESDGIAFDRWRCVATDRVLATSRPGVFAGGDCVTGPSTLVYAMAAGLKAARNIDDWIQRGSVRFFKRSRMRKLIADNHMLANEIVAAPVRNAYRVHNPEIDPELRKHMFGEVEQTIDARAAYAETQRCMRCYRVYSVVTKHPIPEGAA

SEQ ID NO: 4481 - DNA, 3593 bp, Brachydanio rerio
  CDS (36)..(3104)
gagcgatcggatcataaactgcggatcggatagtaatggctacaatgctgagcaaagagttgcaggatattgagagtatcctggccttgaacccgagggtgaagagccatgcaaatgtccattccactgcctcaaagaagaatgagaagaagcactggaagagaaaccctgagaggagctgtgattcctgtgtgaatttggagaacaactttgatgacatcaagcacacgactctgagtgagcgtggggcacttcgggaggcgctgagatgcctgaaatgcgcagacgctccatgccagaaaagctgccccaccaatttggatatcaaatctttcatcaccagcatttccaacaagaactactacggtgctgctaaagcaatcctgtccgataacccactgggtctgacctgtggcatggtgtgtcccacctctgatctgtgcgttgggggctgtaacctctacgcctctgaggaagggcctatcaatattggtgggcttcagcagttcgctactgaggtgttcagtaagatgggcatccctcagatcagaaatccagagcttcccacggcggacaacatgccgaagagtttccacacaaggatcgctctcattggctgcggccctgccagcatcagctgcgcctccttcctggcccggctaggatatgacaacatcaccatcttcgagaagcagaaatacattggtggcttgagcacttcagaaatccctcagttccggttgccctacgaggtggtgcagtttgagattgatctgatgaaggatcttggcgtaaaggttgttcttgagaagggactggggcagaatggcttgactctgacctcgctgaaggaggagggctatcaagtggtctacattggcattggtcttccacaagcaaacagggacaagattttcgagggcttgaccacggaacagggattctacacatcaaaggatttccttcctttggttgcaaaagccagtaaaataggcatgtgtaattgccgctcacagctgccaaagctgcatgggaatgtgatcgtcctgggtgcaggagacacagcgttcgactgcgccacctctgctctccgctgtggagctcgacgagtctttgtggtctttagaaagggcttcaccaacattcgcgctgttccagaagagatggaggcagccaaagaggaaaagtgtgaattcctgcccttcttgtcacctcatgaggtaataaagaaaaatggacgtgtctcaggcctgcgcttctgccgcacagagcagcaggatgatggcacctggattgtggacgaggagcaaattgtccacctgaaagcagatttcatcatcagtgcctttggctccatgctgaatgatccagcagtgacgaaggccctggatccaataaagctgaaccgatgggggactcctgaggtgaacagcgaaaccatgcagaccactgaaccctgggtgttcgccggcggagacatcgcaggctttgccaacaccaccgtggagtctgtcaacgatggcaaacaagcttcctggcacatccacaagtacatccagtctcttcatggtaacacaataagtgccactcccagactgcccttgttccactgctccattgacacagtggacatcagcgtggagatgtgcgggatcaagtttcctaacccctttggactggccagcgctcctcccacgaccagcgcagccatgatccgcagggccttcgagcagggctgggggttcgccctcaccaagacctttggcctggacaaggatttggtgaccaacgtgtcaccgcgaatcgtgcgtgggacaacctcaggtcacatattcggtcctggtcagggctcattcctcaacatcgagctcattagtgaaaaaacagccgcttactggtgcaagagcgtggctgaactcaaagccgacttccccaaaaatattatcattgccagtattatgtgcagttacaaccaagctgactggactgagctggcaaagatggctcaggagtctcaagctgatgctttggagctgaacctctcctgccctcatggcatgggggagagaggtatgggactggcctgtggacaggaccctgagctggtgaggaacatctgtcgctgggttagaaaggccactagcatccccttcttcgccaaactcacacccaatgttaccaacatcgttgacatcgccacagctgcttatgaaggaggtgcggatggagtcacagccaccaacactgtatctggactaatggccctcaaagccgatgctacaccctggcctgggattggcagaggcgccagaactacatatggcggtgtttctggtaatgcaatccggcccatagctctacgtgcagtttcagctatagcaagagcacttcctggcttcccaatcttggccaccggtggcatcgactcggctgagtctggattacagttcctccatgctggagcatctgtcttgcaggtatgcagtgccgtgcagaaccaggacttcacagtgatcgaggactactgtttaggcctgaaggcgctgctgtatctaaaaagcatagaggagctgcacgattgggacggccagtctcctcccaccattcgccaccagaagggcaagcccgttccccatgtgagcgagctcattggaaagagtctgcctagcttcgggccgtacttgcaaacgaagactcaggcactggcgaagtacaagaaagatgccagcggtgatgtgatcatggacaccggcgctgctagagtaaacatccccaaaaaaccaatccctaatgtcaaagatgtgattgcccgcgcgctgaagcacattggcgcctaccaagagctggacaacactgaacaagtgcaggccctggtggatcctgagatgtgcatcaactgtggcaaatgctacatgacctgcaatgactcaggctaccaggctattaagtttgaccctgagactcatcttcctgtaatcacggacagctgcaccggctgcactctctgcctgagcgtgtgtcccatcattgactgcatcaaaatggttagcaggaccacaccgtacgagcccaagagaggcctgcccgttaatcccgtctgctgaagcacaccgtcacagagcgaatgacaaaaaacagcaagagcatccattccacttctaattgctgggtgaaaaattacctttattatgaaaacgaataattagccggcagaaataattgccttatattcccaagccggttatgccagaataattgcgctggcacagaaagagttgcattttttcaaaaacaactcgacagtgcaatgtgcctttctgtcccttttccctcaagagatgacaaagagatgacaataagatgcgagatggaggattgattgattgattgattgattgattgattgattgattgattgattgattgaagtggtgttgtttgctctggtaagactgaccataaataaacagtaaaggaggaatattaataattggaactatcaaagataattgtatgactgctaagtgtgattaataaacattattagcatgtaaaaaaaaaaaaaaaaaaaaaaaaaaaaaaaaaaaaaaaaa

SEQ ID NO: 4482 - protein, 1022 aa, Brachydanio rerio
MATMLSKELQDIESILALNPRVKSHANVHSTASKKNEKKHWKRNPERSCDSCVNLENNFDDIKHTTLSERGALREALRCLKCADAPCQKSCPTNLDIKSFITSISNKNYYGAAKAILSDNPLGLTCGMVCPTSDLCVGGCNLYASEEGPINIGGLQQFATEVFSKMGIPQIRNPELPTADNMPKSFHTRIALIGCGPASISCASFLARLGYDNITIFEKQKYIGGLSTSEIPQFRLPYEVVQFEIDLMKDLGVKVVLEKGLGQNGLTLTSLKEEGYQVVYIGIGLPQANRDKIFEGLTTEQGFYTSKDFLPLVAKASKIGMCNCRSQLPKLHGNVIVLGAGDTAFDCATSALRCGARRVFVVFRKGFTNIRAVPEEMEAAKEEKCEFLPFLSPHEVIKKNGRVSGLRFCRTEQQDDGTWIVDEEQIVHLKADFIISAFGSMLNDPAVTKALDPIKLNRWGTPEVNSETMQTTEPWVFAGGDIAGFANTTVESVNDGKQASWHIHKYIQSLHGNTISATPRLPLFHCSIDTVDISVEMCGIKFPNPFGLASAPPTTSAAMIRRAFEQGWGFALTKTFGLDKDLVTNVSPRIVRGTTSGHIFGPGQGSFLNIELISEKTAAYWCKSVAELKADFPKNIIIASIMCSYNQADWTELAKMAQESQADALELNLSCPHGMGERGMGLACGQDPELVRNICRWVRKATSIPFFAKLTPNVTNIVDIATAAYEGGADGVTATNTVSGLMALKADATPWPGIGRGARTTYGGVSGNAIRPIALRAVSAIARALPGFPILATGGIDSAESGLQFLHAGASVLQVCSAVQNQDFTVIEDYCLGLKALLYLKSIEELHDWDGQSPPTIRHQKGKPVPHVSELIGKSLPSFGPYLQTKTQALAKYKKDASGDVIMDTGAARVNIPKKPIPNVKDVIARALKHIGAYQELDNTEQVQALVDPEMCINCGKCYMTCNDSGYQAIKFDPETHLPVITDSCTGCTLCLSVCPIIDCIKMVSRTTPYEPKRGLPVNPVC

SEQ ID NO: 4483 - DNA, 1440 bp, uncultured bacterium 314
  CDS (1)..(1440)
atgtcggataaaatgcttaaatttgtaaatgttggaatgcaaatgccagctaaaagagccggtggtttaagaactaaagattttaaagaaatctatgatcaatttattcacgagaaagctaaagagcaatcgagccgatgttcacaatgtggagttcctttttgtcaagttcattgtcctttgcataataatattcctgactggttaaagttgaccgccgaagggaggcttcaagaagctcatgaattagttcatagcacaaataatatgcctgagatttgtggaagtatttgtccgcaagatcgtttatgtgaaggtaattgcgttattgaaaaagcaggacatggaaccgttacaatcggatctgttgaaaaatacataacagatactgcatgggaaaaagggtggattaaaccaattaaagttttgaaagaaatagatcaatccgttggtatcattggagcaggaccagcgggattagcttgcgcagaagagctaagaaaatcaggatataaaataactatttacgatcgatacgaccgaccaggtgggcttttgatttacggaataccaaactttaaactagaaaaatttactgttgaaaggagaaccaatcttttaaaagagagtggaataaagtttaaacaagattttgaggttggaaaagatatatcgctcgatgaattaagaaaaaaacatgatacaatacttattgcaactggcgtttataaacctcgagaaatcgatttgccgggctctgatttaaaaaatatttttccagctatggaatttttaacggcttccaatcggaaaggtttaggagatagagtaaacaattttgataacgggacactcaatgctgaaggcaagaacactattataattggcggaggtgataccgggatggattgcgtgagaactgcagtaagacaaaatgcaaaatcagtaaagtgtttgtatagaagagatagagaaaatatgcccggttctgcacgagaagtacataatgcagaagaagaaggaattgagtttatatggttatcaaatccaaaaaaatttattggtacatcacaaatttcatcagtgttagttgagagaatgaaacttggtaagacggattcatctggaagaaaaaaacctgagcctatcccaaattctggatttgaaatgaaggcggatatggtaattaatgctttgggttttgaccctgaagatttaccaaaattatttaactccccagatctatctatttctaaattggggactataaagatcaatttaaaaactatggaaacaaatctctccggtgtttttgccgctggagatatagtcagaggagcctctttggttgtgtgggcaattagagacggtagagatgcaactatatcaattcgaaaatatttagaacacaaacgaagcaaaaatgtaaaagcagcataa

SEQ ID NO: 4484 - protein, 479 aa, uncultured bacterium 314
MSDKMLKFVNVGMQMPAKRAGGLRTKDFKEIYDQFIHEKAKEQSSRCSQCGVPFCQVHCPLHNNIPDWLKLTAEGRLQEAHELVHSTNNMPEICGSICPQDRLCEGNCVIEKAGHGTVTIGSVEKYITDTAWEKGWIKPIKVLKEIDQSVGIIGAGPAGLACAEELRKSGYKITIYDRYDRPGGLLIYGIPNFKLEKFTVERRTNLLKESGIKFKQDFEVGKDISLDELRKKHDTILIATGVYKPREIDLPGSDLKNIFPAMEFLTASNRKGLGDRVNNFDNGTLNAEGKNTIIIGGGDTGMDCVRTAVRQNAKSVKCLYRRDRENMPGSAREVHNAEEEGIEFIWLSNPKKFIGTSQISSVLVERMKLGKTDSSGRKKPEPIPNSGFEMKADMVINALGFDPEDLPKLFNSPDLSISKLGTIKINLKTMETNLSGVFAAGDIVRGASLVVWAIRDGRDATISIRKYLEHKRSKNVKAA

SEQ ID NO: 4485 - DNA, 2331 bp, Desulfovibrio vulgaris
  CDS (1)..(2331)
atgtccggcaatgaaacgatccgcatcggcggactggataacggagagcgcgtctcgtcgcgcaggctcgaagagcgcatacaacaggccgtacaggatggcgcgcgcaccatcgacatcgaggcggcagggcagcacggcataggcggtcgcctgtgggttgcccgcaccgaacccgtgcgcgtgaccgtgcgcggcgcggtgggccagcgtctcggttccatgggatgcgaaggcaccagcatagaggtcatgggccccgcctccgaggacgtgggctggctcaacgccggggccgacatcctcatccacggcaacgtgggcgggggcacggccaacgccatggcgcaaggccgcatccgcgtgggcggcaacatcggctcgcgcggcatgaccatgaccaagcagaacccgcgcttcaccgcccccgaactctgggtgctggggagcgtgggcgactatttcgccgagttcatggcgggcggcaccgccgtggtctgcgggttcaacgcacagaaccccgccaacgtgctgggctaccgcccgtgcgtgggcatggtgggcgggcgcatcctcgtgcgcggtccctatgacggcttctcgcaggccgacgcgcgcctcgaccccatcgacgacgccctgtggcagtggctggtggacggccttgccgacttcaccgccgccctcggcaagcccgaactcgccgccgcgctctcggtgcgtgaggagtggcagtgcatcgtggcgcgcggcccctacgagaagacgggcaagacccgccgctccatctccgacttccgccgcaacgtgtgggaccgagaactgggcatgggcggtcttgtgggcgacctgacgtcgctcgaccgcagccccatcccgctcatcaccaccggcgaactgcgccgcttcgtgcccgtgtgggagaacgcccgctacgcggccccttgccagtcgagttgccccacgggcattcccgtacaggaacggtggcggctggtgcgtgacggactcgtggacgaggccgtggacatggcgctggcctacacaccctttcccgccactgtatgcggctacctgtgccccaacctctgcatgcagggctgcacccgcaacctgcaacgcatgaagcccgtggacgtgaccatgctcggcaaggccggggtgcgttccgacataccggccctgccgcccctcaccgggcagcgcgtggccgtggtgggcggcggtgcggcgggcatctccgtggcgtggcagttacggatgcgcggcatcgaagccgtcatccacgacatggagcctctcctcggcggcaagattgcctcggccattcccgaaagccgcatcccgcgcgaggttctcgacgctgaactcgaacgcgtacgcaaggtgctgccccacatccacctgcaccgcaagctgacgaaggacgacttcgaacagttgcgcgccgacttcgacttcgtggtgctggcgaccggggcgagcaaaccccgtatgctgcccgtacccggcagggagttggcgaccacggccctcgacttcctgcgcgatgccaagtccggcaacggcaagccctgcaagcgcgtggtcatcgtcggcgcgggcaacgtgggatgcgacgtggccaccgaagccgcacgcctcggtgccgaatccatcaccctcgtcgacatccagacccccgccgccttcggcaaggagcgcgacgaagccgaacatgtgggtgccaccttccgctggccctgcttcacccgcgaggtgaccgcagatgggctggtgctcaccaccggcgagctcatccccgccgacacggtggtcttctccatcggcgatgcgcccgacctcgactacctgcccgacaccatcgccacggaacgcggctacgtcacggtcaacgaccttggccagaccaccgacgcccgcgtcttcgccatcggcgacgtggtgcgccccggtctgctgacgcaggccatcggcgcaggtcgcaaggccgccggtgccatcgcggacatggcagagggcaaacgccccgtctccgacacccgcgagatggtggacaccgcccgcatcaagcttgaatacttcgacccgcgcatctccggcttcgacgacctcgaacgttgcggcgaagcgtgtgtgagttgcggcgcatgccgcgactgcggcgtgtgcgagaccatctgcccgcagggggccatctcgcgccgcgacctcggcgaaggacgcttcgagatgactgtggacggcgaacgatgcatcggttgcggcttctgcgccggggcgtgcccgtgcggcatctggaacctcgtggagaacacgccgctggagtag

SEQ ID NO: 4486 - protein, 776 aa, Desulfovibrio vulgaris
MSGNETIRIGGLDNGERVSSRRLEERIQQAVQDGARTIDIEAAGQHGIGGRLWVARTEPVRVTVRGAVGQRLGSMGCEGTSIEVMGPASEDVGWLNAGADILIHGNVGGGTANAMAQGRIRVGGNIGSRGMTMTKQNPRFTAPELWVLGSVGDYFAEFMAGGTAVVCGFNAQNPANVLGYRPCVGMVGGRILVRGPYDGFSQADARLDPIDDALWQWLVDGLADFTAALGKPELAAALSVREEWQCIVARGPYEKTGKTRRSISDFRRNVWDRELGMGGLVGDLTSLDRSPIPLITTGELRRFVPVWENARYAAPCQSSCPTGIPVQERWRLVRDGLVDEAVDMALAYTPFPATVCGYLCPNLCMQGCTRNLQRMKPVDVTMLGKAGVRSDIPALPPLTGQRVAVVGGGAAGISVAWQLRMRGIEAVIHDMEPLLGGKIASAIPESRIPREVLDAELERVRKVLPHIHLHRKLTKDDFEQLRADFDFVVLATGASKPRMLPVPGRELATTALDFLRDAKSGNGKPCKRVVIVGAGNVGCDVATEAARLGAESITLVDIQTPAAFGKERDEAEHVGATFRWPCFTREVTADGLVLTTGELIPADTVVFSIGDAPDLDYLPDTIATERGYVTVNDLGQTTDARVFAIGDVVRPGLLTQAIGAGRKAAGAIADMAEGKRPVSDTREMVDTARIKLEYFDPRISGFDDLERCGEACVSCGACRDCGVCETICPQGAISRRDLGEGRFEMTVDGERCIGCGFCAGACPCGIWNLVENTPLE

SEQ ID NO: 4487 - DNA, 1431 bp, Desulfovibrio vulgaris
  CDS (1)..(1431)
atgaatagtgacaagaagggcagaagcctgcaaccgcgagtccccatgccctgccagcccgcccatgagcgggtgggcaacttccacgaagtggcccttggctactcgcgcgaggacgccatgcgcgaggcctcgcgctgcctgcaatgcaagaagcccaagtgcgtcaagggctgccccgtcgaggtgcagataccgcaattcatcgccgcccttgccaagggcgatgtcgagtcggcctaccgcaccctgcgcgagaccaacagcctgcccgcggtctgtggccgggtctgtccacaggagaaccagtgcgaaggggcctgcatactcggggccaagggacaacccgtggccatcggtcgtctcgaacgctacgccgcagacacctacatggccctcgacgcctgcgaccagcttacgggcaggcccgagtgcccgctcatcgaccccgacctcaaggtcgcgtgcatcgggtccgggcccgcaagcctcaccgtggcgggctacctttcgtcgcgcgggttcaaggtgaccgtgtacgaggccctgcacgaacttggcggggtgctcgtctacggcatccccgaattcaggctgcccaagtccgacatcgtggagaaggagattgccgccctgcgccagcaggaggtggagttcgtcaccaactgggtgggcgggcgcaccttctccatcgacgacctcttcgccgaaggctacaaggccgtgttcatcggggtcggggccgggttgccccgttttctcgacatccccggagagaacctcgtcggggtgttctcggccaacgaatacctgacgcgggtcaacctcgggcgtgcctacggcttcccggactatgacacccccgtctacagggggcgcgaggtcaccgtcttcggcggaggcaacgtggccatggacgcggcacgcactgccctgcgcctcggcgcggagagcgttcgcatcgtctaccgccgtacccgcgacgagatgcccgcccgcctcgaagaacttgaacatgccgaggaggaaggcgttcgcctcgaacttctggccgcaccgctcggcttcaagggcgacgcggacggacgcctcaccgccgtgaccctgcaacgcatggaactgggcgagcccgacgcctcgggcagacgcagcccccgccctgtggagggcgcggtgtacgacctgcccaccgaccttgccgtcatcgccgtgggcacacgccccaacccaatcctgctcgaagcgacccccggactcacgctcgaccgccggggctacatcgcggtggacgaggccacgggcatgacatccatccccggcgtgtacgccggtggcgacatcgtgacgggagccgccacggtcatcctcgccatgggtgccggtcgcagggccgccaaggacatagaagcccgactgcgccctgccacatag

SEQ ID NO: 4488 - protein, 476 aa, Desulfovibrio vulgaris
MNSDKKGRSLQPRVPMPCQPAHERVGNFHEVALGYSREDAMREASRCLQCKKPKCVKGCPVEVQIPQFIAALAKGDVESAYRTLRETNSLPAVCGRVCPQENQCEGACILGAKGQPVAIGRLERYAADTYMALDACDQLTGRPECPLIDPDLKVACIGSGPASLTVAGYLSSRGFKVTVYEALHELGGVLVYGIPEFRLPKSDIVEKEIAALRQQEVEFVTNWVGGRTFSIDDLFAEGYKAVFIGVGAGLPRFLDIPGENLVGVFSANEYLTRVNLGRAYGFPDYDTPVYRGREVTVFGGGNVAMDAARTALRLGAESVRIVYRRTRDEMPARLEELEHAEEEGVRLELLAAPLGFKGDADGRLTAVTLQRMELGEPDASGRRSPRPVEGAVYDLPTDLAVIAVGTRPNPILLEATPGLTLDRRGYIAVDEATGMTSIPGVYAGGDIVTGAATVILAMGAGRRAAKDIEARLRPAT

SEQ ID NO: 4489 - DNA, 2022 bp, Desulfovibrio vulgaris
  CDS (1)..(2022)
atggcacgtgtcatctacggaatctgggacggtaccgtccacgacaacaggggaaaggcgcttttcgagataccggatgcgccggggttcgaagggttcgatacgttcaatcagggcaactccattcgcgcctttgtcggagatagagggttcttcgtcttcgaaccgggtgtgaatctgctcgatgccttgtggcagtatatggaaagggccgcccgcgagtcatgcggcaagtgtacgccatgccgtgtcggcacgggtatcatccgcgacagcctcgccgccctgctgcgtgatggtgtcggttctggcggtctgggcactttggtcgaactcgctgaacaggtacgctctacttcattgtgcggcctcgggcgcacgtgcactgtggcactgtgcggcgcgcttgagcactttcaggatatgctcgttgaaggggcgcgcacggcgagcggacagcagcacggcatgagctatgtcacggcaccgtgcatcgaagcctgtcccgccagagtgaatgtcccccgctatatcgattacatacgtgacggcatgccctcgcattcgctcggggtcatcctgcagaagtatcccatggcggcgacctgtggccgtgtgtgcgtgcggttctgcgaacaggcatgccgacgcgggctggtcgatgagcccgttggcatcaagattctcaaacgctacgtcgccgaccatgagagtcaccttgcgcagggctggttctctcctgatatcgtacgtgacagaaaacccggccacctcaaggtggcagtggtgggggccggacctgccggcatatcctgcgcctatcacctgcttctcaacggctaccccgtcgacgtgttcgaggcgcgtaacgaggcggggggcatggctgcatgcggcattcccagttacaggttgcccaaggatgtcctccgtacggagaccgacatcgtcgaacgtctcggagggcggttcttctatggacagcgtctcgggcacgatgtctcgctcgatggactccgtgagcagggatacaaggccgtgtttctcgcccttggttgcccggaaggacgccttctgggcattgagggggaggatacatcgcttgaaggataccagcccggcatcgactttctcttgcgagtgcacgaccatgtcgaatcgcaagccgacgcttcgctgtcaggggtggtcgtggtcgtggggggcggcaacgtcgccatggactgtgtccgttccgcattgcgcctcggcgcacgtgaggtgcaccttgtctaccgtcgcacacgcgacgccatgcctgccgaccatgaggagatagaggccgcagagaaggagggcgtggtcttccactacctcaccaacccggtgcgcatcatcaccagacagatggtggactccgcaggcgtgacccgtgaccgtgtcgtcggtgtcgaggtcgtggacatgcgcgagggcgagcccgatgcgcgaggaaggcgcggcgtcgtcgcggtgtcggggtcggggcgcgtcataccctgcgataccctcatccccgccatcggccagcagatggacagcaccgcgctttcgccggaggacggcgtcgatgtcgacgcgcgaggtcgcgtcgtctccgaccagaccactctcgccacgacgcggcccggtgtctttgccgggggcgactgcgccttgggcccctcaacgctcatccaggccatggcgaccggcctcaagggggcgcggagcatcgacgactatctgcgctacggcagggtccgcttctttcccagaagccggatgcgccgtatcatccgtgatttcaaaccgctgtcgcaacagtgggtcgatactccggttcgtcatctgtaccgcatccatgcacaggaactcgaccccgcctaccgcaggcagttgttcgacgaggtggaatgtcccatctccgcagaggacgcctatcacgaggccggacgctgtctgcgttgctaccgcgtctattctgtcatcaccgaggccgccatcccgcagtgcgacgactga

SEQ ID NO: 4490 - protein, 673 aa, Desulfovibrio vulgaris
MARVIYGIWDGTVHDNRGKALFEIPDAPGFEGFDTFNQGNSIRAFVGDRGFFVFEPGVNLLDALWQYMERAARESCGKCTPCRVGTGIIRDSLAALLRDGVGSGGLGTLVELAEQVRSTSLCGLGRTCTVALCGALEHFQDMLVEGARTASGQQHGMSYVTAPCIEACPARVNVPRYIDYIRDGMPSHSLGVILQKYPMAATCGRVCVRFCEQACRRGLVDEPVGIKILKRYVADHESHLAQGWFSPDIVRDRKPGHLKVAVVGAGPAGISCAYHLLLNGYPVDVFEARNEAGGMAACGIPSYRLPKDVLRTETDIVERLGGRFFYGQRLGHDVSLDGLREQGYKAVFLALGCPEGRLLGIEGEDTSLEGYQPGIDFLLRVHDHVESQADASLSGVVVVVGGGNVAMDCVRSALRLGAREVHLVYRRTRDAMPADHEEIEAAEKEGVVFHYLTNPVRIITRQMVDSAGVTRDRVVGVEVVDMREGEPDARGRRGVVAVSGSGRVIPCDTLIPAIGQQMDSTALSPEDGVDVDARGRVVSDQTTLATTRPGVFAGGDCALGPSTLIQAMATGLKGARSIDDYLRYGRVRFFPRSRMRRIIRDFKPLSQQWVDTPVRHLYRIHAQELDPAYRRQLFDEVECPISAEDAYHEAGRCLRCYRVYSVITEAAIPQCDD

SEQ ID NO: 4491 - DNA, 2745 bp, Treponema denticola
  CDS (1)..(2745)
atgagtaaaaaagacaagcctaaaaaaatcttgtatgcagtcgattataagccgaaaagaaagagcccctttcttttggaatttgccaaccatctaaaccgaacaaaacccggttccaaaaggtcaattacctacgatgaccccgaatactatgttatggaaaacatcgttaccgacgaaatggcaaaggtcggtatgtttttaaaaatcagaacacctctaagtgctcaagatatatctcccctatgcggaaaaaccgtggaggaaaccgagaagattctttgggatttggcctatgtaggctgctgtattacaaataccattgacggagtaaataagtactggaccgaaatatgggttcccggcattatggaaatgataaacaacaacaaggagctgacctcaaagcatcccgaaataaccatagccttcgatgcctacggaaaaaagaaaggagaaatagctcccggtatcttgcccatgggtgtttccccgatgagggttattcctatcgaaagtgcaatcgaaagcgatacccatcatgcaagttacgaagaaatttctcattacctaaaccagcacactctttttagtgtttcagattgttcttgccgaacggtgcgcgaaaagatgggagaaggctgcggacatctaaaagaagatatgtgtatccagatgggacacgccgccgagtattatataaagaccggaagagcgaggcagattacgcgtgaagaagcctttgaaattataaaaagagctgaagaaaacgggctcatgcacgatattccgaaccttgacggagagggtaaaactcatgccatctgtaactgctgcggatgcggctgtcttgctatccgaaatgcaattatgtacagaaacacggatttttcacgctcaaattatatctccgtaattgacgaagaaaaatgtgtagcctgcggcgaatgtgtagagcattgcccttcaaatgccctaaggctgggacaaaaaatctgctcgtcaaaacctatccccgaagaaaaaaccgtaaaaactcccagagaccatcgatgggggcctgaagactggaatccagattaccgtacaaacagacaggttgtagtaaaaaccggaaccagcccctgtaaggcaaactgccccgcccacataggagttcaaggttatatcaaacttgcggctcagggaaaatacagggaagccttggagcttataaaacttgaaaaccccttcccggcagtctgcggtcatgtatgtccccgttattgcgagcagggctgctcaaggctggggcttgatgaagccgttgccgtcgacgatataaaaaaatttatagcagagcaggatcttaattccgagcaccgctatgttcctaaaaagaaaagatactatcacgataaaaaaatcgccattataggaggcggccccgcaggtctttcctgtgcctattatcttgcaatagataattacgatgtaaccgtcttcgaaaaagaaaaatccttgggcggaatgttaaaattcggtattccctcatttaggctcgaaaaaaatgttcttgatgccgaaatagatgttttaaaagaactgggcgtaaactttaaaaccggagtcgaggtaggaaaagatgtaagccttgatgaacttagagctcagggctttaaggccttttaccttgcaatcggggctcaaaagggaaggcttttaggcattgaaggcgaagatgcggcaggcgtaattaccggtgtggactttttaagggaagaaaacttaaatgaaagcaaaagcctttcaggcaaggtaatcgttatcgggggcggaaatgtcgccattgatgtagccagaatggcagtccgtgcaggcggcgaagaagtttccatgttctgtcttgaaaaaagagaagaaatgcctgcccttcctgaagaaatccatgaagccgaagaagaaggtataaagattacaaactcatggggccccaaacgcattcttgttacgaacggaaaagtgagcggagtcgaatttaaaaaatgcctttccgtttttgataaggacggaaggttcagcccaagctatgacgaaaacgacactatgactgtagaatgtagtttcgttataacctctgtaggtcaggccatagatctaggttctatcttagaaggttccgcttgcgaaataaacagaaatcaaaccgtaaaggcagacccaatcacctatcaaagtgctcaaaaagatatctttgtaggaggcgatgtattgacaggccctaaatttgccatagatgccatcgcccaaggaaaagaaggggccatctcgattcaccgttttgtacatccgggacaaagtttggttatgggcagaacaaggcgggattataaacccctcgatcgtgaaaatttggagcttgcaggctttgacagactgccccgccaaagagcggaagaaccttccggcgaagaaggaaaaaagacatttagggatttacgcaaaacattaaccgaagaacaggtaaaggctgaaaccgagcgctgcttaaaatgcggagccgtaaaggttgacgaatacatgtgcataggctgcggaatgtgtacgacccgctgccgtttcggagctatcagcttaaagcgtgtttatgatgctcacccaagcaccctcgaaaagcttaaaggtgtggttataagaaacatggtaaagagggaaggcaagattttgtttaacaagatttttaagtcttctcccaagaataaatag

SEQ ID NO: 4492 - protein, 914 aa, Treponema denticola
MSKKDKPKKILYAVDYKPKRKSPFLLEFANHLNRTKPGSKRSITYDDPEYYVMENIVTDEMAKVGMFLKIRTPLSAQDISPLCGKTVEETEKILWDLAYVGCCITNTIDGVNKYWTEIWVPGIMEMINNNKELTSKHPEITIAFDAYGKKKGEIAPGILPMGVSPMRVIPIESAIESDTHHASYEEISHYLNQHTLFSVSDCSCRTVREKMGEGCGHLKEDMCIQMGHAAEYYIKTGRARQITREEAFEIIKRAEENGLMHDIPNLDGEGKTHAICNCCGCGCLAIRNAIMYRNTDFSRSNYISVIDEEKCVACGECVEHCPSNALRLGQKICSSKPIPEEKTVKTPRDHRWGPEDWNPDYRTNRQVVVKTGTSPCKANCPAHIGVQGYIKLAAQGKYREALELIKLENPFPAVCGHVCPRYCEQGCSRLGLDEAVAVDDIKKFIAEQDLNSEHRYVPKKKRYYHDKKIAIIGGGPAGLSCAYYLAIDNYDVTVFEKEKSLGGMLKFGIPSFRLEKNVLDAEIDVLKELGVNFKTGVEVGKDVSLDELRAQGFKAFYLAIGAQKGRLLGIEGEDAAGVITGVDFLREENLNESKSLSGKVIVIGGGNVAIDVARMAVRAGGEEVSMFCLEKREEMPALPEEIHEAEEEGIKITNSWGPKRILVTNGKVSGVEFKKCLSVFDKDGRFSPSYDENDTMTVECSFVITSVGQAIDLGSILEGSACEINRNQTVKADPITYQSAQKDIFVGGDVLTGPKFAIDAIAQGKEGAISIHRFVHPGQSLVMGRTRRDYKPLDRENLELAGFDRLPRQRAEEPSGEEGKKTFRDLRKTLTEEQVKAETERCLKCGAVKVDEYMCIGCGMCTTRCRFGAISLKRVYDAHPSTLEKLKGVVIRNMVKREGKILFNKIFKSSPKNK

SEQ ID NO: 4493 - DNA, 1830 bp, Treponema denticola
  CDS (1)..(1830)
atgagtcgacttgagatattttcacaaaaccggtctcaaattataattgaagaactgtatgagaatcttcaacatcgaattgaagcaagtcctcccggactttgtcccgtttacataacacgagcctttattgaaatgtgtcatgcccaaacttgcggaaaatgtgcaccatgccgtatcggccttttacagttaaagcatattttaactgatgtcctaaacggaaaatcaacaatgaaaacccttgatcttattgaagaaactgctaaatctataagggaaacagcagactgtgcactggggtatgaagcagccgatatggtttataaaagcataatctattgccgtgatgactttgaagaacatataaaacacggaagatgcggctgtataacaactcagcccgtaccctgtgtagccctctgtcctgcaaatgtggatattccgggctatattgcccttgtcagggatgaaagatatgccgatgccgtccgcttaatcagaaaggacaatccttttccttctacatgtgcctttatctgtgaacatccttgcgaacataggtgccgtcgaaatatggtagacaccgcaataaatataagaggattaaaaagggttgccgttgaatttgccggaaaagttccgcctcccccatgtgcaccctctacaggaaaatcgatcgccatagtcggaggagggcctgccgggcttaccgcggcttattatttacagctcatgggacatcagacaaccgtatatgagatgctgcccaaattaggagggatgctccgttacggtatacctaattaccgtctccctaaggacagattggacgaagatatagatgcaattcttgaaaccggagttaaagtcgtttacggtaaaaaaataggaaccgatatagaactcaatgaacttataaaagataatgatgcggctataatagcaattggagcctcaaccgacaaaaagctgggccttgaaggagaagattcggaaggcgttatctctgctgttcaattccttagagatgtgggaatggataagggcatggatttaacaggtaaaaaaactgcaataataggaggcggaaatgttgccatggatgcagtgcgtactgctgtccgtctaaaatcggaaaaagttacctgtctttaccgaaggcgtgtagccgatatgacggctcttcctgccgaaatagaaggagccttagccgaaggggtagaaatgatgaccctaaaagctccttcaaaacttgaagtaaagaatggaaaactcacaggcgtttgggttactcctcagatgatttccaaaataaaagacgggcgagcctccgttgtatctacaggagaacctgatatttttattccgtgtgaagtgcttgtcgttgcaataggtcaggatatcgaaactcaacattatgaagattccggtataccggttgatcgaggaaagctttttaccatgcccagcgcaagttttcaaggaatgcctggcctattttcaggcggagactgtgcttcaggccccgctacggttataaaggccattgccgccggaaaagttatggccgcaaatatagacgaatatttaggctatagccacactataagctgtgatatagaaattcccattcccaatattgatgaccgccttgcttgcggaagggttgaacttggagagagggaagcttctgaaagaataaaggattttgaaggcgtagaattctgtatgagtaaaaaggaagcttgtcaagaatcaaatcgctgtcttaaatgcgatcacttcggatttggtatatttaagggaggacgggaacgattatggtaa

SEQ ID NO: 4494 - protein, 609 aa, Treponema denticola
MSRLEIFSQNRSQIIIEELYENLQHRIEASPPGLCPVYITRAFIEMCHAQTCGKCAPCRIGLLQLKHILTDVLNGKSTMKTLDLIEETAKSIRETADCALGYEAADMVYKSIIYCRDDFEEHIKHGRCGCITTQPVPCVALCPANVDIPGYIALVRDERYADAVRLIRKDNPFPSTCAFICEHPCEHRCRRNMVDTAINIRGLKRVAVEFAGKVPPPPCAPSTGKSIAIVGGGPAGLTAAYYLQLMGHQTTVYEMLPKLGGMLRYGIPNYRLPKDRLDEDIDAILETGVKVVYGKKIGTDIELNELIKDNDAAIIAIGASTDKKLGLEGEDSEGVISAVQFLRDVGMDKGMDLTGKKTAIIGGGNVAMDAVRTAVRLKSEKVTCLYRRRVADMTALPAEIEGALAEGVEMMTLKAPSKLEVKNGKLTGVWVTPQMISKIKDGRASVVSTGEPDIFIPCEVLVVAIGQDIETQHYEDSGIPVDRGKLFTMPSASFQGMPGLFSGGDCASGPATVIKAIAAGKVMAANIDEYLGYSHTISCDIEIPIPNIDDRLACGRVELGEREASERIKDFEGVEFCMSKKEACQESNRCLKCDHFGFGIFKGGRERLW

SEQ ID NO: 4495 - DNA, 1512 bp, Treponema denticola
  CDS (1)..(1512)
atggaaaatataaataaagaatgtcataaacatgtaacccatgaagatctttcagatcgggccaaacagctttgggccgatttaaagggcaaaaccttaacccctaaagaaagggctcagattcctattcaggaaatgccgaccctcgatccccataaaagggcctcattgatgaatgaggttgccatgggctacactgatgaacaggcccgcattgaggcggaaagatgcttaaactgcaaaaacaagccctgcgttaaaggctgccccgtaggtataccgattcccgaatttattgccgaaatccaaaaaggcgattataaaaaggctgtcgatattataaaaacaacaaacctcttacctgcaatttgcggacgcgtttgtccacaagaaaagcagtgccaagctttttgtactgtaggtaagatgctcaaatccacggaacaggctgtagccatcggccgtcttgaacgctttgtcgccgactgggaaagaaacaataataagattaccattccgcccgttgctcccgaaaccggaaaaaaagttgctatcatcggttcaggccctgccggtttgactgttgcagcagatgtccgcagggaaggccactcggtaacagtctttgaagccttccacaaaacaggcggcgttatggtttacggaatccccgaattccgcttgccgaaagaaatcgttgcaaaggaagtcgaaaacctcgaaaagatgggcgttgaattcaaaaccaacttcttggtaggaagaaccgaaacccttgagcagcttttaaaagaagacggatatgatgccgccttcatcggaaccggtgccggtcttcccaaatttatgggaattgaaggcgaaaacctaatcggtgtttttagtgcaaacgaatacctgacacgggccaaccttatgaaagcctatgatgcagaacactccgatactcctctttatgaggctgaaaccttggccgtaatcggaggcggaaacgttgctatggatgctgcaagaatgggctaccgccttggctgtaagaaggtttactgtatctaccgccgaacccgtgcagaaatgccggcccgaatcgaagaagttgcccacgccgaggaagaaggcgtagagttctgcttccttcaaaaccccacaagaataatcggagataaagaaggaaaggtttgtgcaatagaagttttagactatgaattgggcgaacccgatgaatccggcagaagaaagcctgtagcaaagcccgggaccgagcatcaaataaaggtagatgccgtaattgttgccctcggaaacgactccaacccccttatggctcaaacaagtcatggtttggaagttaccaaaaaaggaaatatcgttgttgacgaaaaccaaaaaacctcaatcgagggagtttgggcaggcggcgacattgttttaggtgctgctaccgtaattcttgcaatgggcgaaggccgaaaagccgctgctgcaattaacgaatatttaaagacaaaataa

SEQ ID NO: 4496 - protein, 503 aa, Treponema denticola
MENINKECHKHVTHEDLSDRAKQLWADLKGKTLTPKERAQIPIQEMPTLDPHKRASLMNEVAMGYTDEQARIEAERCLNCKNKPCVKGCPVGIPIPEFIAEIQKGDYKKAVDIIKTTNLLPAICGRVCPQEKQCQAFCTVGKMLKSTEQAVAIGRLERFVADWERNNNKITIPPVAPETGKKVAIIGSGPAGLTVAADVRREGHSVTVFEAFHKTGGVMVYGIPEFRLPKEIVAKEVENLEKMGVEFKTNFLVGRTETLEQLLKEDGYDAAFIGTGAGLPKFMGIEGENLIGVFSANEYLTRANLMKAYDAEHSDTPLYEAETLAVIGGGNVAMDAARMGYRLGCKKVYCIYRRTRAEMPARIEEVAHAEEEGVEFCFLQNPTRIIGDKEGKVCAIEVLDYELGEPDESGRRKPVAKPGTEHQIKVDAVIVALGNDSNPLMAQTSHGLEVTKKGNIVVDENQKTSIEGVWAGGDIVLGAATVILAMGEGRKAAAAINEYLKTK

SEQ ID NO: 4497 - DNA, 1413 bp, Geobacter sulfurreducens
  CDS (1)..(1413)
atgagcacgggtatgaccaccagagagcgattggccattgaccgggtccacatggtcgaactcgatgccgacagccgcagccgaaattttgacgaagtgaaccggggcctcaccccggaggaggccgtgcgcgaggcccagcgctgcattcgctgcacgaaccgccagtgcgtggcaggctgtcccgtgggggtgtcgatcccggaatttatcacggccctggccgacggcaacctcagggaggctgcccggatcctgaccagggacaatgcgttgcctgccgtgtgtggccgggtctgtccccaggaaacccaatgcgaggccaggtgcgtgcgtgggatcaagggagagcccgtggccatcgggtatctggagcgttttgtggcggactgggccacggccaatgtcgccgagctcggtgacgagccgctgccgccgccaacaggcaggcgggtggcagtggtcggctgtggtccggccggattgactgccgccggggagttggcccgcaagggacatggcgtgactatcttcgaggcgctccacgacacgggcggggtgcttcgctacggcattccggagttccgcctgcccaaaaccattatcgatgccgaggtggcgcggcttcttgcactgggggtgacggttgagtgcaatgtcatcatcggcaagacgctgaccctcgcccagctgcgggaagaattcgacgcggtattcatcgccaatggcgccggcctgccggtgatgctctccatcccgggcgagaatctcaagggggtctattccgccaacgaatacctgacccgggttaacctcatgggggccggccgcgaccccggctccaccactcccatcattgccggtaagcgcgtggccgtcatcggcgggggcaacaccgccatggactgcgtccgaaccgctcgccgtctgggcgccgagcgggccatgatcatctaccgcaggagcgaggagcagatgccggcccgggtggaggagatcaagcacgccaaggaggaaggggtcgagttcgtaatgctgacagcccccatcgccatcgggggcgacaaggacgggtgggtggccaccctgcgctgcctgcgaatggagctgggcgcgcccgattcgtcgggacgccgatcaccggtgccggtggaaggttccgcatacgacattgccgtggatgtggtggtgaatgccgtcggtacccgggccaatccgctcctgaccgccacggcgccggaacttaaactgaaccggtggggcaacatcgccaccgatgacaacggtgccacgagcgttgccggcgtctatgccggtggcgacatcgtgcgagggggcgccacggtaatccttgccatgggcgatgggaagcaggcggctgccgcgatccacgactggctgaacaggcggtga

SEQ ID NO: 4498 - protein, 470 aa, Geobacter sulfurreducens
MSTGMTTRERLAIDRVHMVELDADSRSRNFDEVNRGLTPEEAVREAQRCIRCTNRQCVAGCPVGVSIPEFITALADGNLREAARILTRDNALPAVCGRVCPQETQCEARCVRGIKGEPVAIGYLERFVADWATANVAELGDEPLPPPTGRRVAVVGCGPAGLTAAGELARKGHGVTIFEALHDTGGVLRYGIPEFRLPKTIIDAEVARLLALGVTVECNVIIGKTLTLAQLREEFDAVFIANGAGLPVMLSIPGENLKGVYSANEYLTRVNLMGAGRDPGSTTPIIAGKRVAVIGGGNTAMDCVRTARRLGAERAMIIYRRSEEQMPARVEEIKHAKEEGVEFVMLTAPIAIGGDKDGWVATLRCLRMELGAPDSSGRRSPVPVEGSAYDIAVDVVVNAVGTRANPLLTATAPELKLNRWGNIATDDNGATSVAGVYAGGDIVRGGATVILAMGDGKQAAAAIHDWLNRR

SEQ ID NO: 4499 - DNA, 2019 bp, Geobacter sulfurreducens
  CDS (1)..(2019)
atggcacaggtggttttttccagctggggaagaacaatcgtcgataaccgcaaggggggagaagcccaggacgtgagcttccgccttccgaccaccctcgatggcgagcggcagattgccgcgttcatggggtgggatgggatcatcctttacgacctgaaggttgacgtgccggccatggcggccgaatatatgaagcgcgtgcagacccagtattgctgcggcaagtgcacccccggcaaaaaggggaccaaggttcttgccgacgttttggcggccatcattgaggggcgggccacagaggcagacctcgacaccatcgacgatctggcggacctgctcaccaattgcaagtgcaccctctgccaaagctcaacgatcccggttctcgatgcagtgaaacacttccgggaagatttcctcgcctatatcaccggcatccgcaaacccgccaacgtacaccggttcatcgacaagtacaccgccccctgcatggaccgctgcccggcccatatcgacattcccgcctacatcgaggcgatcaaggaataccgattcgatgagtcgcttgatatcatccgcgacaacatgccgttgccgtcggtctgcggcagggtgtgcccgcacccctgcgagacccactgtcgccgcaagaacgtggacgactcggtcaacatcatggtgctcaagcgttccgcctccgactacgagtggatgcacaacgcagccccccccatgcaacccaagccgcaaaaaaacaagaaagtcgccattgtcggggccggcccggcaggccttgcctgcgcctactacctggcccttgaaggatatccctgcaccatctacgaggccctgcccgaaggatacggcggcggtatgatcgccgtcggcatccccccctaccgccaaccgcggcacctgctccaacgcgatatcgacatcatttcctccatgggtgtggatatcatctatgacacccgcatcggcaaagacatctccctagaagagctcaagcagaaattcgacgccgtcttcctggcaccaggcgcccaccgctccaagcccatgggcgtcgagggagaagacaagggctacaagggcttcctgaagggcggtatcgactttctccgggaagcctacatgggacgccccaccggcatggggaaaaaggtggtcgtggttggcggcggcaacactgccattgactgcgtgcgggttgctctccgggaaggagcggaagaatccacacttctctatcgtcgttcgcgcaaggaaatgccggccgacgtatgggaagtggacggtgccgacgaagaaggggtacgatttgagttccaggtcctccccacacgggtactcgtggatgagaacgagcaggtgaccggtgtggaatgtgtccgaatggccctcggtgagcctgacgcctcggggaggcgccggcccgagccggttcccggcagcgagttcgtggtcgagtgtgacaccgtcatcccggccattggccaggatcccgatctttccttcatccccgacaacctgggaatcgacatcaccaagtggaacaccgttgtcaccaagtacgttcctctcaaggatgcggcgggcaaggacttgaaagacggcatgggcaacccccttgcacgggtactcatcactgaccttgagggtgttttcgcgggcggcgatgccgaaataggccccctgaccgtcgtcgcctgcattggaaatgcacatcgggccgcgcgggtgattcagcgctggcttgaagaaggaaaggcataccttaccgaggacgaactcatggaggacatcctcacgaacatgccggtctacgacaagaacgaaaaggttccctggctcgactcccgggagcgggcccaccaagccgaggtccacggccaagagcgggcgagcaagggcaactaccaggaagtggaactcggctttgtcgatacccaggcagtggaggaagcagagcgctgcctccggtgctaccgggtcgccatggccgccatttag

SEQ ID NO: 4500 - protein, 672 aa, Geobacter sulfurreducens
MAQVVFSSWGRTIVDNRKGGEAQDVSFRLPTTLDGERQIAAFMGWDGIILYDLKVDVPAMAAEYMKRVQTQYCCGKCTPGKKGTKVLADVLAAIIEGRATEADLDTIDDLADLLTNCKCTLCQSSTIPVLDAVKHFREDFLAYITGIRKPANVHRFIDKYTAPCMDRCPAHIDIPAYIEAIKEYRFDESLDIIRDNMPLPSVCGRVCPHPCETHCRRKNVDDSVNIMVLKRSASDYEWMHNAAPPMQPKPQKNKKVAIVGAGPAGLACAYYLALEGYPCTIYEALPEGYGGGMIAVGIPPYRQPRHLLQRDIDIISSMGVDIIYDTRIGKDISLEELKQKFDAVFLAPGAHRSKPMGVEGEDKGYKGFLKGGIDFLREAYMGRPTGMGKKVVVVGGGNTAIDCVRVALREGAEESTLLYRRSRKEMPADVWEVDGADEEGVRFEFQVLPTRVLVDENEQVTGVECVRMALGEPDASGRRRPEPVPGSEFVVECDTVIPAIGQDPDLSFIPDNLGIDITKWNTVVTKYVPLKDAAGKDLKDGMGNPLARVLITDLEGVFAGGDAEIGPLTVVACIGNAHRAARVIQRWLEEGKAYLTEDELMEDILTNMPVYDKNEKVPWLDSRERAHQAEVHGQERASKGNYQEVELGFVDTQAVEEAERCLRCYRVAMAAI

SEQ ID NO: 4501 - DNA, 6588 bp, Ashbya gossypii
  CDS (1)..(6588)
atgtcttatcttgcttttgtttactgtttacatagtacatcattggtgttagtacctacgctgagttactgtcgtttggatacgcctggcacacacacacacacgcacggttatatacaggcaagcgacgttacgactgaccaacgcaaggtaatgctacactcggagccttatgatgcgctccaagaggcctacgaaggcggacagcctcttggcgagcagacggagttgagaggccaggacggtcatatctcctgggccaacgccattcctggcaagcaggggttgtatgatcctgactatgagaaggacgcctgtggtgtcggcttcgtggccaacatcaagggcgagccatcgcataagatcgtctcggatgcaaaatatttgctatgtaacatgacccatcgtggcgcagtctcgactgacggtaacggtgacggtgccggtatcctggtcgggattccacatgagttcatgcagcgggagttccgcatggaggcgggtgtcgaggttcccgccaagcatcagtatgctgtcggtaacatcttcttcaagaaggatgcagcagaggtcctagaggcctcgaagcaaactttcggccagctagccgagtcgctcgacttgcgggttttgggttggagggaggtcccacacgactcttccattctaggttccgttgcgctatcgcgcgaacccactatcctacaaccgttggttgtgctgaaagagacttatgggcaggagatatccggtgaagaattccaggctaaatacgagacgacgttccggatgcagttgtacattttaagaaagcaggcttctacggccatcggtatccagaactggttctacgtgtgctccctaaataaccggacaattgtgtacaaaggtcaattgacccctgcccaggtgtataattattaccacgacttgaccaatgctcatttcaagtctcacctggcgctggtacactctcgtttctccaccaatacattcccatcttgggaccgtgcccagcctctgcgctggcttgcacacaacggtgaaattaataccctaagaggcaacaaaaactggatgcgtgcgaaggaaggtgtcatggcatccgccgttttccaagaccaactggagaagctttatccgattatcgaagaaggcggatccgactctgccgcgctggacaatgtgctagaattactagtgataaatggtgttctgtcattacccgaagcgatgtgcttgatggttccagaagcctaccacaaggacatggattctaacctgaaggcttggtttgactgggccgcctgtttgatggaaccatgggatggccctgcgttgctcacctttaccgatggccgctacaccggcgctacattggaccgcaacggtttgcgcccatgcagattctatattacttcagatgatcgggttatctgcggctccgaagttggtgttatccctgtcgcaaatgaactcgttgtttgcaagggtaagctaaagccaggcgatatgttgcttgtagacacggagaagggtgaaatggtagacaccaacatgctgaagaaagagttttcgttgagacaggactttaagtcatggctttcaaaggtgattaagctagatgacttgtccgagaaaaccaaaaagtacactccacaggccttcactccatcgcattctactggtcatgtccagcaagaccccagactcttagcgcttggttacacctttgagcaggtttccctccttttgattcctatggccctacaggggaaagaagcattgggatctaggggtaaggacgttcctttggctggcttgaacgaggatcctgttcttgtttacgattacttcaggcaattgtttgcccaagttaccaaccctccaattgaccctatccgtgaggcgaatgtcatgtccctggagtgttttgtgggtccccaaggcaacttgttggagatgcatccatctcagtgtgaccgtctactgctgcggtctccagttctcatgtgggatgaattcgaggctctaaagaatatagagaaagtccatccaacttggtctaccgcacacatcgacataaccttccaaaaatctgaggggttgcttggttataccaatgctatagaacgtatcacacaagaagcctcggatgctattgagcaaggcaagaagatactgatgatctctgataggaaaattgacgctgagcatgtgcccatctcctcactgatcgctgttggagctattcaccatcacctaatcagaaacaagcagcgctcccaggttgctttaatcttggagactggcgaagcccgcgaagttcaccagttctgtgttcttcttggctatgggtgtgacggtattttcccttacttagcgatggaaaccctggtcagaatgaataacgaaggtttagttcggaatgttaacgatgactactctgatattacagatgagcaactgttgcataattacaaggaagcaattgacggcggtatactaaaagtcatgtcgaagatgggtatctctactctggcatcttacaagggagcgcagatatttgaagctttaggtattgataactcagtgattgatttgtgttttgccggaaccgcttctagaattaagggtgttacctttgaatacattgcgcaagacgccttttcattgcacgagcgcgggtatccatcgaggtttacgattaagagatctgtcaacttgcctgaagccggcgaataccactggagggatggtggctataagcacgtcaacgagccaagtgccattgctgcattgcaggattctgtccgtaacaagaacgaggatgcatggtccatgtatgttcaaaaagagatggaagcaattagagactgtaccttaagaggtttgttggatctggattacgagtcgtctacagctattccactagaacaggtcgagccatggactgagattgccagaagatttgctaccggtgccatgtcttacggttccatctctatggaggctcactctaccctagcgattgccatgaacagactaggtgcaaaatctaactgtggagagggtggtgaggaccctgagcgttccattgttcaccctaacggtgacaccatgcgctctgctatcaagcaggtggcctctgcaagattcggtgtaacctctcattacctttctgatgcagatgagatccagatcaaaattgctcaaggtgctaagcctggtgaaggtggtgagctacctggccataaggtttcgaaggaaattgcgaagactagacattctaccccatatgtcggcctcatttctcctcctccacaccacgacatttactctattgaagacttgaaacagttgatttatgatttgaagtgtgctaatcctcgtgctggcatatctgttaaactggtttctgaagttggtgtcggtatcgttgcttctggtgttgcgaaagctaaggcagaccacattcttgtttccggccatgacggtggtactggtgctgctaggtggacttctgttaagtacgcaggtcttccatgggaattgggtttggcagagactcaccaaacattggttctcaacgatctacgtcgtaacgttgttgtccagacggacggtcaactaagaaccggctttgatattgctgttgccattctccttggtgcggaatcgttcactcttgctaccattcctttgattgctatgggctgtgttatgttgcggaagtgccacttgaacgcctgtgcagttggtatcgcaactcaagatcctgtattgagagctaagttccaaggccaaccggagcatgtaattaacttcttctattatttgattcaggacttgagaaagattatggcgaaacttggcttccgtactgtaacagaaatggtaggccattcggagaagctaagaaagagagacgacgtttctacaaaggcattaaacatagacttatcgcctatcttgacaccaggccatgttattcgccctggcgttcctacaagcttcaccaaaaagcaggaccacaagttacacgtccgcctcgacaacaaattaattgacgaggctgaagtcacattggataaaggattgccagtaacaatcgatgcctcgattatcaatactgatcgtgccttaggatctactttatcgtatagagtatcaaagaggttcggtgagcatggtctaccacaggacacaattgttgttaaaatcaatggttcggcaggccagtcttttggtgctttcttagcttctggtattacttttattctagatggtgatgccaacgactatgttggtaagggcttgtccggtggtagaattatcattaagcctccccagaactctaagttcgaatctgatgaaaatgtcatcattggtaacacctgtttctacggtgccacttctggctatgcgtttattgctggtagcgtcggtgagcgttttgctgtccgtaactccggtgcgacattagtcgtggaaaggattaagggtaacaacgctttcgagtatatgacaggtggtagagctgttgtgttgtctcagatggagtcattaaatgcattctccggtgcaactggtggtattgcttactgtttgacttctgactatgacgatctggttggaaagattaacctggacacaatcgagctacagagcttgagcgacccggtggagatcgctttcgtcaaaaacttaatccaggagcactacaactacacaaagtctgagctggcagcgagaatcttgcataactttaaccattatttgaagaatttcgttaaggtcattcctttggactacaagaaggttttggaaaatgaggctgccgaaaagaccaaggagaaggagagaagtgcaaatgaatatttgcggacattcagcaagaagctcaatttgtctgctgatgccaccaatggagaggtaagcaagcttctctccaagaaaaaccaggccgcagctcgtccgatttctatcaaagcgactttggcagagccaaaggttgtggatttggaagacgctgttcaaaatcctgatcaagaggacaatatcaaaaaactagatcgtatcaacggtttcattaaatataagttgcggcacgaagagtataggaacgttgcaaccaggacaaaggactggaaagagctcacttctgcaataacgaagaaggcagcaaagttccagactgctagatgtatggactgtggtgttccattctgtacctctgataccggttgtccaatctccaatgtcattccaaagttcaacgaacttgtctttaagaaccagtggaagcttgctctggacaaacttttggagacaaacaatttcccagaatttaccggcagagtgtgtccagctccgtgccagggtgcttgtaccttgggtatcagtgaagaccctgttggcatcaagtctatcgagcgtctcatcatcgataatgccttcaaggaagggtggatcaaaccatgtcctcctgaagtcagaactggccgtactgttgctataattggttctggtcccgctggtctatcttgtgccgaccagttgaaccgcgctggccactcggttacagtctacgaacgtgccgaccgttgcgggggtcttttgatgtacggtattccaaatatgaagcttgacaaatccatcgttcagagacgtttgaacttgctcgcggcagagggtatcgaattcgtgacgaacaccgaaataggcaaggatatcacaatgagcgagttgaagtcaaaatttgactccgtcgtttacgccgtgggctcgaccattccaagagacctacgcattccaggccgtgagttgaagaatatcgactttgcaatgactctgttgaagaacaacacccaagcgctcctagagaaggacctgggcaccattagaaagcatatagagggaaagaaggtcattgtcattggtggtggtgatactggtaatgactgtctgggcacttctgtcaggcacggcgctgcaagtgtgttgaactttgagctgctaccacagcctccaaaggagcgcgctaaggacaacccttggcctcagtggccgcgtgttatgcgcgttgactacggtcacgcagaggtcaaggagcattacggcagagacccccgggagttctgtatactctccaaggaattcgtgggcaacgaaaatggcgaggtcaccgcgatcaagacggtccgcgtggaatggaagaagtcgcagtccggtgtatggcagatggtggaggtcccaggctcagaggagacatacgaggccgatgttgttctgctctctatgggctttgtcggccctgagctgatcgaagaccctgcggtcacaaagacccgcagaggcactattggcactgtctccgacatgtcctactctgtggacggcggcaagctattcgccgcaggtgactgcagaagaggccagtcgctaattgtctgggccatccaagagggcaggaagtgtgcgactgccattgacaactatttgatgggttctacaaacctacccgggaacggtgggattgtgaagcgcgactacaagcttctcgaggaactagcatccgctttttga

SEQ ID NO: 4502 - protein, 2195 aa, Ashbya gossypii
MSYLAFVYCLHSTSLVLVPTLSYCRLDTPGTHTHTHGYIQASDVTTDQRKVMLHSEPYDALQEAYEGGQPLGEQTELRGQDGHISWANAIPGKQGLYDPDYEKDACGVGFVANIKGEPSHKIVSDAKYLLCNMTHRGAVSTDGNGDGAGILVGIPHEFMQREFRMEAGVEVPAKHQYAVGNIFFKKDAAEVLEASKQTFGQLAESLDLRVLGWREVPHDSSILGSVALSREPTILQPLVVLKETYGQEISGEEFQAKYETTFRMQLYILRKQASTAIGIQNWFYVCSLNNRTIVYKGQLTPAQVYNYYHDLTNAHFKSHLALVHSRFSTNTFPSWDRAQPLRWLAHNGEINTLRGNKNWMRAKEGVMASAVFQDQLEKLYPIIEEGGSDSAALDNVLELLVINGVLSLPEAMCLMVPEAYHKDMDSNLKAWFDWAACLMEPWDGPALLTFTDGRYTGATLDRNGLRPCRFYITSDDRVICGSEVGVIPVANELVVCKGKLKPGDMLLVDTEKGEMVDTNMLKKEFSLRQDFKSWLSKVIKLDDLSEKTKKYTPQAFTPSHSTGHVQQDPRLLALGYTFEQVSLLLIPMALQGKEALGSRGKDVPLAGLNEDPVLVYDYFRQLFAQVTNPPIDPIREANVMSLECFVGPQGNLLEMHPSQCDRLLLRSPVLMWDEFEALKNIEKVHPTWSTAHIDITFQKSEGLLGYTNAIERITQEASDAIEQGKKILMISDRKIDAEHVPISSLIAVGAIHHHLIRNKQRSQVALILETGEAREVHQFCVLLGYGCDGIFPYLAMETLVRMNNEGLVRNVNDDYSDITDEQLLHNYKEAIDGGILKVMSKMGISTLASYKGAQIFEALGIDNSVIDLCFAGTASRIKGVTFEYIAQDAFSLHERGYPSRFTIKRSVNLPEAGEYHWRDGGYKHVNEPSAIAALQDSVRNKNEDAWSMYVQKEMEAIRDCTLRGLLDLDYESSTAIPLEQVEPWTEIARRFATGAMSYGSISMEAHSTLAIAMNRLGAKSNCGEGGEDPERSIVHPNGDTMRSAIKQVASARFGVTSHYLSDADEIQIKIAQGAKPGEGGELPGHKVSKEIAKTRHSTPYVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAILLGAESFTLATIPLIAMGCVMLRKCHLNACAVGIATQDPVLRAKFQGQPEHVINFFYYLIQDLRKIMAKLGFRTVTEMVGHSEKLRKRDDVSTKALNIDLSPILTPGHVIRPGVPTSFTKKQDHKLHVRLDNKLIDEAEVTLDKGLPVTIDASIINTDRALGSTLSYRVSKRFGEHGLPQDTIVVKINGSAGQSFGAFLASGITFILDGDANDYVGKGLSGGRIIIKPPQNSKFESDENVIIGNTCFYGATSGYAFIAGSVGERFAVRNSGATLVVERIKGNNAFEYMTGGRAVVLSQMESLNAFSGATGGIAYCLTSDYDDLVGKINLDTIELQSLSDPVEIAFVKNLIQEHYNYTKSELAARILHNFNHYLKNFVKVIPLDYKKVLENEAAEKTKEKERSANEYLRTFSKKLNLSADATNGEVSKLLSKKNQAAARPISIKATLAEPKVVDLEDAVQNPDQEDNIKKLDRINGFIKYKLRHEEYRNVATRTKDWKELTSAITKKAAKFQTARCMDCGVPFCTSDTGCPISNVIPKFNELVFKNQWKLALDKLLETNNFPEFTGRVCPAPCQGACTLGISEDPVGIKSIERLIIDNAFKEGWIKPCPPEVRTGRTVAIIGSGPAGLSCADQLNRAGHSVTVYERADRCGGLLMYGIPNMKLDKSIVQRRLNLLAAEGIEFVTNTEIGKDITMSELKSKFDSVVYAVGSTIPRDLRIPGRELKNIDFAMTLLKNNTQALLEKDLGTIRKHIEGKKVIVIGGGDTGNDCLGTSVRHGAASVLNFELLPQPPKERAKDNPWPQWPRVMRVDYGHAEVKEHYGRDPREFCILSKEFVGNENGEVTAIKTVRVEWKKSQSGVWQMVEVPGSEETYEADVVLLSMGFVGPELIEDPAVTKTRRGTIGTVSDMSYSVDGGKLFAAGDCRRGQSLIVWAIQEGRKCATAIDNYLMGSTNLPGNGGIVKRDYKLLEELASAF

SEQ ID NO: 4503 - DNA, 1383 bp, Wolinella succinogenes
  CDS (1)..(1383)
atgcaaaattttttacaagttgaacgaagcaaccctaaaaagcgccaagccctagagcgagtcaaagactatagcgagatttaccagccctactcaagcgatgaggcgacccctcaggcgagtcgatgcgtgcagtgcggtgacccctattgtcacaataaatgcccactccacaacttcatccctcagtggctcaaaaaggtctccgaaaaggattttcgcctcgcctttgagctctctcatgccacttcgcccttccctgaaatcatggggcgtgtctgtcctcaagatcgcctctgcgagggggattgcactcttaatgatggctatggggcaatcactattggcgcgattgaaactttcatcagtgaaaaggggatggagcttggctacaagccaaagtttgccactaaaagcgttggtaaaagcgtggctatcgtgggttcaggcccagcaggactctcagcagcaaccttcttgcttcgagaaggtttcaaagtggagctctttgagcgccaagatcgtgcgggtgggctcctcacctatggaatcccaggcttcaaactcgaaaaaagcgtcatagagagacgacttgatcagctcacccaagcaggactaaaactccatcttggtaaagagattggcaaggagatgtcttttgagaagcttcttaaaggctttgatgctatcttcttggggattggcgcaaccgcccctaaaaaggcaaggatttccggagaagaggcggagggctgttatagcgctattgattttctcacggcgattcaaaagcgaaactttggagttgaatcctccatccttttgcccgaactcaagggcaaaagcgtggtcgtggttggcggaggggacacagcgatggattgtgtgcgaaccgccattagagagggagccgaggaggtgaagattctctatcgccgcgatgaaaataatatgcccggaagccacaaagagtatgtgaacgccaaagaggagggggtagaatttgaattttttgccgcccccaagcaggtgattctccgcgagggcaaagctactggaatcgaatcgtaccgaaccgaactttgcgatatggacgagaagggacgacaaaagtgtgtggtcgtggagggaagcgagtttgtcgtggaagcggatgtgattatcttctctctaggctttgatcctgctagaccctcttttttagagcagcaccaaatcgcactgcacccttggggaggaatcatcgtggataattcttatgagacttcccttcccaatgtctttgcaggaggggattgctatcgaggcgctgatcttgtagtcaatgctgcgcttgatggtcgagaggccgccaaagcaatcatcaaaaagcttctaggctaa

SEQ ID NO: 4504 - protein, 460 aa, Wolinella succinogenes
MQNFLQVERSNPKKRQALERVKDYSEIYQPYSSDEATPQASRCVQCGDPYCHNKCPLHNFIPQWLKKVSEKDFRLAFELSHATSPFPEIMGRVCPQDRLCEGDCTLNDGYGAITIGAIETFISEKGMELGYKPKFATKSVGKSVAIVGSGPAGLSAATFLLREGFKVELFERQDRAGGLLTYGIPGFKLEKSVIERRLDQLTQAGLKLHLGKEIGKEMSFEKLLKGFDAIFLGIGATAPKKARISGEEAEGCYSAIDFLTAIQKRNFGVESSILLPELKGKSVVVVGGGDTAMDCVRTAIREGAEEVKILYRRDENNMPGSHKEYVNAKEEGVEFEFFAAPKQVILREGKATGIESYRTELCDMDEKGRQKCVVVEGSEFVVEADVIIFSLGFDPARPSFLEQHQIALHPWGGIIVDNSYETSLPNVFAGGDCYRGADLVVNAALDGREAAKAIIKKLLG

SEQ ID NO: 4505 - DNA, 1950 bp, Wolinella succinogenes
  CDS (1)..(1950)
atgagccaagcgcacttctcctcgtggcggggtcaccaagagtttctcgcccctcatctcattgaagggcgcgccgttcgcgcctttattggatgggcgggggtgatgatctatgatccgaccttggatgtgattgcgctagccaaagagtatgcaagacagtatcaatgctttgcagagacttgcgggagatgcgctccaggcaagtttggcgggaagattctctttgatctgttggagaagattgaccaaggaagaggcgaagagagtgatttggagcgtcttgtagaggtgggaaaactgatgatgacaacgagcaaatgcgaagtgggcaagacgacccccttgcctattttggatttgctggaagcctatcgacccctttttgtggaggcgctagggaatcgctccagaaaagagaggagcaaaaaggagcgctatatcgctaagatcaccgctccatgcatagatgcctgccccgctcatgtcgatattcctgcctatattgagggagtgcgagatcatcttttgggcgattctctggctgccacgcgaaagagtatgccgctagctcaagtgtgcgggcgtgtctgtcctcatccttgtgagagtgcttgtcggcgaggcgatttggatgagcctatctccattatggagctcaagcgcttgggggcggattatgagaaggagcgtcatggcggatttatccacccctatcctccaaaacctaggcgcaaagacaagagggtggcgatcattggggcgggacccgcgggactctctagcgcttactatctggcgctagagggaatcatgagcgatgtttttgaggcgcttcctgtgcttggcggcgaggtgagcgtgggagtgcctgagtatcggatgcccatagatcgatactaccatgatattgaggcgatcaaaagcctaggcgtgagcttttggacgaatcacttcgtgagcgccaaagagttggatgagatgcgccaaaagtatgacgccattattttggccacaggggcgagaatctccaaaaagcttggagtcaaaggcgaagaggagtcgctagggggatatgctcccgcgattccttggctggatcagatcaatcttgccaccaagttcaatcttgccgctctgcctgatttgagaggaaagagcgtggtgtgtgtggggggcggattcacctcgatggatgtagtgcgatgtgccgtgcgattgggggcaaagcggatcgtgatgctctatcgccgcgatgaggcgacactcatccaaaacacctccaaagaggagtatcacgaggcgcttgaagagggggtggagttcctctttcagtgcgctgtgcaggagattaagagctgcgggggagagatcaaagccctcttggtcgaggagtatgaggtggtctatgaggagggcgcgcgcaaaccctcactgagacgaatcgagcgagagcctctctttttagagtgcgatcttcttatccctgcggtctctcaagaggtggacaggagctttatccctaaagagtggaatttggagagtacctcatgggggagtttcaagaccaatggcaaggatttttctacaactctgcgtggggtttttgctgcgggggattgcgaaaaagggcctttgaccatcgtcaatgccgtagggcaggggaagagagcggcgagcgtggtgagtcgattcttggaggatggagagatcactttgactcctgaggaggagatggaagattggcttaaaaaagagggggtttatgaccgatccatgcctgtggtgggctggctggcgggattggtgcgccaagaatcgcacaaagaggagcctttgaagcgcagagaggattttagagaggtgaatcaggggctctccatgcaggaggcttttgccgaatcggaacgatgtatgcgatgctactatatctcgatggtagcgctttaa

SEQ ID NO: 4506 - protein, 649 aa, Wolinella succinogenes
MSQAHFSSWRGHQEFLAPHLIEGRAVRAFIGWAGVMIYDPTLDVIALAKEYARQYQCFAETCGRCAPGKFGGKILFDLLEKIDQGRGEESDLERLVEVGKLMMTTSKCEVGKTTPLPILDLLEAYRPLFVEALGNRSRKERSKKERYIAKITAPCIDACPAHVDIPAYIEGVRDHLLGDSLAATRKSMPLAQVCGRVCPHPCESACRRGDLDEPISIMELKRLGADYEKERHGGFIHPYPPKPRRKDKRVAIIGAGPAGLSSAYYLALEGIMSDVFEALPVLGGEVSVGVPEYRMPIDRYYHDIEAIKSLGVSFWTNHFVSAKELDEMRQKYDAIILATGARISKKLGVKGEEESLGGYAPAIPWLDQINLATKFNLAALPDLRGKSVVCVGGGFTSMDVVRCAVRLGAKRIVMLYRRDEATLIQNTSKEEYHEALEEGVEFLFQCAVQEIKSCGGEIKALLVEEYEVVYEEGARKPSLRRIEREPLFLECDLLIPAVSQEVDRSFIPKEWNLESTSWGSFKTNGKDFSTTLRGVFAAGDCEKGPLTIVNAVGQGKRAASVVSRFLEDGEITLTPEEEMEDWLKKEGVYDRSMPVVGWLAGLVRQESHKEEPLKRREDFREVNQGLSMQEAFAESERCMRCYYISMVAL

SEQ ID NO: 4507 - DNA, 4200 bp, Vibrio vulnificus
  CDS (1)..(4200)
atgatccaaattgtcatagacggtaaataccgtatcgttgaggcggggcaaaccgttctgcaagccgccaaagtgtgtggggttgagattccgtctctgtgtggcatgaatcgttctggtgagaagattccatgcgatttgtgtgttgttgaggtcgaaagtggcggcacccgccgtgcttgtgagcttgaagtctacaacggcctaacggtaaacacgcaatccgaagcgctgtctgcgcatcgtaaacaggcgctcaaccgcatcatgagtgaccactacgccgactgcgaagcgccgtgcaaaacggcgtgccctgcgggcgtggacattcaatcctatctttaccatattgcgcaaaacgaccatcaaaaagcgattgaagtgatcaaacgtacgctgccgatgcctttgtcaattggccgcgtttgtcctgcgttttgcgaatccgaatgtcgccgctcgctggtggatgatgcgattgctatccgccaactgaaacgccacgctgcggacgctgatcttgctgcgcaagaagcctacacacccgagaaaaaagccgacaaaaacaaacgtattgcgattgtcggcagtggccctggtggtttaactgcgggctattacctcaccaatgaaggttatcaggtggatgtgtttgaagcgatgccacaagcgggtggttggctgcgttatggcattcccgagtatcgtctaccgaagagcattctcgataaagagatcgcgttgatgtgtcgcaacggtatggcgattcatactgataaaaaactgggtcgagacatcagtttgtcgcagttaagccaagactatgatgcggtgtgtttggctgtgggtgcctcaaaagcggtggcgatggattacccgggtagcgatcttgatggttgttatttaggggtggattatctgaaagatttcgtcactgagcagcgtttcaccacaggcaaaaaagtggcggtgatcggtgggggtaacacggcgatcgactgcgcgcggacggcggtgagaacgggggcggataccacgttgatctatcgtcgtactcgcgatgaaatgcccgcggaagattacgaaatcgaagaagcagaacatgaaggcgtcaagtttcacttcctgaccaatcctgcgcagaacatcgccgacgaacatgggcgagtgtgctcggtgaagctggaaaaaatggcgctgggtgcgcccgatgcctctggccgccgtcgacctgaagcgacgggggagtatttcaccgaagcctttgataccgtgattgctgcggtttctcagcaagccgatttgagctttatgcaaggggaagcgttaacgctacctctgactcgttggaataccgctgatgcaaatccagaaaccatgcacagtggcaccggcaatatcttcagtatcggtgattttcgccgtggcccagccaccgcggttgaagcggtcgcggatgggcgcattgctgcgcaggccattgaccgtttcttcgatggtgacatggaaaatattccccttaagcccttcaattctcgtaaagagcagaagttgaaacaggtcgacccgcttcatttttctcacctgcaaaaagtggcgcgcaccatcatgcctgagctgacctctcagcagcgcgagcaaagctttgaagaagtcgagttaggctttgataacgccgaagcgatggcggaagcggcgcgctgtttagaatgtggttgccaagtcaacacgtcgtgtgacctgcgcgattacgccactgagtatggcgcggaacagcacttccactattcggtgaacatcaaaagccatgatgagtggcaagcattgcgtcaaaacgacccacgtcataaatacccgatcgaccacagttctgagtttattgtctttgatgctaaccgctgcatcagttgcggccagtgcattcaagcttgccgtgaacagtcagtgcaaggtgtattgagtttcatgaaccttgaaaaaggccgcccggtggtgcgtccggattgccgtccgaactttggtggtcagggggtgaggatgggcgactcacgctgcgtgcaatgtggcgcctgtgtgcaagcgtgccctgttggggcgatgaccgatgcgcgcgatcgctcgcaaggccgcgaaacgcctttgaagaaagtggataccatttgtacctactgcggggtcggttgtaagttgaccatgcatgttgacgaagcggccaaccgaattcgctatgtagaaggggcacactcgccggtcaacgaaggcatgttgtgtgtcaaagggcgctatgggttcgattttgtcgccagtgaagagcggcttactacaccgttgatccgtaaagatggttggttgcagccggccagctggcaagaagcgatccgcttagttgcggataagttcagcaccatcaagcaagatttcggtggccgtgcattggcggggttctcatcggcgaaaaccaccaatgaagataactacgcattccagaagttcatgcgtcgtgagctcggcaccaacaacgtcgatcactgtgcaaggctttgccacgcatcgaccgtcacggggttggaagcgtcgctgggcagtggcgcgatgaccaacgacattccaagcatcaagcactcagatgtcatcttcatcattggttcggatacctctgcggcgcatccggtgattgcgtctcacatcaaacaagcggttcgacatcatggcgcgcgtttgattgtagcggatcccaaacgcattggcatggcggatcacgctgagctctatttggcgcatcgccccggcacggatgtgatgttgattaatggcgtgatgcagcaaatcatcaagaatggctggtatgacatggagtacatcgaagaacgtgtcgatggctttgataccatgctgcaagaggtgatgtcgccggcctatgcgctcgacaaagtcgaattggtgacgggcgtaaaagccgatgacatttttgccatggctcggatgatcggtaccgcgaagcgcaccgccgtctactactcaatgggcatcacccagcacaccacggggcatgacaacgttcgctctatcgccaacttgcaactgctgtgtggcaacattggtatcgagggtgggggcatcaacccattgcgcgggcagtcgaacgtgcagggcgcgtgcgatatgggcgcgttgcctaataactacccgggctatcaaaaagtgtataacccattggtgcgcgagaaatttgtcattgaatgggatgcgcccaatctctctgcagagccgggattgaccctaaccgaaatcatcgatggggcgtgtcgccgtgatgtacgagcgctttatgtgatgggcgaaaaccccgtattgagcgatcccaatcaggcgcatgtgattgagggattggaggcgctggatttcttggtggtgcaagacatcttcctcacggaaaccgcacaatacgccgatgtggtgttgccttcttgctcgtttgctgaaaaatcgggtcactttaccaatacggagcgccgtgttcagcgtatttatcctgcggtaaaccctcccggtgaagcaaaagaagattggcgaatcatccaagagatcgccaatgcgatgggcagcgattggcactatcgttctgtggtggacatcaccaacgaaatcacccgcgtgacgccacaatacgcagggctgaaatgggacaacatcacccgcgaaggcgtgcagtggccgagcaacaaaaacaaccctgcaggcacgcgaatcatgcaccaaacgcagtttacccgtggcaaaggccagatggaggcgataccgttccgttacgccgcagaactgcctgatgaagagtacccactggtgctcaccacggggcgtgttcttgagcagttccacaccggtaccatgacgcgcaaaacgcagggtttgaacaatcttgcggggccacgagcgatgatcagcgtgcaagatgccgaggcgctcggcattggcaatggcgacatgctgaaagtctcaacccgtcgcggtgaaattgaaatcgcggcgtttgtcactaagcgtatgcaagcgggcgtggtgttcattccgttccactttgttgagtcgccagtgaatcgactcaccaccacggcgaccgatcctcatgcgaagatccctgagttcaaagtggcggcggtacgcgtggagaaactgcacactgcgctggtggagtaa

SEQ ID NO: 4508 - protein, 1399 aa, Vibrio vulnificus
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADEHGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAIRLVADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYALDKVELVTGVKADDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVVDITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 4509 - DNA, 1470 bp, Vibrio vulnificus
  CDS (1)..(1470)
atgggtaagccgactggatttttagagtttggacgcgagcttccaaagaagcttgcaccagcagagcgaatcaaaaacaacaaagagttcgtactcaacgcggaatttggtaagaaaatcaatactcaagcgtctcgttgtatggactgtggtgtgccgttttgtcacaacggctgcccaattggtaacatcattccggaatttaacgatgcggtttatcgcgacagttgggaagaagcgtggaacattctaagttcaaccaacaacttcccagagttcaccggacgagtttgccctgcgccatgtgaaagtgcttgtgtattgggcatcaaccaagacccaatcaccatctgtaacattgagaaaaccattgtggagacggcgtatcgtgaagggtacgccaaacccaaaactccgcgttcgcgcacaggtaagaaagtggcgatcatcggttccggtccggcaggcttagcggcagctgagcagctcaatagtgcaggccattcggtgacggttttcgagcgcgatgagaaagtgggtggtctactgcgtttcggtatcccagatttcaaactgggcatggacatcattgaccgcaagatcaatctcatggcagaagcaggggttgagtttaaggtgaatcaacatgttggtgtggatgtgaacgcacagcaaattcgccaagaatacgatgttgtgctgcttactggcggctcgaccgtaccacgcgatcttcctgtccctggccgcgagctgaaaggcgtttactttgcgatgcagttcctcgcacaaaacaaccgccgagcaaatgagatggaccttaaaggtgaagaaattcacgcagcaggaaaacatgttgtcgtgatcggtggtggtgatactggttcagactgtgtgggtacttctaaccgtcatggtgctgcaagtgtaactcaagtagaaatcatgcctgtgccaccagaaaagcgcccggccaatatgccttggccgcaatacccaatgattcttcgcacctcaacttcgcatgaagaaggggttgatcgccattggaatattctgaccaaagagttcatcggcaacgacaaaggtgaagtcacaggtctacgtcttgcagatattgtttggcaagatgcacaaccaggcgaacgcccaagcttcaaagaagtcgaaggtagcgagcgcgtgattccatgtgatatggctttcttggcgatgggtttccttcacccagaaccgcatggtgtacttgcgcagttgaatgtcgcgctggatgagcgcggtaacgtggcaactcaagatttccagaccaatcaacaaggcgtatttgccgcaggtgatatgcgtactggtcaatctttggtggtgcgctgtatcaacgaaggtcgtgaatgtgcacgtgctatcgaccaatacctaatgggcaataccaatctggaagcaaaagccgattcactcatgctttctgcttaa

SEQ ID NO: 4510 - protein, 489 aa, Vibrio vulnificus
MGKPTGFLEFGRELPKKLAPAERIKNNKEFVLNAEFGKKINTQASRCMDCGVPFCHNGCPIGNIIPEFNDAVYRDSWEEAWNILSSTNNFPEFTGRVCPAPCESACVLGINQDPITICNIEKTIVETAYREGYAKPKTPRSRTGKKVAIIGSGPAGLAAAEQLNSAGHSVTVFERDEKVGGLLRFGIPDFKLGMDIIDRKINLMAEAGVEFKVNQHVGVDVNAQQIRQEYDVVLLTGGSTVPRDLPVPGRELKGVYFAMQFLAQNNRRANEMDLKGEEIHAAGKHVVVIGGGDTGSDCVGTSNRHGAASVTQVEIMPVPPEKRPANMPWPQYPMILRTSTSHEEGVDRHWNILTKEFIGNDKGEVTGLRLADIVWQDAQPGERPSFKEVEGSERVIPCDMAFLAMGFLHPEPHGVLAQLNVALDERGNVATQDFQTNQQGVFAAGDMRTGQSLVVRCINEGRECARAIDQYLMGNTNLEAKADSLMLSA

SEQ ID NO: 4511 - DNA, 1389 bp, Porphyromonas gingivalis
  CDS (1)..(1389)
atgtcgcgtccacgggctgaaatgcccgaactcgaccccctctatcgtagctccaagatcaatgaagaggtgaatcgcggtttgtcccgtgaggccgctatggccgaagcctctcgttgtctcgattgtccgcaaccgagctgtatggaaggatgtcctgtgagtatcaatatcccgacctttatcaagcagatagaagtaggcgatatactggctgcagcatctactttgcgagagacaagctctttgccggcggtgtgcggacgtgtctgtccgcaagagaagcaatgcgaaagccggtgcatctatacgaaaatgaacaaaccggctgttgccatcggtttcttggaacgctttgccgcagactacgaacgcgaacagggcgcactcaaagttcccgaaatggctcctcgcaacggtatcaaagtggctgtgatcggaagcggtccggccggactttctttctccggagacatggccaagttgggctatgacgtgaccgtattcgaagccctgcacgaaatcggaggagtgctcaagtacggaattccggaatttcgtcttccgaatagtatagtcgattcggagatcaatcttctcgaagagatgggcgtacgctttgagacgaatacgattgtcggccgaacgatcgcatacgatgacctgcatgaagcaggatttcgcggtgtattcgtaggaagtggtgccggtctgcccaatttcatgaatatcccgggtgaaaaccttgtaggagtcatgtcttcgaatgaatacctgacgcgcgtcaatctgatgcatgcgagccaagccgacagcgacacacccgttttcaagggcaagaatgtagctgtcatcgggggcggcaatacggccatggactccgttcgtacggccaaacgcctcggagcagaacgtgccatgatcgtctatcgacgcagcgaagaggaaatgccggcaagattggaagaggtgaagcacgccaaggaggaaggaatagagttcctgacactgcacaatcctatcgaatatatcggcaatgaacgaggccgagtgactgcgatgcgcctgcaaaagatggagcttggcgagccggatgcaggtggtcgtcgtcgtcctgttgcgatcacgggggctatcgaggagatcccggtggacgaagtgattgtaagtatcggtgtatcgcccaatccgctcgttccccgaactatttccggtcttgaagtgacaagcaaaggaaccatcgtcgtcaatgagagcaatcagacagctctccccgatgtttttgccggtggtgacatcgttcgtggcggagccactgtgatattggcgatgggcgatggacggaaagcagcagctgccatgcacgaatatctgaaagcggaatcatag

SEQ ID NO: 4512 - protein, 462 aa, Porphyromonas gingivalis
MSRPRAEMPELDPLYRSSKINEEVNRGLSREAAMAEASRCLDCPQPSCMEGCPVSINIPTFIKQIEVGDILAAASTLRETSSLPAVCGRVCPQEKQCESRCIYTKMNKPAVAIGFLERFAADYEREQGALKVPEMAPRNGIKVAVIGSGPAGLSFSGDMAKLGYDVTVFEALHEIGGVLKYGIPEFRLPNSIVDSEINLLEEMGVRFETNTIVGRTIAYDDLHEAGFRGVFVGSGAGLPNFMNIPGENLVGVMSSNEYLTRVNLMHASQADSDTPVFKGKNVAVIGGGNTAMDSVRTAKRLGAERAMIVYRRSEEEMPARLEEVKHAKEEGIEFLTLHNPIEYIGNERGRVTAMRLQKMELGEPDAGGRRRPVAITGAIEEIPVDEVIVSIGVSPNPLVPRTISGLEVTSKGTIVVNESNQTALPDVFAGGDIVRGGATVILAMGDGRKAAAAMHEYLKAES

SEQ ID NO: 4513 - DNA, 1419 bp, Photorhabdus luminescens
  CDS (1)..(1419)
atgagccagaatgtatatcagtttatcgacttacaacgcgtcgatccgcctaaaaagccgctgaaaatccgcaaaatagaatttgtggaaatctatgagccattttcaacaagtcaggcacagacacaggccgatcgctgtctttcttgcggtaacccttattgcgaatggaaatgtcccgttcataactacattcccaattggcttaaactggctaatgaaggacgtattatggaagcggcggatttatcccatcaaacaaacagcctgccggaagtttgtggtcgtgtttgtccacaggatcgcctttgtgaaggcgcttgcactctgaatgatgagttcggtgcagtaactattggtaatattgaacgctacatcaatgataaagcgattgctatgggctggaagcccgatatgtcacacgttcagcccacgggcaaacaggttgcgattattggtgcaggccccgcggggctagcttgtgctgacgtattgacccgtaatggcgtacaagccgttgtttttgatcgtcacccggaaatcggtggattactcacctttggcatacccgcgttcaaactggaaaaagaggtcatgatacgccgccgtgaaattttctctgagatgggaattgaattccggctcaatactgaaataggcaaagatattgccttatctgaactgactgagcagtttgatgcgatatttcttggcgtaggaacctatcagtcaatacgtgggggactggcaaatgaagatgctgatggtgtttatgatgctctaccatttctgactgccaatacccggcatttgatgggttatcccgccctaccatcgcaacctttcatcaatatgcaaggcaagcgggtcgtagtgcttggtggcggtgatactgcaatggattgtgtcagaacggctattcgtcaaaaagcggcttcggttacttgtgcttatcgtcgtgacgaaaccaacatgccaggctcccagcgtgaagtcaaaaattccaaggaagaaggtgtagaatttctgtttaatctgcaaccagtcaggattgaaatcaaccattcaggtcaagtttgtggcataaacatggtacggactcaattaggccaacctgatgagaatggacgccgccaagctgaaattatcgcaggctcggaacacctgcttaaggccgatgcagtgatcatggcattcggctttaaaccacataccatgaactggctaagtgctcatcaagtaaccttggataaacaaggacgcattgtcgcaccagagtactcagacattccctttcaaactagcaatccgcagatatttgctggtggagatgctgttcgtggctcagatctcgttgtaaccgcaattgccgaggggcgcaaagccgcacaaggcattcttgattatctcaacatctag

SEQ ID NO: 4514 - protein, 472 aa, Photorhabdus luminescens
MSQNVYQFIDLQRVDPPKKPLKIRKIEFVEIYEPFSTSQAQTQADRCLSCGNPYCEWKCPVHNYIPNWLKLANEGRIMEAADLSHQTNSLPEVCGRVCPQDRLCEGACTLNDEFGAVTIGNIERYINDKAIAMGWKPDMSHVQPTGKQVAIIGAGPAGLACADVLTRNGVQAVVFDRHPEIGGLLTFGIPAFKLEKEVMIRRREIFSEMGIEFRLNTEIGKDIALSELTEQFDAIFLGVGTYQSIRGGLANEDADGVYDALPFLTANTRHLMGYPALPSQPFINMQGKRVVVLGGGDTAMDCVRTAIRQKAASVTCAYRRDETNMPGSQREVKNSKEEGVEFLFNLQPVRIEINHSGQVCGINMVRTQLGQPDENGRRQAEIIAGSEHLLKADAVIMAFGFKPHTMNWLSAHQVTLDKQGRIVAPEYSDIPFQTSNPQIFAGGDAVRGSDLVVTAIAEGRKAAQGILDYLNI

SEQ ID NO: 4515 - DNA, 1431 bp, Chromobacterium violaceum
  CDS (1)..(1431)
atgggagagaacaagatgtccgatgtattccagttcatgaagctgtcgcgcaacccaggcgaaaaggtcgaagcgtcggtgcgcaaggtcgagttcaaggaaatctaccagccgctgcacgcggtggatgccgccgaccaggccggccgctgcctgtcctgcggcaatccgtattgcgagtgggagtgcccggtgcacaactacattcccaactggctgaagctggtggaggaggggcgcctgttcgaggcggcggagttatcgcatcagaccaacagcctgcccgagatctgcggccgggtctgcccgcaagaccggctgtgtgagggggcctgtaccttgaatcaggggggcttcggcgcagtatccatcggcagcatagagaagtacattaccgacgaggcattcaaggcgggttggcgtcccgacatgtccaaggtggtttggacggataagactgtggggatcatcggcgctggtcccgcgggcctggcctgtgccgacgtgttggtgcgcaatggggtcaaggctgtggtgtatgaccgctatgaggagatcggcgggttgttgacctttggtattccggagttcaagttggaaaaaagcattgtccaccgccgcagagagatactggaaggaatgggggtggagtttgtgctgaatactgaggtcggcaaggacatcagctttgacaagcttatgattaagcacgatgccgtgtttatgggtatgggcgcgtacaaggccatgcgggggggctttcctggagaagacagcaagggtgtgctgcaggctttgccctatctgattaataatgtgcgccagtctatgggaaccttgcctgtagacgaagcagccatctcgatgaagggcaagcgagtattggtgctgggtggcggggacactgcgatggactgcaaccgcactgcgatccgacaaggcgcgaaacgtgtgatctgcgcttaccgtcgcgacgaggccaatatgcccggttccagacgagaagtcagcaacgcgcgcgaagaaggggtggagtttttgtggaaccggcagcctttggcgattgagccgatgataggcggcaccctggctgtgaagctgggcgagactcggctgagcgaggctggagccaaggggcgaagcgctgttgaacttgtgccgggggggggggaggtcttagaatgcgaccacgttatcatagcgttcgggtttcaagccgaagcggctgcttggtttgacgcctgcggggtacgaactgaaaatgggtccggtagaaccaaagtctcccgaggaggcaagtacccttaccagactagcaatcccaaagtatttgccggaggggatcaagttcgaggcgcggatcttgttgtgcgcgcagtgttcgaggggcgtcaggctgcggagtcgttgtgcgcgtatttgtttgactag

SEQ ID NO: 4516 - protein, 476 aa, Chromobacterium violaceum
MGENKMSDVFQFMKLSRNPGEKVEASVRKVEFKEIYQPLHAVDAADQAGRCLSCGNPYCEWECPVHNYIPNWLKLVEEGRLFEAAELSHQTNSLPEICGRVCPQDRLCEGACTLNQGGFGAVSIGSIEKYITDEAFKAGWRPDMSKVVWTDKTVGIIGAGPAGLACADVLVRNGVKAVVYDRYEEIGGLLTFGIPEFKLEKSIVHRRREILEGMGVEFVLNTEVGKDISFDKLMIKHDAVFMGMGAYKAMRGGFPGEDSKGVLQALPYLINNVRQSMGTLPVDEAAISMKGKRVLVLGGGDTAMDCNRTAIRQGAKRVICAYRRDEANMPGSRREVSNAREEGVEFLWNRQPLAIEPMIGGTLAVKLGETRLSEAGAKGRSAVELVPGGGEVLECDHVIIAFGFQAEAAAWFDACGVRTENGSGRTKVSRGGKYPYQTSNPKVFAGGDQVRGADLVVRAVFEGRQAAESLCAYLFD

SEQ ID NO: 4517 - DNA, 1293 bp, Anopheles gambiae str
  CDS (1)..(1293)
atgcaggcggatcgctgcctcgactgcggcaacccttactgcgagtggaagtgcccggtccacaactacatccccaactggctgaagctggccaacgagggacgcattctggaggcggtggagctctcccaccagaccaacagcctgccggaggtgtgtggccgggtctgtccgcaagacagactgtgtgagggtgcctgcaccctcaacgatcgcttcggtgccgtcaccatcggcaacatcgaaaaatacatcaccgacaaggcgttcgagatgggctggaagcccgatctctccaaggtggtcaagaccggcaagcgggtcgccgtcatcggcgccggcccggcgggtctcgcctgtgccgatgtgctggcacggggcggagtcaccccggtggtgttcgacaagtatccggagatcggcggcctgctcaccttcggcatcccctccttcaagctggaaaaagaggtgatgcagcgtcgccgcgagatcttcgaggggatgggggtggagtttcgcctcgagaccgaagtgggtcgcgatgtcaccttcgccgacctgctcggtgagttcgatgcggtcttcctcggggttggcacctacaagtacatgaagggcggctttgccaacgaggaggcaccgggagtctacgacgccctgccctacctcatcgccaatgccaaccggctgctgggctttgagaaggcgcaaaccgactacatcgacttcgccggcaagcaggtagtggtgctcggcggcggtgataccgccatggactgcgtacgtaccgccatccgtcagggggccgacaaggtgatctgcgcctatcgccgcgacgaggagaacatgccgggctccaagcgggaggtgaagaatgcccgcgaagagggggttgaattcatgttcaacctgcagccggtcggcgtcgagctggacgcccagggccgcacctgcggcatcaaggtggtgagcacagagctcggcgcccccgatgccaatggccgccgcaacccggtggtgatcgccggctccgagcaggtgctggctgccgatgcggtggtgatggcgttcggcttccagcccaacccccagccctggatggcggaacacggcatcgagcttgacggccgggatcgcatcaaggcctcggagcaggccgaacatgccttccagaccagcaaccccaaggtgttcgccggtggcgacgcggtgcgcggctccgatctggtggtgaccgccatctatgaggggcgcaaggcggccgaagggatcatggactatctggccgtgtga

SEQ ID NO: 4518 - protein, 430 aa, Anopheles gambiae str
MQADRCLDCGNPYCEWKCPVHNYIPNWLKLANEGRILEAVELSHQTNSLPEVCGRVCPQDRLCEGACTLNDRFGAVTIGNIEKYITDKAFEMGWKPDLSKVVKTGKRVAVIGAGPAGLACADVLARGGVTPVVFDKYPEIGGLLTFGIPSFKLEKEVMQRRREIFEGMGVEFRLETEVGRDVTFADLLGEFDAVFLGVGTYKYMKGGFANEEAPGVYDALPYLIANANRLLGFEKAQTDYIDFAGKQVVVLGGGDTAMDCVRTAIRQGADKVICAYRRDEENMPGSKREVKNAREEGVEFMFNLQPVGVELDAQGRTCGIKVVSTELGAPDANGRRNPVVIAGSEQVLAADAVVMAFGFQPNPQPWMAEHGIELDGRDRIKASEQAEHAFQTSNPKVFAGGDAVRGSDLVVTAIYEGRKAAEGIMDYLAV

SEQ ID NO: 4519 - DNA, 2733 bp, Giardia lamblia ATCC 50803
  CDS (1)..(2733)
atgaagcagaatacaactgatgatatgagccatactgctacgccgatatgtattgaaaacgacggatacgttactccagcagataaaacaccgagctctgtaggcgtggctccgacagccccaagtgtcaagccgtttacaattgtaaaacgaactgttctctggaaagaccccgagacggttgagctgacatgctacgctcctgaagttgctgaggccagtaaggccgggcacttcgtcacagtcaaagcctatgctccctccgaaagacttccgatccctatcagcgactgtgatcccgttaagaagaccatcacgttcatttgttcatccataacgcatgcaacaagcaagatagtatcctttgctgaaggtcagagtctgtcatcaattactgggcccttaggtcatgcggctgatattacagcaaagatgggccacgtagcagtagttgcagaaggggctgggcttggtcctgttcagctatacgctaggtcaatccatcagctgcccggtaacagcgtatctgcttttatcggtgctccgtcaaaggaccagctcgttggagaaaacaagcttgcagaaacagtcgatgctctttcagtggtgattgctgatgaaatccctccagaaaagaaggaaaagggacttgtaggggtattcgaagattttcttcaagaaactctgaagactcctcagaagtatgtacctgtggaccttgtctacgtgatgggaccttatccattgcttcgtaagatttctgaactcactagggattacggcattcgcactatcggtcttctcagcaccgttacagtcgatgggtccatgcttctcgggactttccgggtagaattgtataacgagctcccgtatctcacgagcatttatgataaatatgctcttcgtaaggaacacgtcccttcccatattccatgcattaatttggatgagtttgtcagaagcaatattaatcccagcttttccaaaggtaagattagcactagctatgtctttgtcgacggtccagaagttgacgctcatcgtatttcttgggagaagtttagacttgggacaagtatttattcgtctacaacatcttcagctggtaatgcacacaagaagggtccatctgtacgttcagtaaagcctgctcccacacagacaccaatgcctatgcagcatcctaaagttcgctgtcataactgggccgaaatatctctaggctacactccagaaatggcactgatggaggcgtcacggtgcttgcagtgtaagaagcctatgtgtgtcaggggctgtccagtacaagttccaataccccagttcattaaaaagatcactgagcgggacttccttggagcatataaaatcataaagactgcacataattgtccgtctgttactggacgtgtctgccctcaagagaaccagtgccagtctgcagagggaaattacgggtgtatcctttgtcgtactggtaaagagcctgttggcattgggaagctagagcggtttgttgccgactacgtgcgcgaaaacaatttggaggatgaatcacttaaggatggtaaaaatatgcctgagatagttttgtccgggtataaagttgctataattggctctggcccgacaggtcttgcagccgcccgggagtgtgcacttgcgggtcattatgttacaatctttgaggcactagatcagcctggtggtgtattaaattacggaatccctaagttccggttgccaaagcaaatagttgctcacgaaataaatagtgttaagcgcttggggctcgtcgatataaagacaaagactgtcgtggggaaggacgtcactatcccacaactccaaagcgaggggtacactgccatattcatcggtacaggtgtaggaataccacgtagccttggcatccctggagaagaccttccaggtgtcttcacagcaaacgagtttttgaagaggtgtaacctagaagacaactgtgtatttccattcattagcagagctgacagtaacgagccacgcaaaaaggtcgtggtcattgggtgtggaaatgttgcaatggattgtgcttcgtctgcacgaaggctaggagctgatgttgtagtggtatatcgtcgtcgtctacaggattctcctgcgcgttttgaggagatcgagagtgccgaagcagaaggagtctactttgctaccttaaattcgcccttagaaataatccctaacgatagccgtaccggcataaagggactaaggtgccaggttaactccttcgaagcaggagctattgtgcccttggatggagaattttccttttttgcctgtagtatgattattgttgcggtaggatttgggcctaataacattatcgtgaagacgacagaaaatttgaagataaatgacaaaggtcttgtgattactgatgagaacttcgagacttctgtcccaggtgtcttttgcgcaggagatgttcagactggggctgcaaccgtcatcaaggcccttggcaatggaaaggttgcaggtcaaagcatgaacttttggattgcacagaatcatgcgacacttcctcgagacaatgatctcttcggaaaagtaattagccctggtatttgtccacccgcagaaaaagttgacaggcctccacaggatgctctttctgtgtcttcctctgcgacctcacttctcctcaacagcgatatagaggagactctgaccactcacatatag

SEQ ID NO: 4520 - protein, 910 aa, Giardia lamblia ATCC 50803
MKQNTTDDMSHTATPICIENDGYVTPADKTPSSVGVAPTAPSVKPFTIVKRTVLWKDPETVELTCYAPEVAEASKAGHFVTVKAYAPSERLPIPISDCDPVKKTITFICSSITHATSKIVSFAEGQSLSSITGPLGHAADITAKMGHVAVVAEGAGLGPVQLYARSIHQLPGNSVSAFIGAPSKDQLVGENKLAETVDALSVVIADEIPPEKKEKGLVGVFEDFLQETLKTPQKYVPVDLVYVMGPYPLLRKISELTRDYGIRTIGLLSTVTVDGSMLLGTFRVELYNELPYLTSIYDKYALRKEHVPSHIPCINLDEFVRSNINPSFSKGKISTSYVFVDGPEVDAHRISWEKFRLGTSIYSSTTSSAGNAHKKGPSVRSVKPAPTQTPMPMQHPKVRCHNWAEISLGYTPEMALMEASRCLQCKKPMCVRGCPVQVPIPQFIKKITERDFLGAYKIIKTAHNCPSVTGRVCPQENQCQSAEGNYGCILCRTGKEPVGIGKLERFVADYVRENNLEDESLKDGKNMPEIVLSGYKVAIIGSGPTGLAAARECALAGHYVTIFEALDQPGGVLNYGIPKFRLPKQIVAHEINSVKRLGLVDIKTKTVVGKDVTIPQLQSEGYTAIFIGTGVGIPRSLGIPGEDLPGVFTANEFLKRCNLEDNCVFPFISRADSNEPRKKVVVIGCGNVAMDCASSARRLGADVVVVYRRRLQDSPARFEEIESAEAEGVYFATLNSPLEIIPNDSRTGIKGLRCQVNSFEAGAIVPLDGEFSFFACSMIIVAVGFGPNNIIVKTTENLKINDKGLVITDENFETSVPGVFCAGDVQTGAATVIKALGNGKVAGQSMNFWIAQNHATLPRDNDLFGKVISPGICPPAEKVDRPPQDALSVSSSATSLLLNSDIEETLTTHI

SEQ ID NO: 4521 - DNA, 8874 bp, Plasmodium yoelii yoelii
  CDS (1)..(8874)
atgaaaaagaagaaatcggccaaacatggcttatacgatagccgttatgaaaaagatgcgtgcggggttggagttgtagcagatataaatggaaaatcttcaaggatggtaattcaaaaggctatgcaaatattattgcgactaagccacagaggaggtgtacaatcaaataatggagatggtgcaggaatattagttggcatgccgcatgaatattttcaaatgctaagtgatacatgccaattaccttttttattgccagaaaaaggggattatgcagttgctcaaatatttttaccacataatgaagaaagaagattatttttatatcatgaaatagaaagggaagtgtataaccatggtttggttgttttaggatggcgatcacctatacctgttagaagtgacgtcataagtgctacagtaaaaaaaagtgaaccttttattgctcaaatgtttgtatgcaaaagatcagtatttaaaaattatgacgattttaatatataccccttttcggatataaattttacagatgatacaaatttaaatttaaatgaattacctggtgatatagaattactttcattttttataagaaaaaaattagtaagacataatgatatgtatttttgcagcttttcttcaagaacaatagtatataaaggtttattaactccatcacaaatatacttatattttgaagatttgctaagtgagcaatttaccacttatttagctatggttcatgtaagattttcaacaaatacatcccctacatggtatgctgcccatccatttagacgaatttgccataatggtgaaataaatacaattagtgttaattcattattatttaaagagaggatgcaactagctaaagcacctgattttttcaaatccgtttctataaaagatttaaagccaattaatgaagaaaaatacattatttatgataatgacgatgaaataatacataaaagagacacatttgaagatattatgttgacaaaaaatcgattaaaaaaaaaatcgagacgaaatttattactaaaattaaaaagagattatacatataatagctccgcattaaactatcaaataaaaagagaatacatgaattcagatattaatagtaattctgaatttttaaataatatgaatgaacaatctaagagttcttcagatgacttattagatataaatgaaaaagatagccatatgaaaaatgctaagaaatttattacaggcaatactggtataagcaatccaaatgattttggaaaatccatgaaatcacaaataaaatacggtgaaagtaaaaaaaccaaaggagaattaagttttccgtctgattcttctttatttgacaatgcaatagattttctgactatgacagggagagaaatcgaacatgcagttatgatgctaatgccaagagcatatcaaaaagatccaaatataactcctttagaaaaagcattttatgaatatcatacatgtttaatggaaccatgggatggaccagctttagttatatttacagacggaaataaagtaggcgcttcattagatagaaatggtttaaggccagctcgatatagtataactaattatgggctatttgtattatctagtgaaaccggggttgttgacttaccctatgataaaattacacataaaggatgtgtatatccaggaaaagttgtgttagtagattttaaagaaaaaacatttcttagacatgaagatgttttaagtaaatttttaaaattaaataattataaaaaatggttagatcattattctatacatttagataatattataaaacctgcatctaatatggaaaatatacgtatgactgcatataaatatggagctattctgaacaaagataactattatcaccatactaatcatgtaaataataatagtactagtaaaataggacaaataaataatccagatcgtcatgatgattctttaataaaaaaattaaaagcttttggttatacttatgacgcatttaacataatcatatctcctatggttaagcatgcagctgatggattgggagcaatgggtaatgatactgctttcccatttcttagttatttacgtagaaacttagtatactattttcaacaaacatttgctcaagttactaatccagctattgatccaattagagaagaaaatataatgtctcttatgagtattttaggtaaagaaggagatatattacattgtacatatacaaattgtcaacggatatttatcaacgggccaatattaaatgagccattgtataatatgctacttcaattgcccgattttccacatataattattgacatgacgataagtttggatcttttggagcatttaatgtcaacagaaaacccaacttcacccacagctaatggcgaaaatgatgacgacaatttcatcaagtttgatgtagtaaaaagctattcatctccaaaaaaatcatttatccaagactatacaccaaaagccgaggattctgcaaaaaaatatgttaaggatgatcctactgcaaataatactggtgggaataagaagccacgtgtattttccaaatatctgataaaatttattgacagaattaatacaaaggttgaaagtgcaattagaagaggtagccaacttattatattatcacatggaaatgtcagcgaatcaagagttccgatattttctataataatcgttggtgcactacataaatatctattaagtaaaaatttaagaacgaaatgctctattattgttaaagccggtgattgttttgaaatacatcatttagctgttttactatcttttggagccgattgtatttatccatttatactttatgaaagtttacaatttataaaatatggtagcaatgaagctagattaagtaatcaacagcttattagtaattatagacatgcaactaattatggtatattaaaaataatgtcgaaaaatggaatatctacattacctagttataaaggttgtggtttaatgcagccattgggtatatctgatgaaattttaaaaaaatgttttattaatgtttgtgactcaataatagggggagtaactttcgaatttgttgaaaaagaaattttaagaatattcaatcacgcataccctaaaagaatattagcattaaatgttaaaaatgctaatgatgagttagatgattttggtgaatatcattttagaaacatagggaatgcacaaattcatatgaatcatcccgaaacaataaatttattacaaagagcaacaaaaactggaaattttgatacttataaaaaatattcagaattgcaaaatgagttaatcaatcattgtgaaataagaggccaattagaaattaattataaaaaatgtccatcttataataaaaaaaaaaaaaaaaatgagcctataaatattaatttagtagagcctattaataaaatattactacgattttgtacaggtgctatgtcttttggttcattatctgaagaagcacatacaactgttgccattgctatgaatagtattggattaaaatcgaatactggggaaggtggagaagctgaggatcgaataatacaacccaataataataataacaatgagcccaatacatcttcagctgttaaacaaatagcatcagccagatttggagttacagcttatagcttagtaaacgcccatgaattacaaataaaagttgcacaaggatcaaaaccaggggaaggaggagaattaccaggttataaagtaaatgcgaaaatcgcttcagttcgtagaagcacaccaggaattggtttgatttcacctccaccacatcatgatatgtattctattgaagatgttgggcaattggtttatgatctaaaaaatataaataaagaagcaaagatatctgttaaattagtttcaaaattaggtattggtgttataacatctggtgtagtaaaaggtaattgtgaacagattctaattagtggtatgtcaggaggtacaggtgcatctaaatggacatcaataaaacatgcaggtttaccttgggaaattggtttagcagaagcacatcaaactttatgcaaatctaaattaagaaaaagagttattttgcaaatagatggacaattaaaaacgggtagagatgttatattaggggcattattaggagcggaatcttttagtttttctactcagccattaattactttaggctgtattatgatgaggaaatgtcatttaaatatatgccctgtaggtatatgtacacaagatccagaattaagaaaaaaatttgcaggaaaaccagaatatgttattaatttttttttcatggtagcaaacgaagttagagaatatttagctagtatgggatttcgaaaattctcacatattattggtagatctgatttattaaaaaaaaaaagtcacttaaaatatgatgaaaaaagaaaacttttagatttttcaaaattattattccctggttggaaatattataccgaagagcaaaataaggaagatggtgataagggttacaccaatagtgaaaaaagaaaaaaaaaaaagaaggaaattgaaaaagaacgcgaaaaggaaaagaaaaaaaaaacgttaaatgcatattcaatgcataataatataattaacaaatataaagaccaacaaagtggtagtttaaccccttctgagaaaaatataagaaaacaggttcttataaatgaaaatttgaacactgatattaagtatgatccatcaaaggaggaacaacatggtgttaatacaataaaggaaagggtagggaaattatcatatgaaaaaattgaagaagatgaggatggagatgatgaagaagaagaggaaagagaagaagaagaaaaggataaaagcacaagtgaagaagatgaagatgaggaagaagaagacgaagaagaagaggaggatgatgaagaagaggaatatggtgaaacagatggagatgatgtaatagaaaaaaatttaagcctaacatacagagaagatatgttaaaaaatgtagataaattgaattttcaaaataaagcattacgaaaaaagtcaaaaagtatatctgaaaaaaaaagtcatgtaaaaaagaaaaaaaataaacctattccaatattttgttgtgaaacacaaaatcataaactgtgtgacattatagacagagaattaataagacgatctaaaattgcacttttaaattgtactcctgtaaatattaatatgccaataaaaaacacagatagagcagttggagcaatgttaagttatcacattattcagaaatatggtgaaaaaagtttaccaatggatactataaatgtaaaatttagaggaacaggaggattatcatttggtgtatttttaactagtggatgtaattttgaattagaaggagatgcaaatgattttgttggaaaaggtttatcaggtggaataatttcagtacattttcctaaatcttcattatttattaatgaatgccaaaaaaatatgatagtaggaaattcagtgttatatggcgcaacaaaaggtcgagccttttttgcaggtagagcgggtgaacgatttgccgttagaaattcaggagctattgctgtagttgaaggtgttggatgtcatggttgtgaatatatgacaaaaggtatagttgtcatattaggagaaattggatgtaactttgcggctggaatgagtggaggtattgcatacgtattagatataaatgaaaagaacgtaaaccatcaaatggttgatttaaaaatatgtaaaactatggatgaaaaaatgactttagaaaaattgttgcatgaacattatgatcgaacaaattcatatacagctaaaatgttattaaatgattttgataaaaatctagaaagattcacaaaagttattccaagagatataaaaagagtattaactgaagcatgcatagaatttgtaaaaacaggaaacgaagaagctgcatctatacttgatgattgggcatctttattaaaaagtgtagatcatcctgaaaatatgtacaaaaaagctatgcaattttttactacaatttctgatgatatatcaggtttatcaaaaacattagcattaaggaatgtagatggattaattatatatgatatattacaaggaagtaatcatagaaaattattaagaattaaaaatgtgggatctaatttggttaatgattccaattttaatacagaagaaaatatcagctttgaatccgaccaaaataaaatattcgattttgaaaagtttacatataatctagaattatgtagagctaataatagaaaatggaggagatacgtgcaaataccatttaaatgtactgctttttctgattttaaaaatatattcccaaatcgtcttgatgataagtctaaagaaattattaaaaagtacatactaaatgagcaatatttactagatgtacatcttaaatcacttaattcaaatcaatttattgaagggttgctaaatagagaagatgaaagagatgcttatattaaccaaaaacagattaatccaaatatttattcttttaaaaatatgttttatcccgctgattataatgatttattatgtataacagatgagaaaaaaagtgaacaatccatctctataaatcctgatactaacaagtcaaatacagaatccaacgaaaacattaataaaacagataaaggaactagcgaaaatactacaatagatacacaaattgttatacaagaaaaaatacctaaaaaaattaatataataaataatactgaaaatgaaacaggagaaaatattccacgaacatccattgataatataaatcaatcaaaaaatgataattcaattaaaccatttttagttgctaatccaaataaagttacagggtttatggaatatgaaagattatcacatccattaaaagatgtaagtagtagagtgttagattattctgaaattatagttccaataaatgtaaaaagtaagctacataatcaacttctaaaaacgcaatcttctagatgtgtagattgtggaacaccaacctgccattacccaaattctagaggtggaggatgcccattaggtaataggatatatgattggaataacctgatttatgaaaacgaatggaaaaaagcattggaacgattattagacacaaataattttccagaaattacgggaagagtatgtccagctccatgtgaagatgcatgcatattaagcataaatgaaaaaccagtttctataaagtttattgaattatctattattgaatgtggttttataaaaaaatggatacaaccaattataccacgtacaagaacgggaaaaaaagttgctataatcggatcaggaccaagtggtttaacagcagcacaacaattaaataaagctggacatcatgttgtcatatatgaaaaaggagaatatttcgggggattattaatgaacggtatacctagtgtaaggttagataaaaaaattatagaaagaagaataagtttaatgaaaaaagaaggaataactatgaaaaataatataaatattggagttgatataaaattaactgaattaatgcaaaattatgatgccattttattagctactggttatgaaatacctagaaaattaaatatacccggatctaatttaaataatatattttatgcaatggattttttatcatcctttcaaaaatccctaattaaatctgatttaatggatgaccaatatatagatgtatctgaaaaacatgttattatattaggtggtggtaaaacagctgcagattgtataagcttagctatacgtatgggtgcagctagcgttttacaatttacaagaaaagaagctccgcctattaataaaaataaaaattcttggcctggtttaaaaaatatatttaaagtcgaatattcacatgatgaagctattgttatacaaggaaaagatccaagagaattttgtataagaagtttggaatttattccttcaaataaagatcctaaaagagtatctggtataaaggctatcaaagttaagccaaaaagaggtaatatcacacgcaatggagttaataattctattaaaagagacttaagtaaacgtacaccctcccctcaatataataattcgactactaatttaaataccagtattagcggaattacaacaacaggaaatgaatctacaaatacaaatggcagtttttccactatactagctaatactccctctatggatactaattcgcaaaaaaacagtgccaaaaagcagtgtattaacaaaaacaataaattaaagcagaataaaaacacagctaaaagaaattcagatgaatctcctatttcaaataatagcaattacaatcataaaataaataatatgaataatgaagtagtgaaaaattatcaagttgtaaagccagaaaaggaatatgttgatattccatttacagaaagggtttataaagcagatatcataattttagctcttggatttttaaaaacagatgattcaatatgggaaaatgatactattaaaatagaattagataattataattgtataaaaacacataataatatttatcaaacagcacataaaaaaatatttgcgtgtggagattgcagaatcggaccaagtaccgtcgtacaagctattgcagaaggaagagatgttgcttctaaaatagatgagttcttgacaaattcaacttcaattttacccccttgtaacacatattattattatcctaaaaactataaatataccccatttagttctgcacattggggataa

SEQ ID NO: 4522 - protein, 2957 aa, Plasmodium yoelii yoelii
MKKKKSAKHGLYDSRYEKDACGVGVVADINGKSSRMVIQKAMQILLRLSHRGGVQSNNGDGAGILVGMPHEYFQMLSDTCQLPFLLPEKGDYAVAQIFLPHNEERRLFLYHEIEREVYNHGLVVLGWRSPIPVRSDVISATVKKSEPFIAQMFVCKRSVFKNYDDFNIYPFSDINFTDDTNLNLNELPGDIELLSFFIRKKLVRHNDMYFCSFSSRTIVYKGLLTPSQIYLYFEDLLSEQFTTYLAMVHVRFSTNTSPTWYAAHPFRRICHNGEINTISVNSLLFKERMQLAKAPDFFKSVSIKDLKPINEEKYIIYDNDDEIIHKRDTFEDIMLTKNRLKKKSRRNLLLKLKRDYTYNSSALNYQIKREYMNSDINSNSEFLNNMNEQSKSSSDDLLDINEKDSHMKNAKKFITGNTGISNPNDFGKSMKSQIKYGESKKTKGELSFPSDSSLFDNAIDFLTMTGREIEHAVMMLMPRAYQKDPNITPLEKAFYEYHTCLMEPWDGPALVIFTDGNKVGASLDRNGLRPARYSITNYGLFVLSSETGVVDLPYDKITHKGCVYPGKVVLVDFKEKTFLRHEDVLSKFLKLNNYKKWLDHYSIHLDNIIKPASNMENIRMTAYKYGAILNKDNYYHHTNHVNNNSTSKIGQINNPDRHDDSLIKKLKAFGYTYDAFNIIISPMVKHAADGLGAMGNDTAFPFLSYLRRNLVYYFQQTFAQVTNPAIDPIREENIMSLMSILGKEGDILHCTYTNCQRIFINGPILNEPLYNMLLQLPDFPHIIIDMTISLDLLEHLMSTENPTSPTANGENDDDNFIKFDVVKSYSSPKKSFIQDYTPKAEDSAKKYVKDDPTANNTGGNKKPRVFSKYLIKFIDRINTKVESAIRRGSQLIILSHGNVSESRVPIFSIIIVGALHKYLLSKNLRTKCSIIVKAGDCFEIHHLAVLLSFGADCIYPFILYESLQFIKYGSNEARLSNQQLISNYRHATNYGILKIMSKNGISTLPSYKGCGLMQPLGISDEILKKCFINVCDSIIGGVTFEFVEKEILRIFNHAYPKRILALNVKNANDELDDFGEYHFRNIGNAQIHMNHPETINLLQRATKTGNFDTYKKYSELQNELINHCEIRGQLEINYKKCPSYNKKKKKNEPININLVEPINKILLRFCTGAMSFGSLSEEAHTTVAIAMNSIGLKSNTGEGGEAEDRIIQPNNNNNNEPNTSSAVKQIASARFGVTAYSLVNAHELQIKVAQGSKPGEGGELPGYKVNAKIASVRRSTPGIGLISPPPHHDMYSIEDVGQLVYDLKNINKEAKISVKLVSKLGIGVITSGVVKGNCEQILISGMSGGTGASKWTSIKHAGLPWEIGLAEAHQTLCKSKLRKRVILQIDGQLKTGRDVILGALLGAESFSFSTQPLITLGCIMMRKCHLNICPVGICTQDPELRKKFAGKPEYVINFFFMVANEVREYLASMGFRKFSHIIGRSDLLKKKSHLKYDEKRKLLDFSKLLFPGWKYYTEEQNKEDGDKGYTNSEKRKKKKKEIEKEREKEKKKKTLNAYSMHNNIINKYKDQQSGSLTPSEKNIRKQVLINENLNTDIKYDPSKEEQHGVNTIKERVGKLSYEKIEEDEDGDDEEEEEREEEEKDKSTSEEDEDEEEEDEEEEEDDEEEEYGETDGDDVIEKNLSLTYREDMLKNVDKLNFQNKALRKKSKSISEKKSHVKKKKNKPIPIFCCETQNHKLCDIIDRELIRRSKIALLNCTPVNINMPIKNTDRAVGAMLSYHIIQKYGEKSLPMDTINVKFRGTGGLSFGVFLTSGCNFELEGDANDFVGKGLSGGIISVHFPKSSLFINECQKNMIVGNSVLYGATKGRAFFAGRAGERFAVRNSGAIAVVEGVGCHGCEYMTKGIVVILGEIGCNFAAGMSGGIAYVLDINEKNVNHQMVDLKICKTMDEKMTLEKLLHEHYDRTNSYTAKMLLNDFDKNLERFTKVIPRDIKRVLTEACIEFVKTGNEEAASILDDWASLLKSVDHPENMYKKAMQFFTTISDDISGLSKTLALRNVDGLIIYDILQGSNHRKLLRIKNVGSNLVNDSNFNTEENISFESDQNKIFDFEKFTYNLELCRANNRKWRRYVQIPFKCTAFSDFKNIFPNRLDDKSKEIIKKYILNEQYLLDVHLKSLNSNQFIEGLLNREDERDAYINQKQINPNIYSFKNMFYPADYNDLLCITDEKKSEQSISINPDTNKSNTESNENINKTDKGTSENTTIDTQIVIQEKIPKKINIINNTENETGENIPRTSIDNINQSKNDNSIKPFLVANPNKVTGFMEYERLSHPLKDVSSRVLDYSEIIVPINVKSKLHNQLLKTQSSRCVDCGTPTCHYPNSRGGGCPLGNRIYDWNNLIYENEWKKALERLLDTNNFPEITGRVCPAPCEDACILSINEKPVSIKFIELSIIECGFIKKWIQPIIPRTRTGKKVAIIGSGPSGLTAAQQLNKAGHHVVIYEKGEYFGGLLMNGIPSVRLDKKIIERRISLMKKEGITMKNNINIGVDIKLTELMQNYDAILLATGYEIPRKLNIPGSNLNNIFYAMDFLSSFQKSLIKSDLMDDQYIDVSEKHVIILGGGKTAADCISLAIRMGAASVLQFTRKEAPPINKNKNSWPGLKNIFKVEYSHDEAIVIQGKDPREFCIRSLEFIPSNKDPKRVSGIKAIKVKPKRGNITRNGVNNSIKRDLSKRTPSPQYNNSTTNLNTSISGITTTGNESTNTNGSFSTILANTPSMDTNSQKNSAKKQCINKNNKLKQNKNTAKRNSDESPISNNSNYNHKINNMNNEVVKNYQVVKPEKEYVDIPFTERVYKADIIILALGFLKTDDSIWENDTIKIELDNYNCIKTHNNIYQTAHKKIFACGDCRIGPSTVVQAIAEGRDVASKIDEFLTNSTSILPPCNTYYYYPKNYKYTPFSSAHWG

SEQ ID NO: 4523 - DNA, 1467 bp, Mycobacterium bovis
  CDS (1)..(1467)
atggctgatccgggcggcttcctcaaatacacccaccggaaattgccgaagcgacggccggtcccgctgcggctgcgagactggcgggaagtctacgaggaattcgacaacgagagcctgcgccaacaggcgacccgctgcatggattgcggcattccgttctgtcacaacggatgtccgctgggtaacttgatcccggaatggaacgatctggtccgccggggccgctggcgcgacgcaatcgaacggctgcacgccaccaacaacttccccgacttcaccggccggttgtgcccggctccgtgcgagccggcgtgtgtgctgggcatcaaccaggatccggtgacgatcaagcagatcgagctggagatcatcgacaaggccttcgacgaaggatgggtgcaaccacgtccgccgcggaagctgaccgggcaaacggttgctgtggtgggttcggggccggcgggtttggccgccgcccagcaactcacccgggcgggtcacaccgtcaccgttttcgagcgcgaagaccgcatcggcgggctgctgcgttacggcatcccggaattcaagatggaaaagcggcatcttgatcggcgtttggaccaaatgcgctccgaaggaaccgaattccggccgggcgtcaacgtcggggtcgacattagcgccgaaaagctgcgcgctgatttcgatgcggtcgtattggccggtggcgcaaccgcttggcgcgagctgccgattcccggccgcgagctggagggcgtccatcaggcgatggagtttctgccgtgggccaaccgggtgcaagaaggagatgacgtcctcgatgaggacgggcagccgccgatcaccgcaaagggcaagaaggtcgtcatcatcggtggcggcgacaccggggcggactgcctgggtaccgtgcaccgccagggcgcgatcgccgtgcaccagttcgagatcatgccgcgtccaccggacgcccgcgccgaatccaccccatggccgacttacccgctgatgtatcgggtatcggccgcgcatgaggagggtggcgagcgggtgttctcggtcaacaccgaggcgttcgtcggcacggacgggcgcgtgagcgcgctgcgggcacacgaagtgaccatgctggatggcaagttcgtcaaggttgagggctccgacttcgagctcgaagccgacctggtgttgctggcgatgggtttcgtcggcccggaacgggcgggcctgttgaccgacctcggagtgaagttcaccgagcatgggaacgtggcccgtggcgacgacttcgacacctcggttcctggtgtgttcgtagccggtgacatgggccggggccagtcattgatcgtctgggcgattgccgagggccgggccgctgccgcggccgtagaccggtacttgatgggttccagtgccctgccggcgcctgttaagccgaccgctgcaccgcttcaatag

SEQ ID NO: 4524 - protein, 488 aa, Mycobacterium bovis
MADPGGFLKYTHRKLPKRRPVPLRLRDWREVYEEFDNESLRQQATRCMDCGIPFCHNGCPLGNLIPEWNDLVRRGRWRDAIERLHATNNFPDFTGRLCPAPCEPACVLGINQDPVTIKQIELEIIDKAFDEGWVQPRPPRKLTGQTVAVVGSGPAGLAAAQQLTRAGHTVTVFEREDRIGGLLRYGIPEFKMEKRHLDRRLDQMRSEGTEFRPGVNVGVDISAEKLRADFDAVVLAGGATAWRELPIPGRELEGVHQAMEFLPWANRVQEGDDVLDEDGQPPITAKGKKVVIIGGGDTGADCLGTVHRQGAIAVHQFEIMPRPPDARAESTPWPTYPLMYRVSAAHEEGGERVFSVNTEAFVGTDGRVSALRAHEVTMLDGKFVKVEGSDFELEADLVLLAMGFVGPERAGLLTDLGVKFTEHGNVARGDDFDTSVPGVFVAGDMGRGQSLIVWAIAEGRAAAAAVDRYLMGSSALPAPVKPTAAPLQ

SEQ ID NO: 4525 - DNA, 1503 bp, Rhodopirellula baltica
  CDS (1)..(1503)
atgggcaagcccactggattcaaggaattcgatcgcgaaaaagttgcctggcgtctgccggtcattcgaatcaacgactacgacgagatctacaccgaacccaagaccgagcacctgcagcgccagggcgctcgttgcatggactgcggtgttccattttgtcagtctgccaccggatgtccgatcgacaacttgattcctgagtggaacgacctggtttacaacaaccgttggaaggaagcgatcgagcgtctgcacaagaccaacaacttccctgaattcaccggtcgtgtttgtccggcaccctgtgagggatcgtgcgtgttgggaatcaccaacccgcccgtgacgatcaagaacatcgaaaacgcaatcgtcgaccgtgcctgggaagaaggctggatcgttgccgagccgcctgaacaacgcactggcaaaaaggtcgctgtcatcggcagcgggcctgctggtttgactgccgcagaccaactgaacaaagcgggccatttggtcaccgtctacgaacgcgccgatcgcatcggtggtttgttgcagtacggcattcccaacatgaagttgtcgaagaaagccgttcaacgtcgcgtcgacaaaatgaccgaagaaggtgtgacgttcaaaaccggagtgaatgtcggcgtagacgtctcgcccaaggaattgcagagcgagttcgatgctgtgttgttggcttgtggtgcgaccaagccgcgtgatttgccgatcccgggccgcgaagccaagggcgttcatttcgcgatggacttcctcacctcaaacacaaagcagcgggttcacagtgataatttgggagccgaattcatcagtgccgagggcaaggatgtgatcgtgatcggtgggggtgacaccgggaccgactgcatcggaaccagccttcgtcatggttgtcgcagcatggtcaactttgaactgctgccccaaccacctgctgaacgcgccgatgacaacccgtggcctgaatggcctcgtatcttccgtgtcgattacggacatgaagaagccgaagcgaagtttggcaaggaccctcgtgagtatcagatcctcagcaaagagtatctggtcgacgacgaaggtaagctgaaaggcatcaagaccgtcaatgtcgaatggacaaagaatgacgaaggcggctggcaaatggccgaagtcgaaggcagcgagaaagaatggcctgcccaactgatcttgttggcgatgggtttcttgggaccagagcaaaccgttgcggaatcgctcggcctcgagacggacgctcgcagcaacttccaagcagaacatggcaagtacgcgaccaacatcgacggcgtgtttgccgcaggtgactgccgacgtggtcaaagcttggtggtttgggcgatcaacgaaggccgtggtgccgctcgtgcgatcgacatcttcttggaaggttccagcaacctaccagcccccggccaaacgatgggcacatcaatggccgccgtctga

SEQ ID NO: 4526 - protein, 500 aa, Rhodopirellula baltica
MGKPTGFKEFDREKVAWRLPVIRINDYDEIYTEPKTEHLQRQGARCMDCGVPFCQSATGCPIDNLIPEWNDLVYNNRWKEAIERLHKTNNFPEFTGRVCPAPCEGSCVLGITNPPVTIKNIENAIVDRAWEEGWIVAEPPEQRTGKKVAVIGSGPAGLTAADQLNKAGHLVTVYERADRIGGLLQYGIPNMKLSKKAVQRRVDKMTEEGVTFKTGVNVGVDVSPKELQSEFDAVLLACGATKPRDLPIPGREAKGVHFAMDFLTSNTKQRVHSDNLGAEFISAEGKDVIVIGGGDTGTDCIGTSLRHGCRSMVNFELLPQPPAERADDNPWPEWPRIFRVDYGHEEAEAKFGKDPREYQILSKEYLVDDEGKLKGIKTVNVEWTKNDEGGWQMAEVEGSEKEWPAQLILLAMGFLGPEQTVAESLGLETDARSNFQAEHGKYATNIDGVFAAGDCRRGQSLVVWAINEGRGAARAIDIFLEGSSNLPAPGQTMGTSMAAV

SEQ ID NO: 4527 - DNA, 1710 bp, Prochlorococcus marinus
  CDS (1)..(1710)
atgttggatcctgaagcttctccgccagggacacatacactctgtatatttctaccggaatctactccagagatcacactgccaaccgatggtaaggataaatatcataaccgtacatatcgagatcaaaagcagaaaaaagcatccgcaattattgattacttagaaaagaattatttcccagaacttaaaaaacatatcttggttcaggaaatagctaccccacagacgattcagcgctatacccttaaaagtcatggctctattggtggtccacaggtgaatatgagccaaagttatatgagtcggctggccgctcgcagtgattggcaagggctttattgtgtaggcgattccaccagtcaagggatcggcgtagtgtctgtgactgtgtccgcaatcagtgcagtcaatgccattttaaaggatcttcgtcaacctcaatatctaccattaaagcattatcctaaaaattatgttcattttgctaaagcctctctatctcaaaaacaacattctgcggatttgattcctgaccatcagaagataaaaactgtggaattagatccccgatcttgtttgtctccgcgctgcgttcgtgcgggtccagacagtactcatcaagcccatatcgctcgtcttgtcgaagccggcaattggctaggtgcagcccagtccttacgtgccgttaatccattttcagaatcaacctcttacctttctcaatcagacgatttttgtggctcgtcatgttcgcaatcgttatgtcctgatgcttctattcccattaagtcattaaatcgctatgtatgcgagaaagtccccaactacataccagaggcagctccggataatggtaagcgaatttctattgttggggctgggcctgctggtctaacatgtgcacattatttggcgcgtttgggctaccaaatagacatttacgagaagaaaagtgaagctggagggacgctgaaatcgattgctctagtatcaaggattcctctgtcagtattacatcgtgaaatatcaaacctattattaccttctattaggatttattttggtcaatctttaggagaagacattacaattgctgagcttaggcatcaatatgatgcactctttttagcctgtggtctaggagagaagcaaattcagactaaagatgtcgatcacgattttaacttgattcatgggttgaagtttttagaccaatttactcaggagtcaactattgttagagggaagaccttgacaatagttggcgctacctaccttgctatggatatctcaaagttggcaattcaaaacggtgcaaagaaggtttatctgattgacgagcagtctgaatttcaatcgaaatctcaggctaagcgtttaaatgaaatgcaagaacttggaattgagattcactccagaatagatccttcagctttctctaaactctgtagttcttctcatcaggtgatcatggcaggtttggaacaacagcgtattgaggctcaattaagggagcatctaagttcaagccttttggttgatgttgatgccttggttgacttagacacgctacaggttctgggtcacgtcaatgtattcgccggcggagatatcattagaggctccagtagcattcatgagtcaattagagacggtcgcaaggcagcagcagaaattaatcatgccttcatgatcaagcaatcttga

SEQ ID NO: 4528 - protein, 569 aa, Prochlorococcus marinus
MLDPEASPPGTHTLCIFLPESTPEITLPTDGKDKYHNRTYRDQKQKKASAIIDYLEKNYFPELKKHILVQEIATPQTIQRYTLKSHGSIGGPQVNMSQSYMSRLAARSDWQGLYCVGDSTSQGIGVVSVTVSAISAVNAILKDLRQPQYLPLKHYPKNYVHFAKASLSQKQHSADLIPDHQKIKTVELDPRSCLSPRCVRAGPDSTHQAHIARLVEAGNWLGAAQSLRAVNPFSESTSYLSQSDDFCGSSCSQSLCPDASIPIKSLNRYVCEKVPNYIPEAAPDNGKRISIVGAGPAGLTCAHYLARLGYQIDIYEKKSEAGGTLKSIALVSRIPLSVLHREISNLLLPSIRIYFGQSLGEDITIAELRHQYDALFLACGLGEKQIQTKDVDHDFNLIHGLKFLDQFTQESTIVRGKTLTIVGATYLAMDISKLAIQNGAKKVYLIDEQSEFQSKSQAKRLNEMQELGIEIHSRIDPSAFSKLCSSSHQVIMAGLEQQRIEAQLREHLSSSLLVDVDALVDLDTLQVLGHVNVFAGGDIIRGSSSIHESIRDGRKAAAEINHAFMIKQS

SEQ ID NO: 4529 - DNA, 1479 bp, Bordetella parapertussis
  CDS (1)..(1479)
atgaggattagcatgggaaagatcactggctttatggaattccagcgcctgcaggaggccgccgaggccccgcagaagcgcctcaagcactggcgcgagttcgtcctgcacctgaacgacgaacaggccaagcaacaggcggcgcgctgcatggactgcggcatcccgttctgcagcaacggctgtccggtcaacaacatcatccccgactggaacgacctggtctaccggcaggactggcgccgcgcgctggacgtcctgcactcgaccaacaacttccccgaattcaccggccgcatctgccccgcgccgtgcgaggccgcctgtacgctgaacatcaacagcgacgccgtcggcatcaagtcgatcgagcacgccatcatcgacaagggctgggccgagggctgggtgacgccgcaggtaccggtgcgcaagaccggcaaaaaggttgccgtggtgggctcgggccccgccgggctggcctgctcgcagcagctggcgcgcgccggccattcggtcaccctgttcgagaaaagcgatcgcatcggcgggctgctgcgttacggcattcccgacttcaagctggagaagtcgcagatcgaccgccgcatcgcgcagatggaagccgagggcgtggaattcgctccctcgacctacatcggcaacccggatgacgccgccgccgatgggctgacggtgcgtacgccgcagtcgctgctggcggacttcgacgccgtcgtcatgaccggcggctcggaaaccccacgcgacctgccggtgccgggccgcgagctgtccagcgtgtactacgccatggacttcctgcgccagcagaacaaggccgtcgccggcgatcgcctgagcggccagacgctggccaaggacaagcacgtggtcgtgatcggcggcggcgacaccgggtcggactgcgtcggaaccagcaaccgccacggcgcggcctcggtcacgcaattcgaactgctgccccagccgcccgaatgcgaggacaagcccatggtctggccgtactggccgctcaagctgcgcacctcgtcctcgcacgatgaaggctgcgagcgcgactggtcggtggccaccaaggcgttggccggcagcgacggccaggtcgagaagctggtcggcgtgcgcgtcgagtggttcaaggacgaagccaccggccagatgaagatgcgcgaggtcgaagactcggaattcgaaatcccggccgacctcgtcctgctggccataggctttgtctcgccggtggccacggtgctcgacgcgttcggcgtggaccgcgacgcgcgtggcaacgtgcgcgccaacaccgacgattaccgaaccaatgtcgacaaggtgttcgccgccggcgacatgcggcgcggccagtcgctggtcgtctgggccatacgcgaagggcgccagtgcgcgcgctcggtcgacgagtacctgatgggcgcatccgagctgccgcgttga

SEQ ID NO: 4530 - protein, 492 aa, Bordetella parapertussis
MRISMGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSSVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREVEDSEFEIPADLVLLAIGFVSPVATVLDAFGVDRDARGNVRANTDDYRTNVDKVFAAGDMRRGQSLVVWAIREGRQCARSVDEYLMGASELPR

SEQ ID NO: 4531 - DNA, 1491 bp, Streptomyces avermitilis
  CDS (1)..(1491)
atggccgatcccaagggttttctcaccacaccgcgcgaggaatggccccgccggcccgtcgaggaacgggtgcgggactgggacgaggtgtacgtccccggcgcgctgctgccgatcatcagtcggcaggccgaccgctgcatggactgcggggtccccttctgtcatgaggcctgtccgctgggcaatctgattcccgagtggaacgacctggtctcgcgggaggactggcgtgccgcgagcgaccggctgcatgccacgaacaactttcccgagttcaccgggcggttgtgtcccgcgccgtgcgaggcggggtgtgtgctggccatcaaccagcccgcggtcaccatcaagaacgtcgaggtcgccatcgcggatcgggcgtgggcggacgggttcacgccgccgtgtccgccggagcggctgtccgggaggacggtcgcggtcgtcggctcgggccccactggccttgccgcggcgcagcagttgacgcgggccgggcacacggtcgcggtgttcgagcgggccgaccggatcggcgggctgctgcggtacgggataccggccttcaagatggagaagcggcatctgaaccaacggctcgaacaaatgcgggacgagggaacgaagttccgcacgtcgacggcgatcgggcgggacatcggggcggaggagctgcgggcgcggtacgacgccgtggtccttgccgtgggcgcgacggcctggagggaactggacgtacccggacgggagttggccggcattcatcaggcgatggagtatctgccgctggccgaccgggtgtgcgagggggatctggaggtctcgccgctgtctgcggccggcaagcacgtcatcatcgtgggcggaggcgacaccggcgcggactgcctgggaaccgcggtgcgcgagggcgcggcgtccgtgacccagctcgacatctatccgctgcccgaggcggagcgggacgaggacatcgagccgtggccggtgtatccgaagatctaccggatgtcgcccgcgcacgaggaagcccgtgacctgaagacggcgcccgcggcggacgcggacgcacgactgttcgcggcgtccacgctccgcttcgccggggacgcggcggggcatgtgcgggccttgcacctggtcgaggtcgacgcgcggcgtcggccgctgcccggctccgggcgtacgctgcccgccgacctcgttctgctcgctctcggtttctccggtcccgaccgggacgacgggctggtcgaccagctcggtctcgcactcgacccgcgcggcacgatcactcgggacgcggacttcgcgaccaatgtccccggggtgttcgcggccggggacgcggcgcgcggacagtcgctgatcgtgtgggcgatcgcggaggggcgagcggtggcggcggcggtggaccgccggctgacgggcgccgcgtcgaagctgccggcgccgatagggccgtacgaccggccgatgagggcgtag

SEQ ID NO: 4532 - protein, 496 aa, Streptomyces avermitilis
MADPKGFLTTPREEWPRRPVEERVRDWDEVYVPGALLPIISRQADRCMDCGVPFCHEACPLGNLIPEWNDLVSREDWRAASDRLHATNNFPEFTGRLCPAPCEAGCVLAINQPAVTIKNVEVAIADRAWADGFTPPCPPERLSGRTVAVVGSGPTGLAAAQQLTRAGHTVAVFERADRIGGLLRYGIPAFKMEKRHLNQRLEQMRDEGTKFRTSTAIGRDIGAEELRARYDAVVLAVGATAWRELDVPGRELAGIHQAMEYLPLADRVCEGDLEVSPLSAAGKHVIIVGGGDTGADCLGTAVREGAASVTQLDIYPLPEAERDEDIEPWPVYPKIYRMSPAHEEARDLKTAPAADADARLFAASTLRFAGDAAGHVRALHLVEVDARRRPLPGSGRTLPADLVLLALGFSGPDRDDGLVDQLGLALDPRGTITRDADFATNVPGVFAAGDAARGQSLIVWAIAEGRAVAAAVDRRLTGAASKLPAPIGPYDRPMRA

SEQ ID NO: 4533 - DNA, 1461 bp, Streptomyces avermitilis
  CDS (1)..(1461)
atggctgatcccaagggcttccttacgcacggccgcgaggtcgccaggacccgtccggtcgaggagcgggtcaaggactggaacgaggtctacgtccccggctcgctgctgccgatcatctcgaagcaggccggccgctgcatggactgcggcatcccgttctgccacaacggctgtccgctcgggaacctgatccccgagtggaacgactacgcctaccgcgaggactggacctccgcgtccgagcggctgcacgccacgaacaacttcccggagttcacgggccgcctgtgccccgctccgtgcgagtcggcgtgcgtgctgggcatcaaccagcccgcggtgaccatcaagaacgtcgaggtctccatcatcgacaaggcgtgggacaccggcgacgtcaagccgcaggcccccgagcgcctgtcgggcaagacggtcgcggtcgtcgggtccggccccgccggtctcgccgccgcccagcagctgacccgggccggtcacacggtcgcggtgtacgagcgcgcggaccgcatcggcggcctcctgcgctacggcatccccgagttcaagatggagaagcggcacatcaaccgccgtatcgagcagatgcgcgcggagggcaccaagttccgcacgggtgtcgagatcggccgcgacatcgacgccgcgaagctgcgcaggcgctacgacgcggtggtcgtcgccgcggggtccacgaccgcccgtgacctcccggtccccggccgtgagctcaagggcgtctaccaggcgatggagtacctgcccctggccaacaaggtgcaggagggcgacttcgtggccccgccgatcaccgccgagggcaagcacgtcgtcgtgatcggcggcggtgacacgggcgcggactgcgtgggcaccgcccaccgtcagggcgcggcctcggtcacgcagctggagatcctggcgaagccgggcgaggagcgcgccgcgcaccagccctggccgacgttcccgatgctctacaaggtcacctccgcgcacgaggagggcggcgagcgggtctactccgtcagcaccacccacttcgagggcgacgaggacggcaacgtccagtggctgcacctggtcgaggtcgagttcgtcgacggcaagctgacccagaagccgggcacggagcgcaggatcccggcgcagctggtgacgctggcgatgggcttcacgggcacggaccaggacaacggactggtcacccagttcggcctgggcctcgacgagcgcggcaacatcgcgcgcgacgcggacttccagaccaacgtccccggtgtcttcgtcgcgggcgacgcgggccgcggccagtccctgatcgtctgggccatcgcggagggccgctcggccgccaagggcgtcgaccgcttcctcaccggcgcgagcgaactgccggcgccgatccgtcccacggaccgctcgctgatggtctga

SEQ ID NO: 4534 - protein, 486 aa, Streptomyces avermitilis
MADPKGFLTHGREVARTRPVEERVKDWNEVYVPGSLLPIISKQAGRCMDCGIPFCHNGCPLGNLIPEWNDYAYREDWTSASERLHATNNFPEFTGRLCPAPCESACVLGINQPAVTIKNVEVSIIDKAWDTGDVKPQAPERLSGKTVAVVGSGPAGLAAAQQLTRAGHTVAVYERADRIGGLLRYGIPEFKMEKRHINRRIEQMRAEGTKFRTGVEIGRDIDAAKLRRRYDAVVVAAGSTTARDLPVPGRELKGVYQAMEYLPLANKVQEGDFVAPPITAEGKHVVVIGGGDTGADCVGTAHRQGAASVTQLEILAKPGEERAAHQPWPTFPMLYKVTSAHEEGGERVYSVSTTHFEGDEDGNVQWLHLVEVEFVDGKLTQKPGTERRIPAQLVTLAMGFTGTDQDNGLVTQFGLGLDERGNIARDADFQTNVPGVFVAGDAGRGQSLIVWAIAEGRSAAKGVDRFLTGASELPAPIRPTDRSLMV

SEQ ID NO: 4535 - DNA, 3024 bp, Enterococcus faecalis
  CDS (19)..(3024)
ataaaaggagtgacgttaatgagtgatattatgcatcccatctcaattgaggctttattaaattggatttttagtgagtatcaacaagatggcacaatttttggcattcgtaaattttatcatgcggatcctacaaaaacgatttcgttatttggagaaaaaatggaaaccccttgtggtccagcagcaggtcctcatacacaattagcacaaaatattattgcggcctatttaacaggttctcgtttttttgaagttaagacagtccagatactggatggagaagatttacctgtgagtaaaccatgtatcgcagcagcagatgaatgttacaacgttgagtggtccacagaattgcgcgttccccaagcttatgatgaatacgtcaaagcatggttcgttttgaagttacttagtaaagagttcgagctaggtgacccgaatggtttcatttttaatatgagtgttggctatgatttggcagggattcaatcaccaaaaattgatcgttatattaacgaaatgcagaacgcagaaggaacgccgatttgggcggaatgccaagcagctgccaaaaaatatctatcttattttaaaaaagtagatgacttatatatcgaagcaattagtcctaaagtctgtcattctattacgctgtcgactttacacggttgtccatcagacgaaattgaacgaattgcggcctatttattaagtgaaaaagggctccattcctttattaaatgtaatccaaccatgttaggttatgaatatgcgcgtcaaacgatggatgagctagggtttgattatatggtttttgacgatcaccattttaaagaagatttacaatttgaagaagcagtaccgatgttacaacgtctgcaattattagctaatagtaaaaatctaagcttcggagttaaaattacgaacactttcccggtaacgattgcagcaaatgaattacctggtgatgaaatgtacatgtcaggacgttcgctatttcctcttagtatttcattggcacaaaaattatcagaagcatttgatgggaaactacaaatttcttattctggcggtgcagatattttcaatagtaaagaaatattcgatgctgggatttggccaatcactatggcaacgactctgttgaaacctggtggctatcaacgaatgaatcaagttgctaatgtattaagcgcagcagaatatcctcagatggtccatgtcaacttggataaattagctcaagttgttgagaaagctaaaacacaagcgcgttaccaaaaatcaattaaattaccagaaagtaccaaactaagaaaaacagttccgttaacagattgttatattgctccttgtcgaagtgacggtggttgtccaatcaatcaggatattcctgcttaccttcgttatgtcagtgaaggtaattatttaaaggccttgcaagtaattgtcgataagaatccgttgccttttattactggaaccatttgtgcacatccttgtatgactaaatgtacacgtcaattttatgaagaatctattcatattcgggaagtgaagttagaagcagctgaacatgcttatgatgaattattgacgacactagaaaagccacagccaaaagaaaatgcacctaaaacagctgttgtgggtggaggccctgcagggatctctgctgggtatttattagcacgtgaaggcatgcctgttactgtgtttgaaaaatccgagacaattgggggcgtttgtagccagattgtaccagaatttcgaatttctatggaatctgttcaaaaagacgttcagttagcggaatttatgggagccgaattccgtacaggacaagaggcgccatcattggcggaattgaaaaaccaaggctatacgaatgttatttatgccattggtgcatggaaacatggggtccttcgtttagaatctggtcgagcattgaactcgttagaatttttaaaagcaaatcgagaaaatccaacgattaatccttacggagaacaaattgtcgtcgttggtggcggaaatacagccatggactgtgctcgtgcagccacaacattacctggtgttaaaaaagtctcagtggtttatcgtcggaataaacgcaatatgccagcagatgaagaagaactttatttagctttagaagatggtgttgactttttagaattactttcgccaattaaacatgaaaatcaacaattaacttgtgaaaaaatggtcctaggtgaacgagatgcctctggacgccgtcgaccaattggtacaggagaaatgattgatattcctgctgatacagtgattgccgctgttggtgaaaaagtagatacagaattttaccaagcattaggcattcacacagacaactatgggaaagtcgtttcaaatcaagaaacattggaaacaaatataccaggtgtctatgtcattggtgacgctaatttaggaccagccacaattgttgaagcaatcgctgatgcaaccaaagcggccaataatatttgtcttgtccacaatcatcactatgaaaaagataatttaaatagtgatgtcgcatttgttagaaacaaacggggtatccttgtgacagacgagatgtcttgtagtcaagctagtcgttgcttagaatgctccacaatttgtgaatcttgtatggatgtctgtccaaaccgagcaaatattgttgtgtatgtcgaaggaaaaccacaaattgtccatgttgatcggatgtgtaacgaatgtggcaactgtgaaacattttgcccttatgcaagtgccccttacaaagacaaatttaccttatttaacagtgaagctgatttttatgacagtactaattcaggtttctatgttcaaaatcctgtggataaaatttgtttactgcgtctatggggaacggtgtcaacaattcaattaacagatcaaggattagatgtaccagaagatttaattgcattaatggtaactatgattgaagaatatgcttattgtatgcaagcataa

SEQ ID NO: 4536 - protein, 1001 aa, Enterococcus faecalis
MSDIMHPISIEALLNWIFSEYQQDGTIFGIRKFYHADPTKTISLFGEKMETPCGPAAGPHTQLAQNIIAAYLTGSRFFEVKTVQILDGEDLPVSKPCIAAADECYNVEWSTELRVPQAYDEYVKAWFVLKLLSKEFELGDPNGFIFNMSVGYDLAGIQSPKIDRYINEMQNAEGTPIWAECQAAAKKYLSYFKKVDDLYIEAISPKVCHSITLSTLHGCPSDEIERIAAYLLSEKGLHSFIKCNPTMLGYEYARQTMDELGFDYMVFDDHHFKEDLQFEEAVPMLQRLQLLANSKNLSFGVKITNTFPVTIAANELPGDEMYMSGRSLFPLSISLAQKLSEAFDGKLQISYSGGADIFNSKEIFDAGIWPITMATTLLKPGGYQRMNQVANVLSAAEYPQMVHVNLDKLAQVVEKAKTQARYQKSIKLPESTKLRKTVPLTDCYIAPCRSDGGCPINQDIPAYLRYVSEGNYLKALQVIVDKNPLPFITGTICAHPCMTKCTRQFYEESIHIREVKLEAAEHAYDELLTTLEKPQPKENAPKTAVVGGGPAGISAGYLLAREGMPVTVFEKSETIGGVCSQIVPEFRISMESVQKDVQLAEFMGAEFRTGQEAPSLAELKNQGYTNVIYAIGAWKHGVLRLESGRALNSLEFLKANRENPTINPYGEQIVVVGGGNTAMDCARAATTLPGVKKVSVVYRRNKRNMPADEEELYLALEDGVDFLELLSPIKHENQQLTCEKMVLGERDASGRRRPIGTGEMIDIPADTVIAAVGEKVDTEFYQALGIHTDNYGKVVSNQETLETNIPGVYVIGDANLGPATIVEAIADATKAANNICLVHNHHYEKDNLNSDVAFVRNKRGILVTDEMSCSQASRCLECSTICESCMDVCPNRANIVVYVEGKPQIVHVDRMCNECGNCETFCPYASAPYKDKFTLFNSEADFYDSTNSGFYVQNPVDKICLLRLWGTVSTIQLTDQGLDVPEDLIALMVTMIEEYAYCMQA

SEQ ID NO: 4537 - DNA, 1437 bp, Enterococcus faecalis
  CDS (19)..(1437)
aagagcaggtggagaaaaatggctagaaaaagtcgtataaaaacaccgattgcggaacaagcacctactatcagaaagaataattttgaagaggtttgcttaggctatacattagcagaagggcaagaagaagcgattcgctgtttacaatgtaaaaatgcaccttgtattgctaaatgccccgtgatgattgatattcctggatttattttagctattcgtgaaggaaacatggaacaagcagccgatattttaagtaaatatacgaatttacctgctatttgtggacgcgtttgtccgcaagagaaacaatgtgaacaagtttgtaaattagggaaagccaaaaactttgaaccagtggcaattggcaaattagaacgtttagttgccgattgggcattagaaaatcacaagtttcctaagaaaacagcggaaccaacaaaagggaaaatcgcagtggtcggttctggtccttctgggttaacagttgcgggggatttgtcaaagctaggctacgaagtaattatttttgaagcgcttcatgaagctggtggcgtattaacctatggcatacctgaatttcgattaccgaaaaaaattgttaaacaagaaattgcgagtattgaagccttaggtgtaacaatagaaaccaatgtggtagtaggtaaaacgattacgatggaagaaataatgtcagagtttgatgcctgttatctatcggttggtgcaggggcaccaaattttatgggaatcccaggaactagtttaaatggggtttattcttctagtgaatttttaacacgaatcaatttaatgcatagctatgagtttccagaatatgatacaccgattaaacgtgctaaaaatgttgttgtgattggcggcgggaatgttgcaatggatgccgctcgttcagccaaacgattaggcgctgaaaatgtgaacattgtgtatcgtcgttcgttagaagaattgccagcaagaattgaagaatatcaccattcccttgaagaaggaattaactattattggttaacgaatccaattgcttatttagatgaccaacaaggaaatctagccggtgttgaatgtgtcaaaatggttttaggtgaaccagatgcgtctggaagacgacggccagaaccaattccaaacagcacgtttaccattcctgctgatgcagtaatcgaggcaattggccaaggggcaaatcgagtcttgttatcaacatatccagaaatagaactaaaccaatggggttacattcaagctgatcctaaaacaggagcaacctcaatacctggcgtttttgctgggggcgatatagtcacaggtgctgccaccgttattttagcgatgggcgctgggaaaatcgcagctaatgcaattgatcagtatgtcaaaacacaaaaaacaacagtcacaagcaatgtttag

SEQ ID NO: 4538 - protein, 472 aa, Enterococcus faecalis
MARKSRIKTPIAEQAPTIRKNNFEEVCLGYTLAEGQEEAIRCLQCKNAPCIAKCPVMIDIPGFILAIREGNMEQAADILSKYTNLPAICGRVCPQEKQCEQVCKLGKAKNFEPVAIGKLERLVADWALENHKFPKKTAEPTKGKIAVVGSGPSGLTVAGDLSKLGYEVIIFEALHEAGGVLTYGIPEFRLPKKIVKQEIASIEALGVTIETNVVVGKTITMEEIMSEFDACYLSVGAGAPNFMGIPGTSLNGVYSSSEFLTRINLMHSYEFPEYDTPIKRAKNVVVIGGGNVAMDAARSAKRLGAENVNIVYRRSLEELPARIEEYHHSLEEGINYYWLTNPIAYLDDQQGNLAGVECVKMVLGEPDASGRRRPEPIPNSTFTIPADAVIEAIGQGANRVLLSTYPEIELNQWGYIQADPKTGATSIPGVFAGGDIVTGAATVILAMGAGKIAANAIDQYVKTQKTTVTSNV

SEQ ID NO: 4539 - DNA, 1239 bp, Shigella flexneri
  CDS (1)..(1239)
atgccgcaacaaaattatctggatgaactcactccggcttttacgccgttactggcgattaaagaagcctctcgctgtttattatgtcacgacgctccctgtagtcaggcttgcccggcacagaccgatccggggaaatttattcgctcaatctactttcgtaattttaaaggcgctgccgagacaattcgcgaaaataatgccctcggtgccgtttgtgccagagtgtgcccgacggagaaattatgccaaagcggttgtacccgtgccggtgttgatgctcccattgatatcggccgcttacagcgttttgttactgattttgaacaacaaaccgggatggaaatttatcagcccggtactaaaacgctcggcaaagtcgcgattattggcgcaggtcctgccggattgcaggccagtgtgacactgacaaaccagggttatgacgtcacgatttatgagaaagaagcgcaccccggtggctggttgcgtaacggtattccgcaattccggttaccgcaatcagtgctggatgcagagatcgcccgtattgaaaaaatgggcgtgaccattaagtgcaataacgaaatcggtaaaacactcaccctggagcaactgaaagcggaaaaccgcgcggtactggtcaccgtggggttatcaagcggttccgggctaccgctgtttgagcatagcgacgttgagattgccgtcgacttcctgcaacgtgtacgacaggcgcaaggcgatatcagcattccacaaagcgcattaattatcggcggcggtgatgtcgcgatggacgtagccagcacgctgaaagttctcggctgtcaggcggtaacttgcgtagcacgtgaagagttagatgagtttccggcaagcgaaaaagagtttgccagcgcccgggagctgggcgtttcgatcatcgatggattcacgccagtagccgtggaaggcaataaagtcacgtttaagcatgtacggttatcaggcgaactgacgatggcggcagataaaattattctcgccgtcggtcagcatgccagactggatgcctttgcggagttagagcagcagcgtaacaccatcaaaacacaaaattatcagacccgcgatccgcaagtctttgctgctggcgatattgttgagggtgacaaaaccgtggtctatgccgtgaaaaccgggaaagaagccgccgaggcgattcatcactatttagagggagcttgctcatgttaa

SEQ ID NO: 4540 - protein, 412 aa, Shigella flexneri
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEIGKTLTLEQLKAENRAVLVTVGLSSGSGLPLFEHSDVEIAVDFLQRVRQAQGDISIPQSALIIGGGDVAMDVASTLKVLGCQAVTCVAREELDEFPASEKEFASARELGVSIIDGFTPVAVEGNKVTFKHVRLSGELTMAADKIILAVGQHARLDAFAELEQQRNTIKTQNYQTRDPQVFAAGDIVEGDKTVVYAVKTGKEAAEAIHHYLEGACSC

SEQ ID NO: 4541 - DNA, 1401 bp, Clostridium saccharobutylicum
  CDS (85)..(1329)
atttgtttttttaggataatattgaaaaataataataactaagttagtatactatatatatataaagaaatgaggaattttaagatgacatgtaacgacatacaattattagatgaagcagatagatgtttattgtgcaagaaaccaagatgtaaggaaaattgtccaatacaaacatctattccagagattatatctctttataaagaaaatagattaagagaagcaggagaaattttatttaataacaatccactttcagcagtttgttcactagtatgtattcatgaagatcaatgtaaaggtaactgtataaagggaattaaaggggaaccaataagatttcatgatatagaatatgagatatcaatgaagtatttagaagaggtgagatttgaaaatttaccaaaagataaagatagaatagcaataattggtggaggtccggcaggaataacaattgcattcatattagctaataaaggttatgatgttactatttttgatgcacacgtgaaaataggtggagtacttagatatggtataccagaatacagattgcctaaaaaaatactagatacaattgaagatagacttgttgaattaggaattaaaattagacctaatactcttattgggccagtaataactcttgatagattgtatgaggatggatataaggctatatttattgggactggagtatggaatcctaagactttgaatataaagggagaaactagaggaaatgcacattttgctatagattatttaaagtctccagaagcgtatagattaggagaaaaagttgcagttataggagctggaaatgttgcaatggatgcagcaagaagtgcaaagagaaatggtgctaaagaagtaactgtactttatagaaaaggctttgatgaaatgagtgcgaccaaacaagaaataatggaagctaaggaagatggagttatattcaatttattcaaatcacctattgaaataacagaaaaaggtattagattatcatctacagaaaatgtaacagatgaaaatggtaagatagtaactaaggttattgaaggaaaagaggaattttttgaatgtgattcaataataattgctgtaagccaaactcctaaaacaaatatagtatctaatacaaaagaacttaacactaataaatggggattaattattacagatgaaaaaggaaatacaactagaaaaggtacattcgcatctggagatgtagtcacaggagccaaaacagttgttgaagcagtagttcaagctaaaactgtagcaaatactatagaagaatattgtaaaaataattaagaatttgcgtaaattgaataaactaaaagttcgaaattaaagttttagttagagaaatattttacgagaaaa

SEQ ID NO: 4542 - protein, 414 aa, Clostridium saccharobutylicum
MTCNDIQLLDEADRCLLCKKPRCKENCPIQTSIPEIISLYKENRLREAGEILFNNNPLSAVCSLVCIHEDQCKGNCIKGIKGEPIRFHDIEYEISMKYLEEVRFENLPKDKDRIAIIGGGPAGITIAFILANKGYDVTIFDAHVKIGGVLRYGIPEYRLPKKILDTIEDRLVELGIKIRPNTLIGPVITLDRLYEDGYKAIFIGTGVWNPKTLNIKGETRGNAHFAIDYLKSPEAYRLGEKVAVIGAGNVAMDAARSAKRNGAKEVTVLYRKGFDEMSATKQEIMEAKEDGVIFNLFKSPIEITEKGIRLSSTENVTDENGKIVTKVIEGKEEFFECDSIIIAVSQTPKTNIVSNTKELNTNKWGLIITDEKGNTTRKGTFASGDVVTGAKTVVEAVVQAKTVANTIEEYCKNN

SEQ ID NO: 4543 - DNA, 1347 bp, Brevibacillus agri
  CDS (1)..(1347)
atgagcgtcccgaatgacctgcaaaaaaacttcagcgaagtggtgagcgccctcaagccgaaggaagcgatcgatgaagcgaatcgctgtctgtactgctacgacgcgccctgtatcaaggcttgtcccacctcgattgacattccttcgttcattcgcaaaatcgcgacaggcaatctgctcggctctgcgaggacgatcatggaatccaatccggttggggcaagctgcgcgcgcgtttgtccgacggaggagttgtgcgagggagcctgtgtgctcaatcacgcctccaaaccgatcatgatcgggctattgcaacgccatgcgacagactgggcgatccgcaacaacgcggccttgtttcaaaaaggcgatccgaacggcaagcgggtggcgattatcggagcggggccagccgggctgtcggcggcgcgagagcttgcccggctcggctacgaggtcacgatctacgaggcaaaagaaagagcgggcgggctgaacacatacggcatcgtgtctttccggctgccgcaggaaatatcgctctgggaggtcgagcaggtcgaggcgttgggcgtgacgatcaagacgaacacgcggatcggcgtcgacatcatgccagacgagctcgttgccaactacgattcggtgttgctggcggtggggatgagcagcgtgccttctttgcatattcccggggaagagctggaaggggtactggatgcgattgccttggtagaagatacgaaaacgaagccgcttaccacggacatggtcggcaaaaaagtggtcgtgatcggcgccggaaatacggcgattgacgccgcgacctgttcgaagcggctgggggcggacaatgtgcagattttgtaccgcagaacggtgcaggaaatgagctgctaccagttcgaatacgagttcgccaagcaggacggcgtggagtttcgctggctcgtggctccgacgcgcgttttggggaacaaagggcgcgtgacagggctggagctgatccggatggagctgggggagccggatgccaaaggccgaaaacgtccggtaccgatcccgggcagcgagtttttcatcgaggtggactttgtcgtcaaagcgattgggcaaaatcgccacctgtcgctgatcgaccagcttggcctgcagcatcaaaacggcatcgtcaccgtcgaggacggcacctaccggacgtcgcacccgaaagtgtttgccgcaggggacgtcatttttggcggaggaaaaacggacgcgatggtcgtcgacgcggccaatcacggaaagcgtgccgcttatgccatcgacaaggcgatccgcgaccagaagcagcttgtctag

SEQ ID NO: 4544 - protein, 448 aa, Brevibacillus agri
MSVPNDLQKNFSEVVSALKPKEAIDEANRCLYCYDAPCIKACPTSIDIPSFIRKIATGNLLGSARTIMESNPVGASCARVCPTEELCEGACVLNHASKPIMIGLLQRHATDWAIRNNAALFQKGDPNGKRVAIIGAGPAGLSAARELARLGYEVTIYEAKERAGGLNTYGIVSFRLPQEISLWEVEQVEALGVTIKTNTRIGVDIMPDELVANYDSVLLAVGMSSVPSLHIPGEELEGVLDAIALVEDTKTKPLTTDMVGKKVVVIGAGNTAIDAATCSKRLGADNVQILYRRTVQEMSCYQFEYEFAKQDGVEFRWLVAPTRVLGNKGRVTGLELIRMELGEPDAKGRKRPVPIPGSEFFIEVDFVVKAIGQNRHLSLIDQLGLQHQNGIVTVEDGTYRTSHPKVFAAGDVIFGGGKTDAMVVDAANHGKRAAYAIDKAIRDQKQLV

SEQ ID NO: 4545 - DNA, 3073 bp, Drosophila melanogaster
  CDS (966)..(2894)
acggtctggatctggattttgtttggatgaaccttccgcagtgtgattgttcaggctgatggacagctccgcacaggattcgatgtggttgtggctgcactgctgggtgctgatgagtttggtttcagtactgctccattgatcgtcatgggctgcactatgatgcgcaagtgtcacttgaacacctgtcccgtgggcattgccacccaggatccggagctgcgcaagaagttcacgggtaaaccagagcatgttatcaacttcttcttcatgctggccgaggatattcgcaaaattatggctggattgggcattcgaaagttccaggatctgattggtcgcaccgatttattgcgcgtggccagtcaacgcgatgccaaggctagtaacctggacctcaagttgctcctgcagccagctttggaactgcgtcccggcacgaacatcgttggaggttccgtaaagcaggacttccagctggagaagcgttccgacaacgaactaattgccaaggctcagcaaatattcagtggagcagacgataatgtaaccgtcaagatgcgcatccacaatgaggagcgagcctttggttctactctgagctatcatattgcatgcaaatatggagaggctggcttgcccgctggcaagagcatcgacatcttcctggagggttccgctggtcagagcttctgcgcgttcctggcgcggggtgttaatgtgacattgaagggcgatgccaacgattatgtgggcaagggtctttgcggtggtaatgttgtcatcatgccacaagatacggttcccttcgaatcacatctcaatgttatcgtgggcaacgtttgcttgtatggagccactgagggaactgccttttccgcggtattgcctccgaacgcttctgcgtacgaaactctggtgtaaccgccgttgttgaaggtgtgggcgatcacggatgtgaatacatgactggcggtgtagtggttatcctcggtcttacgggacgaaacttcgccgctggcatgtccggcggtattgcttatgtgtacgatttagatggttcctttaagcccaaggtaaacccggaaagtgtggaactcctgccgttggaaattgagaaggatgtgctgctcgtcaaggaactgttggctgatttcattgagaagacaggctcgaaggtggccaaggagttgcttgacaactgggccgaagcccagggcaagtttgtcaaggtcttcccgtatgaataccaaaaggctctaaaggacatggccgaacaacaagcagtggagcagcccctgaagtccgccatcgagaatggaaacggaaagcatgaaccgcacatcaaggacattgaggaagcgattcaggacgtggtgctcgagcagaagcgtgccgatcgcgtcctggacaagacccgtggctttgtaaagtacaagagggaatcggctccgtaccgagatgctggagagcgacagaaggattgggatgaagtctacaacttcccacatgtgcgcaagaacctcaaggttcaagcagctcgatgcatggaatgcggtgtgcccttctgtcagtccaactccacgggctgtccgctcggtaacatcattcccaagtggaacgacctcgttttccacggcgagtggcaggaggctctgcgtcaactgctgcagaccaacaacttcccggagttcactggtcgagtatgcccctctccctgcgagggttcctgcgttttgggcatctccgagccagctgtaacgatcaagaacatcgaatgcgccatcatcgatcatgccttcgagcagggctggattaagccagagattccggaagtgcgcactggcaaacgagttgcgattgtgggatcaggaccttccggcttggccgcctcgcagcagctgaaccgcgccggtcactttgtcaccgtttttgagcgcaacgatcgcgttggtggacttttgcagtatggtattcccacgatgaagctttccaaggaggtggtcaagcggcgggtagatctgatggctgacgagggtatcgagttccgcaccaatgtccatgtgggcaaggacctcaaggccgagcaactgctgcaggagtatgatgccgtcctcctcaccactggctccacctggccacgtgacttgccgctcgccaaccgtgacctgaagggcattcactttgccatggaattcctggaggcgcagcagaagaagcagctgggcggaaagaatgatataatatctgccgctggcaagaatgtgatcatcatcggcggtggcgataccggatgcgattgcattgccacgtcgttgcgtcaaggcgccaagagtatcactacattcgagatccttccggaaccgccacagaagcgtgctcaggacaacccctggcctcagtggccgaaggtcttccgcgtggactacggtcacgaggaggtgaagctgaagtggggcaaagatccgcgccagtactgcaccaccaccaaggagttcgtgggcgaaaatggagccatcaagggcgtgaacaccgtcgaggttgagtggaccaagacggaaacgggccagtggcgcatgcaggaggtggccggttcggagaagtacttccccgcagaccttattctcctggccatgggcttcctgggtccggagaagacggtgccgagcgaactgggcctggagctggacccgcgcggcaacatcaaggcatccaacggacagtatggcacctcgaactccaaggtctttgcggcaggagattgccggcgtggccagtcgctggtcgtctgggccattaccgagggtcgccaggccgcacgacaggtcgattcctatctgaccggccgtcccagtgggcttccaggacctggtggcgtcatcgcgacatcctaaagaggatccacagaggcagccagagcagctaatatcaagttttgtgtgcgtgcatcgtccttagcctatagtgcgaaattctttaacgatttgtgatttttattttcgcgattttagtttagtttacactaaaaagacttgagttttttacacaccaaaccaaaaaaaaaaaaaaaaaa

SEQ ID NO: 4546 - protein, 642 aa, Drosophila melanogaster
MTGGVVVILGLTGRNFAAGMSGGIAYVYDLDGSFKPKVNPESVELLPLEIEKDVLLVKELLADFIEKTGSKVAKELLDNWAEAQGKFVKVFPYEYQKALKDMAEQQAVEQPLKSAIENGNGKHEPHIKDIEEAIQDVVLEQKRADRVLDKTRGFVKYKRESAPYRDAGERQKDWDEVYNFPHVRKNLKVQAARCMECGVPFCQSNSTGCPLGNIIPKWNDLVFHGEWQEALRQLLQTNNFPEFTGRVCPSPCEGSCVLGISEPAVTIKNIECAIIDHAFEQGWIKPEIPEVRTGKRVAIVGSGPSGLAASQQLNRAGHFVTVFERNDRVGGLLQYGIPTMKLSKEVVKRRVDLMADEGIEFRTNVHVGKDLKAEQLLQEYDAVLLTTGSTWPRDLPLANRDLKGIHFAMEFLEAQQKKQLGGKNDIISAAGKNVIIIGGGDTGCDCIATSLRQGAKSITTFEILPEPPQKRAQDNPWPQWPKVFRVDYGHEEVKLKWGKDPRQYCTTTKEFVGENGAIKGVNTVEVEWTKTETGQWRMQEVAGSEKYFPADLILLAMGFLGPEKTVPSELGLELDPRGNIKASNGQYGTSNSKVFAAGDCRRGQSLVVWAITEGRQAARQVDSYLTGRPSGLPGPGGVIATS

SEQ ID NO: 4547 - DNA, 1485 bp, Xylella fastidiosa
  CDS (1)..(1485)
atgagtcgcaagcacgctttccaatttcttgatttgcctcggcagatgccgcaacgcatcccggtggagctgcgtacttccggggattggcgggagttatacggtaagttcgataagggtgaagcgcagtaccaagccggtcgctgtttggactgtggtaatccatattgcagttggaagtgtccggtgcataacgccatcccgcagtggttgcagttagtgcaggaaaatcgcattgatgaggccgcagcgttgtgccatgcaaccaacccgcttcctgaagtgtgcggcagggtgtgtccgcaggaccgtctctgtgaaggcagttgcacgctggaggagtttggtgcggtcactatcggtgcggtggaaaagtacattgtggataccgcgttgcagcaggggtggcgtcccgatttgagccatgtgcaaccgacgggttggcgtgtggcggtggtcggtgcagggcctgccggccttgcctgtgcggatcgtttggcgcgtgctggggtccaggcggtggtgtatgaccgctatgagcagatcggcgggttgctgcagttcgggattcccagttttaagcttgataaggcggtgatgagtacgcgccgccaagtgcttgagggcatgggcgtagagtttcgattgggtgtggagattggaaaggatctggggattgaagcgttgttggaggactacgatgctgtgttccttggcgtcggtgcgtatcgctacacggacggtggcttgccgggtcaggacttgaaaaacgtgttgccggcattaccgtttttggttcagaacggacgtatcatttctggcaatgatccgtatggccgtccgattgccggttgggaggatcaggtgcagttgccggatgtggcggggaagtctgtggttgtactcggtggcggtgataccggcatggattgtgtacggagtgcgatccgtttaggtgccaccaaagtcacctgtatctatcggcgtgatgaggcgaatatgcctggctcggcgcgtgaggttgctaacgcgcgggaagagggggtgcgctttctgtttaatcgtcagccattgtcgattcaatccggtaccgacaaacaagccattggtgtcactgtggtggaaacgaagcttgctgagccggatgccaatggtcgtcgcaacgcagtgcctatccagggtactgaagcggtgctggaagcggatgtggtgattattgcttttggtttttcgccgatgttgctggagtggttaactgcgcagggtgtacaagcgtcgagcaacggccgcattgtggtggcgttgtctgatactggcgatagactgacctatcagacaacgcatccgaagttgtttgctggtggtgattgtgtgcgtggtgccgatttggttgtcactgccgtggccgaggggcgcgacgcggctgagagcattgtgcggtggttgcgtgcgactgcacaggtgatggatgttgcggtgatctga

SEQ ID NO: 4548 - protein, 494 aa, Xylella fastidiosa
MSRKHAFQFLDLPRQMPQRIPVELRTSGDWRELYGKFDKGEAQYQAGRCLDCGNPYCSWKCPVHNAIPQWLQLVQENRIDEAAALCHATNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRQVLEGMGVEFRLGVEIGKDLGIEALLEDYDAVFLGVGAYRYTDGGLPGQDLKNVLPALPFLVQNGRIISGNDPYGRPIAGWEDQVQLPDVAGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLLEWLTAQGVQASSNGRIVVALSDTGDRLTYQTTHPKLFAGGDCVRGADLVVTAVAEGRDAAESIVRWLRATAQVMDVAVI

SEQ ID NO: 4549 - DNA, 4269 bp, Vibrio parahaemolyticus
  CDS (1)..(4269)
atgatagaaattgtcatcgatggaaaatatagaattgtagaagaggggctaacccttctggaagcagccaaagtgtgtggggtcgaaatcccttcactgtgcggaatgaacaaaagtaacgagaaaattccgtgtgatttgtgtgttgtcgaagtggagagtggcggaactaagcgcgcctgcgatctcaaagtgtaccgcggtctcaatgtcgtcacacaatcagaacaactgagtgagcaccgcagaaaagcgctcaaccgaatcatgacggaccactacgccgactgtgaagctccatgcaaaacggcgtgtcctgctggagtagacatccaatcttacctctaccatatctcgcaaaatgatcatcaaaaagcgattgaagttattaaacgcacactgccaatgccgttgtcgattgggcgcgtgtgtccggcattctgcgaaagtgagtgtcgccgctctttggtggatgagccgattgccattcgccaactcaaacgccatgccgcagacgcagatttagcggcgcatgaagcgtatgtcccagagaaaaaaccagcgaagcatcgcaagatcgccgttgttggtagtggccccggtggcttaacggcaggttattacttgtcgaatgaaggttatgacgttaccatatttgagtccatgccaaaagcaggcggttggctacgctacggtattcctgaatatcgcctacccaaagacattctagacaaagaaatcgaactgatgtgccgcaacggtatgcaagttgaaaccaacaaaaagcttggtgttgatttcacgctgtcgcaattgagtgaagactacgatgctgtctgtttggccgtgggggcgtctcaagcggtagaaatgaattatcctggtagcgacttggacggttgttatctcggtgttgattacctgaaagattacgttacagaacaaaactacgttacgggcaaaaaagttgccgtgattggtggtggtaacactgcgatcgactgtgcgcgtacggcgcgtcgtgcgggtgccgataccactttgatctatcgtcgaactcgcgacgaaatgccggccgaagactacgaaatcgtcgaagctgaacatgagggcgtgacgttccatttcttaacgaatccggcggaaaacatcgcggatgaaaacggccgcgtgaaggcaattcgattagaacgaatggcgttaggtgagccagatgcgtctggtcgtcgtagcccgaaaccaacgggtgagttctttactgaagcatttgataccgtgattgcagcggtatcgcaaaagccggatctcagcttcttagaaaacgatgatttgtctattccactaacacgttggaacacatctgagtccgactcgcaaaccatgcacacgggtacgggcaatatcttcagtatcggtgattttcgtcgtggtcctgcgactgcggttgaagcagtgggggatgggcgagttgcggcaaaagcgattgatctgttcctcaatggcgatatggcggatatgccgaaacctgcgttcaactctcgtaaagagaaaaaactggcgcaggttgacccacttcatttcgaaaacatccaaaaagttgctcgttcaatcatgccggagttgactccagcgcagcgtgagcagagttttgctgaagtggaactgggctttgataacgaagaggccatgaaagaagcggcgcgctgcttagagtgtggttgccaagcgaataccgactgtgccttgcgagattactcaacggaatatcatgccgagcaacatttcgatgtttccgtggacgtttcctctgctagcgtgattggccatcaagattggctcgatttacgtgcgaaagatcttcgtcataaatacgaagtagaccgcagttctgagttcattgaatttgatgctaaccgctgcatcagttgtggtcagtgtattcaagcatgccgcgagcaagcggtacatggtgtgttgagttttgtgtcggataaaaatggccgaccagctttacgcccagatgatcgcccacgattccgctccgatgaaaaaggcgtaggttgcagcggtttgacgctcatgggcgattcaaaatgcgtgcaatgtggggtgtgtgttcaggcatgtccaacgggcgcgatggtggacagccgtgaccgctctcaaggcagaaccgaacagctaaaagccgtcgataccatttgtacctattgtggtgtgggttgtaagttgaccatgtttgtcgatgagcgacaaaacaaaatccgctatgtaaaaggggcggattcgccggttaaccaaggtatgctgtgcgtgaaaggccgttttggttttgacttcattagcagcgaagagcgtttaacgacaccactgattcgtaaagatggttggttgcagccagcaacttgggacgaagcgattcagctagtggcttcgaagctttcgaccatcaagcaagattttggtagcaacgcactggccggattctcttcagcgaaaaccactaacgaagataactacgcgtttcaaaaattcatccgtcgtgaactgggtacgaacaacgttgatcactgcgcacgtttgtgtcacgcatcaagtgtgacagggcttgaagcatcgttggggagtggtgcgatgaccaacgacattccaagcattaagcattccgatgtgatctttattatcggttctgacaccacatctgcgcacccgatcatcgcttcgcacatcaaacaggcgatccgtcatcacggggcgcgcttgattgtggcagacccgaaacgagtagacatggccgaacatgcagagctgtacttggcgcatcgtccgggtacggatgttatgttgctcaatggcgtgatgcagcaaatcatcaaaaatggttggtacgatcaagaatacatcgaagagcgcgtagacggctttgataccttgcttcaagaggtgatgtcgccagcgtacaacctcgacaaagttgagttagtgacgggcgtaaaagcggacgatattttcgcgatggcgcgaatgattggtacggcaaaacgcacggcggtgtattactcaatgggtattacccagcatacaacagggcacgacaacgttcgttcgattgcaaacctgcaattgttgtgtggcaacatcggtattgagggtggtggtattaacccactgcgcggtcaatcaaacgtacaaggtgcgtgtgatatgggcgcattgccgaactgttatccgggataccaaaaagtgtataacccgattgttcgtcagaaattcgcgattgagtgggatgcgccgaacttaccttctgagcaagggcttaccctaacggaaatcatcgatgcggcgtgcaaacgagaagttcgcgggatgtacatcatgggcgaaaacccagtactgagcgatccaaaccaagcacacgtgattgaagggttggaagcactcgacttcttggtcgtgcaagacatcttcctcaccgagacggcgcagtacgccgatgtggtattgccttcttgttcatttgcggaaaaatccggtcacttcaccaatactgagcgacgcgtgcagcgcgttaatgcggcagtgaaagcgccgggtgaggcgaaagaagattggtggatcattcaagcgatcgcaaacgcgatgggcagcgattggcattaccagtgcgtttctgaaatcactagcgagatcgcgcgtgtaacgccgcaatatgcagggttgcgttgggacgcgatcacgccgaacggtgttcaatggccaagtaacaagaacaatccaaacggtactcgtattatgcaccaaacccaatttacccgagggaaagggcaaatggtgggcgtgccgttccgttatgcagccgagttacctgatgaagagtatcctttggtgcttacaacagggcgtgtgctagaacagttccacaccggtacgatgacgcgcaaaacgaaagggttggataaccttgctgggccaagagcgatgatcagtgttgaagatgctgaagcaattggtatccataatggtcagcgcctaaaagtctcgactcgtcgtggcaacatcgaaattgatgcgtttgtgaccaagcgaatgcaaaaaggcgtcgtgtttattcctttccatttcgttgagtcgccagtcaaccgcttgacgactacggcaacggacccgcatgcgaaaattcctgaattcaaagtcgcagcggttaagattgaaatcagtgaaacggccgctcaaccagagcctgtcgaggaggcggtacaccacgtctaa

SEQ ID NO: 4550 - protein, 1422 aa, Vibrio parahaemolyticus
MIEIVIDGKYRIVEEGLTLLEAAKVCGVEIPSLCGMNKSNEKIPCDLCVVEVESGGTKRACDLKVYRGLNVVTQSEQLSEHRRKALNRIMTDHYADCEAPCKTACPAGVDIQSYLYHISQNDHQKAIEVIKRTLPMPLSIGRVCPAFCESECRRSLVDEPIAIRQLKRHAADADLAAHEAYVPEKKPAKHRKIAVVGSGPGGLTAGYYLSNEGYDVTIFESMPKAGGWLRYGIPEYRLPKDILDKEIELMCRNGMQVETNKKLGVDFTLSQLSEDYDAVCLAVGASQAVEMNYPGSDLDGCYLGVDYLKDYVTEQNYVTGKKVAVIGGGNTAIDCARTARRAGADTTLIYRRTRDEMPAEDYEIVEAEHEGVTFHFLTNPAENIADENGRVKAIRLERMALGEPDASGRRSPKPTGEFFTEAFDTVIAAVSQKPDLSFLENDDLSIPLTRWNTSESDSQTMHTGTGNIFSIGDFRRGPATAVEAVGDGRVAAKAIDLFLNGDMADMPKPAFNSRKEKKLAQVDPLHFENIQKVARSIMPELTPAQREQSFAEVELGFDNEEAMKEAARCLECGCQANTDCALRDYSTEYHAEQHFDVSVDVSSASVIGHQDWLDLRAKDLRHKYEVDRSSEFIEFDANRCISCGQCIQACREQAVHGVLSFVSDKNGRPALRPDDRPRFRSDEKGVGCSGLTLMGDSKCVQCGVCVQACPTGAMVDSRDRSQGRTEQLKAVDTICTYCGVGCKLTMFVDERQNKIRYVKGADSPVNQGMLCVKGRFGFDFISSEERLTTPLIRKDGWLQPATWDEAIQLVASKLSTIKQDFGSNALAGFSSAKTTNEDNYAFQKFIRRELGTNNVDHCARLCHASSVTGLEASLGSGAMTNDIPSIKHSDVIFIIGSDTTSAHPIIASHIKQAIRHHGARLIVADPKRVDMAEHAELYLAHRPGTDVMLLNGVMQQIIKNGWYDQEYIEERVDGFDTLLQEVMSPAYNLDKVELVTGVKADDIFAMARMIGTAKRTAVYYSMGITQHTTGHDNVRSIANLQLLCGNIGIEGGGINPLRGQSNVQGACDMGALPNCYPGYQKVYNPIVRQKFAIEWDAPNLPSEQGLTLTEIIDAACKREVRGMYIMGENPVLSDPNQAHVIEGLEALDFLVVQDIFLTETAQYADVVLPSCSFAEKSGHFTNTERRVQRVNAAVKAPGEAKEDWWIIQAIANAMGSDWHYQCVSEITSEIARVTPQYAGLRWDAITPNGVQWPSNKNNPNGTRIMHQTQFTRGKGQMVGVPFRYAAELPDEEYPLVLTTGRVLEQFHTGTMTRKTKGLDNLAGPRAMISVEDAEAIGIHNGQRLKVSTRRGNIEIDAFVTKRMQKGVVFIPFHFVESPVNRLTTTATDPHAKIPEFKVAAVKIEISETAAQPEPVEEAVHHV

SEQ ID NO: 4551 - DNA, 1797 bp, Vibrio parahaemolyticus
  CDS (1)..(1797)
atgaacaatgtaatttttagccaaaagctatacgacaccgcgcaaatgattgtcgatggctgtatgggtgatgccgatccggcatgtcaaaccgcatgtccaatgcacacagacgtaaagcaatacgttcgcatggcgggtgaaggtaattttcaaggtgctctggatctgatccgcagcaaattatttcttcctcaaacgcttggccgcatctgtgcccacccttgtgaagcgtcttgtcgtcgtaacacagagttcggtcaaccaatcagcgttgcaggtatcaaacgtttcgtcgcagagaaaatggataaccaagatcactgggatctcaacattgcgcccctgaccaacaagcacatcgcgatcgtgggtgcaggccctgctggtgcgcaagcggctattgagcttcgtcgtcaaggccacgaagtaacgatttatgaaaagctagacgtatacggcggcatgatgcgtgtgggtatccctgaataccgtttaccgcgcgacgttatcgacttcgaatacagctacttggcgatgctgggtatcaaaactcagttcggcgttgagatcggcaaagacattagcttcgacactctacgtagcgaacatgatgctgtgattctggctcacggtgcacacgtcggttcgatcatccctctgccgggtcatgacaacgatggcgtgttttctgcggttgaatacctaaaagagatttctgaaactcgccaatttccacgtgcatgtaaacgagtgatggttatcggcggtggtgacgttgctatggactgtgcgcgctcttcatggcgtatcggtgcaagcgacgtttaccaatgttcacttgagagccttgaaagcctacctgcaagccaaatcgaaatcgacgagtcgctagaagaaggtgttgagttcaacgcaggttggggcccagtagctattgaacatgagaacggcaaagtaaccggcatcactatcaagaaagtcctgtctatctttgatgagcaaggcaactttgcacctcagtacagcgaagaaagtaaaaccatctctgtggataccgttgttttcgctacgggtcaaatcgtggcagatattactgacggtgcactagagcaaactcgcggtggtcgttacgtggtcgataaacaaacactagcatcgagcctagaagacgtctttgtagccggtgacgcgtgtggcggtaacatcgtaattgaagcgatggcattaggtcgcaaagcagcaatgagcgttgagcgtttcctaacagctcgcccactgactgaagatcgcgacttcgagcaagaatacagctactcatctcgtctagacgtaccactaccaaaaggtacggtagatacccctcgcctacacggtgaattgcgtgatgcagaagagcgtaaacaagactttgcacaagtggatttaggctttactgaagaacaaatcaaacaagaagcatctcgctgtctgcaatgtagctgcaagctatgtatgaccgagtgcatcatgatgaacgacttcagtgactgtccaaagaccatcttctctgacttcgtgaacaacaagtcgatggatccattgctggcttactcatgtaacgcctgtgaccagtgcaccatcgtgtgtccgaaagacttcccgatgaaggaaatgttcctaggcgcacgtactgactttgttaaggcaaacaatggtgaatcaccaatgccgggtcataaagcgatcaatatgcaccagaaactgggcttctcaaaaatcttcactatggcaaaacgagcggtatcgacaaaatga

SEQ ID NO: 4552 - protein, 598 aa, Vibrio parahaemolyticus
MNNVIFSQKLYDTAQMIVDGCMGDADPACQTACPMHTDVKQYVRMAGEGNFQGALDLIRSKLFLPQTLGRICAHPCEASCRRNTEFGQPISVAGIKRFVAEKMDNQDHWDLNIAPLTNKHIAIVGAGPAGAQAAIELRRQGHEVTIYEKLDVYGGMMRVGIPEYRLPRDVIDFEYSYLAMLGIKTQFGVEIGKDISFDTLRSEHDAVILAHGAHVGSIIPLPGHDNDGVFSAVEYLKEISETRQFPRACKRVMVIGGGDVAMDCARSSWRIGASDVYQCSLESLESLPASQIEIDESLEEGVEFNAGWGPVAIEHENGKVTGITIKKVLSIFDEQGNFAPQYSEESKTISVDTVVFATGQIVADITDGALEQTRGGRYVVDKQTLASSLEDVFVAGDACGGNIVIEAMALGRKAAMSVERFLTARPLTEDRDFEQEYSYSSRLDVPLPKGTVDTPRLHGELRDAEERKQDFAQVDLGFTEEQIKQEASRCLQCSCKLCMTECIMMNDFSDCPKTIFSDFVNNKSMDPLLAYSCNACDQCTIVCPKDFPMKEMFLGARTDFVKANNGESPMPGHKAINMHQKLGFSKIFTMAKRAVSTK

SEQ ID NO: 4553 - DNA, 1470 bp, Vibrio parahaemolyticus
  CDS (1)..(1470)
atgggtaagcctactggatttttagagcatggtcgtgaactaccacagaagatcgacccagctgaacgtatcaagaacaacaaagagttcgttctgaacgaggagtttggtagcaaaatcaatactcaggcttctcgttgtatggattgtggtgtgccgttttgtcataacggctgccctatcggcaacatcatcccagaatttaacgatgcggtttatcgtgatagctgggaagaagcatggaacattctaagttcaaccaacaacttcccggagtttactggtcgagtttgtcccgctccttgtgaaagtgcatgtgtgcttggcattaaccaagacccaatcactatctgtaatatcgagaaaaccatcgtggaaacggcgtatcgtgaaggatacgccaaaccaaaaactccgcgttctcgcactggtaaaaccgtcgctattattggttctggccctgcgggtcttgcggctgccgagcagctaaacagcgcaggccataccgtgaccgtattcgagcgtgacgagaaagtgggtggtctgctgcgtttcggtattccagatttcaaactgagcatggaagtcattgatcgtaagatcaatctaatggcagaagctggcgttgagtttagagtaaatcaacacgttggtgtcgatgtaaacgcgcaacaactacgtcaagagtacgatgtggtactgctgactggtggctcaaccgttcctcgcgatcttcctgttccgggacgcgatctaaaaggcgtgtactttgcaatgcagttcctaggacaaaacaatcgccgagcaaacaacatggatctaaaaggtgaagaaattcacgcagcaggaaaacatgttgtcgtaatcggtggtggtgataccggttcagactgtgtgggtacatcaaaccgtcacggcgcagcaagcataactcaagttgaaatcatgccgattccaccagagaagcgcccagccaatatgccatggccacagtacccgatgatcctacgcacttcgacttctcatgaagaaggtgtcgatcgtcactggaacatcttgaccaaagagttcatcggtaacgacaaaggtgaagttacaggtcttcgtcttgcagatatcgtttgggaagatgcgaaaccaggcgagcgcccaagctttaaagaagtagaaggcagcgaacgcgtgatcccatgtgacatggctttccttgcgatgggcttcctgcacccagaaccaactggcgtgcttgctcaactggatatcgcactcgatgatcgcggcaacgttgcaacgcaaggtttcgcgacgaatcaagaaggcgtattcgccgcaggtgatatgcgtacaggccaatctttggtggttcgttgtatcaacgaaggtcgcgaatgtgctcgtgctattgatgaatacctgatgggtggcactaaccttgaagcaaaagcaaattcgctaatgctttcagcataa

SEQ ID NO: 4554 - protein, 489 aa, Vibrio parahaemolyticus
MGKPTGFLEHGRELPQKIDPAERIKNNKEFVLNEEFGSKINTQASRCMDCGVPFCHNGCPIGNIIPEFNDAVYRDSWEEAWNILSSTNNFPEFTGRVCPAPCESACVLGINQDPITICNIEKTIVETAYREGYAKPKTPRSRTGKTVAIIGSGPAGLAAAEQLNSAGHTVTVFERDEKVGGLLRFGIPDFKLSMEVIDRKINLMAEAGVEFRVNQHVGVDVNAQQLRQEYDVVLLTGGSTVPRDLPVPGRDLKGVYFAMQFLGQNNRRANNMDLKGEEIHAAGKHVVVIGGGDTGSDCVGTSNRHGAASITQVEIMPIPPEKRPANMPWPQYPMILRTSTSHEEGVDRHWNILTKEFIGNDKGEVTGLRLADIVWEDAKPGERPSFKEVEGSERVIPCDMAFLAMGFLHPEPTGVLAQLDIALDDRGNVATQGFATNQEGVFAAGDMRTGQSLVVRCINEGRECARAIDEYLMGGTNLEAKANSLMLSA

SEQ ID NO: 4555 - DNA, 1413 bp, Vibrio parahaemolyticus
  CDS (1)..(1413)
atgagtcagaacgtttaccaatttatcgatgttcaacgcgtagatccggcgaaaaaaccaattaagattcgtaagattgagtttgttgaaatttacgagccgttcacgaaacaacaagcaacagcgcaggccgatcgctgtttggattgcggtaacccatattgtgaatggaagtgccccgtccataactacattccccagtggctaaaactggcgaatgaaggccgaattttagaagccgtggaactttcacaccaaaccaacagcttgcctgaagtgtgtggccgtgtgtgtccgcaagaccgtttgtgtgagggttcgtgcacactaaatgatgattttggtgcagtcacgataggtaacattgaaaagtacatcaccgacaaagcctttgaaatgggctggaagcctgacatgtccaaagtggagtggacaaataaaaaggtggcaatcatcggcgctggccctgctggtttggcagcagcagacattttagttcgcaacggtgtaaaacctgtggtgtttgaccgttacccagagattggtggcctacttacctttggtattccttctttcaaattggaaaaaggggtcatggaaaatcgtcgtcgggtatttaccgaaatgggcgttgagttccgcatgaatgtggaagtcggccaagatgtgcagatgcaagaactgcttgatgaatacgatgcggttttcttaggtgtgggcacatacaaatacatgcgcgccggtttggaaaatgaagacgcgccgggcgtttatgacgccctaccatttttgatttccaatacctataaggttatggagctagaacataaccaaccgtttatcgatatggctggcaaaaaagtcgtagtgcttggtggtggtgataccgcgatggactgcgtacgaacttcgatccgtcaaggcgcatctaacgtgatttgtgcctaccgtcgtgatgaagaaaacatgccaggctcccgtcgagaagtgaaaaatgccaaagaagagggcgtgaagttcatgtttaaccttcagcctttaggtattgaggttgatgcgtatggcaaagtttcaggcgtgaaagtggtcaaaactgctttaggcgagcctgatgacgcaggtcgccgtcgcccagaacccgtagaaggaagtgaacacgtactgcctgccgatgctgtcatcatggcatttggtttccaacctcatcaaatggactggctgactccgttcaatgttgaacttgatcaatgggggcgaatcaaagcacccaacaaccaagagtttcaatatcaaaccagcaatgaaaagatcttcgctgggggagacgcggttcgcggttctgatttagtggtaaccgccattgatgaaggacgaaaagcagcagaaggtattcttgattacttagacgtgtag

SEQ ID NO: 4556 - protein, 470 aa, Vibrio parahaemolyticus
MSQNVYQFIDVQRVDPAKKPIKIRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTNKKVAIIGAGPAGLAAADILVRNGVKPVVFDRYPEIGGLLTFGIPSFKLEKGVMENRRRVFTEMGVEFRMNVEVGQDVQMQELLDEYDAVFLGVGTYKYMRAGLENEDAPGVYDALPFLISNTYKVMELEHNQPFIDMAGKKVVVLGGGDTAMDCVRTSIRQGASNVICAYRRDEENMPGSRREVKNAKEEGVKFMFNLQPLGIEVDAYGKVSGVKVVKTALGEPDDAGRRRPEPVEGSEHVLPADAVIMAFGFQPHQMDWLTPFNVELDQWGRIKAPNNQEFQYQTSNEKIFAGGDAVRGSDLVVTAIDEGRKAAEGILDYLDV

SEQ ID NO: 4557 - DNA, 1419 bp, Pseudomonas syringae
  CDS (1)..(1419)
atggctgaacgtctcagtaacgacttccagttcatcgacgtcgggcgtaaagacccgaagaagaaactgctgcgtcaacgcaagaaagagttcgtggaaatctacgaacccttcaaaccccagcagtccgccgatcaggcgcaccgctgcctgggttgcggcaacccgtattgcgagtggaagtgcccggtgcacaacttcattcccaactggctcaagctggttgccgagggcaatattctcgcggcggcggagttgtcccaccagaccaacaccctgccggaagtctgcggccgcgtgtgcccccaggatcgcctgtgtgaaggtgcctgcacgctgaacgacggctttggtgcggtcaccatcggctcggtcgagaagtacatcaccgacaccgcgttcgccatgggctggcgtccggacatgtccagggtcataccgaccggcaagcgcgtcgccatcattggcgcagggcctgcgggccttggctgtgccgacgtgctggtgcgtggcggcgtgaccccggtggtgttcgacaagaaccctgaaatcggcggtctgctgaccttcggcatccccgaattcaagctggaaaaatccgtgctcagccatcggcgtgaagtgttcaccggcatggggatcgagttccggctcaacaccgaagtcggcaaggacgtgaccatcgaccagttgctcgaagagtacgatgcggtgttcatgggcatgggcacctacacctacatgaaaggcggttttgccggtgaagacctgccgggcgtgcacgatgcgctcgacttcctgattgccaacgtcaaccgtaacctgggcttcgaaaaggcgccggaagactttgtcgacatgaaaggcaagcgcgttgtcgtgctgggcggcggcgacacggcgatggactgcaaccgtacttcgatccgtcagggcgccaaatcggtcacctgcgcctaccgtcgcgacgaagaaaacatgccgggttcacgcaaggaagtgaagaacgccaaggaagagggcgtgcgcttcctctacaaccgccaacccatcgccattgtcggcgaaggcaaggtcgaaggcgtcaaggtggtcgaaacgcgtcttggcgaacccgacgcccgtggccgtcgcagccccgagccgattccgggttctgaagagatcatcccggcagacgccgtggtcatcgcctttggcttccgcccaagcccggcaccgtggttcgagcagttcacgatcagcaccgacagtcagggccgcgtcgtcgccccggagcaggcgcagtacaagcaccagaccagcaatccgaaaatctttgccggtggtgacatggttcgcggctccgacctggtggtcactgcgatcttcgaaggccgcaatgcggctgaagggatcatggattacctcggcgtctag

SEQ ID NO: 4558 - protein, 472 aa, Pseudomonas syringae
MAERLSNDFQFIDVGRKDPKKKLLRQRKKEFVEIYEPFKPQQSADQAHRCLGCGNPYCEWKCPVHNFIPNWLKLVAEGNILAAAELSHQTNTLPEVCGRVCPQDRLCEGACTLNDGFGAVTIGSVEKYITDTAFAMGWRPDMSRVIPTGKRVAIIGAGPAGLGCADVLVRGGVTPVVFDKNPEIGGLLTFGIPEFKLEKSVLSHRREVFTGMGIEFRLNTEVGKDVTIDQLLEEYDAVFMGMGTYTYMKGGFAGEDLPGVHDALDFLIANVNRNLGFEKAPEDFVDMKGKRVVVLGGGDTAMDCNRTSIRQGAKSVTCAYRRDEENMPGSRKEVKNAKEEGVRFLYNRQPIAIVGEGKVEGVKVVETRLGEPDARGRRSPEPIPGSEEIIPADAVVIAFGFRPSPAPWFEQFTISTDSQGRVVAPEQAQYKHQTSNPKIFAGGDMVRGSDLVVTAIFEGRNAAEGIMDYLGV

SEQ ID NO: 4559 - DNA, 1419 bp, Pseudomonas putida
  CDS (1)..(1419)
atggctgaacgtctgaacaacgacttccagttcatcgaagtgggccgaaaggacccgaaaaaaaagctgctgcgccagcgcaagaaggagttcgtggaaatctacgaaccgttcaagccgcagcagtccgtggagcaggcgcaccgctgcctgggctgcggtaacccgtattgcgagtggaagtgcccggtacacaacttcatccccaactggttgaagctggtctccgaaggcaacatcctggccgcggcggaactgtcgcaccagaccaacaccctgccggaagtatgcggccgtgtttgcccgcaagaccgcctgtgcgagggtgcctgcaccctgaacgacggtttcggcgcggtgaccatcggctcggtggagaagtacatcaccgacaccgccttcgccatgggctggcgtccggacatgtccaaggtcaagccaaccggcaagcgcgttgccatcatcggcgccggcccggcgggcctgggctgcgccgacgtgctggtgcgcgccggggtaaccccggtggtgttcgacaaaaaccctgagatcggtggcctgctgaccttcggtatccccgagttcaagctggaaaagaccgtgctcagcaaccgccgtgaagtgttcaccggcatgggcatcgagttccgcctgaacaccgaggtgggcaaggatgtgaccatggaacagctgctcgccgagtacgacgcggtgttcatgggcatgggtacctacacctacatgaagggcggcttcccgggtgaagacctgccgggcgtgcatgacgcactggacttcctgatcgccaacgtcaaccgcaacctgggcttcgagaagtcgccggaagacttcgtcgacatgcagggcaagaaagtggtggtgctgggcggtggtgacaccgcgatggactgcaaccgtacctcgatccgtcagggtgccaaggcggtgacctgtgcttatcgtcgtgacgaagccaacatgccgggttcgcgcaaagaggttaagaacgccaaggaagagggcgtgaagttcctctacaaccgtcagcccattgccattgtgggcgaggacaaggtcgaaggcgtcaaagtggtcgagactcgcctgggcgagcctgatgcccgtggccgccgcagccctgagccaatcccgggctccgaagagatcctgccggcagacgccgtggtaatcgccttcggcttccgcccgagcccggcaccgtggtttgaacagcatggcattcagctggacagccaaggtcgtgtggttgccccggagaagggcaagttcaagcaccagaccagcaacccgaaagtgtttgccggtggcgacatggtgcgcggttcggacctggtggtgactgcgatcttcgaagggcgtacggctgccgagggtatcctggactacctcgaagtctag

SEQ ID NO: 4560 - protein, 472 aa, Pseudomonas putida
MAERLNNDFQFIEVGRKDPKKKLLRQRKKEFVEIYEPFKPQQSVEQAHRCLGCGNPYCEWKCPVHNFIPNWLKLVSEGNILAAAELSHQTNTLPEVCGRVCPQDRLCEGACTLNDGFGAVTIGSVEKYITDTAFAMGWRPDMSKVKPTGKRVAIIGAGPAGLGCADVLVRAGVTPVVFDKNPEIGGLLTFGIPEFKLEKTVLSNRREVFTGMGIEFRLNTEVGKDVTMEQLLAEYDAVFMGMGTYTYMKGGFPGEDLPGVHDALDFLIANVNRNLGFEKSPEDFVDMQGKKVVVLGGGDTAMDCNRTSIRQGAKAVTCAYRRDEANMPGSRKEVKNAKEEGVKFLYNRQPIAIVGEDKVEGVKVVETRLGEPDARGRRSPEPIPGSEEILPADAVVIAFGFRPSPAPWFEQHGIQLDSQGRVVAPEKGKFKHQTSNPKVFAGGDMVRGSDLVVTAIFEGRTAAEGILDYLEV

SEQ ID NO: 4561 - DNA, 1368 bp, Pseudomonas putida
  CDS (1)..(1368)
atgaccaacgccctgaaccatttgccgcgcccccgggccggcgccgaccagttggccgagcgcttcagcgacctggccccacccctcaccgcgcgtcaggccgccctggaaagtgcacgctgcctgtactgctacgacgccccctgcgtcaacgcttgccccagcgaaatagacattccctcgttcatacaccgcatcagtgacgaaaacctgcaaggcgccgccgagcgcattctttcggccaacattctgggcggtagttgcgcccgcgtgtgccccaccgaaatcctctgccagcaagcctgcgtgcgcaacaacgcccaggaatgcgcgccggtgctgatcggccaactgcagcgttacgccctggacaacgcccagttcagcgcacacccgttcaagcgctcggcagccaccggcaagcgtatcgccgtggtgggcgccggcccggcagggctgtcctgcgcccaccgcctggccatgcacgggcatgacgtggtggtgttcgaggcctgcgacaaagccggtggcctcaacgagtacggcatcgcccgctacaagctggtagacgactatgcccagcgtgaagtggatttcttgttgggcattggcggtatcgaagtccgccatggccagcgcctgggtggcaacctcagcctgggcgaactgcgcgatcagtacgacgcggtgttcctgggcctcggcctgaatgccgtgcgccagctagggctgcccgacgaggaagcccccggtgtggtcgccgccaccgaatacatccgcgagctacgccaggccgatgacctgagccagctcccgttggccgaccgctgcctggtgatcggtgctggcaacacggccatcgacatggctgtgcagatgagccgtctgggtgcccgcgacgtcaacctggtgtaccgccgtggccacgccgacatgggcgctaccggccacgagcaggacattgccaaggccaaccaggtacgcctgcacacctgggcccgccctgatgccgtgctgctggatgacgccggcaaggtccgcggcatgcgctttgcccgcaccgagctggcggaaggtcgtctgcgcgataccggcgaaaccttcgagctggctgcggacgccattttcaaggccattggccaacgctttgacgatgccagcctcggcgacccggtggctgcgcaactggcccgcgagggtgagcgcatccgcgttgacgaaaacctgcagaccagcctgccgggcgtgtacgcaggcggcgactgcaccgcgctggggcaggaccttaccgtgcaggccgtgcaacacggcaagctggccgccgaagccatccatgcccaactcatgctcaacgtggaggcagcgtaa

SEQ ID NO: 4562 - protein, 455 aa, Pseudomonas putida
MTNALNHLPRPRAGADQLAERFSDLAPPLTARQAALESARCLYCYDAPCVNACPSEIDIPSFIHRISDENLQGAAERILSANILGGSCARVCPTEILCQQACVRNNAQECAPVLIGQLQRYALDNAQFSAHPFKRSAATGKRIAVVGAGPAGLSCAHRLAMHGHDVVVFEACDKAGGLNEYGIARYKLVDDYAQREVDFLLGIGGIEVRHGQRLGGNLSLGELRDQYDAVFLGLGLNAVRQLGLPDEEAPGVVAATEYIRELRQADDLSQLPLADRCLVIGAGNTAIDMAVQMSRLGARDVNLVYRRGHADMGATGHEQDIAKANQVRLHTWARPDAVLLDDAGKVRGMRFARTELAEGRLRDTGETFELAADAIFKAIGQRFDDASLGDPVAAQLAREGERIRVDENLQTSLPGVYAGGDCTALGQDLTVQAVQHGKLAAEAIHAQLMLNVEAA

SEQ ID NO: 4563 - DNA, 1425 bp, Clostridium tetani
  CDS (1)..(1425)
atgtcacgtaggattagggggagatcattaatggatagattcaaaagaactcctataaaagttcaagatgccaaaaagagaataaaaaactttaaagaggtttgtcttggatatacagaagaagaagcgattaaagaagcttcaagatgtcttaattgtaaaaatccaatttgtgtgccaaattgtccagtggcaataaatatacctaaatttatacaacatgttaaaaatagggaatttgaggaagctgcaaaagttattaacgaagcaagttctctaccagctatatgtggaagagtatgtcctcaagaaactcaatgtgaaggtaaatgtgttttaggtgtaaaaggagagccaatagccattggaaagctagaaagatttgtaggagattggtctagggaaaataacgtagatttatcttttaaaggaaaaaagaaagataaaaaaattgcagttataggagcaggtcccgcaggattaacctgtgcaggggatttagctaaacttggatataatgttactatatttgaagctttacatgaaccaggaggagttttagtatatggtataccagaatttagattgccaaaggatactgtagtaaaacatgaaatagataatgttaaaaaactaggagtagaaattgaaacagatgtaatagttggaagaacaattacagtggatgaacttttaaatgaagaagggtttcatgcagtatttataggttcaggagcagggctacctaagttcatgggaatacctggagaaaacttaaatggtgtattttcatcaaatgaatttttaactagaaataatcttatgaaggcctatagagaagattatgatactcctataaaagtaggtgaaaagttagcagtagtaggtggtggaaatgttgctatggatgctgctagaaccgctaaaagacttggggcagaagttcatatagtgtatagaaggtcagaagaagaaataccagcaagaagagaagaagtagagcatgcaaaagaagagggaataatatttaatctacttaccaatccaacagaaataataggtggagaagatggatgggtaaaggcaatgaagtgtataaaaatggagttaggagaacctgataaatctggcagaagaagaccagtagaaattgagggatctgaatttattttagatgtagacactgtaataatggcattaggaacttcaccaaatccactaatatctggtacaacaaaaggactggaaacggacaaatggggctgcttagtagctaaggatgaaaatggagaaactactaaaagagcggtatttgcaggaggagatgtggtaactggtgctgcaactgtaatactagctatggaagcaggaaaaaaagctgctaaaggaatagatgaatttttgagtgatagtgaaaaaaaataa

SEQ ID NO: 4564 - protein, 474 aa, Clostridium tetani
MSRRIRGRSLMDRFKRTPIKVQDAKKRIKNFKEVCLGYTEEEAIKEASRCLNCKNPICVPNCPVAINIPKFIQHVKNREFEEAAKVINEASSLPAICGRVCPQETQCEGKCVLGVKGEPIAIGKLERFVGDWSRENNVDLSFKGKKKDKKIAVIGAGPAGLTCAGDLAKLGYNVTIFEALHEPGGVLVYGIPEFRLPKDTVVKHEIDNVKKLGVEIETDVIVGRTITVDELLNEEGFHAVFIGSGAGLPKFMGIPGENLNGVFSSNEFLTRNNLMKAYREDYDTPIKVGEKLAVVGGGNVAMDAARTAKRLGAEVHIVYRRSEEEIPARREEVEHAKEEGIIFNLLTNPTEIIGGEDGWVKAMKCIKMELGEPDKSGRRRPVEIEGSEFILDVDTVIMALGTSPNPLISGTTKGLETDKWGCLVAKDENGETTKRAVFAGGDVVTGAATVILAMEAGKKAAKGIDEFLSDSEKK

SEQ ID NO: 4565 - DNA, 1272 bp, Clostridium tetani
  CDS (1)..(1272)
atggaaaaaaataattattcaaaggaagttaaaaaaacttatactccactactagcaatagaggaagcttcaagatgtcttttatgttatgatgcaccctgtagtaagaattgtcctgtagatacgaaaccagatgaattcataagatctttaagatttaaaaatttaaaaggggcagcagaaaccatcagaaaaaataatatattaggtggagtatgctcaagactttgtccttatgataaatattgtcaaaaaaattgtacaagaggaaaaattgataagcctatagatataggatcacttcaaagatatttaatagaatttgagaaaaacataagattagatacgttaaataaagttgaaattaataaggaaaaggtggccattataggatcgggtcctggaggattatcagcggctgcatctttagctcaaaaaggatataaagttaatatttttgagaagaaagaaaaatttggtggttggttaacttatggaataccagaatacagattaccacaaaatttagtggattatgagattgatattataaggaaattaggggtggaatttaaggctaattgtaatgtaggtaaagatattacgatagacgatttaaaagagaaaggatttgaagctattctattagcttgtggacaacaacaaagtaaagaattaaacatagaaggaataaagttaaaaggagtattaaagggaacagaatttttatctgaggctaaattaagtaatgggaacttagaagtagggcaaaaggttatagttataggtggtggagatgtggctatagattccgcagtaacagctaaattacttggagcggaggatgtgaaaatagtatatagaagaaatatagaaaaaatgccctcaaataaaaatgagagaatctatgcacataatttaaatatacctatatttacgggaataaagccttatagcttaataggaaataatgagaaggttattagttttaaaggtgtagggatgtttgatgattctagtttagaattggaagtggatacagttatatttgctatagggcaagaattagaagatctttcctatatagatgaattaaaaattgaaaataatgaggttctggtggatgaaaatttaaataccagcatagaaggaatatttgcctgtggagatattataaaaggaaataaaacagtagtggatgcagttgcaacgggtaaaagagttgctatagaaatagaagaatatataagaagaaagggagatgttaggtaa

SEQ ID NO: 4566 - protein, 423 aa, Clostridium tetani
MEKNNYSKEVKKTYTPLLAIEEASRCLLCYDAPCSKNCPVDTKPDEFIRSLRFKNLKGAAETIRKNNILGGVCSRLCPYDKYCQKNCTRGKIDKPIDIGSLQRYLIEFEKNIRLDTLNKVEINKEKVAIIGSGPGGLSAAASLAQKGYKVNIFEKKEKFGGWLTYGIPEYRLPQNLVDYEIDIIRKLGVEFKANCNVGKDITIDDLKEKGFEAILLACGQQQSKELNIEGIKLKGVLKGTEFLSEAKLSNGNLEVGQKVIVIGGGDVAIDSAVTAKLLGAEDVKIVYRRNIEKMPSNKNERIYAHNLNIPIFTGIKPYSLIGNNEKVISFKGVGMFDDSSLELEVDTVIFAIGQELEDLSYIDELKIENNEVLVDENLNTSIEGIFACGDIIKGNKTVVDAVATGKRVAIEIEEYIRRKGDVR

SEQ ID NO: 4567 - DNA, 1452 bp, Bradyrhizobium japonicum
  CDS (1)..(1452)
atgggcaagatcacgggttttctggaaatcgaacggcacgaccgcaagtacaccccggtcgccgagcgcgtgaagcattttcacgagttcgtcgttcccttgaccgagagggaaacgcgcgaccaggccgcgcgctgtatgaactgcggcattccctattgccacggcacaggctcggtcgcgcccggcacgccgggctgcccggtcaacaaccagatccccgatttcaacgacctcgtctatcagggcaactgggaagaggcctcgcgcaacctgcactcgaccaacaatttcccggagttcaccgggcgcatctgccccgcgccgtgcgaagcgtcctgcacgctcaacatcgacgacaacccggtcaccatcaagacgatcgaatgcgcgatcgtcgaccgcgcctgggacaatggctggctgaagccggaagtcgcctccgtcaagaccggcaagaaggtcgcagtgatcggctctggacccgccggcatggcctgcgcgcagcagctcgcgcgcgccggccacgacgtgcacctgttcgagaagttcgccaaggccggcggcttgctccgttacggcatccccgacttcaagatggagaagggcatcatcgaccgccgcgtcaagcagatggaaggcgaaggcgtcaccttccactacaacagccatgtcggcgctgacggcaatgtcgatccgcgcgagatgctcaacgagtatgacgccgtggcgctgaccggcggcgcggaagccccgcgcgacctgccgatccccggccgcgatctccaaggcatccactacgccatggacttcctgccgcagcagaatcgccgcgtctccgaggagccgctgaacggcgtcaccgagattttggccggcggcaagcatgtcgtcgtcatcggcggcggcgacaccggaagcgactgcatcggcacctcgctgcgccagggcgcgctgtccgtgacccagctcgagatcatgcccgccccgcccgagcgcgagaacaagggcctgacctggccgaactggccgctgaagatgcgcacctcctccagccaggccgaaggcgcgatccgcgaattcgccgtgctgacccagaagttttccggcgagaacggccaggtcaagaagctgcactgcgtgcgcgtcgacgacaagttcaagccgattgccggcaccgagttcgagctggatgccgagctcgtcctgctcgccatgggtttcgtccaccccgtgcatgagggcctgctcaagctgctctcggtcgagctcgacccccgcggcaacgtcaaggccaacacgctcgactaccagacctcgcgtccgaacgtgttcaccgccggcgacatgcggcgtgggcaatcgctggtggtctgggcgatccgtgagggccggctgtgtgcaaggtcgattgatacgttcttgatggggaagacggatctgccgcggtag

SEQ ID NO: 4568 - protein, 483 aa, Bradyrhizobium japonicum
MGKITGFLEIERHDRKYTPVAERVKHFHEFVVPLTERETRDQAARCMNCGIPYCHGTGSVAPGTPGCPVNNQIPDFNDLVYQGNWEEASRNLHSTNNFPEFTGRICPAPCEASCTLNIDDNPVTIKTIECAIVDRAWDNGWLKPEVASVKTGKKVAVIGSGPAGMACAQQLARAGHDVHLFEKFAKAGGLLRYGIPDFKMEKGIIDRRVKQMEGEGVTFHYNSHVGADGNVDPREMLNEYDAVALTGGAEAPRDLPIPGRDLQGIHYAMDFLPQQNRRVSEEPLNGVTEILAGGKHVVVIGGGDTGSDCIGTSLRQGALSVTQLEIMPAPPERENKGLTWPNWPLKMRTSSSQAEGAIREFAVLTQKFSGENGQVKKLHCVRVDDKFKPIAGTEFELDAELVLLAMGFVHPVHEGLLKLLSVELDPRGNVKANTLDYQTSRPNVFTAGDMRRGQSLVVWAIREGRLCARSIDTFLMGKTDLPR

SEQ ID NO: 4569 - DNA, 1800 bp, Bradyrhizobium japonicum
  CDS (1)..(1800)
atgaaaccgaccgatatcgcggcccccgactactttcacaaagtggtcgactgtcagtgggcctgtcctgcacacaccccggttcccgaatacatccgactgatcgcccaaggccgctacagcgacgcctacatgatcaattggaaatcgaacgtgtttcccggcattctgggacgcacctgcgatcgtccatgcgagccggcgtgccgccgcggacgcgtcgaggaaacaccggtcgcgatctgccgcctcaagcgcgtcgcagccgacttcaaggacgacatcacgcagcgcctgccgcgcccttcgccgaagaacggcaagcgcgtcgcgctggtcggcggcggtccggcctcgctgacggtggcgcgcgatctggcgccgctcggctatcactgcaccgtgttcgatgccgatccggaagccggcggcatgatgcgctcgcagatcccgaagttccggttgcccaattccgtgatcgacgaggagaccggctatatcctcaatctcggcgtcgagttcaaaggcggtcaccgcatcgagagcatgaaggcgctgctcacggagaagtacgacgcgatcttcgtcggctccggcgcgccgcgcggccgcgagctcgacattcccggccgcaaggaggccgccgccaacatccatatcggcatcgactggctgtcctccgtttcgttcggtcacaccgacaagatcggcaagcgcgtgatcgtgctcggcggcggcaacaccgcgatggattgctgccgcaccgcgcgccgcctcggcggcgagaaagtcacggtgatcgtgcgctccggctttgaggagatgaaggcctcgccgtgggagaaggaggacgcgatccacgaggatattccgatcctcaactacatggtgccggtggcattcaagcatgtcgccggcaagctcatcggcgtcaccttccagcacgtcaaagccgaatacgacgccaaaggccgccgcaacctggtgccttcgggcgaccccgagcagaccattccctgcgacgacgtgctggtcgcggtcggccaggagaacgccttcccctggatcgagcgcgactgcggcatcgcgttcgacaagtggaatatgccgcaggtcgaccccaagaccttcgtctcgaccaacccaaaggtgttcttcggcggcgatgccgctttcggcccgaagaacatcatctgggcggtggcgcagggccatgacgccgcgctgtcgatccacagactgctgtcgggcgaggacatcaccgagcggccgctgccggaggtgcacgtctcctcgcagaagatgggcatccacgaatggagctatgacaacgacatctccgtcgacaagcgcttcaaggtgccgcaccgcgacaaggtgatcgcgctgaaggacatccgcaccgaggtcgagctcggctacgatgtcaagctcgcgctcggcgaagcccatcgctgcctgaactgcgacgtgcagacggtgttctcgacctcgctctgcatcgagtgcgacgcctgcgtcgacatctgcccgatggactgcatcaccttcaccgagaatggcgaggaacccgatctgcgccagcgactgaaggcgccgtcgctgcaccccgaccaggatctttacgtgtcctccgatctcaagaccggacgcgtgatggtgaaggacgaggatgtctgcctgcattgcgggctgtgtgccgagcgttgtcccaccggagcctgggacatgcagaaatatttgatcgaaatgactcacgcaggttcagcatgtccgacaaaaagccgatcagcagcgtaa

SEQ ID NO: 4570 - protein, 599 aa, Bradyrhizobium japonicum
MKPTDIAAPDYFHKVVDCQWACPAHTPVPEYIRLIAQGRYSDAYMINWKSNVFPGILGRTCDRPCEPACRRGRVEETPVAICRLKRVAADFKDDITQRLPRPSPKNGKRVALVGGGPASLTVARDLAPLGYHCTVFDADPEAGGMMRSQIPKFRLPNSVIDEETGYILNLGVEFKGGHRIESMKALLTEKYDAIFVGSGAPRGRELDIPGRKEAAANIHIGIDWLSSVSFGHTDKIGKRVIVLGGGNTAMDCCRTARRLGGEKVTVIVRSGFEEMKASPWEKEDAIHEDIPILNYMVPVAFKHVAGKLIGVTFQHVKAEYDAKGRRNLVPSGDPEQTIPCDDVLVAVGQENAFPWIERDCGIAFDKWNMPQVDPKTFVSTNPKVFFGGDAAFGPKNIIWAVAQGHDAALSIHRLLSGEDITERPLPEVHVSSQKMGIHEWSYDNDISVDKRFKVPHRDKVIALKDIRTEVELGYDVKLALGEAHRCLNCDVQTVFSTSLCIECDACVDICPMDCITFTENGEEPDLRQRLKAPSLHPDQDLYVSSDLKTGRVMVKDEDVCLHCGLCAERCPTGAWDMQKYLIEMTHAGSACPTKSRSAA

SEQ ID NO: 4571 - DNA, 2292 bp, Bacteroides thetaiotaomicron
  CDS (1)..(2292)
atgaacaaaatcattagcaaagaacgcttttctgagaaagtgtttaaacttgaaattgaagctcctttaattgctaaatcccgcaaagccggccacttcgtcattgtacgtgtaggcgacaagggagaacgtatgcctctgacgattgccggttctgatttgaagaaaggcaccatcactctggtgatacaggaagtcgggctctcctctacccgtctttgtgaattgaacgaaggtgattatatcactgatgtagtaggtccgctcggacaagctactcatattgagaatttcggaacagttgtttgtgctggtggtggtgtaggtgttgctccgatgcttcctatcgtacaggctttgaaagctgccggaaacagagtgatcactgtattggcaggacgtaacaaagaccttatcattctggaaaaagaaatgcgcgaaagctccgatgaggtgattattatgacggacgatggctcttacgggcgtaaaggtctggtaaccgaaggcgtggaagaagtcatcaaacgtgaaaaggtagataaatgcttcgccatcggccctgctatcatgatgaagttcgtttgtctgctgacaaagaaatatgagattcctaccgacgtttcattaaataccatcatggtagacggaaccggcatgtgtggtgcttgccgtatcacggtaggaggaaaaacgaagttcgtttgtgttgacggtcccgaattcgacggtcatcaggtggactttgatgaaatgctgaaacgtatgggtgcgttcaaaaaaatagagcgtgaagagatgaacaaactccagcccgaatgtgaagcaacgaaagagatagatgagaaaagccgcaacgcagcctggagacaggaactgcgcaaatcgatgaaaccgaaagaacgtacagctattccacgtgtcgagatgaacgaactcgatgccgaataccgttcacatagccgcaaggaagaagtaaaccagggtctgaccgctgagcaagctgttacagaagccaagcgttgtctggactgcgctaaccctggatgtatggaagggtgtccggtaggcatcgacattccgcgcttcattaagaacattgagcgtggcgaattcctcgaagcagccaaaacactgaaagagacaagtgcgcttccggctgtatgcggtcgtgtctgcccacaggaaaagcaatgcgaatccaaatgtatacacttgaagatgaatgaaaaaccggtagctatcggttatctggaacgcttcgctgctgacttcgaacgtgaaagcggacaaatttcagtacctgtcattgccgaaaagaacggcatcaaagtggcggtgatcggttcgggtcctgccggattatcattcgcaggtgatatggcaaaatacggttatgatgtaacagtattcgaggcactccacgaaatcggcggtgtattaaaatatggtattccggaattccgtctgccaaacaagattgtagatgtagaaatagacaacctcgttaaaatgggcgttactttcatcaaagactgcattgtaggaaaaacaatcagtgtggaagatttgaaggaagaaggttttaaaggaatatttgtcgcttccggtgccggtttgcctaactttatgaatataccgggcgaaaactcgatcaatatcatgtcttccaacgaatacctcactcgtgtcaatctaatggatgctgcgagcgaagactctgacactccggtagctttcggcaaaaatgtggctgtcatcggtggtggtaatactgctatggactctgtccgtacagccaaacgcctgggtgctgaacgtgctatgatcatctaccgccgttcggaagaagaaatgcctgcacgtatcgaggaagtgaagcatgccaaagaagaaggagtcgaattcctgacattgcacaatccgattgaatatattgccgacgaacaaggttgcgtgaaacaggtcattctccagaagatggaattaggagagccggatgcttccggacgtcgcagtcctgtagccattccgggagctacggaaacaatcgatatcgatctggccatcgtcagtgtcggtgtatctccgaacccgattgttccgagttccattaaaggactggaattaggacgcaaaggaaccattgccgtagatgacaacatggaatcatctattccgatgatctatgccggcggagacattgtgcgcggaggagctaccgtaatccttgccatgggagatggccgtaaagccgccgctgccatgaatgaacaactgcaaagcaagtaa

SEQ ID NO: 4572 - protein, 763 aa, Bacteroides thetaiotaomicron
MNKIISKERFSEKVFKLEIEAPLIAKSRKAGHFVIVRVGDKGERMPLTIAGSDLKKGTITLVIQEVGLSSTRLCELNEGDYITDVVGPLGQATHIENFGTVVCAGGGVGVAPMLPIVQALKAAGNRVITVLAGRNKDLIILEKEMRESSDEVIIMTDDGSYGRKGLVTEGVEEVIKREKVDKCFAIGPAIMMKFVCLLTKKYEIPTDVSLNTIMVDGTGMCGACRITVGGKTKFVCVDGPEFDGHQVDFDEMLKRMGAFKKIEREEMNKLQPECEATKEIDEKSRNAAWRQELRKSMKPKERTAIPRVEMNELDAEYRSHSRKEEVNQGLTAEQAVTEAKRCLDCANPGCMEGCPVGIDIPRFIKNIERGEFLEAAKTLKETSALPAVCGRVCPQEKQCESKCIHLKMNEKPVAIGYLERFAADFERESGQISVPVIAEKNGIKVAVIGSGPAGLSFAGDMAKYGYDVTVFEALHEIGGVLKYGIPEFRLPNKIVDVEIDNLVKMGVTFIKDCIVGKTISVEDLKEEGFKGIFVASGAGLPNFMNIPGENSINIMSSNEYLTRVNLMDAASEDSDTPVAFGKNVAVIGGGNTAMDSVRTAKRLGAERAMIIYRRSEEEMPARIEEVKHAKEEGVEFLTLHNPIEYIADEQGCVKQVILQKMELGEPDASGRRSPVAIPGATETIDIDLAIVSVGVSPNPIVPSSIKGLELGRKGTIAVDDNMESSIPMIYAGGDIVRGGATVILAMGDGRKAAAAMNEQLQSK

SEQ ID NO: 4573 - DNA, 1341 bp, Bacteroides thetaiotaomicron
  CDS (1)..(1341)
atgggagatcctaaagcttttttaaatatacctcggcaagaggcgggataccgccccgttagcgagcgcatcactgactatagtcaggtagaacaaacattgaatacgaacagccgtaaattacaggcatcacggtgtatggattgcggagtacctttttgtcactgggcttgtccaataggcaataaacagccggaatggcaggacgctttattcaaaggaaaatggaaagaagcgtatgaagtgctgtcatccacttgcgactttccggaatttacaggacgtatctgccctgccctctgtgagaaatcctgtgtactgaaactatcctgtgaccaaccggtgactatccgtgaaaatgaagctgccattgtagaagccgccttccgtgaaggatatatacaggtgcagcatccccaaagaaacggcaaaaaagtagcagttgtcggtgccggtccggccggattggtagttgccaaccaactgaatctaaaaggatacaccgtaacgttattcgataaagatgaagctgcgggaggattattacgtttcggtattccaaacttcaaactggacaaaaacgtaatcgaccgccgcatgaaaatacttgccgcagaaggtattcagtttgaaatgggagtagaaatagacgttaaccatttgccggaaggattcgatgcatattgcatttgcacgggtacaccgactgcccgtgatttaagcattccgggacgggagttgaaaggaatccatttcgcactggaaatgctggcgcaacagaacaggattctggaaggacaaactttccccaaagacaaactggtgaatgccaaaggcaaaaaagtgcttgtgatcggcggtggagacaccggttcggactgtatcggaaccagtgtacgacagggagcaaccagcgtcacgcaaattgaaattatgcccaaacctcccgtcggccacaatccttctacgccctggccgcaatggccggtagttttcaaaacgacctccagccatgaagaaggttgtacccgtcgctggtgcctgacttccaatcagtttttgggtaagaacggtaaagtaaccggcgtcgaggtggaagaagtagaatggacaccggcaacagatggcggacgtccgaccatgaacctcacagggaagaaagaagtaatcgaagcagatatggtgctgctggccatgggattcctgaaaccggaacaaccgaaatttgcagaaaacgtattccttgccggagatgcagctaccggagcaagcctcgtagtacgggcgatggcaggaggacgaaaggctgctgcggacatagatcactatttggtgaagtaa

SEQ ID NO: 4574 - protein, 446 aa, Bacteroides thetaiotaomicron
MGDPKAFLNIPRQEAGYRPVSERITDYSQVEQTLNTNSRKLQASRCMDCGVPFCHWACPIGNKQPEWQDALFKGKWKEAYEVLSSTCDFPEFTGRICPALCEKSCVLKLSCDQPVTIRENEAAIVEAAFREGYIQVQHPQRNGKKVAVVGAGPAGLVVANQLNLKGYTVTLFDKDEAAGGLLRFGIPNFKLDKNVIDRRMKILAAEGIQFEMGVEIDVNHLPEGFDAYCICTGTPTARDLSIPGRELKGIHFALEMLAQQNRILEGQTFPKDKLVNAKGKKVLVIGGGDTGSDCIGTSVRQGATSVTQIEIMPKPPVGHNPSTPWPQWPVVFKTTSSHEEGCTRRWCLTSNQFLGKNGKVTGVEVEEVEWTPATDGGRPTMNLTGKKEVIEADMVLLAMGFLKPEQPKFAENVFLAGDAATGASLVVRAMAGGRKAAADIDHYLVK

SEQ ID NO: 4575 - DNA, 4452 bp, Mus musculus
  CDS (100)..(3177)
ccacgcgtccgggcaagctgaggctttggtgcggggctggaggctgctgcagcagagggagggtctgtgtgcgggagtctgaggccagaaagcgctgccatggcgggtgtgctgagcagggacgcgccggacatcgagagtatcctggctttaaaccctcgagtacaagctcatgcaactctgcgttccaccgcagccaagaaactagacaagaaacactggaaaaggaacacggacaagaactgctttacctgtgagaagctggagagtaattttgatgacatcaagcacacgactcttggtgagcgaggagctctccgagaagcagtgagatgcctgaagtgcgcagatgctccctgccagaagagctgtcccacatctcttgacattaaatcatttatcacaagtatcgccaacaagaactactatggtgcagctaagctgattttttctgataaccctcttggtcttacttgtggaatggtttgtccaacatctgacctctgtgttggaggatgcaacttacatgctgctgaagagggaccaattaatattggtgggctgcagcagtttgctactgaggtgttcaaagcaatgaacatcccacagatcagaaacccatcgctgcctcctccggaacatatgccggaagcctactcagcaaaaattgcactttttggtgcagggcctgcgagtataagctgtgcctcctttttggctcggttgggctattccaacattactatattcgaaaaacaagaatatgttggtggtttaagcacttctgaaatccctcagtttcgactcccatatgacgtcgtgaattttgagattgagctcatgaaggaccttggtgtaaagataatttgtggtaaaagcctttccaccgatgaaatgactcttagctctttgaaagaaaatggctacagagctgcatttattggaataggcttgccagaacccaaaaaggaccatattttccaaggcttgacacaagtccagggattttacacatctaaagactttctgccacttgtcgccaaaagcagtaaaacaggaatgtgcgcctgtcactctccattgccatccataaggggagccgtgattgtactcggagctggagatactgcgtttgactgtgcaacatccgctctgcgctgtggagcccttcgcgtgttcatcgtcttcagaaagggctttgttaatattcgagctgttccagaggagatggagctcgctaaggaagagaaatgtgaatttttgcctttcctctcgccacggaaggttatagtcaaagatggaaagattgtggcaatgcaatttgttcgaactgagcaagatgaaaccggaaactgggtggaagatgaagagcagacggtgcggctaaaggctgatgtggttattagtgcctttggatctgtcctggaggatcccaaagtgaaagaagcattgagtcccatcaagtttaacagatggggtctcccagaagtaaatccagaaaccatgcaaaccagtgaaccatgggtgtttgcaggtggtgatgttgtgggtatggctaacaccacagtggaatctgtcaacgatggaaagcaagcttcatggtacattcacaagcacatacaggcacaatatggaacctcagtgccttctcagcctacaatgcccctattttacactccggttgacttagtggacatcagcgtggaaatggcagggttgaggtttcccaatccctttggccttgccagtgcgacaccagccactagcacaccaatgattcgaagggcctttgaagctggctggggttttgctctgaccaaaactttctctcttgataaggacatcgtgacaaacgtctcaccaagaatcatccgggggacaacttctggccccttgtatggccctggacaaagctcctttcttaacattgagctcatcagtgagaaaacagctgcatattggtgtcacagtgtcaccgaactaaaggctgacttcccggacaatatcctgatcgccagcatcatgtgcagttacaacaagagtgactggatggaactctccaaaatggctgaggcttctggagcagatgccctggagttaaatttatcgtgtccacatggcatgggggagagaggaatgggcctggcttgtgggcaggatccagagctggtgaggaacatctgtcgctgggttaggcaagctgttcgggttccattttttgccaagttgaccccaaatgtcactgatattgtaagcatcgcaagagcagcaaaggaaggtggagcagatggtgtaacagccaccaacaccgtctcgggtctgatgggactgaaagctgatggcacaccctggcctgctgtgggcattggaaggaggactacatatggaggagtgtcaggaactgctatcaggcccattgctttgagagctgtgaccgccattgcccgtgctttgcctgggtttcctattttggccacaggtggaattgactcagctgaaagtggacttcagtttcttcatagtggtgcttcagttcttcaggtatgcagcgctattcagaatcaggacttcactgtgattgaagattactgcactggactcaaagccctgctttatctgaagagcattgaagagttagcagactgggatggtcagagtccacccattataagtcatcagaaagggaaaccagttccacgcgttgctgagctcatgggacagaaactgcccagctttggaccttaccttgaacagcgcaagaaaatcatagcagcaagcaaaatcagacagaaagatcaaaacacagcttgctcacctctccagagaaagcactttaactcgcaaaagcctattcctgccatcaaggatgtaattggaaaatcactgcaatacctgggaacatttggtgagatgagcatcatggaacaagttgtggccctgatcgatgaggaaatgtgcatcaattgcggcaaatgttacatgacctgtaatgactctggctaccaggctatccagttcgatccagaaactcacctgcctaccgttagcgacacatgtacaggctgtactctctgcctcagcgtctgccctattatggactgtatcaggatggtttccagggcaacaccttatcaaccaaagagaggcctaccattagccgtgaagccggtgtgttaaggtgatttgtaagacagctgctgtgaactttgatattacccatgtaggctgatctttaagaacaataacaattgtaatcattatgatcagttctttccaaattttatagctgaacaataacaattgtaatcattatgatcagttctttccaaattttatagctatgcatatataatttctaaataagtgtctaaattggaaaacaatgtctaatgccagtgacaaattaatggtcataaaatggaataactcttctctgaggtagctggtgagtaactgcagaccagttaattggatgtgctctgtccgttgtgtgctgtgaaaaattaactttttcatggcaattagcgtgacaatttctaaattgccctatgccgtactcactctttgatttctaattgtaaacgaaatgaactattttggaacggagtgcactttcatatacaggaaaccgtttccaaggaaacgctttgtaattaaaaattacctgtaattttaacactgtttctaaggacatgtaattagttccattaagaacaattgaagaaagtcaaggcattatttactatgacaagggggaagaaaacctggaagagggtttctagagttttctaaagtccccctttgctgaagtaactcactcttcggtgctggacacggaaagggagattatttcctgactaaaatgctgttgaccacctgaaacaggtgtcagactgaccagggatggagtcctggccatttttatttgaataccaaagcggtgttcctaatgaaataagatatcgaggtgaatgtctggtgaatggcccactttcactgagcacagacagctagatctgcttcttttagtcaccttcattatgagagcaattaatgttcaaacaagggctagattacacagcgctgagccataggcttcaagattcaacaacaaagtgtgtcatatctgaacctgctacataataaacctaactaactttactttgatactcatgtgaattcaaaattaatgaaagagaaatgtgtatctttggatattgatcagtgtttttccccatatctttatttttataatcagtaaatagcatcacataaattcatttattccttctttatggcacattttaaaatgaatctatagaaagtaagtgagaaatgacaacctgtggaatatttctatgataaatgcaagatatctacaagtgcattttaaaaaatgtgtatgatttaaaaatcacaaataaaattttatgatctaaaaaaaaaaaaaaa

SEQ ID NO: 4576 - protein, 1025 aa, Mus musculus
MAGVLSRDAPDIESILALNPRVQAHATLRSTAAKKLDKKHWKRNTDKNCFTCEKLESNFDDIKHTTLGERGALREAVRCLKCADAPCQKSCPTSLDIKSFITSIANKNYYGAAKLIFSDNPLGLTCGMVCPTSDLCVGGCNLHAAEEGPINIGGLQQFATEVFKAMNIPQIRNPSLPPPEHMPEAYSAKIALFGAGPASISCASFLARLGYSNITIFEKQEYVGGLSTSEIPQFRLPYDVVNFEIELMKDLGVKIICGKSLSTDEMTLSSLKENGYRAAFIGIGLPEPKKDHIFQGLTQVQGFYTSKDFLPLVAKSSKTGMCACHSPLPSIRGAVIVLGAGDTAFDCATSALRCGALRVFIVFRKGFVNIRAVPEEMELAKEEKCEFLPFLSPRKVIVKDGKIVAMQFVRTEQDETGNWVEDEEQTVRLKADVVISAFGSVLEDPKVKEALSPIKFNRWGLPEVNPETMQTSEPWVFAGGDVVGMANTTVESVNDGKQASWYIHKHIQAQYGTSVPSQPTMPLFYTPVDLVDISVEMAGLRFPNPFGLASATPATSTPMIRRAFEAGWGFALTKTFSLDKDIVTNVSPRIIRGTTSGPLYGPGQSSFLNIELISEKTAAYWCHSVTELKADFPDNILIASIMCSYNKSDWMELSKMAEASGADALELNLSCPHGMGERGMGLACGQDPELVRNICRWVRQAVRVPFFAKLTPNVTDIVSIARAAKEGGADGVTATNTVSGLMGLKADGTPWPAVGIGRRTTYGGVSGTAIRPIALRAVTAIARALPGFPILATGGIDSAESGLQFLHSGASVLQVCSAIQNQDFTVIEDYCTGLKALLYLKSIEELADWDGQSPPIISHQKGKPVPRVAELMGQKLPSFGPYLEQRKKIIAASKIRQKDQNTACSPLQRKHFNSQKPIPAIKDVIGKSLQYLGTFGEMSIMEQVVALIDEEMCINCGKCYMTCNDSGYQAIQFDPETHLPTVSDTCTGCTLCLSVCPIMDCIRMVSRATPYQPKRGLPLAVKPVC

SEQ ID NO: 4577 - DNA, 1464 bp, Staphylococcus epidermidis
  CDS (1)..(1464)
atgggcgaatttaaaggatttatgaaatatgataaacagtcgctatcagaattgtctttggtagaccgtctttcgaatcatgaagcgtttcaacaacgcttcactaaagaagatgcttcgattcagggtgcgcgctgtatggattgtggaacacctttttgtcaaactgggcaatcttatggaagagaaacaataggatgccctattggtaattatatacctgagtggaacgacttagtctatcatcaagattttaaagctgcttacgaaagattgagagagacgaataattttcctgaatttacaggaagagtttgtcctgcaccatgtgagcaatcatgtgttatgaaaattaatagagaatccgtggcgattaaaggtattgaacgtacaattattgatgaagcatatgagaatgagtgggttcatcccgcatatcctgaagatcataaagaccaacgagttgctatcgtaggtagtggtccagcgggacttacagcagctgaagaattaaactttaaaggctataaagttactgtttatgaaaaggcgcatgaaccaggcggcttgctaatgtatggtataccaaatatgaaactagataaagacgtaatacgtcgacgtgtatcacttatgaaagatgctggggttttatttaaaacaggcgttgaaattggcgtcgatgtgagccgtgaaacacttgaagaaaattatgatgctattattttatgcacaggtgctcaaaatgcgagagatttaccattggaaggacgaatgggctctggtattcattttgcaatggactatcttactgaacaaacacagtatctaaatggtgagattgaaagtttgagcattactgctaaagataagaatgtaattattataggtgctggtgatactggtgcagactgtgtagcgacagcattacgtgaaaactgtaaatctattgttcaatttaataaatatacgaaacagcctgaagagattacttttgaaagtaatacttcctggccattagcaatgcctgttttcaaaatggattatgcgcataaggaatatgaagctaaatttggtcaagaaccaagagcctatggtgtacaaacaatgcgctatgatgttgacgagttaggaaatgttaaaggcttatatacacaaatattaaaagaaacgcctgatggcatggtgatggaagatggaccagaacgattttggccggctgatttagtcttattatctatagggtttgttggtactgaaaccactgttccgcatgcgtttgatatacacaccgagcgtaataaaattgtagctaatgatacaaattatcaaactaatcacgctaaaatatttgctgcaggagatgcaagacgaggtcagagtttggttgtttgggcaataaaagaaggtcgtgaagtagcacattctgttgatcaatacttaagtaaagaagttctagtgtag

SEQ ID NO: 4578 - protein, 487 aa, Staphylococcus epidermidis
MGEFKGFMKYDKQSLSELSLVDRLSNHEAFQQRFTKEDASIQGARCMDCGTPFCQTGQSYGRETIGCPIGNYIPEWNDLVYHQDFKAAYERLRETNNFPEFTGRVCPAPCEQSCVMKINRESVAIKGIERTIIDEAYENEWVHPAYPEDHKDQRVAIVGSGPAGLTAAEELNFKGYKVTVYEKAHEPGGLLMYGIPNMKLDKDVIRRRVSLMKDAGVLFKTGVEIGVDVSRETLEENYDAIILCTGAQNARDLPLEGRMGSGIHFAMDYLTEQTQYLNGEIESLSITAKDKNVIIIGAGDTGADCVATALRENCKSIVQFNKYTKQPEEITFESNTSWPLAMPVFKMDYAHKEYEAKFGQEPRAYGVQTMRYDVDELGNVKGLYTQILKETPDGMVMEDGPERFWPADLVLLSIGFVGTETTVPHAFDIHTERNKIVANDTNYQTNHAKIFAAGDARRGQSLVVWAIKEGREVAHSVDQYLSKEVLV

SEQ ID NO: 4579 - DNA, 1437 bp, Streptococcus mutans
  CDS (1)..(1437)
atggcagatccgtttggatttttaaagtatgagcgcaaggacaatccctatcgtcctgttaatgagcgtatcaaagattttgaagaattgcagacaactttatcagttgaggaacgtcaaaagcaagctgctcgctgtatgaattgtgggatccctttctgtcatgagggaactttctatggtggcggtcgtgctgtttcaggttgtcccaatgacaatttaatccctgaatggaatgatttgatttataagggcgatttcagacgtgcttttgaacgcttgacacgaactaaccctttaccagaaatgacaggtcgtgtctgcccggcaccttgtgaaaaggcctgtacagaaggcttaaatggttcgggtgttaccattcatgataatgaacgttttattattgataatgcatttgaagaaggctgggtagctgattctggtcgccctattgagcgtacaggttttaaagtagctgtcgtaggttcaggtcctgctggcctgtcagctgcttggcgtcttaaccagttgggtcacagtgtaactgtgtttgagcgttctgatcgctttggtggtttgctcatgtatggtattcccaatatgaaattggataagaaaattgtgcaacgccgtattgatacgatggcttcaattggtattaattttgttgccaatacagaaattggtcgtgatattacagcagaagaattattagaaaaatttgaccgtgtaatcttggcaactggagctagcgttcctcgtgacttggatattccaggccgtgacttaaaaggcattcgatttgctgttgatttcttaacagaaacgactaaaaatcttttggacagtgacacacacgaattaccgcccttgcttgaaggaaaacatgtcttagttattggcggtggcgatactggaaatgactgtatcggtacggctgttcgtttgggagctgctagtgttagacaattagaaattacgccgcaactgcctgaaaagcgtctgccaacaaatccatggccacaatatcctatgattaatcgtacaggctatggacaggaagaagccgattttgttcaacagactgatttgacggactatatcacgtcaacagtagaatttcttggtgaaaatggccaagtgactgcggtgaagacaattaaggttggacctggtttcaaagccattgaaggaactgaagaggtaattaaggcagatcttgttcttcttgctatgggcttcacaggtgctgaaaaagcgctctttgaccaattccgagttgaatgtgtttatgatgactattcaactcgaaatgagaaggtttttgttgcaggtgatgcacgccgtggtcctagtcttgttatttggggaattcgagaaggacgcaaaacagcagagaaaattgatcaaaacctcagaatgatggttacagagtag

SEQ ID NO: 4580 - protein, 478 aa, Streptococcus mutans
MADPFGFLKYERKDNPYRPVNERIKDFEELQTTLSVEERQKQAARCMNCGIPFCHEGTFYGGGRAVSGCPNDNLIPEWNDLIYKGDFRRAFERLTRTNPLPEMTGRVCPAPCEKACTEGLNGSGVTIHDNERFIIDNAFEEGWVADSGRPIERTGFKVAVVGSGPAGLSAAWRLNQLGHSVTVFERSDRFGGLLMYGIPNMKLDKKIVQRRIDTMASIGINFVANTEIGRDITAEELLEKFDRVILATGASVPRDLDIPGRDLKGIRFAVDFLTETTKNLLDSDTHELPPLLEGKHVLVIGGGDTGNDCIGTAVRLGAASVRQLEITPQLPEKRLPTNPWPQYPMINRTGYGQEEADFVQQTDLTDYITSTVEFLGENGQVTAVKTIKVGPGFKAIEGTEEVIKADLVLLAMGFTGAEKALFDQFRVECVYDDYSTRNEKVFVAGDARRGPSLVIWGIREGRKTAEKIDQNLRMMVTE

SEQ ID NO: 4581 - DNA, 1419 bp, Vibrio vulnificus
  CDS (1)..(1419)
atgaacatgagccagaatgtataccagtttatcgatgttcaacgtgtcgatcctgctaagaagccgctgcagattcgcaagatcgagttcgtcgaaatctacgaaccctttactaaacagcaagcgaccgctcaagcggatcgctgcttagattgtggtaacccttattgtgaatggaagtgcccggtacacaactacatccctcagtggctaaaactggccaatgaaggacgaattttggaagcggtcgagctttcacatcagaccaacagcttgccggaagtgtgtggccgagtttgccctcaagaccgactgtgtgaaggctcttgcacattaaatgacgactttggtgccgtcaccatcggtaatattgaaaaatacatcaccgacaaagcctttgagatgggctggaagccagacatgtccaaagtcgaatggacagataagaaagtggccatcattggcgcgggccctgcaggtctcgcggcggctgatattttggtgcgcaatggggtcaaacccgttgtcttcgaccgctacccagagatcggtgggctactgacgtttggtattccgtctttcaaactggaaaaaggggtgatggaaaaccgccgccgcattttcagcgaaatgggggttgagttccgcatgaacgtcgaagtcggtaaagatgtacagatgcaagaactgctggaagagtatgatgccgtgttccttggcgtcggcacctacaaatacatgcgtgctggtttggagaatgaggatgcctccggcgtgtatgacgccctgccttttttgatttccaacacttacaaagtaatgggccttgaacacgaccagcctttcatcgatatggcgggcaaaaatgttgtcgtgcttggtggcggtgataccgcgatggactgtgttcgtacttctatccgccaaggcgctgccaatgtcgtttgtgcctatcgtcgcgatgaagagaacatgccaggctcacgtcgtgaagtgaaaaacgccaaagaggaaggggtgaactttatgtttaacctgcaacctctgtcgattgacgtggacactcgcggacaagtgacgggcgtgaaagtggtgcagactgcgttaggtgagcccgatgaggcaggccgccgtcgtcccgaacctgtggcaggcagtgagcatgtgttacctgccgatgtggtgatcatggcctttggcttccaaccccatcaaatgagttggttggagccttatggagttgagctcgaccaatggggtcgcatcaaagctgctgcgaaacagacttaccaattccaaaccagcaatgagaagatttttgccggtggtgatgcggtgcgtggttccgatttggtggtgacggcgattgatgaaggccgtaaagccgcggaaggcatattagattatctcgaactctaa

SEQ ID NO: 4582 - protein, 472 aa, Vibrio vulnificus
MNMSQNVYQFIDVQRVDPAKKPLQIRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTDKKVAIIGAGPAGLAAADILVRNGVKPVVFDRYPEIGGLLTFGIPSFKLEKGVMENRRRIFSEMGVEFRMNVEVGKDVQMQELLEEYDAVFLGVGTYKYMRAGLENEDASGVYDALPFLISNTYKVMGLEHDQPFIDMAGKNVVVLGGGDTAMDCVRTSIRQGAANVVCAYRRDEENMPGSRREVKNAKEEGVNFMFNLQPLSIDVDTRGQVTGVKVVQTALGEPDEAGRRRPEPVAGSEHVLPADVVIMAFGFQPHQMSWLEPYGVELDQWGRIKAAAKQTYQFQTSNEKIFAGGDAVRGSDLVVTAIDEGRKAAEGILDYLEL

SEQ ID NO: 4583 - DNA, 1407 bp, Shewanella oneidensis
  CDS (1)..(1407)
atgagtaacgattttcaatttattgaagtgggtcgcaaagacccaaccaaacaccctgcggcaaaacgttcgactcagtttattgagatttatcagccctttgcacaggctcaggtgagcgaacaagcggatcgctgtttagattgtggtaacccttactgtgagtggaagtgtccactgcacaactacattcctaactggctaaagctcgcgcaacagggccggattatggaggcggcagatttagtccatgagaccaataccctgcccgaaatttgcggccgcgtctgtccacaggacagactctgtgaaggcgcctgtaccctaaacgccgactttggcgctgtgactatcggtaatgtggaaaaatacattaccgataccgctatcgcccaaggctggcgtccggatatgagcaaggtcacgccacgtaaagaaaaggtcgcgattgtcggcgcaggaccagcgggtttaggctgcgccgatattcttgcccgcaatggagtaaaggctgtggtgtttgataagtatccccaaattggtggcctgctgacctatggtatccccgcctttaaactggataaagccgtaatggcgactcgccgcactgtgttagaaggcatgggcattgagttcaaactgggcgtaactgtcggcaaggacgttgcctttaatcaattgcttgaggaatacgatgccgtcttccttggcatgggaacctacaccgccatgaaagcgggccttgagggtgaagatgctcaaggcgtttaccaagccctgccctatttgattggtaatacccatcacctgatgggcagcacaagccctgatatgccttatcttaaccttgccggtaaacgcgtagtggtcttaggtggcggtgataccgccatggattgtgttcgtaccgccgtgcgccaaggtgccagcagtgtaatttgtgcctatcgccgtgatgaggccaacatgccaggttctcgccgcgaagtacaaaatgcccgtgaagagggagtgaacttcctgtttaaccgtcaacccgtggcgattaaaacccaggatggcaaagtgctaggtgtggaatgcgttgaaacccagatgggcaaggcggatgccagtggtcgtcaacgggccgaagcgattgtgggcagtgagcagttactcgaagccgatgcagtgattatcgccttcggtttccaaccaagcccagcgccttggtttgccgattacggcattgaactcgaccaatggggccgagtaaaagccagtaaacaggccgataatcctttccaaaccaccaatcccaaggtatttgctggcggcgatatggtaagaggctcggaccttgtcgttaccgcgattgccgaaggacgggatgccgcgcaaggcattcttaactatctggattaa

SEQ ID NO: 4584 - protein, 468 aa, Shewanella oneidensis
MSNDFQFIEVGRKDPTKHPAAKRSTQFIEIYQPFAQAQVSEQADRCLDCGNPYCEWKCPLHNYIPNWLKLAQQGRIMEAADLVHETNTLPEICGRVCPQDRLCEGACTLNADFGAVTIGNVEKYITDTAIAQGWRPDMSKVTPRKEKVAIVGAGPAGLGCADILARNGVKAVVFDKYPQIGGLLTYGIPAFKLDKAVMATRRTVLEGMGIEFKLGVTVGKDVAFNQLLEEYDAVFLGMGTYTAMKAGLEGEDAQGVYQALPYLIGNTHHLMGSTSPDMPYLNLAGKRVVVLGGGDTAMDCVRTAVRQGASSVICAYRRDEANMPGSRREVQNAREEGVNFLFNRQPVAIKTQDGKVLGVECVETQMGKADASGRQRAEAIVGSEQLLEADAVIIAFGFQPSPAPWFADYGIELDQWGRVKASKQADNPFQTTNPKVFAGGDMVRGSDLVVTAIAEGRDAAQGILNYLD

SEQ ID NO: 4585 - DNA, 4287 bp, Shewanella oneidensis
  CDS (1)..(4287)
atgatagaacttcgaatcgacaataagatagtctcggccgaaccgagcgataacctattacacgcagcccgtaaggcgggtattgctattcccagcctgtgcgatcccactgacgcctcacggcaattggacacgcaagcccatgccgaaaagcaggactgtaacctctgtctggtgcaaatcgaaaatagcgatgccagcctacgctgtgttaaagcctgtgaaaccccagcccaaacaggcatgaaggtcatcacccaatcggcgtttttaaccaaacaacgccaagcagcactgaacgctattttgagcgatcactttgccgactgtgaggcgccctgccaacaagcctgcccagcgggtgttgatgtgcagcgttatctgtaccacattgcccaaggtgaccacactcaagcggttaaagtcattaaagaaacattgccactgccactgtcgattggccgagtttgccccgcgttttgcgaaaccgaatgccgccgcggcctcatcgacgacccgattgccatccgccaacttaagcgccatgccgccgatttagatttagccgatgacgagcacggcaatagttatcaaccgccacgcctcgcagacactggcaagaaaattgcgattattggctctggcccagcgggcttaagcgcgggttattacctgtctaaccaagggcataatattgagatttttgaggccatgcccaaggccggtggttggctgcgctacggtattcccgaataccgtttacccaaagcgattctcgataaagaaattgagttgctgtgtcgtaatgggttaaccattcatacccaaatgcgcctaggtcatgagatccatttaaaccagctgatcaccgattttgatgcagtgtgccttgccatcggcgcccaaaaagcagtgccaatgcactataaaggctccgagcttgctggctgctatcttggggtggattttcttaaggatcattgcctcgataagcaattgaagcttggtaaaaaagtggcggtaattggcggcggcaacaccgccatagattgtgctcgcacagcggtgcgcgaaggctgcgatgtcaccttaatctaccgccgtacccgcgccgaaatgcccgctgaagcctacgaagtgcacgaggccgaagttgaaggggttaagtttcacttcttaaccaatccacttgaaaaccatagtgatgccgacggtcgagtgcagtcggtcacctttagcaaaatgacgctcggcgaagccgatgcctcgggcagacgtgcgccagtggacacgggggaaacctttaccgaagcctttgatacagtgatcgccgccgtatctcaagcgccagatctgagctttatgcaagatcctaaaggacagcttagccatggcgaactggcgctgagccgttggaacacactaatgggttgtgagcaaaccatgtcatcgggcgtggaaaagctgtttgtgatgggcgatgcccgccgcggcccagccaccgccgttgccgccattggtgatggccgaaaggcagcaaaagccattgataaaatgcttcaaattggccttagctgcgatttgcatgcccatgaatttaactcggtaaaaaccattccgggctcccttaaacaggctgaggtcaaatcagcagaagcaagttcacccctctacccccatacaaaacgtcagccccgcttaaaaatgcccgaactcacggcgctgcaacgactactcaattacagtgaagtagaattgggctttcccgcagatgccgccatgcaagaagcggcacgttgccttgagtgtgcttgccaagccaatactgactgtaaacttagggattacgccacggattacggtgttgagagcaaaagcttagccaccgaaaatgcacggtattttagcgtagataagagttcgccctttattcaattcgatgccaaccgttgtattagctgcggcaaatgcgtcgatgtgtgtcagcagcagagtggtcactgcgcgattcaattcgcgaaagactcctaccaagtactgccgcagagcatcagtcctgctgatgagcgaagagcccccagagttggctttagtgccagcatggccgatagccactgcgtacaatgtggtaactgtgtgcaggtttgcccaacgggcgcgctggtcgatgcgcgggataaacgccaaggcgattgtacagagttaacaaccgcctccaccatttgtacttactgcggtgtcggctgtcgtctcgatcttaaaatcgaccccagcaccaatcgtattcgccatatcgaaggcaacaaagactcggtcgttaaccaaggcatgttatgtgttaaagggcgttttggcttcgattttattcacagcgacaaacgcctaaccaccccactaatacgtaaaaacggcaaactgcaaccttgtagttggccggaagctatcgactatgtagcaaaacgtttaaccgagataaaacaaaaagatggcagcaatgccttcgcaagtctcgcctcggccaaggccaccaatgaagataactttgtactgcaaaagtttgtccgtagcgtccttggcaccaacaacatcgaccattgcgcccgcctgtgtcactcctcgaccgttacgggcctgcagcagagcattggtagcggcgccatgaccaatgatattctgagtataaaggactccgacgtcatttttattctgggttccgataccacctgcgcccatccgattatcgcctcaaaaatccagcaggcagtcaacctgtacggcgctcggttgatcgtggccgatccgaaacgcgttggcatagcagaaaaggccgaactctatgttgcccacagaccgggcacggatgtgatgctgctcaacgccattatggcagaaattattcgcaataattggcaggataaagactatattgccaagcggaccgaaggcattgaggcactgtatgccgagcttgccaaggaggattactcccttgaaaaagcggcacttatcacaggtgttaaagctgagaatatcgcccgtattgcgcgtaccataggcacggcgcaaaaaacggcggtgtactacgccatggggataacccaacataccacggggcacgataacgtcaccgccatatctaatctgcagctactttgcggcaatattggtgtgtcaggagctggcatcaacccactgcgcggccagagtaatgtgcagggcgcctgcgatatgggcgcgctgcccaactattttaccggttaccaaaaggtcacggatattcatgccagaatgcgcttcgaaagccattggcaaactccgttatcgggggagattggcgtcacagcaacccatatgatgcatgatattgccaagggcaaaatcaacgccttatatgtgatgggtgaaaacccagtgctgagcgatcctgaccaagcccatgtgcttaacgccttaagccagattgagtttttagttgtccaggacatctttttaaccgagaccgctgagcttgcccatgtggtgttgcccgccgccgcttttgtggaaaaacgcggccactttaccaacaccgaacgacgagtacagcgacttgagcaagcgcttgcctcaccgggtgaagcgctgcccgattggcaaatcgtacaagcgattgccaatgctatgggagcaaactgggattataaagatgaagcagcaatttgggctgaaattaatgcattaacgcctcagtatcgcggcattctttgggagagattaaccgctggtgaggatggtcaaatccctcaaggtattcaatggccttgtccggatgaaaagcatccgggaacaccgattatgcaccaaggtcaattcacccgcggtttaggtttatttacgccggtcagctatcgccttcccgctgaaatgccctgcaacgagtatccacttacgctctcgacaggtcgtctattggagcaattccatacgggcaccttaacgcgcaaaacgcccgggctggacttacttggtgcacctaaagtgatgatttctgtctacgatgccgaacaactcgggattaataacggcgataaaattcgcctaaccacccgccgtggcgagattgaaattgatgcctttgtgacaaaacgcgctcaggcaggcgtactgttcttacccttccattttgtcgaagccgcagcgaacaaactcaccatcaatgcattagatcccgtggcttatatccccgagtataaagtgtgtgcggtaagagttgaaaaggtgacaaagcagatgtgtgagcccacctaa

SEQ ID NO: 4586 - protein, 1428 aa, Shewanella oneidensis
MIELRIDNKIVSAEPSDNLLHAARKAGIAIPSLCDPTDASRQLDTQAHAEKQDCNLCLVQIENSDASLRCVKACETPAQTGMKVITQSAFLTKQRQAALNAILSDHFADCEAPCQQACPAGVDVQRYLYHIAQGDHTQAVKVIKETLPLPLSIGRVCPAFCETECRRGLIDDPIAIRQLKRHAADLDLADDEHGNSYQPPRLADTGKKIAIIGSGPAGLSAGYYLSNQGHNIEIFEAMPKAGGWLRYGIPEYRLPKAILDKEIELLCRNGLTIHTQMRLGHEIHLNQLITDFDAVCLAIGAQKAVPMHYKGSELAGCYLGVDFLKDHCLDKQLKLGKKVAVIGGGNTAIDCARTAVREGCDVTLIYRRTRAEMPAEAYEVHEAEVEGVKFHFLTNPLENHSDADGRVQSVTFSKMTLGEADASGRRAPVDTGETFTEAFDTVIAAVSQAPDLSFMQDPKGQLSHGELALSRWNTLMGCEQTMSSGVEKLFVMGDARRGPATAVAAIGDGRKAAKAIDKMLQIGLSCDLHAHEFNSVKTIPGSLKQAEVKSAEASSPLYPHTKRQPRLKMPELTALQRLLNYSEVELGFPADAAMQEAARCLECACQANTDCKLRDYATDYGVESKSLATENARYFSVDKSSPFIQFDANRCISCGKCVDVCQQQSGHCAIQFAKDSYQVLPQSISPADERRAPRVGFSASMADSHCVQCGNCVQVCPTGALVDARDKRQGDCTELTTASTICTYCGVGCRLDLKIDPSTNRIRHIEGNKDSVVNQGMLCVKGRFGFDFIHSDKRLTTPLIRKNGKLQPCSWPEAIDYVAKRLTEIKQKDGSNAFASLASAKATNEDNFVLQKFVRSVLGTNNIDHCARLCHSSTVTGLQQSIGSGAMTNDILSIKDSDVIFILGSDTTCAHPIIASKIQQAVNLYGARLIVADPKRVGIAEKAELYVAHRPGTDVMLLNAIMAEIIRNNWQDKDYIAKRTEGIEALYAELAKEDYSLEKAALITGVKAENIARIARTIGTAQKTAVYYAMGITQHTTGHDNVTAISNLQLLCGNIGVSGAGINPLRGQSNVQGACDMGALPNYFTGYQKVTDIHARMRFESHWQTPLSGEIGVTATHMMHDIAKGKINALYVMGENPVLSDPDQAHVLNALSQIEFLVVQDIFLTETAELAHVVLPAAAFVEKRGHFTNTERRVQRLEQALASPGEALPDWQIVQAIANAMGANWDYKDEAAIWAEINALTPQYRGILWERLTAGEDGQIPQGIQWPCPDEKHPGTPIMHQGQFTRGLGLFTPVSYRLPAEMPCNEYPLTLSTGRLLEQFHTGTLTRKTPGLDLLGAPKVMISVYDAEQLGINNGDKIRLTTRRGEIEIDAFVTKRAQAGVLFLPFHFVEAAANKLTINALDPVAYIPEYKVCAVRVEKVTKQMCEPT

SEQ ID NO: 4587 - DNA, 1485 bp, Oceanobacillus iheyensis
  CDS (1)..(1485)
atgggaaaacaaacgggttttatggagtatgaacgacaaacgcgtcctggtagaaatccacaagagcgtgttaaagactggaacgattatacggcaccgatgtcagatgaggaagtgcaaaaacagggtgctcgttgtatggattgtggtgttcctacgtgtcatcaaggaattgagatagcaggggtaacttcaggttgccctgtctatcacttaattccagagtggaataacttagtatatgaggggaaatggagagaagcacttgataaagaacatcaaatgaataatttccctgaatttacaggaatcgcatgtccggccccttgtgaaggtgcatgtgtgttaggaataaatgagcctgcggtagctatccgtacggtggaacgttcgattattgaaaaaggatttgaagaaggatgggttgtaccaaatccaccaaaaatccgaactggtaaacgtgtagcaatagttggatctggtccagccggtttagcagcagcagatcagttaaacaaagcaggacattctgttacagtttatgagcgagataagcgcgttggtgggctattaacatatggaattccagaaatgaaactatcttatgatattgtaatcagacgtgtgtccatcttagaacaagaaggcattgagtttattacgaatacagaagttggtaaagatattacaaatgaagagttacaagaaacatatgattccgttgtactatgtggcggtgcaagtttacatcgtgacatgccagtagaaggtagtcagcttaaaggagttcatcctgctatggactttttacatgccaatgttgaaagtctattagattctaacttagaagatggaagctatatttcagctaaagataagaatgttatcgtcattggtggtggtgatacaggaacggattgccttgctacctctgttcggcataattgtaaaagccttacacaatttgatatctatgaaaaacgtaatcttttacgtgatgaagaagcaaatccatggccccaatatccaaaaattcatcgagtggagtatggtcaaaaagaagcggaagcacaatttggtgaggatccacgagcttatgcagttcagactacaaagtttgtaggcgatgaaaacggtcatgtgaaagaagtgcacacgattaacgtaaagacacgttatgaaggtggtaagaaaattcgtgaagaaataccaggaacagaaaaagtgtggccagcggatctagtattagttgctattgggttccaaggaccagatcaagatctaatcgaatcattagatgttgaaacaacaacacgttctacagtgaaagcaaaatacggcgaatttcaaacgaatatcgacggtgtttttgcagctggagatatgcgacgaggtcagagtctaatcgtctgggcaataaatgaaggacgaggagctgcacgtgagtgtgatcgtttcttaatgggagacacgatacttccataa

SEQ ID NO: 4588 - protein, 494 aa, Oceanobacillus iheyensis
MGKQTGFMEYERQTRPGRNPQERVKDWNDYTAPMSDEEVQKQGARCMDCGVPTCHQGIEIAGVTSGCPVYHLIPEWNNLVYEGKWREALDKEHQMNNFPEFTGIACPAPCEGACVLGINEPAVAIRTVERSIIEKGFEEGWVVPNPPKIRTGKRVAIVGSGPAGLAAADQLNKAGHSVTVYERDKRVGGLLTYGIPEMKLSYDIVIRRVSILEQEGIEFITNTEVGKDITNEELQETYDSVVLCGGASLHRDMPVEGSQLKGVHPAMDFLHANVESLLDSNLEDGSYISAKDKNVIVIGGGDTGTDCLATSVRHNCKSLTQFDIYEKRNLLRDEEANPWPQYPKIHRVEYGQKEAEAQFGEDPRAYAVQTTKFVGDENGHVKEVHTINVKTRYEGGKKIREEIPGTEKVWPADLVLVAIGFQGPDQDLIESLDVETTTRSTVKAKYGEFQTNIDGVFAAGDMRRGQSLIVWAINEGRGAARECDRFLMGDTILP

SEQ ID NO: 4589 - DNA, 3099 bp, Escherichia coli O6
  CDS (1)..(3099)
atgggggatattatgcgtcccattccgtttgaggaacttttgacgcgcatatttgatgaataccaacaacaacgctcaatctttggtattcccgagcaacagttttactcacccgtaaaaggtaaaactgttagcgtcttcggtgaaacctgtgccactcccgtcggccctgccgctggcccgcacacgcaacttgcgcaaaacatcgtcacctcctggctgactggcggacgcttcatcgaactaaaaaccgtccaaattcttgaccgcctggagctggaaaagccctgtatcgatgccgaagacgagtgctttaacaccgaatggtctaccgaatttaccctgcttaaagcctgggatgaatacctcaaagcctggtttgccctgcaccttctcgaagcgatgttccagccttctgattccggtaaatcgttcatctttaatatgagcgtcggttacaacctcgaaggtattaagcaaccgccgatgcagcagttcatcgacaatatgatggacgcatctgaccatccgaaattcgctcaataccgcgatgcacttaataagctactccagaatgaggcatttttagcccgccacggattgcaggaaaaacgcgaaagcttgcaagccttacccgctcgcatccccaccagcatggtacaaggggttaccctctccaccatgcacggctgtcctccgcatgaaatcgaagccatttgccgctacatgctggaagaaaaagggctcaacacctttgtgaaactcaacccgaccttactggggtacgcgcgtgttcgtgagatcctcgatgtctgcggtttcggttacatcggcttaaaagaagagtcatttgatcacgacctcaagctgacgcaagcgctggaaatgctggaacgcctgatggcactggcaaaagaaaaatcactcggctttggcgtaaaactgactaacactctcggcaccattaataacaaaggcgcactgcctggtgaagagatgtatatgtcaggccgtgcgctgttcccgctctccatcaacgttgcagcagttctctctcgcgcctttgacggcaaactgcccatttcttattccggtggtgccagtcagctgactatccgcgatatttttgatactggtattcgccctattactatggcaaccgacctgctgaaacctggcggctatctgcgcttaagtgcctgcatgcgcgagctggaaggctccgacgcctggggacttgaccatgttgacgtcgaacgactgaacagactggcagcagacgcgttaaccatggaatacacccagaaacactggaagccagaagagcgtattgaagtggctgaagacctgccgctgaccgattgctacgttgccccctgtgttactgcctgcgctatcaagcaagatattccggaatacatccgtctgcttggcgaacaccgctatgccgacgcgctggaactcatctatcaacgcaacgccctgcccgccattaccggtcatatttgcgatcaccagtgccaatacaactgtacccgcctggattacgacagtgcgctgaatatccgcgaactgaaaaaagtcgcgctggaaaaaggttgggaggaatataagcaacgctggcacaaaccagccggttctggttcacgccatccggttgccgtgattggtgcaggtccggcgggtctggccgcaggttacttccttgccagagcgggccatccggttacgctgtttgaacgcgaagccaatgcgggcggcgtggtgaaaaatatcattcctcagttccgtattcctgcagagttaattcagcacgatatcgattttgttgccgatcacggcgtgaaatttgagtacggttgctcacccgatttgaccgttgaacagttaaaaaatcagggcttccactatgttctgattgccaccggtaccgataaaaatagcggtgtgaaactggcgggcgacaaccaaaatgtctggaaatcactccccttcctgcgtgaatacaacaagggcaccacactcaagctgggcaaacatgtggtcgttgtcggggcgggtaacaccgcaatggactgcgctcgtgcggcgttacgcgttccaggcgtagaaaaagcaacggtcgtttaccgtcgttcactgcaagagatgccagcatggcgcgaagagtatgaagaagcgttgcacgacggcgtggagttccgtttcctgaataatccggaacgtttcgatgctgatggcaccttaaccttgcgcgttatgtcgcttggcgaacctgatgagaaaggtcgtcgccgtccggttgaaaccaacgaaacagtaacactgcatgtagacagcctgatcaccgccattggtgaacagcaggatactgaagccctgaatgcgatgggcgtgccgctggacaaaaacggctggccagacgtcgaccataatggcgaaacgcgtctgagtgacgtctttatgatcggcgacgtacagcgcggaccatcctccattgtcgctgctgtcggaaccgcgcgtcgggcgaccgatgccatcctgagtcgggaaaatatccgttcccaccagaacgataaatactggaataacgtcaatccggcggaaatctatcaacgtaaaggcgatatctctgtcactctggtgaacagtgacgatcgtgatgcgtttgtcgcgcaggaagccgctcgctgccttgaatgtaactacgtttgcagcaagtgtgtggatgtctgcccgaaccgcgccaacgtatccattacggtcccaggcttccagaaccgtttccagacgctgcacctcgacgcttactgtaacgaatgtggcaactgcgcccaattctgcccgtggaacggtaaaccgtacaaagacaaaatcaccgtcttcagcctgtcgcaagactttgataacagcagcaacccaggcttccttgtggaagattgccgggtacgcgtacgtctgaataaccaaagctgggtgttaaacatcgacagcgaaggtcagttcaacaacgtaccaccggagctgaacgatatgtgccgtatcatcagccatgtccaccagcatcatcattatctgctgggccgcgtggaggtgtaa

SEQ ID NO: 4590 - protein, 1032 aa, Escherichia coli O6
MGDIMRPIPFEELLTRIFDEYQQQRSIFGIPEQQFYSPVKGKTVSVFGETCATPVGPAAGPHTQLAQNIVTSWLTGGRFIELKTVQILDRLELEKPCIDAEDECFNTEWSTEFTLLKAWDEYLKAWFALHLLEAMFQPSDSGKSFIFNMSVGYNLEGIKQPPMQQFIDNMMDASDHPKFAQYRDALNKLLQNEAFLARHGLQEKRESLQALPARIPTSMVQGVTLSTMHGCPPHEIEAICRYMLEEKGLNTFVKLNPTLLGYARVREILDVCGFGYIGLKEESFDHDLKLTQALEMLERLMALAKEKSLGFGVKLTNTLGTINNKGALPGEEMYMSGRALFPLSINVAAVLSRAFDGKLPISYSGGASQLTIRDIFDTGIRPITMATDLLKPGGYLRLSACMRELEGSDAWGLDHVDVERLNRLAADALTMEYTQKHWKPEERIEVAEDLPLTDCYVAPCVTACAIKQDIPEYIRLLGEHRYADALELIYQRNALPAITGHICDHQCQYNCTRLDYDSALNIRELKKVALEKGWEEYKQRWHKPAGSGSRHPVAVIGAGPAGLAAGYFLARAGHPVTLFEREANAGGVVKNIIPQFRIPAELIQHDIDFVADHGVKFEYGCSPDLTVEQLKNQGFHYVLIATGTDKNSGVKLAGDNQNVWKSLPFLREYNKGTTLKLGKHVVVVGAGNTAMDCARAALRVPGVEKATVVYRRSLQEMPAWREEYEEALHDGVEFRFLNNPERFDADGTLTLRVMSLGEPDEKGRRRPVETNETVTLHVDSLITAIGEQQDTEALNAMGVPLDKNGWPDVDHNGETRLSDVFMIGDVQRGPSSIVAAVGTARRATDAILSRENIRSHQNDKYWNNVNPAEIYQRKGDISVTLVNSDDRDAFVAQEAARCLECNYVCSKCVDVCPNRANVSITVPGFQNRFQTLHLDAYCNECGNCAQFCPWNGKPYKDKITVFSLSQDFDNSSNPGFLVEDCRVRVRLNNQSWVLNIDSEGQFNNVPPELNDMCRIISHVHQHHHYLLGRVEV

SEQ ID NO: 4591 - DNA, 1980 bp, Escherichia coli O6
  CDS (1)..(1980)
atgaatcgttttattatggccaacagtcagcaatgtctgggttgtcatgcttgtgaaatcgcctgtgtcatggctcacaatgacgagcaacatgtcctgagccaacaccattttcatccccgaattacggttatcaaacatcagcagcaacgtagtgcagtgacctgtcaccattgtgaagatgcgccctgcgcccgtagctgccctaatggcgcaatcagccacgttgatgacagcattcaggtcaatcagcaaaagtgtattggctgtaaatcctgcgtggtggcctgtccatttggtacgatgcaaatcgttctgacacccgttgcggtaggaaaagtaaaagccacggcgcataaatgcgacctttgtgcagggcgcgaaaacggtcctgcctgtgtcgaaaattgcccggcggacgcgctgcaactggtcactgacgccgcactctccggcatggcgaaatcccgccgcttgcgcaccgcacgtcaggaacatcaaccgtggcatgccagtaccgcggcgcaagaaatgccggtaatgagtaaagtcgagcaaatgcaggcaacgcccgcgcgtggcgagccagataaactggcgattgaagcgcgcaaaaccggttttgatgaaatttatctgccattccgtgccgatcaggcacaacgggaagcctcgcgctgccttaagtgcggcgagcacagcgtttgtgaatggacctgcccgctgcataaccatataccgcagtggattgaactggtgaaagccggaaacatcgacgccgccgtcgagctttctcaccagaccaacaccctgccggaaattaccggacgcgtttgcccgcaagaccgtttgtgtgaaggtgcctgtactattcgcgatgagcacggcgcagtaactatcggtaacattgaacgctacatttcagatcaggcgttggcgaaaggttggcgtcctgacttaagccatgtcaccaaagtggacaagcgggtggcgattatcggtgcgggtccggcagggctggcctgtgcagatgttctcacccgcaatggcgtggcggtgacggtgtacgatcgccatccagaaatcggtggcttgctcactttcggcattccttctttcaaactggataaatccctgctggcacgccgtcgggaaatcttcagcgcgatggggattcacttcgaactcaattgtgaagtgggtaaagatgtctctttgaattcgcttttggaacaatacgacgcggtcttcgttggcgtaggcacttaccgttccatgaaagcgggtttacccaatgaagatgcgccgggcgtttatgacgcgctgccgttcctcatcgccaatactaaacaggtgatgggactcgaagagctaccggaagagccgtttatcaatactgccggacttaacgtcgtggtactgggcggcggcgacaccgcgatggactgtgtgcgtactgcgctgcgccacggcgcgagtaacgtcacctgcgcttatcgtcgtgatgaagctaacatgccaggctcgaagaaagaggtgaagaacgcccgtgaagagggggccaacttcgaatttaacgtccagccggtggcgcttgaactgaatgaacaaggtcacgtctgcaggattcgtttcctgcgcacgcgtcttggcgagccggacgcccagggacgtcggcgtccagtgccggtggaaggcagtgaatttgtcatgccagccgatgcggtgattatggcgtttggcttcaatccgcacgggatgccgtggctggagtcgcacggtgtaacggtagacaaatggggccgcatcatcgcggatgtggaaagccagtaccgttaccagaccacgaatccgaaaatcttcgccggtggtgacgccgtgcgtggtgcggatctggtggttaccgcaatggcagaaggacgtcatgcggcacaggggatcattgactggctgggcgtaaaatcagtcaaatctcactga

SEQ ID NO: 4592 - protein, 659 aa, Escherichia coli O6
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAVGKVKATAHKCDLCAGRENGPACVENCPADALQLVTDAALSGMAKSRRLRTARQEHQPWHASTAAQEMPVMSKVEQMQATPARGEPDKLAIEARKTGFDEIYLPFRADQAQREASRCLKCGEHSVCEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVAVTVYDRHPEIGGLLTFGIPSFKLDKSLLARRREIFSAMGIHFELNCEVGKDVSLNSLLEQYDAVFVGVGTYRSMKAGLPNEDAPGVYDALPFLIANTKQVMGLEELPEEPFINTAGLNVVVLGGGDTAMDCVRTALRHGASNVTCAYRRDEANMPGSKKEVKNAREEGANFEFNVQPVALELNEQGHVCRIRFLRTRLGEPDAQGRRRPVPVEGSEFVMPADAVIMAFGFNPHGMPWLESHGVTVDKWGRIIADVESQYRYQTTNPKIFAGGDAVRGADLVVTAMAEGRHAAQGIIDWLGVKSVKSH

SEQ ID NO: 4593 - DNA, 1239 bp, Escherichia coli O6
  CDS (1)..(1239)
atgccgcaacaaaattatctggatgaactcactccggcttttacgcctttactggcgattaaagaagcctctcgctgtttattatgtcatgacgctccctgtagtcaggcttgcccggcacagaccgatccggggaaatttattcgctcaatctactttcgtaattttaaaggcgctgccgagacaattcgcgaaaataatgccctcggtgccgtttgtgccagagtgtgcccgacggagaaattatgccaaagcggttgtacacgtgccggtgttgatgctcccattgatatcggtcgtttacagcgttttgttactgattttgaacaacaaactgggatggaaatttatcagcccggtactaaaacgctcggcaaagtcgccattattggcgcaggtcctgccggattgcaggccagtgtgacgctgacaaaccagggttatgacgtcacgatccatgagaaagaagcacaacccggtggctggttgcgtaacggcattccgcaattccggttaccgcaatcggtgctggatgcagaaatcgcccgtatagaaaaaatgggcgtgaccattaagtgcaataacgaaatcggtaaaacacttaccctggagcagctgaaagcggaaaaccgcgcggtactggtcaccgtagggttatcgagcggttccgggttatcgctgtttgagcatagcgacgttgagattgccgtcgacttcctgcaacgtgcacgacaggcgcaaggcgatatcagcattccacaaagcgcattaattatcggcggcggtgatgtcgcgatggacgtagccagcacgctgaaagttctcggctgtcaggcggtaacctgcgtagcgcgtgaagagttagatgagtttccggcaagcgaaaaagagtttaccagcgccagagagctgggcgtttcgatcatcgatggatttacaccagtagccgtggaaggcaataaagtcacctttaagcatgttcgtttaccaggtgaactaacgatagcggcggacaaaattattctcgctgtaggtcaacatgccgaacttgctgttttttccgcactggaaccgcagcgtaacaccatcgaaacgcaacattaccagacccgcgacccgcaagtctttgctgctggcgatattgttgagggtgacaaaaccgtggtctatgcagtgaaaaccgggaaagaagccgccggggcgattcatcactatttagagggagcttgctcatgttaa

SEQ ID NO: 4594 - protein, 412 aa, Escherichia coli O6
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIHEKEAQPGGWLRNGIPQFRLPQSVLDAEIARIEKMGVTIKCNNEIGKTLTLEQLKAENRAVLVTVGLSSGSGLSLFEHSDVEIAVDFLQRARQAQGDISIPQSALIIGGGDVAMDVASTLKVLGCQAVTCVAREELDEFPASEKEFTSARELGVSIIDGFTPVAVEGNKVTFKHVRLPGELTIAADKIILAVGQHAELAVFSALEPQRNTIETQHYQTRDPQVFAAGDIVEGDKTVVYAVKTGKEAAGAIHHYLEGACSC

SEQ ID NO: 4595 - DNA, 1527 bp, Corynebacterium efficiens
  CDS (1)..(1527)
atgtccgacccacatggattccagaaatacacccgcgccgaacccgcccaccggccggtgcccctgcgcctcatggacttccacgaggtctacgaggcggcacccgccggccagatcgaggagcaggccgcccgctgcatggactgcggcgtgcccttctgccaccagggttgccccctgggcaacatcattcccgagtggaacaacctggtgcgcgagggacggtggaaggaggcctacgaccgcctgcacgccaccaacaacttccccgaattcaccggccgcctgtgccccgcgccgtgtgagggtgcgtgcgtgctcgacatcaacgatgacgccgtgaccatcaagaatgtggagctggagatcgtcgaacgggccttcgccgagggctgggtggaaccggtgcgtgcctccctggataccggcctgacggtggccgtggtgggttcgggcccggccggtctggccgccgcgcagcagctgacccgcgccggacaccgcgtgaccgtcttcgaacgctccgaccgcctgggtggcctgatgcgttatggcgtgccggactacaagatggagaaccgctggatcgaccgccgtctcgaccagatgcgggcggagggcaccgtgttccgggtcggggtctccccgaaggccgctgaactggcgcttttcgacgccgtcgtgctcgccaccggcacgcccgtcgcccgtgagctgggcatcccgggcgcagaactcgccggtgtccacccggcgatggactacctcaccgcgcagaacagggcgaatgaaggtgacggcccggtgcctgcggagtttgatgcccgcggcaggagggtcgtgatcatcggtggcggcgacaccggcaccgactgcttcggcaccgccctgcgccagggggcggcctcggtgacacagttcgacatccgcccgcgcggaccggtgctgcgcgccgaggagaccccgtggccgatgtaccccaaccagttccgcaccgccaccgcccatgaggagggttcctatgtcctccgcggggatgaatccgtcgccgagatcgaggccctgggcctgggtacccgcgccgtcggcgaaccgctgggtgagcggagattcgcggtgaacaccgtcgccctgcacggcgatgaccggggccgggtcaccggtctgaccggatgccagatcaaggtggtcggcggtcgccgcgaaccagtcgaaggcaccgagttccccttcgacgccgacctggtcctggtggccctgggcttcaccggcgccgaacagggcgggctggcccatgaactgggcgtgggtttcgatacccgcggccgcatgatccgcgacgccggttaccgcagtcccaccaactcccgcgtctacatcgccggcgacaacggccgtgggcagtccctgatcgtctgggccatcgccgagggccgggcgtgtgccgccgccgtcgacgccgacctcatgggtgaaaccgcactcccggttgccgtgacccctcaggacatgccgatggcggtgtga

SEQ ID NO: 4596 - protein, 508 aa, Corynebacterium efficiens
MSDPHGFQKYTRAEPAHRPVPLRLMDFHEVYEAAPAGQIEEQAARCMDCGVPFCHQGCPLGNIIPEWNNLVREGRWKEAYDRLHATNNFPEFTGRLCPAPCEGACVLDINDDAVTIKNVELEIVERAFAEGWVEPVRASLDTGLTVAVVGSGPAGLAAAQQLTRAGHRVTVFERSDRLGGLMRYGVPDYKMENRWIDRRLDQMRAEGTVFRVGVSPKAAELALFDAVVLATGTPVARELGIPGAELAGVHPAMDYLTAQNRANEGDGPVPAEFDARGRRVVIIGGGDTGTDCFGTALRQGAASVTQFDIRPRGPVLRAEETPWPMYPNQFRTATAHEEGSYVLRGDESVAEIEALGLGTRAVGEPLGERRFAVNTVALHGDDRGRVTGLTGCQIKVVGGRREPVEGTEFPFDADLVLVALGFTGAEQGGLAHELGVGFDTRGRMIRDAGYRSPTNSRVYIAGDNGRGQSLIVWAIAEGRACAAAVDADLMGETALPVAVTPQDMPMAV

SEQ ID NO: 4597 - DNA, 1455 bp, Brucella suis
  CDS (1)..(1455)
atgggtaaggtaactggttttcttgaaatcgaccggcaggtggcgaagtaccagccggcgtcggatcgtatccgccacttccgcgaattcaccatcccgatgacggatggcgaggtgcagaagcaggcggcgcgctgcatggattgcggcattccatactgccacgggccgacgggctgcccggtgcacaaccagatcccggactggaacgatctcgtctataacaacaactgggatcaggcgatcaggaacctgcacctgaccaacaatttcccggaattcaccggtcgtatctgcccggcgccttgcgaggaagcctgcacgctgaaccttgaggacatgccggttgcaatcaagaccgtggaacaggcgctgggcgacaaggcctatgagcttggctatatcgtgccgcagcctgccgccagcaagaccggcaagttggttgccatcatcggctccggcccggctggccttgcggcggcgcagcagcttgcgcgtgcgggccacatggttgatgtctatgagcgcgaaagccgtcccggcggattgctgcgctatggcattcccgatttcaagatggaaaagcacctgatcgaccgccgcgtcgcgcagatggaaggcgagggggtgcgtttccattgcggtgtgaatatcggcgtcgacaagccgttgcgcggccttctcgatacttatgatgcggtgctttattgcggcggttcggaaaccccgcgcccggcgggcattcccggcgccgatcttgatggtgtccatgatgccatgccctatctcgtgcagcagaaccgccgcgttggccgcgaaaacatcgagtccgtcgcctgggcttcggttccgattctcgcaggcggcaagcatgtcgtagttgtcggcggcggcgatacggcatcggattgcgtcggcacggctttccgtcagggcgcggtcaatgtgacccagctcgatatccgtccgcagccgccggaaaaggaagacaagctcagcgtctggccctattgggcgaccaagatgcgcacttcttccagccaggcggaaggcgcatcgcgtgagtttcaggtcgcgacgctggaatttatcggcgaggatggacgccttacccatgtgaagtgctgtcaggtcgatgaaaagcgcaggccgattgccggaacggaattcttcatcaaggccgatctggccttcatcgccatcggctttgccggtcctgtggaagacagtgtggtgaaggaaatggacgggaaactcgaaatcgccaccgaccggcgtggctcgaagtccgtcaaggcaaacgatcgtgattatcgcaccaatgtcgacaagctctatgcggcgggtgatatccgtcgcggccagtcgctggttgtctgggcgatccgcgaaggccgtcaggcagcccatgctattgatgcggatttgatgggcagttccgttttgcctcgttga

SEQ ID NO: 4598 - protein, 484 aa, Brucella suis
MGKVTGFLEIDRQVAKYQPASDRIRHFREFTIPMTDGEVQKQAARCMDCGIPYCHGPTGCPVHNQIPDWNDLVYNNNWDQAIRNLHLTNNFPEFTGRICPAPCEEACTLNLEDMPVAIKTVEQALGDKAYELGYIVPQPAASKTGKLVAIIGSGPAGLAAAQQLARAGHMVDVYERESRPGGLLRYGIPDFKMEKHLIDRRVAQMEGEGVRFHCGVNIGVDKPLRGLLDTYDAVLYCGGSETPRPAGIPGADLDGVHDAMPYLVQQNRRVGRENIESVAWASVPILAGGKHVVVVGGGDTASDCVGTAFRQGAVNVTQLDIRPQPPEKEDKLSVWPYWATKMRTSSSQAEGASREFQVATLEFIGEDGRLTHVKCCQVDEKRRPIAGTEFFIKADLAFIAIGFAGPVEDSVVKEMDGKLEIATDRRGSKSVKANDRDYRTNVDKLYAAGDIRRGQSLVVWAIREGRQAAHAIDADLMGSSVLPR

SEQ ID NO: 4599 - DNA, 1506 bp, Brucella suis
  CDS (1)..(1506)
atgcgatccatgaaacacacgggatcagcaggaagttcgtccattgatgcaggctctccagacattcgcggcgcgcggcttcctgctggcgattatgcgcatgtcttcgacgacctgcatccaccgctctcaccgcatgaagccattgtcgaaagcgaccgctgttatttctgttatgacgcgccttgcatgaacgcctgcccgacgggcatcgatattccgcttttcatccggcagatcaatgcaggcaacccggctggcgcggccaggaccattcttgccgaaaacattctgggcggcatgtgcgcccgcgtctgcccgaccgaaacgctctgcgaggaggtctgtgtgcgcgaggtggcggaaggcaagccggtgaagatcggccatttgcaacgctacgctaccgatatgctgatggccacgggcaaccacccgtttacccgcgcagccgaaacgggcaggcacattgccgttgtcggcgctggcccggcgggcatttcggctgcacatcgccttgccatgcatggccatcaggtgacgattttcgaggcccggcccaagggcggcggtctcaacgaatatggcatcgccgcctataagacggtgaacaatttcgcccagcgcgaacttgatttcgtgttgcagatcggcggcatccatatcgaatataaccagacgctgggccaggacattaccgtcgaggcgctgaaggccggatatgatgcggtgttcctcgccatggggctgccgggcgtgaacgacctcggccttgccggcgaagacgcgccgaacgtgctggatgccgtcgattacatcgccaatctgcggcaggccaggaacctttccaccctgcccgtcgggcgcgatatcgtcgttatcggtggcggcatgacggccatcgacgttgcaatccagaccaaaaagctcggcgcaaacaacgtcaccatcgtctatcgccgcggacaggaaagcatgaatgccagcgcctatgaacaggaactggcgcagatacatggcgtcgtcatccgccactggttgcagccccatgcgctggagcgcagtgaagacggcatcgtccatgcgatcacctttgaatatacggccaatcgggatggcaagcttgtcggcaccggcgaatatctgacccttgaggccgaccaggtgttcaaggccatcggccagaccttcgatccggaacccttgcgcgggtccggcatcgcccttgcgaaaggccgcatcagcgtggatgcggaagggcggacctcggtggagggtatctgggctggcggcgattgtgtggcaggcggaaaagatctgacggttgcctccgttgaagacggcaaggtcgcggccttatccattcatgcggcactgacgagccgcccggaagctgtggaaggttttgccgaagccgttctttccggtgccgcgcattatgcgcccgcagcgccatcccgtcacgcaaccgttcaacctggcagcgaacagggtttgggagattga

SEQ ID NO: 4600 - protein, 501 aa, Brucella suis
MRSMKHTGSAGSSSIDAGSPDIRGARLPAGDYAHVFDDLHPPLSPHEAIVESDRCYFCYDAPCMNACPTGIDIPLFIRQINAGNPAGAARTILAENILGGMCARVCPTETLCEEVCVREVAEGKPVKIGHLQRYATDMLMATGNHPFTRAAETGRHIAVVGAGPAGISAAHRLAMHGHQVTIFEARPKGGGLNEYGIAAYKTVNNFAQRELDFVLQIGGIHIEYNQTLGQDITVEALKAGYDAVFLAMGLPGVNDLGLAGEDAPNVLDAVDYIANLRQARNLSTLPVGRDIVVIGGGMTAIDVAIQTKKLGANNVTIVYRRGQESMNASAYEQELAQIHGVVIRHWLQPHALERSEDGIVHAITFEYTANRDGKLVGTGEYLTLEADQVFKAIGQTFDPEPLRGSGIALAKGRISVDAEGRTSVEGIWAGGDCVAGGKDLTVASVEDGKVAALSIHAALTSRPEAVEGFAEAVLSGAAHYAPAAPSRHATVQPGSEQGLGD

SEQ ID NO: 4601 - DNA, 1536 bp, Bifidobacterium longum
  CDS (1)..(1536)
atgggcgacccgagaggatttctgaaggtccgtacccgccgagagctggctgaacgccccgttgaggaacgtatcaaggactggttcgacgttcacgccgaaaccggcctgcaaccgtggacccaagcgcaggcggcccgctgcatggattgcggcaccccgttctgtatgaccggatgtccgctgggcaacctgattcctgagtggaacgatctggtccgtcagggcaagtgggaggacgcgtacaaccgtctgtccatgaccaacaacttccctgaagtcaccggtcgtatctgcccggctctgtgcgagcaggcctgcgtgctcggcatccaccagccgccgaccatgatcaagcttgacgagcagaccatcattgaccaggcatgggatttggactacgtcaagccgctgccgccgcagcgtctgaccgaccagacggtcgccgtcgtcggctccggccctgccggcctcgccgccgcacagcagctcacccgcgccggccacaccgtcgtcgtctacgagaaggacgacgccatcggtggtctgatgcgttacggcatcccgaacttcaagcttgagaagggtctgcttgaccgccgtgtcaagcagatggaggccgaaggcacccgcttccgcaccaacgtggaaatcggcaaggacatcacgtgggatgacctgcgtgaccgttacgacgccgtcgtagtggccatcggctcccgcgtgccgcgcgatatgaagattccgggccgcgagctcgacggcatccacttcgccctcgacttcctgcccgacgccacgcgccgtatcttcggcgtcaagccggtgcacgacatcaccgccaaggacaagcacgtcatcgtcatcggcggtggcgacaccggttccgactgcctcggcacctcgatccgtcagggtgcgaaggacgtcaccgtgctacagatcatgccgaaagagccgtcaagccgtccggacaacagcccgtggccgaccttcgcccgcacctaccagaagacctcctccatggaagagggcggcgagtacatctactccaccgactccgtgaacttcgagggcaccgaagaggagaaggccaaggtcaccattgataactcgaccaccgccgaaggcttcgtggccgatgagcgtggtcatgtcaccggcttgaaggtcgtctccgtggctcccggcgaaaatggtccgttcactcgccagcctggcaccgagcgcgtgctgcccgccgatctggtcctcatctccgtgggcttcctgcacccggacaccgagaccatcctcgaccagctgcccgtcgaactcgacaagcgtggcaacatcgctcgcaatgacaagttcgccacctcccaggatggcgtgttcgtgtgcggcgatgccggccgtggccagagcctcgtggtctgggccatcgccgaaggccgctcctgcgccgcagccgtggacgagtacctctccaaggaaaagagcgagctgccggccccgatcaaggccagccagcgtccgatgatgctgcctcgctga

SEQ ID NO: 4602 - protein, 511 aa, Bifidobacterium longum
MGDPRGFLKVRTRRELAERPVEERIKDWFDVHAETGLQPWTQAQAARCMDCGTPFCMTGCPLGNLIPEWNDLVRQGKWEDAYNRLSMTNNFPEVTGRICPALCEQACVLGIHQPPTMIKLDEQTIIDQAWDLDYVKPLPPQRLTDQTVAVVGSGPAGLAAAQQLTRAGHTVVVYEKDDAIGGLMRYGIPNFKLEKGLLDRRVKQMEAEGTRFRTNVEIGKDITWDDLRDRYDAVVVAIGSRVPRDMKIPGRELDGIHFALDFLPDATRRIFGVKPVHDITAKDKHVIVIGGGDTGSDCLGTSIRQGAKDVTVLQIMPKEPSSRPDNSPWPTFARTYQKTSSMEEGGEYIYSTDSVNFEGTEEEKAKVTIDNSTTAEGFVADERGHVTGLKVVSVAPGENGPFTRQPGTERVLPADLVLISVGFLHPDTETILDQLPVELDKRGNIARNDKFATSQDGVFVCGDAGRGQSLVVWAIAEGRSCAAAVDEYLSKEKSELPAPIKASQRPMMLPR

SEQ ID NO: 4603 - DNA, 9321 bp, Plasmodium falciparum
  CDS (1)..(9321)
atggggaaagaaaatatagataataaaggactttatgatagtaggaatgaaaaggatgcttgtggtgtcggtgtagtagctgatattaatgggaagttttctagaaatgtgatacagaaagctttacaaatattattacggttaagtcatagaggtggtgtacaaggaaataatggagatggtgctggtattttagttggaataccacatgaatactttcaaatgttaagtgatacttgtcaattaccttttttattaccagaaaaaggagaatatgctgttgctcaaatatttttaccacaaaatgaagaaagaagactttttttataccatgaaattgaaaaggaagtatataatcatggattagtcgtattaggatggagatctcctatacctgttcgacgtgatgttattagttgtagtgttaaaaaaagtgaaccttttattgctcaaatgtttgtttgtaaaagatcggtttttaaaaattatgatgatttcaatatatatccattttcagatataaattttacagatgatagtaatttgaaattaaatgaattaccagatgatattgaattattatcattctttataagaaaaaaattagttagacataatgatatgtatttctgtagcttttcatctagaactattgtatataaaggactattaacgccttcacaaatatatttatattttgaagatttattaagtgaaaattttacatcctatttagctatggtacatgtacgtttttcaactaacacatcacctacatggtatgctgctcatccttttagaagaatatgtcacaatggagaaataaatacgatcagtgttaattctattttatttcaagaacgtatggaatcagcaaaaactcctgaatgtttcaaatcagtatccataaaagatctaagaccaataaatgaagaaaattatatcatatatgataatgatgatgaaataatacaaaaaagagatacttttgaagatattatgttaacacaaaatagattgaaaaaaaagtctagaagaaatttacttttaaaattaaagaaggattatacttataatagttcagctattcattataatattaaaagagaatatatgaattctgatattaatagtaattcagaatttttaagtaatgtaaatgatgactccaaaagttcctctgatgtagataaaataagtgaagaaaatttaatgaaccatttgaaagaaaaaaataataaagcttttagaaagtctatgaaaaatcaaattaaacatggagaatcacaaaaaaccaaaggcgctattagttatccatctgattcttctatatttgataatgcaatcgattttcttactatgacaggtagggaaattgaacatgcagtcatgatgttaatgcctagagcatatcaaaaagatccaaatataagtccattagaaaaagctttttatgaatatcatacctgtattatggaaccatgggatggaccggctttaattatatttacagatggatataaagtaggtgcatcattagatagaaatgggttaaggccagcaagatatagtattactaattatggattgtttgttttatctagcgaaaccggagtagtagatttatcatatgacaaaattgttcataagggttcggtttatcctggtaaagttgttttagtagattttaaggaaaaaaaatttttaagacatgaagaagtattgagtaagtttttaagagaaagaccatataaaaaatggatagatcattattctatacatatggataacataattaggccagtaacaaatatggagaatattcgtatgaatgcatataagtatggtgctatattgaataaagacaattattatcataacaataatacaaatataaacaacagcaacaacaataataataataatatgattaaaagtaatagtaatgctcttagtattaataataataaaacatgtttaaatgatatagattattatgacgaatcattaattaaaaaattaaaagcatttggatatacatatgatgcttttaatatgatcatatcaccaatggttaaacatgcagctgatggattaggttcaatggggaatgatacagcctttccatttttaagttatttgcatcgtaatttattatattattttcagcaaacatttgcacaagtcaccaatccagctatagatcctattagagaagagaatattatgtctctaatgagtaatctaggaaaagaaggagatttgttacaatatagtcatgttaattgtcatcgtatatttataaatggacctatattaaatgaagctttatataatatgttacttcaattacctgattttccacatattataattgatatgacgatagatttggataaactacaatccatgatgattaatgtaaatagtaatttttcacctaataaagatggtgaccctagtcaaaacattcacaacaatattgttagtaataagaattcggaagatccttcaaaattggatgtgtgtaaaacaaaacaagcaaaagaggaacatactaagaaaaagcatatatcatctaaatatttaattaaatttattgatagcgttaattctaaagctgaaaatgctattaaaaaaggatgtcaattaatcattttatcacataataatgttaatgaaaagagagtgcccatattttctatattaattgtaggtgcattacataaatatttattaagtaaaaatttaagaacaaaatgttcattgattgttaaagctggagactgttttgagattcatcatttggctgttcttttatcttttggtgctgattgtatttatccatatattttatatgagagtttacagttcatcaaatttgctgataatgaagcaaggctaagtaataaccagatgataagtaattatagacatgcagctaattatggtatattaaaaataatgtctaaaaatggaatatctacattaccaagttataaaggttgtggtttaatgcaacccttgggaatatcagatgaaatattaaaaaaatgttttataaatgtatgtgattcaataattggtggagtgacttttgaatttgttgaaaaagaaatattaaatatattttatcttgcatatccaaagagaatcttaacactaaatttaaaagatgcaaatgaagaattagatgattatggtgaatatcattttagaaatatagggaaatctcaaatacatatgaatcatcctgaaactattagtttattacaaaaagctacaagaagtggtaataaagatacttataaaaaatattctgaattacaaaatgaattgattaatcattgtgaaattagaggacagttggaaattaattataaaaaatgtccatcatataataaaataaaaaagaaacatgaaccaattaatattcatttagtagaaccagtaaataaaatattattaagattctgtaccggggctatgtcctttggatctttgtcagaagaagcacatactactgtagctactgccatgaatagtatgggtttaaaatcaaataccggagaaggaggagaagcagaagaaagaataaaaacagccaataacgaaataaatacaaattctgccgtaaaacaaattgcttcagcccgatttggtgttactgcatatagtttagtaaatgcacaagaattgcaaataaaagtagcacaaggatccaaaccaggagaaggtggagaattaccaggttataaagtaagttctaaaatagcttctattcgtagaagtactccaggagttggtttaatatctcctccaccacatcatgatatgtattctattgaagacgtaggtcaattggtatatgatttgaaaaatataaataaagaagcaaaaatatcagtgaaacttgtatcaaagttaggtattggtgttataacatcaggggtggttaaaggaaattgcgaacaaattttaataagtggaacatcgggtggtacaggtgcttctaaatggacttcaattaagcatgcaggtttaccatgggaaattggtttagcagaagctcatcaaacgttatgtaaatcgaaactacgaaaaagagttattttacaaattgatgggcaactaaaaactggaagagatgtgattttaggagcattattaggtgctgaatcatttagtttttctactcaaccattaatatcattaggttgtattatgatgaggaaatgtcatttgaatatttgtcctgttggtatatgtacacaagatcctgaattaaggaaaaaatttgctggaaaacctgaatatattgttaatttcttttttatgttagctgaagaagttcgagaatacttggctagtatgggattccgaaaattttctcaaattataggtagatctgatttgttaaaaaaaaaagatcatttgaaatatgatgagaaaaggaaactcttggatttttcgaaactgttatttcctggatggaaatattatgcagaggatgaaatgaaagatgatcagaataaaagatataaaaatatatcaaataaaaaaaagaaatataatacaaattctttgtactctgcttcaaagcataaaaaaaaaaataccaaagctggtctacattcgattaaaaaaaaaatgaagaatagaaaacaggtcctaataaatgaaagttttaatactattaaaaagtataaaattaattccaaacaagcggatactatagaaagggttaatggacaaaatgaatatttcataaatgtagaatgtgatgaagcagatgcggaaaatgaaagtgatcagaacgacaataatgaggaagaagaaacggataagagtgatgtagaggaaaatattgataatgatgaaaatgaagatatggatcaaattgatgatatagatgaagaagatgacgaatattataatgatggtagtgatgatagtgatgatagtgatgatagtgatggtaatgatgatagtgatgataatgatgatgatatagatgatttagatgatgtagatgatgtagatgatttagatgatgtagatgatttagatgatgtagatgatttagatgatttagatgatgtagatgatatagatgatgtagatgatgtacataatgcagataatgtaaattgccgaaaagataatcatactgaccatgattatgatgataataacaatgttaaggatgaatatccaaataataatgacaagaaaggacaaaacagtagagagaagagaaacaaaaaaaaaagtatgaataggaacataatatataaatatcaatataaagaaaagggttcttataatataaataagaagaaccataataataataatattaataaaaagaatactaagaaaataaagaaaaaaattcatttaaaaaagaaaaaagtaaaaccaattcctatattttgttgtgaaactcaaaatcataaattatctgatgttattgatagagaattaatcaggagatcaaagattgccttattaaattgtacacctgtgaatattaaaatgcctattaaaaatacagatagagcggttggagctatgttaagttatcatataatacaaaaatatggagaagaaggattaccaattgatacgataaatgtgaaatttcgaggtacaggtggattatcatttggtgtatttttaacgagtggagtaaattttgaattagaaggagatgcaaatgattttgtaggtaaaggtttatcaggtggtatcatatcagtacattttccaaagaacgctttatttataaacgaatgtcaaaaaaatgttatagctggaaattctgttttatatggagctacaaaaggaagagcattttttgctggaagagcaggtgaaagatttgctgttcgaaattcaggagcaattgctgttgtagaaggtgttggtagtcatggttgtgaatatatgacaaaaggtatagtagtagtgttaggtgaaattggttgtaattttgctgctggtatgagtggaggtatagcatatgtattagatataaatgagaaaaatgtaaatcatcaaatggttgatttgaaagtttgtaaaactatggatgaaaaaatgactttagaaaaattattacatgaacattatgaaagaactaattcatatacagccaaaatgttattacaaaattttgatgaaaatttacaacgttttactaaaattatacctagagatattaaaagagttttaaccgaagcttgtattgaatttgttaaaacaggtaatgaagaagcagctgctattttagatgattgggcttccttattaaaaagtgtagatcaaccagaacatatgtataaaaaagctatgcaattctttacaactattactgatgatatatcaggattatccaaatctttagcattaagaagtgtagatggattaattatttatgatatattacaagaacaacgtagtcgaaatttattaagtataaaaaattcgtccaatgattttaatagtttaaataatgaagaacaaaatattaagaaaaaaaaatttttcgattttgaaagttttatacataatctagaattgtgcagaagtaataatagaaaatggagacgattctctgaaatccctttcaaatgtaatgcattttcagattttaaaaatacctttcctgaaaaattagatgataaatcaaaagaaatgataaaaaaatatattcttaatgaacaatatttattagatttacatttgaaatcattaaattcaaataaatttattgaaaaattgattattagagaaacagatgattatattcatatggatcaaaaacaactaagtccaaatatatacaccttaaaaaaatatttatatccatcggataattatgatgtttctaatatttccaattctatgacagcctataataaaattaatggggtacacttaatgaacaagcaaaatgaaaataagcaaaatgcagaagtgcctaattcctatgatttttctgggtatacattgggtgcaagaagaaaaacggctgatatggtaaatattcaaaaggatgatgaaaatgacatacgtattgcaaataatacgaaaagtataagtaatacaaatgatatgaacaatgtaagcaatatgaacaatatgaacaatgtaaacaatgtaaacaatgtaaacaatgtaaacaatgtaagcaatatgaacaatatgaacaatatgaacaatatgaacaatataaacaatatgaacaatataaacaatatgaataatataaataaagatgataataataatattaatggtgatgatacaaacaacaccgtcatttctgaagttaccaatactacgtatgctaacaaatcatcaaattattcacaatcgcaatatgctaaaacaagtggtgatggtaaaataaagaaatatagtgtagacaccgaaattagtgatatgactagggtttcatcagattatggaaatgcttcaagcatcagttctacgaaaccttttttagttgctaatccaaataaagttacaggatttaaagaatatgaaagattatctcatccacttaaagatattagtagtagagtattagattattccgaaattattgtacccataaacgttaaaagtaaactacataatcaattattaaaaacacaagcttctagatgtgttgattgtggtaccccaacttgtcattatcctaattcgagtggtggtggctgtcccttaggtaatagaatttttgattggaacaatttagtatatgaaaatgaatggaagaaagcactagaacgtttattagataccaataatttcccagaaattaccggtcgtgtttgtccagcaccttgtgaagatgcatgtgttttaagtataaatgagaaggctgtatcaataaaatttattgaattatctattattgaatatggattcataaaaaaatggatacaaccaatgataccaattagtcgtactggaaaaaaagtggcaattgtgggttcaggaccagcgggattaactgcagcacaacaattaaacaaagctgggcatgaagtaactgtttttgaaaaggatgaatattttggaggattattaatgaatggaataccaaatgtacgtttagataaaaaaattctagagagaagattaatattaatgaaaaaagaaggaattttaatgaaaaataatgtaaatgtaggtgtagatataacattatctgatttagtaaaagaatatgatgctatacttttagctactggttataaaattcctagaaagttagatattccaggtgctaatttaaataatatttattttgctatggatttcttaacatcatgtcaaatatcattaacaaaatcagatatgacagatgataattatatagatgtatctgaaaaacatgttatcatattaggtggaggaaaaacagcagtagattgcatcagtttagctattcgtatgggtgcgtctagtgtgttacaatttacacgacaagaaattcttcctatgaatacatcagaatattggtggccaggattaaaaaatattttcaaagttgaatattcacatgaggaagctatcattatacaaggtagagatccaagagaattttgtgtgaggagtttggaattcattccatctaataaagaccctaaaagagtttctggaattagagctataagagtaaaattaaaaaaaaacttaaaaagtgaaatgaaacaaaataataaaatgttatataataattatatggataatcatcgtaataattcatccaaaatagatttaaagaaacatctatctaaaacaaataaattaaaaagtattaaaagtatttcaaaaggcccaactcaagaaacaacaacagcaagttcttattcttcttcatctcctgcagaaaatgatattattcagaattaccaaataataaaggatcataatgaatattttgatataccatttactgaaagaatttataaagctgatgtagtcattttagcattgggattttcaaaaacagatgattccatatgggaaaatgataatataaaaattgaacttaataattataattgcataaaaacaaacaatagaatttatcaaactaatcataaaaatatatttgcatgtggagattgtagaataggacctagtacagtagtacaagcaattgccgaaggaagagatgtagcttctaaaatagatgaatatttaactaattcggtatctatacttcctccatgtaatacttattattattatcctaagaattataagaatgttccctttggttcttctaactggggataa

SEQ ID NO: 4604 - protein, 3106 aa, Plasmodium falciparum
MGKENIDNKGLYDSRNEKDACGVGVVADINGKFSRNVIQKALQILLRLSHRGGVQGNNGDGAGILVGIPHEYFQMLSDTCQLPFLLPEKGEYAVAQIFLPQNEERRLFLYHEIEKEVYNHGLVVLGWRSPIPVRRDVISCSVKKSEPFIAQMFVCKRSVFKNYDDFNIYPFSDINFTDDSNLKLNELPDDIELLSFFIRKKLVRHNDMYFCSFSSRTIVYKGLLTPSQIYLYFEDLLSENFTSYLAMVHVRFSTNTSPTWYAAHPFRRICHNGEINTISVNSILFQERMESAKTPECFKSVSIKDLRPINEENYIIYDNDDEIIQKRDTFEDIMLTQNRLKKKSRRNLLLKLKKDYTYNSSAIHYNIKREYMNSDINSNSEFLSNVNDDSKSSSDVDKISEENLMNHLKEKNNKAFRKSMKNQIKHGESQKTKGAISYPSDSSIFDNAIDFLTMTGREIEHAVMMLMPRAYQKDPNISPLEKAFYEYHTCIMEPWDGPALIIFTDGYKVGASLDRNGLRPARYSITNYGLFVLSSETGVVDLSYDKIVHKGSVYPGKVVLVDFKEKKFLRHEEVLSKFLRERPYKKWIDHYSIHMDNIIRPVTNMENIRMNAYKYGAILNKDNYYHNNNTNINNSNNNNNNNMIKSNSNALSINNNKTCLNDIDYYDESLIKKLKAFGYTYDAFNMIISPMVKHAADGLGSMGNDTAFPFLSYLHRNLLYYFQQTFAQVTNPAIDPIREENIMSLMSNLGKEGDLLQYSHVNCHRIFINGPILNEALYNMLLQLPDFPHIIIDMTIDLDKLQSMMINVNSNFSPNKDGDPSQNIHNNIVSNKNSEDPSKLDVCKTKQAKEEHTKKKHISSKYLIKFIDSVNSKAENAIKKGCQLIILSHNNVNEKRVPIFSILIVGALHKYLLSKNLRTKCSLIVKAGDCFEIHHLAVLLSFGADCIYPYILYESLQFIKFADNEARLSNNQMISNYRHAANYGILKIMSKNGISTLPSYKGCGLMQPLGISDEILKKCFINVCDSIIGGVTFEFVEKEILNIFYLAYPKRILTLNLKDANEELDDYGEYHFRNIGKSQIHMNHPETISLLQKATRSGNKDTYKKYSELQNELINHCEIRGQLEINYKKCPSYNKIKKKHEPINIHLVEPVNKILLRFCTGAMSFGSLSEEAHTTVATAMNSMGLKSNTGEGGEAEERIKTANNEINTNSAVKQIASARFGVTAYSLVNAQELQIKVAQGSKPGEGGELPGYKVSSKIASIRRSTPGVGLISPPPHHDMYSIEDVGQLVYDLKNINKEAKISVKLVSKLGIGVITSGVVKGNCEQILISGTSGGTGASKWTSIKHAGLPWEIGLAEAHQTLCKSKLRKRVILQIDGQLKTGRDVILGALLGAESFSFSTQPLISLGCIMMRKCHLNICPVGICTQDPELRKKFAGKPEYIVNFFFMLAEEVREYLASMGFRKFSQIIGRSDLLKKKDHLKYDEKRKLLDFSKLLFPGWKYYAEDEMKDDQNKRYKNISNKKKKYNTNSLYSASKHKKKNTKAGLHSIKKKMKNRKQVLINESFNTIKKYKINSKQADTIERVNGQNEYFINVECDEADAENESDQNDNNEEEETDKSDVEENIDNDENEDMDQIDDIDEEDDEYYNDGSDDSDDSDDSDGNDDSDDNDDDIDDLDDVDDVDDLDDVDDLDDVDDLDDLDDVDDIDDVDDVHNADNVNCRKDNHTDHDYDDNNNVKDEYPNNNDKKGQNSREKRNKKKSMNRNIIYKYQYKEKGSYNINKKNHNNNNINKKNTKKIKKKIHLKKKKVKPIPIFCCETQNHKLSDVIDRELIRRSKIALLNCTPVNIKMPIKNTDRAVGAMLSYHIIQKYGEEGLPIDTINVKFRGTGGLSFGVFLTSGVNFELEGDANDFVGKGLSGGIISVHFPKNALFINECQKNVIAGNSVLYGATKGRAFFAGRAGERFAVRNSGAIAVVEGVGSHGCEYMTKGIVVVLGEIGCNFAAGMSGGIAYVLDINEKNVNHQMVDLKVCKTMDEKMTLEKLLHEHYERTNSYTAKMLLQNFDENLQRFTKIIPRDIKRVLTEACIEFVKTGNEEAAAILDDWASLLKSVDQPEHMYKKAMQFFTTITDDISGLSKSLALRSVDGLIIYDILQEQRSRNLLSIKNSSNDFNSLNNEEQNIKKKKFFDFESFIHNLELCRSNNRKWRRFSEIPFKCNAFSDFKNTFPEKLDDKSKEMIKKYILNEQYLLDLHLKSLNSNKFIEKLIIRETDDYIHMDQKQLSPNIYTLKKYLYPSDNYDVSNISNSMTAYNKINGVHLMNKQNENKQNAEVPNSYDFSGYTLGARRKTADMVNIQKDDENDIRIANNTKSISNTNDMNNVSNMNNMNNVNNVNNVNNVNNVSNMNNMNNMNNMNNINNMNNINNMNNINKDDNNNINGDDTNNTVISEVTNTTYANKSSNYSQSQYAKTSGDGKIKKYSVDTEISDMTRVSSDYGNASSISSTKPFLVANPNKVTGFKEYERLSHPLKDISSRVLDYSEIIVPINVKSKLHNQLLKTQASRCVDCGTPTCHYPNSSGGGCPLGNRIFDWNNLVYENEWKKALERLLDTNNFPEITGRVCPAPCEDACVLSINEKAVSIKFIELSIIEYGFIKKWIQPMIPISRTGKKVAIVGSGPAGLTAAQQLNKAGHEVTVFEKDEYFGGLLMNGIPNVRLDKKILERRLILMKKEGILMKNNVNVGVDITLSDLVKEYDAILLATGYKIPRKLDIPGANLNNIYFAMDFLTSCQISLTKSDMTDDNYIDVSEKHVIILGGGKTAVDCISLAIRMGASSVLQFTRQEILPMNTSEYWWPGLKNIFKVEYSHEEAIIIQGRDPREFCVRSLEFIPSNKDPKRVSGIRAIRVKLKKNLKSEMKQNNKMLYNNYMDNHRNNSSKIDLKKHLSKTNKLKSIKSISKGPTQETTTASSYSSSSPAENDIIQNYQIIKDHNEYFDIPFTERIYKADVVILALGFSKTDDSIWENDNIKIELNNYNCIKTNNRIYQTNHKNIFACGDCRIGPSTVVQAIAEGRDVASKIDEYLTNSVSILPPCNTYYYYPKNYKNVPFGSSNWG

SEQ ID NO: 4605 - DNA, 1734 bp, Chlorobium tepidum
  CDS (1)..(1734)
atgaatgcagaatcaaacccgattctcgattttgcgacagagtacgtctaccctgccttcagcgaactgacagggaccgacaagatcgtcgcctttggggatcacagccacaaatgcccgatctacgtaccgcagaccccgccctgcaccgccgagtgcccggcaggcgaagacatccgggccatcaaccgttttctgaacggcaccgacccgtcggacgacccgctgaaatcggcctgggaaacggccaccgacaccaaccccttcccggcggtaatggggcgcatctgcccgcacccgtgccagagcaaatgcaaccgcggcgtgcacgacgaaagcgtggccatcaacgccgtcgagcaggtgctcggcaactacggcatcgagcacaacctcaaactcaaaggccccggtgccgacaccggcaagcgggtcgccatcatcggcggcggcccggcgggactctccgccgcctaccagctgcgccgcaaaggccacgccgtcaccatctacgacgccaacgaaaagctcggcggcatggtgctctatggcatcatgggctaccgcgtagatcgcaaagtgctcgaagccgaaatcgggcgcatcatcgaactcggcgtcgagacgaagatgggcgtcaccatcggcaaggacatcaccctcgaacagctcgaagcggagtacgacgcggtcttcatcgccgtcggcgcacagaagggaagagctcttcccgtgcccggctttgaaggcacgcccggcgccaccaacgccatcgacttcctgaaaagctacgaagtgctgggcgatgacattccggtcggcaagcacgtggtggtgatcggcgacggtaacgtagcgatggacgtcgcgcgtctggcgctgcgtctcggctcgcaagccaccatcatctccggcgtgccgcgcgaagagatggcctgcttcgagaacgaattcgacgacgccaaaaacgaaggcacaacgatgcactttctcaccggcacggtagaagtgctcggcggagcgagtggcgtcaccggcctgcgttgcacaaagatggtcaaaaaggagaaaggcgaggaaggctggaactccccgattccgttcctgcgctacaaaagcaatggcgaaagcttcgagatcgaagcggacatggtggtggcggccatcggccaggcgaccgacctgtcgggcctcggcagtgcggccagcggcccgtggctcaaggttgaccgcaacttccggattccgggccgcgaaaagctcttcggcggcggcgacgccctgaaggtcgatctcatcaccacggcggtgggtcacggccgcaaagccgcctacgccatcgacgccttcctgaaaggcgaaccgatgccggaggagccgtatcgcgagatcaccaagccgcacaagcaggacctgctctacttcctgcacaccccgcaggcaaaacgcaccagcatcaagccggaggtggtggtgggcaaccacgacgaactgctcgaagcgctgacgcccgaacaggccatcaccgaatcgaagcggtgtatgagctgcgggttctgcttcgactgcaagcagtgcgtctcgttctgcccgcaggaggcgatcacccgcttccgcgacaacccggcaggcgaaaaagtctataccgactacacaaaatgcgtcggctgccacctctgctccctggtctgcccctgcggctacatccagatgggcatgggcgacggactgtaa

SEQ ID NO: 4606 - protein, 577 aa, Chlorobium tepidum
MNAESNPILDFATEYVYPAFSELTGTDKIVAFGDHSHKCPIYVPQTPPCTAECPAGEDIRAINRFLNGTDPSDDPLKSAWETATDTNPFPAVMGRICPHPCQSKCNRGVHDESVAINAVEQVLGNYGIEHNLKLKGPGADTGKRVAIIGGGPAGLSAAYQLRRKGHAVTIYDANEKLGGMVLYGIMGYRVDRKVLEAEIGRIIELGVETKMGVTIGKDITLEQLEAEYDAVFIAVGAQKGRALPVPGFEGTPGATNAIDFLKSYEVLGDDIPVGKHVVVIGDGNVAMDVARLALRLGSQATIISGVPREEMACFENEFDDAKNEGTTMHFLTGTVEVLGGASGVTGLRCTKMVKKEKGEEGWNSPIPFLRYKSNGESFEIEADMVVAAIGQATDLSGLGSAASGPWLKVDRNFRIPGREKLFGGGDALKVDLITTAVGHGRKAAYAIDAFLKGEPMPEEPYREITKPHKQDLLYFLHTPQAKRTSIKPEVVVGNHDELLEALTPEQAITESKRCMSCGFCFDCKQCVSFCPQEAITRFRDNPAGEKVYTDYTKCVGCHLCSLVCPCGYIQMGMGDGL

SEQ ID NO: 4607 - DNA, 1419 bp, Chlorobium tepidum
  CDS (1)..(1419)
atggccattccccgtcagaagatgcccgctcaggatccagtggagcgcgtcggtaacttcaaggaggtcaaccttggcctaaccccggaacaggcacagcaggaagccctgcgctgtatccagtgcaaggacccggtctgcatcgcagggtgtccggtcaacatcaagatcgaccagttcatcaaactgatcgccgagggtgacttcatgggcgcggtcagaaagatcaaggaggacaacgtactgccgtcaatttgcggccgcgtctgcccgcaggaagaccagtgcgagaaggtgtgcgtcatcggcaagaagcacgagccggtggccatcggtaacctcgaacgcttcgtgggcgattacgaacgcaccagcggccagaagatcgatccgaaaatcgcgcctccgaccggcaaaaaggttgccgttgtcggcagtggtccggccggcctgagctgcgccaatgacctggcccagtacggccacaaggtggtggtgttcgaggcgctgcacgaactcggcggtgttttgatgtacggcattccggaattccgtctgccgaaggagatcgtccgcgaagagcttgacggcctgcgccgcatgggcatcgagttccgcaccgacgtggtggtcggacgcacgatcaccatcgacgagctgatggaagaggaaggtttcgacgcggttttcatcggcgtgggcgcgggtctgccctggttcatgggcattccgggcgagaacctcgtcggcgtactcgcggccaacgagttcctcaccagggtgaacctcatgaaggcctacgacttcctgaagagcagcgacacgccggtgttcgactgcaagggtaaaaacgtcgcggtcttcggcggcggcaacaccgcgatggacgccgtacgcacggccaaacggctcggagcggagcacgcctacatcgtctatcgccgctccgaaaaagagatgcccgcccgcgaggaggagattcacaacgccaaggaggagggcatcgagttcctgctgctcaccacaccgcttgaattcgtcggcgatgaaaaggcgtggctcaccggcgcgaagtgccagaaaatggagctgggtgaacccgacgattcgggacgccgccgcccggtaccagtcgaaggctcggagtacatcctgcccatcgacatggcgatcatctccatcggcaacggccccaacccgctcatccaccagacgacacccgacatcgaggtcagcaaacgcgagaccatcgtcgttgacgtcaacaccatgcagacctccaaggagaacgtttacgccggtggcgacatcgtcacgggcggcgcgaccgtgattctcgcgatgggcgcgggacgcaaagcggcggctgccatcaacgaaaagctcggcggcacggccaagaacttcaacgagtggtaa

SEQ ID NO: 4608 - protein, 472 aa, Chlorobium tepidum
MAIPRQKMPAQDPVERVGNFKEVNLGLTPEQAQQEALRCIQCKDPVCIAGCPVNIKIDQFIKLIAEGDFMGAVRKIKEDNVLPSICGRVCPQEDQCEKVCVIGKKHEPVAIGNLERFVGDYERTSGQKIDPKIAPPTGKKVAVVGSGPAGLSCANDLAQYGHKVVVFEALHELGGVLMYGIPEFRLPKEIVREELDGLRRMGIEFRTDVVVGRTITIDELMEEEGFDAVFIGVGAGLPWFMGIPGENLVGVLAANEFLTRVNLMKAYDFLKSSDTPVFDCKGKNVAVFGGGNTAMDAVRTAKRLGAEHAYIVYRRSEKEMPAREEEIHNAKEEGIEFLLLTTPLEFVGDEKAWLTGAKCQKMELGEPDDSGRRRPVPVEGSEYILPIDMAIISIGNGPNPLIHQTTPDIEVSKRETIVVDVNTMQTSKENVYAGGDIVTGGATVILAMGAGRKAAAAINEKLGGTAKNFNEW

SEQ ID NO: 4609 - DNA, 1473 bp, Chlorobium tepidum
  CDS (1)..(1473)
atgggtaaactgaaaggatttatggagtaccggagagcccttcccgtagaccgggagcctctggaaagaataaaggactggaacgagttccacgaggagatgtcggccgagcagctcagcgaccagggcgcgcgctgcatggattgtggcacgccgttctgccactcgggcttcatgctcaacggcatgactgctggctgcccgattcacaaccttatccccgagtggaacgatcacgtctatcgcggcttctggcgcgacgcctgggaacgactgatgaagaccaacaacttcccggaattcaccggcagggtgtgccccgcgccgtgtgaaggctcctgcgtgctcggcatcatccagccgccggtgaccatcaagaatatcgagtactcgatcatcgaacatgccttcgctgaagggtgggtcgagccgaagcagatcgccgtccgcactggtaaaaaggtggctattgtgggttccggtccgtcgggccttgcctgcgccgaccagctcaacaaggcggggcacacggtcacggttttcgagcgtgatgaccgcgttggcggccttctcatgtacggtattccgaacatgaagctcgacaagcggctggtggtgcagcgccgcgtcgatctcatgaaagaagagggcgtgagttttgtgaccggaaccgaagttggagtcaactacccggttgacaagctgctctcggagtacgacgccgtggtgctctgtatcggagcgaccaacccgcgcgatctcaatgccgatgggcgcaatcttgacggcattcacttcgcgatggagtttctccgtgccagcaccaaggctgtgctcgatggcaccgaacctgtgctctccgccaagggcaaggatgtggtggtgatcggcggcggtgacaccggaaccgactgcgtggctacatcgctgcgccaggggtgtaagagcgtcatacagcttgaaatcatgccgaaaccagccgacttccgccaagaagacaacccgtggcccgaatggccgaaggttttcaaggtcgattacggccaggaagaggcagctgccgtgcagggcggcgacccgcgtcgctatctcatgatgaccaagaagttcatcggcgagaacgggcggctcagtgccgtcgaggtctcgaaggtcgagtggatcaaacaggaggggcgcaccattcccgtgccggtatccggcagcgaagagatcattccagcccagctcgtgctgctggcgatgggcttcctcgggccagaagcgcagctcttgcagtcgcttggcgtcgagcaggacagccgcagcaacatcaaggctgacgagaaaagctaccgtaccagcgttgacaaggttttcgccgcaggcgatgcccgccgtggtcagagcctcgtggtgtgggcgatcaacgaagggcgcgccgctgccagagagtgcgaccgcttcctgatgggttgcaccagcctgccgtga

SEQ ID NO: 4610 - protein, 490 aa, Chlorobium tepidum
MGKLKGFMEYRRALPVDREPLERIKDWNEFHEEMSAEQLSDQGARCMDCGTPFCHSGFMLNGMTAGCPIHNLIPEWNDHVYRGFWRDAWERLMKTNNFPEFTGRVCPAPCEGSCVLGIIQPPVTIKNIEYSIIEHAFAEGWVEPKQIAVRTGKKVAIVGSGPSGLACADQLNKAGHTVTVFERDDRVGGLLMYGIPNMKLDKRLVVQRRVDLMKEEGVSFVTGTEVGVNYPVDKLLSEYDAVVLCIGATNPRDLNADGRNLDGIHFAMEFLRASTKAVLDGTEPVLSAKGKDVVVIGGGDTGTDCVATSLRQGCKSVIQLEIMPKPADFRQEDNPWPEWPKVFKVDYGQEEAAAVQGGDPRRYLMMTKKFIGENGRLSAVEVSKVEWIKQEGRTIPVPVSGSEEIIPAQLVLLAMGFLGPEAQLLQSLGVEQDSRSNIKADEKSYRTSVDKVFAAGDARRGQSLVVWAINEGRAAARECDRFLMGCTSLP

SEQ ID NO: 4611 - DNA, 1749 bp, Chlorobium tepidum
  CDS (1)..(1749)
atggtggtcgaaacgagcaatgccgagctcgacgccatgcgccgccagagccttgaacggctgcttgcccggcactgcggcgactgcctcgcgccgtgcgagctggcctgcccggcgggttgcgacattcccggattcgtctcggccatcgccaaaggtaacgaccgcgaagcgctcgaaatcatccgccgcaccattccgctgccgggcattctcggtcgcgtctgccccgcaccgtgcgaggaggcgtgccgccgccacggcgttgacgagccggtctcgatctgcgccctcaagcgcttcgctgctgatcaggatatggttgaaggatcgggacttccggagcgcaaaccggcctccggcaagcgcgtggccatcgtcggcgcaggcccggcgggtctgaccgccgcttggtatctgctgctcgacgggcacgcggtgacggttctcgatgcgaacgaaaaagcgggcggcatgatgcgttacggcatcccgaagttccgcctgcccgaagcggtgatcgacgccgacgtcaagccgctcgtgaagatgggcgcggagttccgcttctcgaccctgttcggcaaggacgcaaacctggaggaattgcagcaggagcacgatgccgtgctgctcaccatcggcgcgagccaggcatcgaagctcggcattccgggcgaagagcttgacggcgtacagagcggcatcggtttcctcgccaatgttgcggacggaaaagctgccgcgcccggcaagtcggtgatcgtcatcggcggcggcaacacagccatcgacgcggcacgaaccgccctgcggctcggtgcggaatcggtgacgattctctaccgccgcggacgcgaagagatgcccgctaaccggctggaaatcgaggaggcggtcgccgagggcgtcgagcttcgcctgctggccgcgccggtcgcgattgaaaaaggagcgaatagtcttgtcgtcacggcggtcgaaatgcagctcggcgaacccgacgcgagcggacgccgccgcccggttcccgtcgcgggatcggagttcacgctccacgccgacacggtcatctcggccaccggccagcaggttgacctcccggctgaagcggcagcgggtatcggcgtcgagcgcaacggaacagtcaaaatcaatggagaatctatgctcactggcgcggcgggcgtcttcgcggcgggcgactgcgtcagcggccccgacctcgccatcaaagctgtccggcagggtcgcctcgccgctgaagcgattgaccgctacctcaacggcggcgatccggcagcaacaggaatgtcgatgttcaactcatcgtacggagcgcgagacaaggccccgcaccagttctacgaccgggcgaggcctgcggcacgggttgccgtgccggagcttgaggcggaatcgagacgccagagcttcgaggaggcggtaacggggtacgatccggaaaaggcgcgagaggaggccaaacgctgcctgcgatgccgctgccaggcggttgacgattgccgcctgcggaatctggccacggcgttcggcgtggcaacaccggccaccgaagaggcccacgaatacttcagcatcgacaggtcaggcgacatgcgtttcgaacgggaaaagtgcatcgattgcggcatctgcatccgcacgttggagtcggcttcggcagatgcagtcacgatccgggaagagctgatcgaccactgcccgaccggagcgatcagcagataa

SEQ ID NO: 4612 - protein, 582 aa, Chlorobium tepidum
MVVETSNAELDAMRRQSLERLLARHCGDCLAPCELACPAGCDIPGFVSAIAKGNDREALEIIRRTIPLPGILGRVCPAPCEEACRRHGVDEPVSICALKRFAADQDMVEGSGLPERKPASGKRVAIVGAGPAGLTAAWYLLLDGHAVTVLDANEKAGGMMRYGIPKFRLPEAVIDADVKPLVKMGAEFRFSTLFGKDANLEELQQEHDAVLLTIGASQASKLGIPGEELDGVQSGIGFLANVADGKAAAPGKSVIVIGGGNTAIDAARTALRLGAESVTILYRRGREEMPANRLEIEEAVAEGVELRLLAAPVAIEKGANSLVVTAVEMQLGEPDASGRRRPVPVAGSEFTLHADTVISATGQQVDLPAEAAAGIGVERNGTVKINGESMLTGAAGVFAAGDCVSGPDLAIKAVRQGRLAAEAIDRYLNGGDPAATGMSMFNSSYGARDKAPHQFYDRARPAARVAVPELEAESRRQSFEEAVTGYDPEKAREEAKRCLRCRCQAVDDCRLRNLATAFGVATPATEEAHEYFSIDRSGDMRFEREKCIDCGICIRTLESASADAVTIREELIDHCPTGAISR

SEQ ID NO: 4613 - DNA, 1521 bp, Corynebacterium glutamicum
  CDS (1)..(1521)
atggccgacccacaaggattcatcaaatactcccgacgcgagcctgcacaccgcccggtcccgctgcgcctcatggaccactccgaggtctacgaaaaggcaccggcaggtcagatcgaggaacaggctgcccgctgcatggattgcggtgtcccgttctgccacgaaggctgcccactgggcaacatcatccctgagtggaatgatctggtacgccaaggtcggtggaaggaagcctacgatcgcttgcacgcgaccaacaatttccccgagttcaccggccgtttgtgccccgcaccctgcgaaggcgcctgcgtgctcggtatcaacgatgattctgtcaccatcaaaaacgttgagctggaaatcgtcgaaaaagcattccgcgaaggctgggtgcaaccagtaatcccatccatgtctaccgggctgtcagtcgccgtcgtcggttccggccccgctggccttgccgccgcgcagcagctcacccgcgcaggccacagcgttaccgtctttgaacgcgacgaccgcctcggcggcctcatgcgctacggcgtgccagaatacaaaatggagaaccgctggatcgaccgccgcatcgagcaaatggaagcagagggcacaactttccaggtaggcacctcgccgcgcgccgctgaactagcgcttttcgacgcgatcctcctcgcaaccggcaccccagtggcccgcgaactctcagttccaggccacgatctcaacggcatccatgcggcaatggattacctcaccgcccaaaaccgcatcaacgaaggcgacggtgaagtctctccaatcaacgccaaaggcaagaaagttgtcatcatcggtggcggcgacaccggcaccgactgcttcggcaccgcactgcgccaaggagcagaatcagtcacccaatttgatatccgcccccgcgctcctttccagcgcgccgattccaccccatggccgatgtaccccaacctcttccgcaccgcaacggctcacgaagaaggcgaatacatcatcactggcgatgaatcagccgatgaaatcgcagccctgggcctcgccgaacgtgccgcaggctccacgcttggtgaacgtaaatttgctgtcaacaccgtggaattccacggcaacaacggccacgtcaccggactcaccggcaaccaaatccgagttgtcaacggcaaacgtgaaccaatcgaaggcaccgaattccccttcgaagcagacctcgttcttgttgcacttggcttcaccggcgcagaacaaggcggattggcacacgaactaggcgtaggtttcgacgaccggggccgcatcctccgcgattccgaataccgcagccccaccaactcccgcgtttacatcgcaggcgacaacggccgtggccagtccctgatcgtgtgggcaatcgccgaaggccgcgcatgcgccgcagctatcgacgccgatctcatgggtgaaactgcactccctgtagcagttgcaccacaggacgtgccgctggctgtctag

SEQ ID NO: 4614 - protein, 506 aa, Corynebacterium glutamicum
MADPQGFIKYSRREPAHRPVPLRLMDHSEVYEKAPAGQIEEQAARCMDCGVPFCHEGCPLGNIIPEWNDLVRQGRWKEAYDRLHATNNFPEFTGRLCPAPCEGACVLGINDDSVTIKNVELEIVEKAFREGWVQPVIPSMSTGLSVAVVGSGPAGLAAAQQLTRAGHSVTVFERDDRLGGLMRYGVPEYKMENRWIDRRIEQMEAEGTTFQVGTSPRAAELALFDAILLATGTPVARELSVPGHDLNGIHAAMDYLTAQNRINEGDGEVSPINAKGKKVVIIGGGDTGTDCFGTALRQGAESVTQFDIRPRAPFQRADSTPWPMYPNLFRTATAHEEGEYIITGDESADEIAALGLAERAAGSTLGERKFAVNTVEFHGNNGHVTGLTGNQIRVVNGKREPIEGTEFPFEADLVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 4615 - DNA, 1482 bp, Xanthomonas campestris
  CDS (1)..(1482)
atgagccgcaagcaagccttccaattccttgacctgccgcggaccatgcccacgcgcatcccggtggagctgcgtacgtccggtgactggggcgagttgtacggcaagttcgacaaggccgacgcgcagtaccagtccggccgctgtctggattgcggcaacccgtactgcagctggaagtgcccggtgcacaacgccattccgcagtggctgcagctggtgcaggaagatcgcatcatcgaggccgccgcgctgtgccattccaccaacccgctgccggaagtgtgcgggcgcgtgtgtccgcaggaccgtctgtgcgaaggcagctgcacgctggaagaattcggcgcggtcaccatcggcgcggtggaaaagtacatcgtcgataccgccttcagcatgggctggcgcccggacctgggcaacgtgcaacccagcggccaccgcgtggccgtggtcggcgccggcccggcaggcctgtcctgcgcggaccgcctggtgcgcgccggcatcgaagcggtggtctacgaccgctacgaacagatcggcgggctgctgcagttcggcattcctagcttcaagctggacaagtcggtgatcggcaagcgccgcgagatcctggaaggcatgggcgtgcagttccgcctgggcgtggagatcggcaaggacgtcagcatcgaacagttgctcggcgaatacgacgccgtgttcctgggcaccggcgcgtaccgctacaccgacggcgggctggacggccaggacctgaagaacgttttgccagcgttgcccttcctggtgcagaacagccgcatcgtcagcggcaacgacccgcacggccggccgatcgccggctgggaagaccagatcgccctgcccgacctcaacggcaagcgcgtggtggtgctgggcggcggcgacaccggcatggactgcgtgcgcagcgccatccgcctgggcgcggccaaagtcacctgtgcctaccgccgcgacgaatccagcatgccgggctcggcgcgcgaagtggccaacgcgcgcgaagaaggcgtgcgcttcctgttcaaccgccagccgctgtcgatcgagtccggcgccgacgacgaagccatcggcgtgaccgtggtggaaaccaaactcggcgagcccgacgccagcggccgccgcaacgcggtgccggtggaaggcagcgaatcgttgctggaagcggacgtggtgatcatcgcgttcggcttctcgccgacggtgccggagtggctgtcctcgcaaggcgtggaggccggcagcaacggtcgcatcgtcgccccggccgagggcaacggccgcctgccctaccagaccagcaacccccgcctgttcgccggtggcgactgcgtgcgcggcgccgacctggtggtcaccgccgtggccgaaggccgcgatgcggccggcagcatcgtgcagctgctgggtgtcaaagcgcaggtcaaggagccggctgcggcgtga

SEQ ID NO: 4616 - protein, 493 aa, Xanthomonas campestris
MSRKQAFQFLDLPRTMPTRIPVELRTSGDWGELYGKFDKADAQYQSGRCLDCGNPYCSWKCPVHNAIPQWLQLVQEDRIIEAAALCHSTNPLPEVCGRVCPQDRLCEGSCTLEEFGAVTIGAVEKYIVDTAFSMGWRPDLGNVQPSGHRVAVVGAGPAGLSCADRLVRAGIEAVVYDRYEQIGGLLQFGIPSFKLDKSVIGKRREILEGMGVQFRLGVEIGKDVSIEQLLGEYDAVFLGTGAYRYTDGGLDGQDLKNVLPALPFLVQNSRIVSGNDPHGRPIAGWEDQIALPDLNGKRVVVLGGGDTGMDCVRSAIRLGAAKVTCAYRRDESSMPGSAREVANAREEGVRFLFNRQPLSIESGADDEAIGVTVVETKLGEPDASGRRNAVPVEGSESLLEADVVIIAFGFSPTVPEWLSSQGVEAGSNGRIVAPAEGNGRLPYQTSNPRLFAGGDCVRGADLVVTAVAEGRDAAGSIVQLLGVKAQVKEPAAA

SEQ ID NO: 4617 - DNA, 1482 bp, Xanthomonas axonopodis
  CDS (1)..(1482)
atgagccgcaaacaagccttccaattcctcgacctgccccggaccatgcccacgcgcattccggtggaactgcgcacgtccggcgactggggcgagttgtacggcaggttcgacaaggccgacgcgcaataccaggccggccgttgcctggactgcggtaatccgtattgcagctggaaatgcccggtgcacaacgccatcccgcaatggctgcagctggtgcaggaagaccgcatcatcgaggccgccgcgttgtgccattcgaccaacccgctgccggaagtgtgcgggcgggtgtgtccgcaggaccgcctgtgcgaaggcagctgcacgctggaagaattcggcgcggtcaccatcggcgcggtggagaaatacatcgtcgacaccgccttcaagatgggctggcgcccggacctgggcaacgtgcaggccagcggccaccgtgtggcggtgatcggcgccggcccggccggcctggcgtgtgcggaccgcctggcgcgcgccggtatcgaagcggtggtgtacgaccgctatgagcagatcggcggcctgctgcagttcggcatccccagcttcaagctggacaaatcggtgatcggcaagcgccgcgagatcctcgaaggcatgggcgtgcagttccgcctgggcgtggaggtcggccgcgacgtcagcatcgagcagttgctgggcgaatacgacgcagtgttcttagggaccggcgcgtatcgctacaccgacggcggcctgcccgggcaggacctgaagaacgtgctgccggccctgccgttcctggtgcagaacagccgcatcgtcagcggcaacgacccgcacggccggccgatcgctggctgggaagaccagctcgccctgcccgacctcaccggcaagcgcgtggtggtgctgggcggtggcgacaccggcatggactgcgtgcgcagcgccattcgtctgggcgcagccaaggtcacctgcgcgtatcgccgcgacgaagccagcatgcccggctcggcacgcgaggttgccaacgcacgcgaagaaggcgtgcgcttcctgttcaaccgccaaccgctgtcgatcgaatccggcgccgacgacgaagccatcggcgtgaccgtagtggaaaccaagctgggcgaacccgacgccagcggccgccgcaatgcggtgccggtggaaggcagcgaatcgctgctggaagcggacgtggtgatcatcgccttcggcttctcgcctaccctgcccgactggttggcctcgcaaggcgtggacgccggcagcaatggccgcatcgtcgccccgtccgacggcaacggccgcctgccctaccagaccaccaacccgcgcctgttcgccggcggcgactgcgtgcgcggcgccgatctggtggtgaccgcagtagccgaaggccgcgatgcggcgggaagcatcgtgcagctgctcggggtcaaagcgcaggtcaaggagccggctgcggcgtag

SEQ ID NO: 4618 - protein, 493 aa, Xanthomonas axonopodis
MSRKQAFQFLDLPRTMPTRIPVELRTSGDWGELYGRFDKADAQYQAGRCLDCGNPYCSWKCPVHNAIPQWLQLVQEDRIIEAAALCHSTNPLPEVCGRVCPQDRLCEGSCTLEEFGAVTIGAVEKYIVDTAFKMGWRPDLGNVQASGHRVAVIGAGPAGLACADRLARAGIEAVVYDRYEQIGGLLQFGIPSFKLDKSVIGKRREILEGMGVQFRLGVEVGRDVSIEQLLGEYDAVFLGTGAYRYTDGGLPGQDLKNVLPALPFLVQNSRIVSGNDPHGRPIAGWEDQLALPDLTGKRVVVLGGGDTGMDCVRSAIRLGAAKVTCAYRRDEASMPGSAREVANAREEGVRFLFNRQPLSIESGADDEAIGVTVVETKLGEPDASGRRNAVPVEGSESLLEADVVIIAFGFSPTLPDWLASQGVDAGSNGRIVAPSDGNGRLPYQTTNPRLFAGGDCVRGADLVVTAVAEGRDAAGSIVQLLGVKAQVKEPAAA

SEQ ID NO: 4619 - DNA, 1410 bp, Methanosarcina mazei
  CDS (1)..(1410)
atgcaagaattacacggagaaaagacaggaaaagcaaagaaagagagaaccccaatgccagagcagcctgcaggggaacgcaggaagaacttcaatgaagttgccctcggctacacgaaagaagatgcccttgcagaggcttccaggtgtcttgcctgcaaagaaccgaaatgtgttgaaggctgccctgtgaacgtggatattccgggatttattcagcttatatgtgaggagaattttgaaggggcaattgaaaggattaaagccacaaacgctctccctgcaatctgcggccgcgtctgccctcaggaaagccagtgcgaagcccactgtgtactggggaaaaagggccagcctgttgcaatcggaaggcttgagcgtttctgtgcagattatgagcgcgaaaaaggtgtgaagtctccacaggtcatgccgcccacaggcaagagggtggcagttgtaggttccggtcctgcaggacttactgccgcagcagacctggcaaaactcgggcacaaagtaacaatctttgagtccctgcacaaagccggaggagtcctgagttacggcatccccgagttcaggctgccaaaagaaattgtccggcaggaaatcgagtacattgaaaaactcggtgttgaggtcaggcccaactatatcataggcaggatcaagactcttgacgaattatgtgacgatttcgatgccgttttccttggaaccggggcagggctcccgagcttcatgggaatagagggcgaaaacctgaatggcgtatattcagctaacgaattcctgacccgggtaaacctcatgaaagcctatgaccccgaatacgataccacggtcaggcgcgggaagaatgttgtggttgtaggaggcggaaatgtggcaatggacgcagcccgctctgctctccgcctgggcgcagacgaggtaagcatagtctaccgccgcggagaggatgagatgcccgcccgccgtgaggagatcgagcacgccaaagaagagggcattactttcaggctccttacaaaccccgtacgcatccttggtgacgagaagttcaacgtcacaggtgtcgaatgcataaggatggaacttggcgaacccgataaatctggcaggagaagccctgtccctgttgaaggctcggaattccttgtgccggcagatgttgtggttattgcgataggcacctctccaaacccgatcatttttaaaggctcggaagggcttgaacagaataagagaggaactgtagttgctgatgaggagaccggagcgacctccaaatgtggagtctttgccggcggagacgtggttacaggggcagcaaccgttatcagcgcaatgggcgcaggtaagaaggctgcaaaagcaattgatgaatatttgaaagaaaagtga

SEQ ID NO: 4620 - protein, 469 aa, Methanosarcina mazei
MQELHGEKTGKAKKERTPMPEQPAGERRKNFNEVALGYTKEDALAEASRCLACKEPKCVEGCPVNVDIPGFIQLICEENFEGAIERIKATNALPAICGRVCPQESQCEAHCVLGKKGQPVAIGRLERFCADYEREKGVKSPQVMPPTGKRVAVVGSGPAGLTAAADLAKLGHKVTIFESLHKAGGVLSYGIPEFRLPKEIVRQEIEYIEKLGVEVRPNYIIGRIKTLDELCDDFDAVFLGTGAGLPSFMGIEGENLNGVYSANEFLTRVNLMKAYDPEYDTTVRRGKNVVVVGGGNVAMDAARSALRLGADEVSIVYRRGEDEMPARREEIEHAKEEGITFRLLTNPVRILGDEKFNVTGVECIRMELGEPDKSGRRSPVPVEGSEFLVPADVVVIAIGTSPNPIIFKGSEGLEQNKRGTVVADEETGATSKCGVFAGGDVVTGAATVISAMGAGKKAAKAIDEYLKEK

SEQ ID NO: 4621 - DNA, 1401 bp, Thermoanaerobacter tengcongensis
  CDS (1)..(1401)
atgccgttaaatagaagcaaaaagaaaacacccatgcctacccaaaagcctgaagtccgcaggcgtaattttaacgaagtagctttgggctattcggaagaggaggcagtaagtgaagcccagaggtgccttcagtgtaaaaaaccaggatgtgttgaagggtgccccgttcaggtacaaattccccagtttataaagcgtattgcagaaagagattttgaaggagctataaagattataaaggaaaccaacagcttgcccgccatatgtggcagagtctgtccacaagaaacgcaatgcgagaaaaactgtgttttgggcaaagtaggtgaacctgtggccataggtcgcctagaacggtttgcagcagactgggaaagagccaaaggcatccgtcccccggtaattcctaaaaagcttggtaaaaaagtggccatcatcggttccgggcccgccggtctcacctgtgcaggagatttggctaaactcggctacgatgtaacgatctttgaagctcttcacaaacccggcggcgtactggtatacggtattcctgaattcaggctaccgaaaattatagtggaacaagaagtaaagtttatacaacagctgggcgtagaaattaaaaccaacatggttatgggcaaagttttaacgatagacgacctttttgaaatggggtatgaggctgtctttatcagcaccggagctggcctcccgaaatttatgggcatacctggtgaaaactaccttggcgtgtattcagccaacgagtttctaaccaggataaacctgatgaaagcctattcttttcccaacactgacacccccataaaggtaggtaaaaaagtagcagtaatagggggtggcaatgtagctatggatgcagccaggtctgccctaagaatgggagctgacgaagttcatattgtgtatcgccgttctgaagaagaaatgcccgcaagaaaagaagaattcgagaacgctaaagaggaaggtattatattcgatttcctcacaaatccagtgagaataataggtaacgaaaatggttgggtcaaaggtattgagtgcatccgcatggaacttggagaacctgacgcttcgggtcgtcgtcgtccagttcctataacgggttctgaatttattatggatgttgatacgatagtaatcgccataggtactggccctaatcccctcctcacaaagaccactgaaggcttagaacttacaaaacacggttatattgctgtcgatgaagagggaagaacttccagagaaggggtatgggctggaggcgatattgtaacgggttcagctactgtaattttggccatgggtgccggaaaaaaagcagctcgttccatccatgaatacctacaaaacaaaaaatggcggtaa

SEQ ID NO: 4622 - protein, 466 aa, Thermoanaerobacter tengcongensis
MPLNRSKKKTPMPTQKPEVRRRNFNEVALGYSEEEAVSEAQRCLQCKKPGCVEGCPVQVQIPQFIKRIAERDFEGAIKIIKETNSLPAICGRVCPQETQCEKNCVLGKVGEPVAIGRLERFAADWERAKGIRPPVIPKKLGKKVAIIGSGPAGLTCAGDLAKLGYDVTIFEALHKPGGVLVYGIPEFRLPKIIVEQEVKFIQQLGVEIKTNMVMGKVLTIDDLFEMGYEAVFISTGAGLPKFMGIPGENYLGVYSANEFLTRINLMKAYSFPNTDTPIKVGKKVAVIGGGNVAMDAARSALRMGADEVHIVYRRSEEEMPARKEEFENAKEEGIIFDFLTNPVRIIGNENGWVKGIECIRMELGEPDASGRRRPVPITGSEFIMDVDTIVIAIGTGPNPLLTKTTEGLELTKHGYIAVDEEGRTSREGVWAGGDIVTGSATVILAMGAGKKAARSIHEYLQNKKWR

SEQ ID NO: 4623 - DNA, 1395 bp, Thermoanaerobacter tengcongensis
  CDS (1)..(1395)
atggccgttaaggatagagtacctatgagagaacaggacccgaaagtgaggataaagaattttgatgaggtagcgctaggttatactgaagaagaagctatcttagaggcttcaaggtgtttgcagtgcccaaatcctacctgtgtggccgggtgccccgtccatgtgagaatacctgaatttataaaagctataactgaaagaaaatttgaagaagcgtacaagataataaccagcactaacagtcttccagccgtttgtggaagagtttgtccacaggaagagcagtgtgagaagaactgcattttgaatagaataggcaagcccattgcaattggaaggttggagaggtttgtagctgattatgcgcttcagaataacattgaagaggaagtaaagccggagaagaagaacaaaaaagtcgccataatagggagcggtcctgcagggcttacctgtgctggagaccttttgaagatggggtacgatgttactatttttgaggcattgcacgctttaggtggagttttaacttatgggattcctgaatttagattgccaaaaagaattgtggaagctgagatagaaaggttaaagaaactgggagcaaaggtagagacaaacgtagtggtaggaaagacagttacaatagacgagctcatggaggaagaaggctttgaagcggtcttcattggcacgggagcaggccttccgaggtttatgggaattcctggagagaacttaaatggagtctattcagccaatgagtttttgacgaggataaacctcatgaaagcctataaatttccggagtacgatactcctatagctgtgggcaagagagtggcagttataggtggagggaatgtagctatggacgctgcccgttcagctttaaggcttgaaggggtagaagaggttatagttgtatacaggcgttcaaaagaagaaatgccagcaagggctgaggaaatagaacacgccattgaggaaggaataaagtttgaatttttggcaaatccaatacgaataaacggaacagaagacggctgggtcaagagcatggacgtaataagaatgaagttaggagagccagacagttcaggaagaagaaggcctatagagatacctggttcagaatttacaatggaagtagatacagtgatcatggcattaggaactagtcctaacaggcttataccctctactacaaaggatattcaagttcaaaaatggggtggaataataacagacgaggatggcaggacctcaaggccaggtgtatttgccggaggagatgccgtcactggagctgcaaccgtgattttagcaatgggagcagggaaaaaagctgcaaaagcgatagatgaatatttgaggagcaaaggagaataa

SEQ ID NO: 4624 - protein, 464 aa, Thermoanaerobacter tengcongensis
MAVKDRVPMREQDPKVRIKNFDEVALGYTEEEAILEASRCLQCPNPTCVAGCPVHVRIPEFIKAITERKFEEAYKIITSTNSLPAVCGRVCPQEEQCEKNCILNRIGKPIAIGRLERFVADYALQNNIEEEVKPEKKNKKVAIIGSGPAGLTCAGDLLKMGYDVTIFEALHALGGVLTYGIPEFRLPKRIVEAEIERLKKLGAKVETNVVVGKTVTIDELMEEEGFEAVFIGTGAGLPRFMGIPGENLNGVYSANEFLTRINLMKAYKFPEYDTPIAVGKRVAVIGGGNVAMDAARSALRLEGVEEVIVVYRRSKEEMPARAEEIEHAIEEGIKFEFLANPIRINGTEDGWVKSMDVIRMKLGEPDSSGRRRPIEIPGSEFTMEVDTVIMALGTSPNRLIPSTTKDIQVQKWGGIITDEDGRTSRPGVFAGGDAVTGAATVILAMGAGKKAAKAIDEYLRSKGE

SEQ ID NO: 4625 - DNA, 1410 bp, Methanosarcina acetivorans
  CDS (1)..(1410)
atgcaagaagtacaaggagaaaaaccgggaaaagcaaagaaagaaagaaccccgatgccggaacagcctgcagaagagcgcaggaaaaactttaatgaagtaaccctcggatacacaaaagaagatgcccttgccgaagcttctcgctgccttgcctgcaaagacccgaagtgtgttgagggatgccctgtgaatgtggacattccgggctttattcaacttatctgcgaggaaaacttcgaaggggcgatcgagagaatcaaagctacaaacgccctccctgcaatctgcggccgtgtctgcccccaggaaacccagtgtgaggcccgctgtgtactcgggaagaaaagccagcctgttgcaatcggaaggcttgagcgtttctgcgcagactatgaacgcgaaaagggtgtgaaggctcctgaagtcatgcccccgacaggcaagaaggtagcagttgtgggttcaggccctgcagggcttactgccgcagcagaccttgcaaagctcgggcataaggtcacaatctttgaatccttgcacaaagccggaggagtcctgagttacggcatccccgagttcaggctgccaaaagaaattgtgcggcaggaagtagagtacatcgaaaagcttggggtagaggtcaagcccaattatatcatcggcaggatcaagaccctggacgaactctgtgacgatttcgacgccgttttcctggttacgggcgcagggctcccgaacttcatgggaatcgaaggagaaaacttaaacggcgtatattccgcaaacgaattcctgacccgcgtaaacctcatgaaagcctatgaccccgaatatgatacaatggtcaggcacgggaaacatgtggttgtcgttggaggcggaaacgtagcgatggatgcagcccgttctgccctccgccttggcgccgacgaggtaagcatagtctaccgccgcggagaagacgaaatgcctgcccgccgggaagaaatcgaacacgccaaagaagaaggcataattttcaggctccttacaaaccctgtccgcatcctcggggacgaaaagttcaacgttacaggtgtcgaatgcataaaaatggaactaggagaacccgacaagtccggaaggagaagccctgttcccgtagaaggcacggagttccttgtccaggctgacgttgtgatcatcgctataggcacctccccgaacccgatcatattcaaaggctcagaaggacttgaacagaacaggcggggcactgttgttgctgacgaggaaaccggcgcaacctccaaatgcggagtctttgccggcggagacgcggtcacaggcgcagcaaccgtaatcagtgcaatgggcgcaggtaaaaaagctgcaaaagcaattgatgcgtttttgaaagaaaagtga

SEQ ID NO: 4626 - protein, 469 aa, Methanosarcina acetivorans
MQEVQGEKPGKAKKERTPMPEQPAEERRKNFNEVTLGYTKEDALAEASRCLACKDPKCVEGCPVNVDIPGFIQLICEENFEGAIERIKATNALPAICGRVCPQETQCEARCVLGKKSQPVAIGRLERFCADYEREKGVKAPEVMPPTGKKVAVVGSGPAGLTAAADLAKLGHKVTIFESLHKAGGVLSYGIPEFRLPKEIVRQEVEYIEKLGVEVKPNYIIGRIKTLDELCDDFDAVFLVTGAGLPNFMGIEGENLNGVYSANEFLTRVNLMKAYDPEYDTMVRHGKHVVVVGGGNVAMDAARSALRLGADEVSIVYRRGEDEMPARREEIEHAKEEGIIFRLLTNPVRILGDEKFNVTGVECIKMELGEPDKSGRRSPVPVEGTEFLVQADVVIIAIGTSPNPIIFKGSEGLEQNRRGTVVADEETGATSKCGVFAGGDAVTGAATVISAMGAGKKAAKAIDAFLKEK

SEQ ID NO: 4627 - DNA, 1431 bp, Pyrococcus furiosus
  CDS (1)..(1431)
atgcctaggcttattaaagagagggttcctactcctgagaggtctgttggggagagggttagggattttggtgaggttaatcttggttattcttgggagttggctttgagggaggctgagcgttgtctccagtgtcctgttgagtatgccccttgcattaaaggttgtcctgtgcatattaacattccgggtttcattaaagccttgagggagaatagggataatcctagtaaggctgtgagggaggctcttaggattatttggagggataatacgttaccagcaattactggtagggtttgtccccaggaagagcagtgtgagggtgcttgtgtggttggaaaggttggtgatccaataaacattggaaaattggagaggtttgtggctgattatgctagggagcatgggattgacgatgaattattactagaggagattaaggggattaagaggaatgggaagaaagtcgcaatcattggagctgggcccgctggcctaacttgtgccgcagacctggcaaaaatgggttatgaggtaacaatctacgaagccctccaccaaccaggaggagtactaacatacggaatcccagaattcagactaccaaaagaaatacttagaaaagagctgaagaagctaagccttttgggtgtagaaataaaaacggaccatatagttggtaaaactataacaattcaagagttacttcaggaatatgatgcagtatttataggaactggagctggaacaccaaaattgccaaatataccaggaataaaccttaatggtatttattctgcgaatgagttcctcacgagaattaacctaatgaaggcctacaaattcccagaatacgacactccaattgttgttgggaagaaggttgttgttattggagctggtaatactgcaatggatgctgctaggtcagcactgaggcttggagcggaggttactattgcttacagaagaggcagggaggatatgacagccaggattgaggaagttaagcatgctgaggaagagggagttaagttcatgttctttgttaatccagtggaattcattggagatgagaatggaaatgttaaggcggtgaagtttgagaagatgaagccactggaagagagggacagtagaggaaaaagaaaaatagttggaacaggagaatacataactgtggaagcagatacagtaataatagcgattggccaaactccaaataaggttctctggagggcaactcctgagcttaaggtggatgagtggggtaggattgttgtggatgagaatttgatgactagtattcccggggtttttgctggtggtgatgctattaggggtgaggctacggttattctagcaatgggcgacgggagaaaagcagcaaaagccatccaccaatacctaagcaagaaaggaaattga

SEQ ID NO: 4628 - protein, 476 aa, Pyrococcus furiosus
MPRLIKERVPTPERSVGERVRDFGEVNLGYSWELALREAERCLQCPVEYAPCIKGCPVHINIPGFIKALRENRDNPSKAVREALRIIWRDNTLPAITGRVCPQEEQCEGACVVGKVGDPINIGKLERFVADYAREHGIDDELLLEEIKGIKRNGKKVAIIGAGPAGLTCAADLAKMGYEVTIYEALHQPGGVLTYGIPEFRLPKEILRKELKKLSLLGVEIKTDHIVGKTITIQELLQEYDAVFIGTGAGTPKLPNIPGINLNGIYSANEFLTRINLMKAYKFPEYDTPIVVGKKVVVIGAGNTAMDAARSALRLGAEVTIAYRRGREDMTARIEEVKHAEEEGVKFMFFVNPVEFIGDENGNVKAVKFEKMKPLEERDSRGKRKIVGTGEYITVEADTVIIAIGQTPNKVLWRATPELKVDEWGRIVVDENLMTSIPGVFAGGDAIRGEATVILAMGDGRKAAKAIHQYLSKKGN

SEQ ID NO: 4629 - DNA, 1425 bp, Pyrococcus furiosus
  CDS (1)..(1425)
atgcctaggcttattaaagatagggttcctactcctgagaggtctgttggggagagggttagggattttggtgaggttaatcttggttattcttgggagttggctttgagggaggctgagcgttgtctccagtgtcctgttgagtatgctccttgcattaagggttgtcctgtgcatattaacattccgggtttcattaaagccttgagggagaatagggataatcctagtaaggctgtgagggaggctcttaggattatttggagggataatacgttaccagcaattactggtagagtttgtccccaggaagagcagtgtgagggtgcttgtgtggttggaaaggttggtgatccaataaacattggaaaattggagaggtttgtggctgattatgctagggagcatgggattgacgatgaattattactagaggagattaaggggattaagaggaatgggaagaaagtcgcaatcattggagctgggcccgctggcctaacttgtgccgcagacctggcaaaaatgggttatgaggtaacaatctacgaagccctccaccaaccaggaggagtactaatatatggcattcccgaatttaggttaccaaaggagatcgtcaagaaggagcttgagaatctgaggaggcttggagttaaaattgaaacaaatgttttggtaggaaaaactattacatttgaagagcttagggaagagtacgatgcaatattcataggaactggagctggaacgccaaggatatacccctggcctggggtaaatctcaatggtatttattctgcaaatgagttcctcacgaggattaacctaatgaaggcctacaaattcccagaatacgacactccaataaaagtcgggaagagagttgcggttataggtggaggaaacacagcaatggatgctgctaggtcagcactaagactaggggctgaagtttggattctttacagaagaacaaggaaggagatgacggctagagaggaagaaataaagcatgccgaggaggagggagttaagttcatgttcttggtaacccccaagaggttcattggggatgaaaatggaaacttaaaagctatagagctggagaagatgaagctaggagagcccgatgaaagtggaagaagaagaccaattccaacaggagaaaccttcataatggagttcgatacagcaataatagcaataggccaaaccccgaacaaaacattcttggagaccgtcccagggcttaaggtggatgagtggggtaggattgttgtggatgagaatttgatgactagtattcctggggtttttgctggtggtgatgctattaggggtgaggctacggttattctagcaatgggcgacgggagaaaagcagcaaaagccatccaccaatacctaagcaaagaaaagtaa

SEQ ID NO: 4630 - protein, 474 aa, Pyrococcus furiosus
MPRLIKDRVPTPERSVGERVRDFGEVNLGYSWELALREAERCLQCPVEYAPCIKGCPVHINIPGFIKALRENRDNPSKAVREALRIIWRDNTLPAITGRVCPQEEQCEGACVVGKVGDPINIGKLERFVADYAREHGIDDELLLEEIKGIKRNGKKVAIIGAGPAGLTCAADLAKMGYEVTIYEALHQPGGVLIYGIPEFRLPKEIVKKELENLRRLGVKIETNVLVGKTITFEELREEYDAIFIGTGAGTPRIYPWPGVNLNGIYSANEFLTRINLMKAYKFPEYDTPIKVGKRVAVIGGGNTAMDAARSALRLGAEVWILYRRTRKEMTAREEEIKHAEEEGVKFMFLVTPKRFIGDENGNLKAIELEKMKLGEPDESGRRRPIPTGETFIMEFDTAIIAIGQTPNKTFLETVPGLKVDEWGRIVVDENLMTSIPGVFAGGDAIRGEATVILAMGDGRKAAKAIHQYLSKEK

SEQ ID NO: 4631 - DNA, 2553 bp, Azoarcus evansii
  CDS (1)..(2553)
atggaagccgtacagacatcggaaatcaggtggtggaaggcgagcaagccggccggcatggccgagttcggcgcgcccgtgaagctgagcatcgacggcgttgaggtcgaggcgcccgccggcgcgtcggtcctgaatgccgccaccgccgcaggcctctacattccggccctgtgtgcgcaccccgatctgccgcccgccggccagcgtggggcgggagagggcggctgcaatctctgtatggtcgagatcgacggtgttgatggcgttgtgaaggcctgttcgacgaccgtcacggccggcatggtcgtgacgaccaagtcgccggcgatccaggaagtgcgccaggccagcctcgccaagatcctcggcccgcatccccatgtctgcctgacctgtccgcagcgcgacggctgttcgcgctcgcagtgctcctacggcaacccgcaggaaacgcgctgctgcacgatcttctcgtcctgtgagctgcgcaaggtctccgactacatcggcatcccgaacacgacgccgccgtacaagcccgcgcagctgccggtcgtgctcgacgagcccttcttcgaccgcgactacaacctgtgcatcgactgccgccgctgcctggtcgcctgtaatgacgtgcgcggggtgggctgtctcgagttcaagggaagtcgagacgcctggcagggcaagcgcacctatgtcggcacgatcgcgccgacgctgatcgaatccggctgtaccttctgccaggcctgtgtgaccgtttgcccgaccggcgcgctgatggaccgcacgctcgaccctgccaaacgcgaggagtcgatggtgccgtgcaagaacgcctgtccggcgggtatcgacgtgccgcgctacgtgcagctcgccgccgaaggcaagtacggcgaggcgatcgcggtagtgcgcgaacggcttcccttcccgggcatcctcggtcgcgcctgtttcgcgatgtgtgaatcggcctgccgccgcaaggacctggacgatccgctgtcgatccgcaacctgaagcgcatcgccgcggacaacgacacgggggtctggcgcgagcatgcgaagaagctgccggcgaccggcaagaaggccgcggtgatcggcgccggcccggccggcctgacggtcgcgtactacctcgccaagcagggccatggtgtcacggtgttcgacgcacagccggccgcagcgggcatggcgcgctacggcatcccgtcctaccgcgtgccggccgaagtgatcgacaacgaggttgccgaagtgtcggcgttgggcgtcgagttccgcttcggtgcgaaggtcgagaacgtcgatacgctcttcaatgacggctatggcgccgtgttcgtcggcatcggcgcgcagggcggcgacaagctgggcatccccggcgacgacctgccgggcgtggtcgacagcccgacctacctcaaggccgtgacgatgggcctcgtgaatacccctgagggcatccagaccggcaagaaggtcgcggtgatcggcggcggcaacgtcgcgaccgacaacgcgcgttcatcgcgccgcttcggcgccgaggtcgacatggtgtaccgccgcacccgcgaggagatgccggcacgcctggaggagttcgagggctgcgtggaggagggcgtgaatatccgctacctgctcgcgccgaagaagatcgagccgggcaccaacggtttccgcctgcagatcacctacgcgaagatggcgctgggcgagcccgacgcatccggtcgccgcaagccggtcgagaccggcgaggaagtcgtcgagggcgtggatctggtgatcgccgcgatcggccagttcccgaaccgcttcgaaggtttcggcgtcgagaccgatcgcaagggccgcatcacggtgcgcgaggattcgatgctgacgagccggcccaaggtgtatgccggcggcgattgcgtgctcggaccttcgacgctgatcgagtcggtcgcgcagggacgtgtggcggcgtccgcgatggacatcgtgctcggcggcgacggcgacatctccgaagtgctgctgcgcaccggctgggagaccaacccgtgcatcggccgcaaggaaggcttcaacaagatccgcaagttccatccgatcatgctggcgcccgagcagcgcacgggctgggacgaggtggaactgggcttcgacgatgcgacggcgcgtgcggaggcggctcgctgcttcaagtgcaacctggcgccgaagatcgccgacgcgatcctgcccccggagtcctcactgaagttcgacgaagcgacgatcgcgtccgtgccgaccgagtcgggcgtgttccagctgctcgatggcgacaagaacgtgctgatcatcaaaggcgtggagaacctgcgcgagggcttgatggagcagctcgagcgcggcggcgacgcaacgaatttcgtgttcgaggaggcggcgctcttcacgtcccgcgagagccagatgatccaggcctacctgcagcagtacgggaagatgccgggcggagggtccgacgaactcgacgacctgttctga

SEQ ID NO: 4632 - protein, 850 aa, Azoarcus evansii
MEAVQTSEIRWWKASKPAGMAEFGAPVKLSIDGVEVEAPAGASVLNAATAAGLYIPALCAHPDLPPAGQRGAGEGGCNLCMVEIDGVDGVVKACSTTVTAGMVVTTKSPAIQEVRQASLAKILGPHPHVCLTCPQRDGCSRSQCSYGNPQETRCCTIFSSCELRKVSDYIGIPNTTPPYKPAQLPVVLDEPFFDRDYNLCIDCRRCLVACNDVRGVGCLEFKGSRDAWQGKRTYVGTIAPTLIESGCTFCQACVTVCPTGALMDRTLDPAKREESMVPCKNACPAGIDVPRYVQLAAEGKYGEAIAVVRERLPFPGILGRACFAMCESACRRKDLDDPLSIRNLKRIAADNDTGVWREHAKKLPATGKKAAVIGAGPAGLTVAYYLAKQGHGVTVFDAQPAAAGMARYGIPSYRVPAEVIDNEVAEVSALGVEFRFGAKVENVDTLFNDGYGAVFVGIGAQGGDKLGIPGDDLPGVVDSPTYLKAVTMGLVNTPEGIQTGKKVAVIGGGNVATDNARSSRRFGAEVDMVYRRTREEMPARLEEFEGCVEEGVNIRYLLAPKKIEPGTNGFRLQITYAKMALGEPDASGRRKPVETGEEVVEGVDLVIAAIGQFPNRFEGFGVETDRKGRITVREDSMLTSRPKVYAGGDCVLGPSTLIESVAQGRVAASAMDIVLGGDGDISEVLLRTGWETNPCIGRKEGFNKIRKFHPIMLAPEQRTGWDEVELGFDDATARAEAARCFKCNLAPKIADAILPPESSLKFDEATIASVPTESGVFQLLDGDKNVLIIKGVENLREGLMEQLERGGDATNFVFEEAALFTSRESQMIQAYLQQYGKMPGGGSDELDDLF

SEQ ID NO: 4633 - DNA, 1242 bp, Clostridium perfringens
  CDS (1)..(1242)
atgacagtaaatgagcaaaacttaaaagaagaagctttaagatgcttaatgtgcaaaaatccaagatgtaaggctaattgcccaataagtacacctattccagaggtaataggattatttaaagaagataaaataaaagaggctggggaaattttatttgaaaacaatcctttatcagtagtttgttccatagtatgtcctcatgaaaatcaatgtaaggggaattgtataaaaggaataaaggatacaccagtaaactttagtgaaatagagagagaaatatcagaagagtttttagataatctagaacttactcaagatactattttagaagataaaattgctataataggtggaggtcctgcgggaataacagctgcatttatattagctaaaaagggatatcaagtaacaatatttgatgaaaatgataaaattggtggagtattaagatatggaataccagagtttagactttctagagatataatagataaatatgaagaggcccttattaaattaaatgttaaaataagacctaacactttaataggaacagttataactttagatatgttaaaaagtgatggttataaagcaatatttatagcaactggggtttggaatcctaagactttaaatgttaagggagaaactttaggcaatgttcactatgctatagattatttaaaagcaccaaaatcatataatcttggagagagagtagttgtaataggagctggaaatgttgcaatggatgctgctagaactgcaaagagaaatggtgcagatacatatgtgctttatagaaaaagctttgaagatatgccagctactaaggttgaaatagaagaggctaaggaagatggcgtaaaatttgaactttataaagctcctttagagatttatgaggatggagtaaaatacatacaaacagaaagagtaatttctgaggatggaagagtatcatttaaaaccttagaaggtagtgaaggtgtgtttaaatgcgattcaataatagttgccataagccaagcgcctagaactaatatagtatctagtagtagagatctttcaacagataaatatggcttagtagtaactgacgaaaagggaataacaacacttaatggagtttttgcttcaggagatgttgtaagtggtcctaagactgtagttgaggcagttgcaaatagtaaaaaggttgctcatgctatagatgaattttgtaaaaacaattaa

SEQ ID NO: 4634 - protein, 413 aa, Clostridium perfringens
MTVNEQNLKEEALRCLMCKNPRCKANCPISTPIPEVIGLFKEDKIKEAGEILFENNPLSVVCSIVCPHENQCKGNCIKGIKDTPVNFSEIEREISEEFLDNLELTQDTILEDKIAIIGGGPAGITAAFILAKKGYQVTIFDENDKIGGVLRYGIPEFRLSRDIIDKYEEALIKLNVKIRPNTLIGTVITLDMLKSDGYKAIFIATGVWNPKTLNVKGETLGNVHYAIDYLKAPKSYNLGERVVVIGAGNVAMDAARTAKRNGADTYVLYRKSFEDMPATKVEIEEAKEDGVKFELYKAPLEIYEDGVKYIQTERVISEDGRVSFKTLEGSEGVFKCDSIIVAISQAPRTNIVSSSRDLSTDKYGLVVTDEKGITTLNGVFASGDVVSGPKTVVEAVANSKKVAHAIDEFCKNN

SEQ ID NO: 4635 - DNA, 1407 bp, Clostridium perfringens
  CDS (1)..(1407)
atgagtaatttaaaaaagaaaagagttaaatctagggagcaagatccaatagaaagagggaaaaactttaaggaggtttccttaggatatggagaagaagaggctattgaagaggcaaatagatgtttagggtgtaaaaatcctaagtgtgtggaagggtgtcctgtttcagtaaacataccaagttttatatctttcataaaaaaaggagatttttctgcttcttttgaagaattatcaaaatataatgctttacctgctgtatgtggaagagtttgcccacaagaatctcaatgtgaagggaagtgtgttttaggaataaagggagaaccattagccattggtcaattagaaagattcatagcagactttgcaagaaataataaattaagctctttaaaaaagagtgaaaagattttagagaaggtagctgttattggaagtggccctgctggattaacctgtgcaggagagctagctaaactaggatatagagtaactatttttgaagcattacatgaatctggaggggttttagtttatggaattccagagtttagattaccaaagaaggatgtagttaaatatgaaatagaggaaataaaaaaactaggagttaaaatagaaaacaatgtggtagttggtaaaactgtggacattgatgaattaatagaaaatgaaggatttaaggctgtctttataggttctggagcaggtcttccaaaattcatggggattaaaggggaaaatgccaatggagttttttcagctaatgaagttttaactagggtaaatcttatgaaggcttttaaaaatgaaagccatactcctttaaatttaggaaaaaaggttgctgtagttggtggaggaaatgttgccatggatgcagctagaacttccttaagattaggagcagaaactcacataatttatagaagaagtgaaaaggagctgccagctagattagaagaaattcatcatgctaaggaagaaggagttattttagatgttttaactaatcctactgaaattttaactgatgaaaagggttgggtaaagggtataaagtgtataaggatgaaacttggagaggaagattcttcaggaagaagaagaccaattgaaattgaaaattcagagtttattatggaagtagatagtgtaataatgtccttaggaacttctcctaatcctctaatatctaatgccacaaagggattaaagacaaataagagaggatgtctccttgtagatgaagaaagcttaaaaacctccttaaaggggatttatgcaggaggagatgctgttacaggagcagctacagttattcttgctatgggagctggaaagaaagctgcaaagtccattgattcttatttaagaaaagaagagcaaaataatatttag

SEQ ID NO: 4636 - protein, 468 aa, Clostridium perfringens
MSNLKKKRVKSREQDPIERGKNFKEVSLGYGEEEAIEEANRCLGCKNPKCVEGCPVSVNIPSFISFIKKGDFSASFEELSKYNALPAVCGRVCPQESQCEGKCVLGIKGEPLAIGQLERFIADFARNNKLSSLKKSEKILEKVAVIGSGPAGLTCAGELAKLGYRVTIFEALHESGGVLVYGIPEFRLPKKDVVKYEIEEIKKLGVKIENNVVVGKTVDIDELIENEGFKAVFIGSGAGLPKFMGIKGENANGVFSANEVLTRVNLMKAFKNESHTPLNLGKKVAVVGGGNVAMDAARTSLRLGAETHIIYRRSEKELPARLEEIHHAKEEGVILDVLTNPTEILTDEKGWVKGIKCIRMKLGEEDSSGRRRPIEIENSEFIMEVDSVIMSLGTSPNPLISNATKGLKTNKRGCLLVDEESLKTSLKGIYAGGDAVTGAATVILAMGAGKKAAKSIDSYLRKEEQNNI

SEQ ID NO: 4637 - DNA, 1464 bp, Ralstonia solanacearum
  CDS (1)..(1464)
atgggcaaggcgaccggctttctcgaatttccccgccagaacgaggcatacgaagcgcccgcagcgcgcgtgaagcattacaaggagttcgtgttcgcgctggcggacagcgaagccaagatccagggcgcgcgctgcatggactgcggcattccgttctgcaacaacggctgcccggtcaacaacatcatccccgacttcaacgacctggtgtaccgccaggactggaagacggcgatcgaggtgctgcactcgaccaacaatttccccgagttcacgggccgcatctgtccggcgccgtgcgaggcggcctgcacgctgggcatcaatgaggcgccggtcggcatcaagtcgatcgagcacgccatcatcgacaaggcgtgggccgagggctgggtgcagccgcaggtgcccaggcacaagaccggcaagaccgtggccgtggtcggctcgggcccggccggcctggcggcggcgcagcagctggcacgcgccggccacgacgtgacggtgttcgagaagaacgaccgcatcggcggcctgctgcgctacggcattcccgacttcaagctggaaaagacgcagatcgaccgccgcatgcagcagatggaagccgagggcgtgaccttccgcaccggcgtgatggtgggcgacaagaccgtccccgccggcatctgcaacgacgcgcgcgagaccctcgccgcacaggacatcctcaagaccttcgacgccgtggtgctcacgggcggctcggaagtcccgcgcgacctgccggtgccgggccgcgacctggatggcgtgcattacgcgctcgaattcctgatcccgcagaacaaggaagtggccggcgacgcgcccaacccgatccgcgccgacggcaagcacgtcatcgtcatcggcggcggcgatacggggtcggactgcgtgggcacctccaaccgccacggcgccgcctcggtcacgcagttcgagctgttgccgcgtccccccgaggaagagaacaagccgctggtgtggccgtactggccgatcaagctgcgcacctcgtcgtcgcatgacgagggctgcgagcgcgactggtcggtggccaccaaggcgctgatcggcgagaacggccgcgtgacgggcctcaaggccgtgcgcctggagtggaaggacggcaagatggccgaggtcgaaggcagcgagttcttgctcaaggccgacctcgtgctgctggcgatgggcttcacccatccggtcggcggcgtgctggaagcgttcggcgtggccaaggatgcgcgcagcaatgcccgcgccgccaccgagggtgacaacgcctacgccaccaatgtgccgaaggtgttcgccgctggcgacgtgcgccgcgggcagtcgctggtcgtgtgggccatccgcgaaggccggcaggccgcgcgtgcggtggacgcgttcctcatgggccattcggtgctgccgcgctga

SEQ ID NO: 4638 - protein, 487 aa, Ralstonia solanacearum
MGKATGFLEFPRQNEAYEAPAARVKHYKEFVFALADSEAKIQGARCMDCGIPFCNNGCPVNNIIPDFNDLVYRQDWKTAIEVLHSTNNFPEFTGRICPAPCEAACTLGINEAPVGIKSIEHAIIDKAWAEGWVQPQVPRHKTGKTVAVVGSGPAGLAAAQQLARAGHDVTVFEKNDRIGGLLRYGIPDFKLEKTQIDRRMQQMEAEGVTFRTGVMVGDKTVPAGICNDARETLAAQDILKTFDAVVLTGGSEVPRDLPVPGRDLDGVHYALEFLIPQNKEVAGDAPNPIRADGKHVIVIGGGDTGSDCVGTSNRHGAASVTQFELLPRPPEEENKPLVWPYWPIKLRTSSSHDEGCERDWSVATKALIGENGRVTGLKAVRLEWKDGKMAEVEGSEFLLKADLVLLAMGFTHPVGGVLEAFGVAKDARSNARAATEGDNAYATNVPKVFAAGDVRRGQSLVVWAIREGRQAARAVDAFLMGHSVLPR

SEQ ID NO: 4639 - DNA, 1962 bp, Salmonella typhimurium
  CDS (1)..(1962)
atgaatcgttttattatggccaatagccagcagtgtctgggctgccatgcctgcgaggtcgcctgcgtaatggctcacaatgatgagcgacatgtcctgacgtcacagcgctatcagccccgaattactgtcattaaacatcagcaccagcgcagcgcggttacatgtcaccattgcgaagatgcgccctgcgcccgtagctgtccgaacggcgcgatcgcgcatattaacgacagcgtgcaggtcaatgcgcagaagtgcatcggctgtaaatcctgcgtcgtcgcctgtccattcggcaccatgcagatggtattgacgcccgtcgcgccaaaccagttcaaagccagcgcgcataaatgcgatctgtgtcagggacgtgaacaggggccggcctgtgtggaaaattgcccggcggatgcgctgcaactggtcaccgaagactcgttgacccgtctggctaaaacgcgacggctgcgtaccgcccggcaggagattcgcccctggcataccgtggatacacaacacagtggggcagcaagcagcaaagccgagcgtatgcaggcgacgccgccgcgcggcgaaccggataaactggcgattgaagcgcgtaaaaccacctttgaggaaatttatctgccgtttcgcgccgcgcaggcggagcgtgaggcgtcccgctgcctcacatgcggggaacacagtatctgcgaatggacctgtccgctgcataaccatattccccagtggatcgaactggtgaaagccggcgatattgatgcggcggtagagctttcccaccagaccaactgtctgccggaaattaccgggcgcgtctgtccgcaggatcggctatgcgaaggcgcgtgtacactccgcgatgagtatggcgcggttaccatcggcaatattgagcgctatatctccgatcgcgctctgagcaaaggctggcgtcccgacctgtcggacgtacagaagagcgataagcgcgtggcgattatcggcgcggggccggcaggtcttgcctgcgctgacgtgctggcgcgccatggcgtaagcgccaccgtctacgatcgccatccggaaatcggcggtttactcacctttggtattccggctttcaaactggataaatctctgctggcgcgccgtcgggaaatcttcagcgcgatggggattcgtttcgagcttaactgcgaagtagggaaagatatttctctggagacgctgctggagagttatgacgccgtctttgttggggttggaacctatcgttccatgaaggctgatttaccgaatgaagatgcgccgggggtatatgatgcgttgccattcctcatcgccaataccaaacaggtgatggggcttccggcgttgcctgacgagccgtttattgatactgcgggccttaacgtggttgtgctgggcggcggtgacaccgcaatggactgcgtacgtacggcgctgcgtcatggcgctgctaacgtcacctgcgcttatcgccgcgatgaggccaatatgccagggtcgaaaaaagaggtgaaaaacgcgcgggaagagggcgcgaactttgaatttaacgttcagccggttgagttggtgctggatacgcacgggcgcgccagcggtattcgctttttgcgtacgcggcttggcgaaccggatggtcaggggcgacgccgcccggtacctgtaccggacagcgagttcgtgatgccggcggatgcggtcattatggcgtttggttttcatccgcatggtatgtcgtggctggaatcgcatggcgtgaaggtggataactggggacgtattgccgccagcgtcgagagcgagtttcgttaccagacgtccaacccgaaaattttcgccggcggcgatgcggtgcgcggcgccgatctggtggtgacggcgatggcagaaggccgacatgctgcgcaggggatactcgactggttagctaaataa

SEQ ID NO: 4640 - protein, 653 aa, Salmonella typhimurium
MNRFIMANSQQCLGCHACEVACVMAHNDERHVLTSQRYQPRITVIKHQHQRSAVTCHHCEDAPCARSCPNGAIAHINDSVQVNAQKCIGCKSCVVACPFGTMQMVLTPVAPNQFKASAHKCDLCQGREQGPACVENCPADALQLVTEDSLTRLAKTRRLRTARQEIRPWHTVDTQHSGAASSKAERMQATPPRGEPDKLAIEARKTTFEEIYLPFRAAQAEREASRCLTCGEHSICEWTCPLHNHIPQWIELVKAGDIDAAVELSHQTNCLPEITGRVCPQDRLCEGACTLRDEYGAVTIGNIERYISDRALSKGWRPDLSDVQKSDKRVAIIGAGPAGLACADVLARHGVSATVYDRHPEIGGLLTFGIPAFKLDKSLLARRREIFSAMGIRFELNCEVGKDISLETLLESYDAVFVGVGTYRSMKADLPNEDAPGVYDALPFLIANTKQVMGLPALPDEPFIDTAGLNVVVLGGGDTAMDCVRTALRHGAANVTCAYRRDEANMPGSKKEVKNAREEGANFEFNVQPVELVLDTHGRASGIRFLRTRLGEPDGQGRRRPVPVPDSEFVMPADAVIMAFGFHPHGMSWLESHGVKVDNWGRIAASVESEFRYQTSNPKIFAGGDAVRGADLVVTAMAEGRHAAQGILDWLAK

SEQ ID NO: 4641 - DNA, 1437 bp, Rhizobium meliloti
  CDS (1)..(1437)
atggagatcgaccggcaggtggcgaagtaccagccggcatccgaccgcatccgccatttccgcgaattcaccattccgatgtccgaccaggaagtgcagaagcaatccgctcgctgcatggactgcggcatcccctattgccatgggccgaccgggtgcccggtgcacaaccagatccccgactggaacgatctcgtctataacggcaattgggacgaggcgatccgcaacctgcactccaccaacaacttcccggaattcaccggccgcgtctgcccggcgccctgcgaggaagcctgcacgctgaacctcgaagacgtgccggtggcgatcaagacgatcgagcaggcgatcgccgacaaggcctatgagatgggctatatcgtgccgcagcccgccgtgaccaagaccggcaagaaggtcgcggtcatcggctccgggccggccggcatggcggctgcccagcagctggcgcgcgccggccacgaggtgcatgtctacgaacgcgagtccaagcccggcgggctgctgcgctacggaatcccggacttcaagatggagaagaacttcatcgaccggcgtgtcgagcagatgcggggcgagggcgtgaccttccattgcggcgtcaatgtcggtgtcgatgtcgcggtgcaaaagctcgtcgatgaaaacgacgccgtgctctattgcggcggctccgagacgccgcgcgacgccggcattcccggcgtggagttcttcggcgtgcacgacgccatgccttatctggtacagcagaaccgtcgcgtcggccgcgagaacatcgacagcgtgggctggccgtccgagccgatcctcgccggcggcaagcacgtcgtcgtcgtcggcggcggcgacacggcatcggactgtgtcggtaccgccttccgccagggcgccgtcaaggtgacccagctcgacattcgtccgcaaccgcccgagaaggaagacaagcttgcggtttggcccttctgggcaacgaagatgcgcacctcctccagccaggccgagggcgctgtccgcgagttccaggtcgcgacgctcgagtttgtcggcgacgaggacggcaatctcaccggcgtcaaatgctgtcaggtcgacgagcgccgcaagccgatcgccggtaccgagttcatcatcaaggccgatctcgccttcatcgcgatcggtttccgtggtcccttcgcagacagcgtgctcaaggatctcggcgagaagctgacggtcaacaccgaccgccgcggttcgaccaatgtcgtcgccaacgagcgcgactacaggacttcggtcgacaaattgtgggcggcaggcgacattcgccgcggccagtcgctcgtcgtatgggcgatccgcgaaggccggcaggcggcacgcgcgatcgacgaggcgctgatgggctcgacggtgctgccgcggtag

SEQ ID NO: 4642 - protein, 478 aa, Rhizobium meliloti
MEIDRQVAKYQPASDRIRHFREFTIPMSDQEVQKQSARCMDCGIPYCHGPTGCPVHNQIPDWNDLVYNGNWDEAIRNLHSTNNFPEFTGRVCPAPCEEACTLNLEDVPVAIKTIEQAIADKAYEMGYIVPQPAVTKTGKKVAVIGSGPAGMAAAQQLARAGHEVHVYERESKPGGLLRYGIPDFKMEKNFIDRRVEQMRGEGVTFHCGVNVGVDVAVQKLVDENDAVLYCGGSETPRDAGIPGVEFFGVHDAMPYLVQQNRRVGRENIDSVGWPSEPILAGGKHVVVVGGGDTASDCVGTAFRQGAVKVTQLDIRPQPPEKEDKLAVWPFWATKMRTSSSQAEGAVREFQVATLEFVGDEDGNLTGVKCCQVDERRKPIAGTEFIIKADLAFIAIGFRGPFADSVLKDLGEKLTVNTDRRGSTNVVANERDYRTSVDKLWAAGDIRRGQSLVVWAIREGRQAARAIDEALMGSTVLPR

SEQ ID NO: 4643 - DNA, 1362 bp, Rhizobium meliloti
  CDS (1)..(1362)
atgggaacgacgcaatctgggattctcggcgggcggctgccgcttgccgagtacgaagccaatttctccgaccttcatccgtcgctcgacaggcacgaggcgctggtcgccgccgaccgctgttatttctgtcatgacgcgccctgcatgaccgcctgtccgacctccatcgacatcccgctcttcattcgccagatcgcgacgggcaatccgatcggctcggcgaagacgatcttcgaccagaacatactgggcggcatgtgcgcccgcgtctgtcccaccgagacgctctgcgaagaggcctgcgtacgcaacacggccgaggagcggccggtcgaaatcggccgcctgcagcgctacgcgacggacatcgccatgcgggagaacaagcagttctattcgcgcgccgctcgttccggccgcagggtcgccgtcgtcggcgccgggccggcggggctcgcctgcgcgcatcggctggccgtgaaaggccacgacgtggtgatctacgatgcgcgcgaaaaatccggcggcctcaacgaatacggcatcgccgcctataaggcggtcgacgacttcgcccagagagaggtggaatacgtgctttcggtcggcggcatcgaggtcagccacggcaaggcgctcggccgcgacttctctcttgccgatctggcggaagaattcgatgccgtctttctcggcctcggtcttgcaggtgtcaatgcactgcggatcgaaggcgagaatgccgaaggcgtcgaggacgccgtcgacttcatcgccgcacttcgccagtcgaagacaaaggccgacattccggtcggccggcgcgtcgtggtgctcggcggcggcatgactgcgatcgacgccgccgtccaggcgaagctgctcggcgccgaggaagtgacgatctgctatcgccgcggcaaggagcacatgaacgcctcggaattcgagcaggaccttgcggcttccaagggcgtcaccatccgccactggctgcagccgaagcgcatcgccgtcaaggatggccgggtcgccggcatcgaactcgactacaccacgcttgaaaacgggaagctgacaacgaccggcgagaccggaatcattgccgccgaccagatcttcaaggccatcggccaggccttcgaggcctccggcctcggcgcccttcgcatggaaagcggacgcatcgtcgtcgattcggaaggacgcacctcgctggaaaaggtctgggccggcggtgactgcgtgctcgggggcgaggacctcaccgtttcggccgtcgcgatgggacgcgatgccgccggatcgatcgaccgggctttcgccgtggctcagccgctggcgagcgccgttgcttga

SEQ ID NO: 4644 - protein, 453 aa, Rhizobium meliloti
MGTTQSGILGGRLPLAEYEANFSDLHPSLDRHEALVAADRCYFCHDAPCMTACPTSIDIPLFIRQIATGNPIGSAKTIFDQNILGGMCARVCPTETLCEEACVRNTAEERPVEIGRLQRYATDIAMRENKQFYSRAARSGRRVAVVGAGPAGLACAHRLAVKGHDVVIYDAREKSGGLNEYGIAAYKAVDDFAQREVEYVLSVGGIEVSHGKALGRDFSLADLAEEFDAVFLGLGLAGVNALRIEGENAEGVEDAVDFIAALRQSKTKADIPVGRRVVVLGGGMTAIDAAVQAKLLGAEEVTICYRRGKEHMNASEFEQDLAASKGVTIRHWLQPKRIAVKDGRVAGIELDYTTLENGKLTTTGETGIIAADQIFKAIGQAFEASGLGALRMESGRIVVDSEGRTSLEKVWAGGDCVLGGEDLTVSAVAMGRDAAGSIDRAFAVAQPLASAVA

SEQ ID NO: 4645 - DNA, 1428 bp, Klebsiella aerogenes
  CDS (10)..(1428)
ggggttaagatgagtcagaacgtttatcaatttatcgacctgcagcgcgttgatccgccaaagaaaccgctgaagatccgtaaaattgagtttgtggaaatttacgagccgttttcagaaggccaggccaaggcgcaggcggatcgctgcctctcctgtggcaacccgtactgcgaatggaagtgccctgtgcataactacatcccgaactggctgaagctggccaacgaggggcgtatttttgaagcggccgagctgtcgcatcaaaccaacactctgccggaagtctgcgggcgcgtctgcccgcaggaccgcctgtgtgaaggctcctgtacgctgaacgatgagttcggcgcggtgaccatcggcaacatcgaacgctatatcaacgataaggcattcgagatgggctggcgtccggatctctccgacgtgaagccgaccggtaaaaccgtcgcgatcatcggcgctggcccggcgggcctcgcctgcgccgacgtgctgacccgtaacggcgtcaaggcggtggtatttgaccgccatccggaaatcggcggcctgctgaccttcggtatcccggcgttcaagctggaaaaagaggtgatgacccgccgccgggagatcttcaccggcatgggcattgagttcaaactcaataccgaagtgggccgcgacgtgcagctcgatgacctgctgaaggagtacgatgcggtgttcctcggcgtcgggacctatcagtcgatgcgcggtggactggacaacgaagacgccccgggtgtttacgacgcgctgccgttcctgatcgctaacactaagcagatcatgggctttggtgaaaccgccgatgagccctatgtcagcatggaaggcaaacgcgtggtggtgctcggcggtggcgacaccgcgatggactgcgtacgcacctccgtccgtcagaatgcggcgcacgtgatctgcgcctatcgccgtgacgaagagaacatgcccggctcaaaacgcgaagtgaaaaacgcgcgcgaagaaggcgttgagttccagtttaacgtccagccgctgggcgtggaagtgaatgccaacggtaaggtttgcggcgtgaagatggcgcgcaccgaaatgggccagccggatgcgaagggccgccgccgcgcggagatcgtccccggctctgagcacgtggtgccggctgacgccgtagtcatggcgtttggcttccgtccgcacagcatggagtggctggcgaagcacagcgtcgaactggactcccagggccgtattatcgccccggaaggcagcgaaaacgccttccagaccagcaacccgaaaatcttcgccggtggcgatatcgttcgcggttccgatctggtggtcaccgcgattgccgaaggtcgtaaagcggcggacgggatcctcaactaccttgaagtctga

SEQ ID NO: 4646 - protein, 472 aa, Klebsiella aerogenes
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDLSDVKPTGKTVAIIGAGPAGLACADVLTRNGVKAVVFDRHPEIGGLLTFGIPAFKLEKEVMTRRREIFTGMGIEFKLNTEVGRDVQLDDLLKEYDAVFLGVGTYQSMRGGLDNEDAPGVYDALPFLIANTKQIMGFGETADEPYVSMEGKRVVVLGGGDTAMDCVRTSVRQNAAHVICAYRRDEENMPGSKREVKNAREEGVEFQFNVQPLGVEVNANGKVCGVKMARTEMGQPDAKGRRRAEIVPGSEHVVPADAVVMAFGFRPHSMEWLAKHSVELDSQGRIIAPEGSENAFQTSNPKIFAGGDIVRGSDLVVTAIAEGRKAADGILNYLEV

SEQ ID NO: 4647 - DNA, 1491 bp, Streptomyces coelicolor
  CDS (1)..(1491)
atggccgatcccaagggttttctgacgacgccccgcgaggagtggccccgcagaccggccggcgagcgggtccgggactgggacgaggtgtacgtcccgggagcgctgctgccgatcgtcggccggcaggccgaccggtgcatggactgcggcgtccccttctgccacgaggcctgtccgctgggcaacctgatcccggagtggaacgacctggtctcccggtcggactggcgggcggcgagcgagcggctgcacgccacgaacaacttcccggagttcaccggccggttgtgtccggcgccgtgcgaggcgggttgtgtgctcgccatcaaccagcccgcggtcaccatcaagaacgtcgagtgcgcgatcgcggacacggcctgggaggagggcttcgtcccgcccctgccgccggagcggctgtccgggaggacggtggcggtgatcggctcgggaccggcggggctcgcggcggcgcagcagttgacccgggccgggcacacggtcgcggtgtacgagcgcgacgaccggatcggtgggctgctgcggtacgggatccccgcgttcaagatggagaagcggcacctggagcggcgtgtcggccagatgcgggcggaggggacgaggttccgtacgtcggcggcggtcggacgggacgtggacgccgcggcgctgcggacccgctacgacgcggtggtgatcgccaccggggcgacggcgtggcgggagctgaccgtgcccggccgggagctggcgggggtgcatcaggcgatggagtaccttccgctggccaaccgggtgtgcgagggcgacctcgagcgctccccgctgtccgccgccgggcggcacgtggtcgtcgtcggtggtggcgacacgggcgcggactgtctcggcacggcggtgcgggagggggccgcctccgtgacgcaactggacatctacgcgcggccgggtgcggagcgcgacgagcgggccgagccctggccgacctatccgcgcctgtaccggctgtcggcggcgcacgaggaggcacgcgacctgcggtccgcgccggcggcggacgcggacgcgcggctgttcgcggcgtccacgctccgcttcaccggcgacgagcgggggcatgtacgtgcgctgcacctggtcggggtggacacgggacgccgtccgctgcccggcagcgagcggtcgctcccggcggacctggtccttctcgccctcggcttctcggggcccgaccggcacgacgggctcgtcgacgggctgggactggacatggagccccgtggcacgatcacccgggaccggggcttcgcgaccaacgtcccgggggtgttcgccgccggggacgcggcgcgcgggcagtcactcgtcgtctgggcgatcgcggaggggcgggcggtggcggcggccgtggaccgccacctgtccggcggcagcacccggctgccggccccggtcggcccgtacgaccggccgatgacggcctga

SEQ ID NO: 4648 - protein, 496 aa, Streptomyces coelicolor
MADPKGFLTTPREEWPRRPAGERVRDWDEVYVPGALLPIVGRQADRCMDCGVPFCHEACPLGNLIPEWNDLVSRSDWRAASERLHATNNFPEFTGRLCPAPCEAGCVLAINQPAVTIKNVECAIADTAWEEGFVPPLPPERLSGRTVAVIGSGPAGLAAAQQLTRAGHTVAVYERDDRIGGLLRYGIPAFKMEKRHLERRVGQMRAEGTRFRTSAAVGRDVDAAALRTRYDAVVIATGATAWRELTVPGRELAGVHQAMEYLPLANRVCEGDLERSPLSAAGRHVVVVGGGDTGADCLGTAVREGAASVTQLDIYARPGAERDERAEPWPTYPRLYRLSAAHEEARDLRSAPAADADARLFAASTLRFTGDERGHVRALHLVGVDTGRRPLPGSERSLPADLVLLALGFSGPDRHDGLVDGLGLDMEPRGTITRDRGFATNVPGVFAAGDAARGQSLVVWAIAEGRAVAAAVDRHLSGGSTRLPAPVGPYDRPMTA

SEQ ID NO: 4649 - DNA, 1455 bp, Thermoplasma volcanium
  CDS (1)..(1455)
atgctcagttttgaaagagtcaggatccggaaagcagaccctgtcaagcgagtgggaacgttcgaattagagccattagaaaactacaatgatggagaagcaatagctgaggccagcagatgcataggttgtaatatgtgctctgctgcatgtcctgctagtctagatattggtggttacgtaagaagcacagccgctggagatcctgcacaaacgatcagaataataatggaaacacttccgtttccagcaataattggcagagtatgcacacatatgtgcgaggatgtctgcgtattgtacgatggaggggggccaatagccataaggcacctgaagaggtacgcagctgacaaatttgatgattatggcgaaatattaaaaccccagaagagaaagtttattggaaagcgtgttgctgttgttggcggtggcccggctgggctgactgttgcttactatctcaccttacagggcgtgaaagtcactgtttttgaagagaggcctgctttaggcgggtttatgaaaactggcataccaaggtacagacttccgcagaatgttcttgacaaggagatagggtatatattatccagaggtgttcaagtcaagctcaacactgctgttggacgagatgtcaaattcgaagacttaatgaaggaatatgatgctattttcctgggtgttggaaaccacaaaccacgcatgaccggcactcctggaagcgatgcacctaatgtaatgcacgctacggaatttttagagagagtaagttttggtgaaaagataaacgtcggagaaaccgtagcagtaataggtggtggtttcacagccaacgactctgctaggacttccttaagactgggagcgaagcacgtatatataatgtatcggagaagggacgtggataggcctggatatccaagtatgaatgcagacgaggagatggaagaggcggaagaggaaaatgtagagtatgtatgggaagtgacgcctttcgaatatgtaaaggaaaatgggagagttgtggctatgaaatactggaaaaacgaaatggtgtcacagggaaaaggaagggcaaagcctgtaccaataaaagataaattctatactataaaagtcgatatggtaattgaggctactggccaggaaacagattattcgttcctaggcagctatgtagaaaagctcagacttaacgataggggggagcccatagttgatcaatacggaatgacgtcaataccgggtgtatttaccggaggggattctaccaaccctaacagggatctcataagtgcggttagggatggggatatagcagttcagggtattttaagatacctcaatgttatggatcaggtatcctacgatgatctgccgcttttagataggtttaagccatattcatatacagcagcagcggaggcttacgcgtctcgtgggcttgagtaa

SEQ ID NO: 4650 - protein, 484 aa, Thermoplasma volcanium
MLSFERVRIRKADPVKRVGTFELEPLENYNDGEAIAEASRCIGCNMCSAACPASLDIGGYVRSTAAGDPAQTIRIIMETLPFPAIIGRVCTHMCEDVCVLYDGGGPIAIRHLKRYAADKFDDYGEILKPQKRKFIGKRVAVVGGGPAGLTVAYYLTLQGVKVTVFEERPALGGFMKTGIPRYRLPQNVLDKEIGYILSRGVQVKLNTAVGRDVKFEDLMKEYDAIFLGVGNHKPRMTGTPGSDAPNVMHATEFLERVSFGEKINVGETVAVIGGGFTANDSARTSLRLGAKHVYIMYRRRDVDRPGYPSMNADEEMEEAEEENVEYVWEVTPFEYVKENGRVVAMKYWKNEMVSQGKGRAKPVPIKDKFYTIKVDMVIEATGQETDYSFLGSYVEKLRLNDRGEPIVDQYGMTSIPGVFTGGDSTNPNRDLISAVRDGDIAVQGILRYLNVMDQVSYDDLPLLDRFKPYSYTAAAEAYASRGLE

SEQ ID NO: 4651 - DNA, 1455 bp, Rhizobium loti
  CDS (1)..(1455)
atgggcaaggtaacaggctttctcgagatcgaccggcaggtgcacaagtaccagccggcctccgaccgtatccggcatttccgcgagttcacgctgccgatgtcggacaaggaggtcgagaaacaggccgcgcgctgcatggattgcggcattccgttctgtcacgggccgacgggctgtccgatccacaaccagatcccggactggaacgacctcgtctacaacagggactgggacaacgcgatccgcaacctgcattcgaccaacaatttcccggagttcaccggccgcatctgtcccgccccttgcgaggaagcctgcacgctgaacctcgaggacattccggtcgccatcaagacggtggaacaggcgatcgccgacaaggcctacgagaccggacacatcaggccctatccgccggagaagaagaccggcaagcgggtcgccatcatcggctccggcccggccggcatggcggccgcccagcaattgggccgcgccggccatgatgtccatgtctatgagcgcgagagccgcccgggcgggctgatgcgctacggcattcccgacttcaagatcgagaagcactatatcgaccggcgcatcgaacagatgcagggcgagggcgtgaccttccattgcggcgtgaatgtcggcgtcgacaagcccgtcgccgaactgctggccgaacatgacgcggtgctctattgcggcggctcggaaacgccgcgcgcggccaacattccgggtgacgatctcggcggcgtgcatgacgccatgccctatctggtgcagcagaaccgccgcgtcggcggcgagccgatccagtcggtggcatggccctcgcatccgatcatcgccggcggtcagcatgtcgtcgtcgttggtggcggcgataccgcctccgactgcgtcggcaccgccttccgccagggcgcggtgcgcgtcacccagctcgacatccgcccgcagccgcccgagaaggaagacaagctcgcggtgtggccctactgggcgaccaagatgcgcacctcgtcctcgcaggccgagggcgcggagcgcgaattccaggtggcgacgctcgaattcatcggcgaggacggccaactgaccggcgtcaaatgctgcgaggtcgatgagaagcgcaagccgatcgccggcaccgaattcgtcatccgcgccgatctcgccttcatcgccatcggctttgctggaccggcgatggtgggcgtggcgaaggaactcgagggtgagatgaagatcaccaccgacagccgccgctcccggaatgtcgaggccaatgaccgcgactacaagaccagtgtcgaccggctctatgcggcgggcgacgtgcgccgtggccagtcgctcgtcgtctgggcgatccgcgaaggccgccaggcggcgcgctcgatcgatgaagcgctgatggggacgagtgtgttgccgcgctga

SEQ ID NO: 4652 - protein, 484 aa, Rhizobium loti
MGKVTGFLEIDRQVHKYQPASDRIRHFREFTLPMSDKEVEKQAARCMDCGIPFCHGPTGCPIHNQIPDWNDLVYNRDWDNAIRNLHSTNNFPEFTGRICPAPCEEACTLNLEDIPVAIKTVEQAIADKAYETGHIRPYPPEKKTGKRVAIIGSGPAGMAAAQQLGRAGHDVHVYERESRPGGLMRYGIPDFKIEKHYIDRRIEQMQGEGVTFHCGVNVGVDKPVAELLAEHDAVLYCGGSETPRAANIPGDDLGGVHDAMPYLVQQNRRVGGEPIQSVAWPSHPIIAGGQHVVVVGGGDTASDCVGTAFRQGAVRVTQLDIRPQPPEKEDKLAVWPYWATKMRTSSSQAEGAEREFQVATLEFIGEDGQLTGVKCCEVDEKRKPIAGTEFVIRADLAFIAIGFAGPAMVGVAKELEGEMKITTDSRRSRNVEANDRDYKTSVDRLYAAGDVRRGQSLVVWAIREGRQAARSIDEALMGTSVLPR

SEQ ID NO: 4653 - DNA, 1356 bp, Rhizobium loti
  CDS (1)..(1356)
atgccagaaggccagttcaaggaaggtatcgtcggcggcaggcttgcggccgagcagtacgccgataatttttccgacctgcatccgccgctcgatcatcatgaggggttggtcgaatccgaccgctgctatttctgctatgacgcgccatgcatgaacgcgtgcccgacctcgatcgacatcccgctgtttatccgtcagatctcgaccggcaacccgatcggctcagccaagaccatcttcgaccagaacattttgggcggcatgtgcgctcgcgtctgcccgaccgagacgctgtgcgaagaggtctgcgtgcgcgaggtggcggaaggcaagccggtgcagatcggacgcctgcagcgctacgccaccgatgtcgccatggccgagaacaagcagttctacccgcgcgcggagccgaccggaaagacggtcgccgtggtcggggccggcccggccggccttgccgccgcgcaccggctcgcccgtcatggccatgacgtaaccatactggaagcacggccgaaggccggcggcctcaacgaatacggcatcgccgcctataagagcgtcgacaatttcgcccaggccgaggtcgaatatgtcaccgcgatcggcggcatcgacatccagaacggcaaggcgctcggccgcgactaccagctttccgacctgatccgcaactacgacgcggtgttcctcggcatggggcttggcggcgtcaacgcgctgcgcgccgatggcgaggatgccgaaggcgtcaccaatgcggtggagttcatcgccgagctgcgccaggccagcgatctctccggcctgccggtcggccggcgcgtcgtcgtcatcggcggcggcatgacggcgatcgacgccgccgtgcagtctaagctgctcggcgccgaggaggtgacgatctgctaccgtcgtggtcaggagcacatgaacgcttctgggttcgagcaggatcttgccgccgccaacggcgtcaccatccgccactggctgcagccgaagcgggtgatcgccgaggccggccaggtgtcgggcatcgaactcgaatacacggcattgaagggcgacaagctcgccggcaccggcgagacgttgacgctcgtcgccgaccaggtgttcaaggcgatcggccagagctttgtcccggccgcgctcaacggcagcgaggcctcgatcgagctcgaagccggccgcatcaaggtcgacggggaagggcggacatcgctggcgaaagtctgggccggcggcgactgcatctttggcggtgacgacctgaccgtctcggccgtggcgcaagggcgcgatgcggcggaaagcatacacaggagtctgacgcagggataa

SEQ ID NO: 4654 - protein, 451 aa, Rhizobium loti
MPEGQFKEGIVGGRLAAEQYADNFSDLHPPLDHHEGLVESDRCYFCYDAPCMNACPTSIDIPLFIRQISTGNPIGSAKTIFDQNILGGMCARVCPTETLCEEVCVREVAEGKPVQIGRLQRYATDVAMAENKQFYPRAEPTGKTVAVVGAGPAGLAAAHRLARHGHDVTILEARPKAGGLNEYGIAAYKSVDNFAQAEVEYVTAIGGIDIQNGKALGRDYQLSDLIRNYDAVFLGMGLGGVNALRADGEDAEGVTNAVEFIAELRQASDLSGLPVGRRVVVIGGGMTAIDAAVQSKLLGAEEVTICYRRGQEHMNASGFEQDLAAANGVTIRHWLQPKRVIAEAGQVSGIELEYTALKGDKLAGTGETLTLVADQVFKAIGQSFVPAALNGSEASIELEAGRIKVDGEGRTSLAKVWAGGDCIFGGDDLTVSAVAQGRDAAESIHRSLTQG

SEQ ID NO: 4655 - DNA, 1965 bp, Chromatium vinosum
  CDS (1)..(1965)
atggcgacttccagcgacgagatgaagatgaagccgacctggcgtcgattcgaggacggcgaacacgtctgggacaacctgaccgacaagatcttcaatcaggaccgctcccacaagtgtccgacctatgtccacaagacgccgccctgtcaggggagctgtccctcgggcgaggacatccgcggctggctgcagatcgtgcgcggcatggagaagccgccgcagggcatggactggcaggagtatgccttccgtcgttccaccgatgccaaccccttcccggcgatgatgggccgcgtctgtccggcgccctgtcaggacggctgtaatcgcaacgagctggaagacttcgtcggcatcaactcggtcgagcagttcatcggcgacaccgccatcgccaacggttacaccttcgaggcgcccgaactcgacaccggcaagcgcatcgccatcgtcggcggcggtcccgccggtctggcggcggcgtatcaactgcgtcgcaagggccatagctgcaccatcttcgaggccaacgacggtctgggcggcatgttccgcttcggcatccccggctatcgcgtgccgcgcgacaagctcgacgccgagatccagcgcatcctcgacatgggccgggtcgaggtcaggctcaagacccgcatcggcaccgatgtcacggtcgagcagctcgaaaaggactatgacgccatcctctgggccatcggttgtcagagcggtcgcggtctgccggtgcccggctgggaaggcacgccgaactgcgtcacgggtgtcgccttcctcaaggcgttcaacgaaggccgcatgaaggtcacggccggcaaagtcgtctgcgtcggcggtggcgacacctcgatcgacgtggtctcggtcgcgcgtcgtctcggccatgtcaacaagagcaacccgaacgagctgcccgagaccgtgatccgcgacggctatgtcgcccacgatgccgccagtgccgccgccgctcagggcgccgaggtcacgctgacctcgctcttcacccgcgacaagatgaccgcctccgagcacgaggtcgatgatgcgacccgcgagggcgtgaccatactcgacggcgtgatgccggtcgaggtcatcaaggacgccaatggccgcgccatcggtttgaaagtcgccgactgcaccatgaccgacggtcgtccgactccggtcgagggcacagagcgcgtgctcgaagccgacctgatcgtctcggcgatcgggcagggcggcgatctctcgggcctggagcagctcgacaacgggcgcggtctgatggactccgacaagttctatcaggtgccgggcaaggccggacacttcgtcgccggcgacatcatccgtccgcacctgctgaccaccgccatcggtcaggcctggatcgccgccgactcgatcgacgcctatgtgatgcaggccgagcacaagcgccgtccgaaagtcgacgtgcaccacttcaacctgctcgacaagctcaccgaagcccatctggcgcctgagtccttcgtcgccggtcaggccggcgatatgcgcggaacctcggatgccaactatgcgatccacaactatgaggatcgctccggcgccgaagtcattccgcacgaagagttgttcctggggcacttcaactatgtgccgcgcaatctgcgcaaggaagaggtgccgagcgccgacgaggtgctgggccacttccacgagcgcgtcatcggtctgaccgagccggaagcgatcgacgaggccaaacgctgcatgagctgcggtctgtgcttcgagtgcgacaactgcgtcatcttctgtccgcaggatgccgtgttccgggtcgacaagggtagccgcaccacgggtcgctatgtcgataccgactatgccaagtgcatcggctgtcacatctgtgccgacgtctgtccgaccggctacatcaagatgggtctgggcgagtga

SEQ ID NO: 4656 - protein, 654 aa, Chromatium vinosum
MATSSDEMKMKPTWRRFEDGEHVWDNLTDKIFNQDRSHKCPTYVHKTPPCQGSCPSGEDIRGWLQIVRGMEKPPQGMDWQEYAFRRSTDANPFPAMMGRVCPAPCQDGCNRNELEDFVGINSVEQFIGDTAIANGYTFEAPELDTGKRIAIVGGGPAGLAAAYQLRRKGHSCTIFEANDGLGGMFRFGIPGYRVPRDKLDAEIQRILDMGRVEVRLKTRIGTDVTVEQLEKDYDAILWAIGCQSGRGLPVPGWEGTPNCVTGVAFLKAFNEGRMKVTAGKVVCVGGGDTSIDVVSVARRLGHVNKSNPNELPETVIRDGYVAHDAASAAAAQGAEVTLTSLFTRDKMTASEHEVDDATREGVTILDGVMPVEVIKDANGRAIGLKVADCTMTDGRPTPVEGTERVLEADLIVSAIGQGGDLSGLEQLDNGRGLMDSDKFYQVPGKAGHFVAGDIIRPHLLTTAIGQAWIAADSIDAYVMQAEHKRRPKVDVHHFNLLDKLTEAHLAPESFVAGQAGDMRGTSDANYAIHNYEDRSGAEVIPHEELFLGHFNYVPRNLRKEEVPSADEVLGHFHERVIGLTEPEAIDEAKRCMSCGLCFECDNCVIFCPQDAVFRVDKGSRTTGRYVDTDYAKCIGCHICADVCPTGYIKMGLGE

SEQ ID NO: 4657 - DNA, 1455 bp, Thermoplasma acidophilum
  CDS (1)..(1455)
atgctgagttttgaaagagtccggattaaaaaggcggatcccgacgagagggttaagaccttcgatatcgaaccgctggataattatacagacgaagaagccatagcagaggccagcaggtgccttggatgcaacatgtgctcggctgcatgccccgcaagcctagacatatcgggctacataaggagcaccgcggcgggtgatccggctcagaccgtgaggatcataatggaaacgcttccctttccggccataatagggagggtatgcacacacatgtgcgaggatatctgcgtgatgtatgacggaggcggtccgatagccataaggcacctgaagcgatatgctgctgataaattcgacgattatggagagatcctgaggccacagaagagaaagttcataggaaaaaaggttgcggtcataggtggcggcccggctggactcacagtggcctactatctcagcctgcagggtgttaaggtaacgctttttgaggagaggccagccctcggaggcttcatgaagaccggaatacccaggtacaggctgccgcagagcgtcttggacaaggagataggctatgttgtatcccgcggcgttgacgtgaagctgaacacaaaggtgggccgcgacatctcgttcgatcagataatgaaggaatacgatgccgtatttctcggcgtgggcaatcacaagccaaggatgaccgggactcccggcagcgatgcaccgaacgtgatgcacgccaccgaattcctcgagcgtgtgagtttcggcgaaaggatagatgttggagataccgttgccgtcataggcggaggcttcacggcaaacgattcggccaggacttcacttcgcctcggtgccaagcacgtttacataatgtacaggaggagggatgtcgatcgtcccggttaccccagcatgaacgcagatgaggagatggatgaagccgaagaggaaaaggttgagtacgtatgggaggttacgccctttgaatacgtgaaggagaatggaagggtcgtggccatgaagtactggatgaacgagatggtgaaggagggcaagggaagggccaagcctgttccgataaaggacaaggtgtacaccataaaggtggacatggtaatagaggctacaggccaggagactgattactccttcctgggcgattacgtgaaaaaactccggctaaatccacacggtgaacccatcgtggaccagaacggcatgacctcaatagagggggttttctccggcggagattcaacaaaccccaacagggatctgataagcgctgtcagggacggggatatagccgtgcagggcatactaaagtacctcaacgtcatggataaggtatcatacgatgatctgcccatactggacaggttcaagccatactcctatacggccgcacaggaagcctatgcggtgagaggcctgatctga

SEQ ID NO: 4658 - protein, 484 aa, Thermoplasma acidophilum
MLSFERVRIKKADPDERVKTFDIEPLDNYTDEEAIAEASRCLGCNMCSAACPASLDISGYIRSTAAGDPAQTVRIIMETLPFPAIIGRVCTHMCEDICVMYDGGGPIAIRHLKRYAADKFDDYGEILRPQKRKFIGKKVAVIGGGPAGLTVAYYLSLQGVKVTLFEERPALGGFMKTGIPRYRLPQSVLDKEIGYVVSRGVDVKLNTKVGRDISFDQIMKEYDAVFLGVGNHKPRMTGTPGSDAPNVMHATEFLERVSFGERIDVGDTVAVIGGGFTANDSARTSLRLGAKHVYIMYRRRDVDRPGYPSMNADEEMDEAEEEKVEYVWEVTPFEYVKENGRVVAMKYWMNEMVKEGKGRAKPVPIKDKVYTIKVDMVIEATGQETDYSFLGDYVKKLRLNPHGEPIVDQNGMTSIEGVFSGGDSTNPNRDLISAVRDGDIAVQGILKYLNVMDKVSYDDLPILDRFKPYSYTAAQEAYAVRGLI

SEQ ID NO: 4659 - DNA, 6651 bp, Arabidopsis thaliana
  CDS (1)..(6651)
atgtcggcagcttcttctagctccgttcttcacctccgaaccaaccaacaactgttatcactccgatctctcaaaaattccacctccgttgcttctcaattggccgttacgtctggtgttagccgtagaagatcgtgtacggcgcgatgctctgtgaagaaaccggtgattcctgagagtcctttcctagggactcgtgtgcggagatccggatccgagacgcttcagttctggagatcagatggtcctggacggtctgcgaagcttcgaacggtggttaaatcgtcattttccgctgttccggagaagcctcttggtctttatgatccttcctatgataaagactcttgtggtgttggttttgtagcagagttgtccggcgagaccacccgcaaaacggtgactgattcgttggagatgttgatacggatgactcatagaggtgcttgtggttgtgagagcaacactggtgacggcgctgggattcttgttggtctgcctcatgatttctatgcagaggctgcgacagagcttggctttgtacttccttctgctggaaattatgctgttggtatgttcttcttgccaactgttgaaagcaggagagaagaaagcaagaatgttttcactaaggttgctgaatcacttggccactcggttcttggatggagattagtgcctaccgataattctggactgggaaactccgctttgcagactgaaccgattattgcgcaagttttccttactcctacaactaaatctaaagctgactttgagcaacagatgtatatccttagaagggtttctatggttgctattcgagctgcgttgaaccttcaacatggtgcgatgaaggacttctacatctgttcgttgtcttctaggactatcgtctacaaaggacaattgaagcctgatcaactaaaggactattactatgcggatcttgggagtgaaaggtttacgagctacatggccctggttcattctcggttctctaccaatacatttcccagctgggatcgtgctcagccgatgcgtgttttgggccacaatggggagatcaatacactcaggggaaacgtgaactggatgagggcacgtgagggtctgctcaagtgcaatgaacttggattatcaaagaaagagttgaagaagcttctacctattgtggacgttagctcttctgactcaggtgcttttgatggtgttcttgagcttcttgtccgagctggtagaagtcttcctgaagctgttatgatgatgatccctgaagcatggcaaaatgacaaaaacattgatccaagcaggaaagagttttatgaatacttatctgctctaatggagccatgggatggacctgccctcatatcattcactgatggtcgctacttgggtgccacattggaccgtaatggacttcgtcctggtaggttctacataacccacagtggaagggttatcatggctagtgaagttggggtagtggatgtaccacctgaagatgtgatgaggaaaggaagacttaacccgggtatgatgcttcttgtcgattttgagaagcatattgttgttgatgacgatgccttgaagcagcagtattcactggcaaggccttatggtgagtggcttaaaaggcaaaagattgaacttaaagacatcattgagtcagttccggaggctgaacggattgctccttcaatttctggggttgtaccgttaacctttttcttggaaactaaggcctctaatgatgatgactcaatggagagcatgggcattcatggtttattgtctccactaaaagcctttggctacacagttgaggccttggagatgttgctgcttccgatggctaaagatggctctgaagcacttggttctatgggaaatgatacccctctagctgtaatgtcaaacagagaaaaattatgctttgagtacttcaagcaaatgtttgctcaagtaacaaatcctccaattgatcctattcgtgagaaaattgttacatcaatggagtgcatgatcggtccagaaggcgatctaaccgaaacaactgaagagcaatgtcaccgtctctccctaaaaggtcctcttttgaaaatcgaagagatggaagccatcaagaaaatgaactacagaggctggcggactaaagttctggatataacttatgcaaaagaaagaggtacaaaagggttagaggagactttggaccgaatttgtgatgaagcaaatgaagcaataaaggagggctacacattactggttttgtctgatcgagctttctctgcaacacgtgttgctgtgagctccctcatggctgttggtgccgttcatcaccacctggttaagacacttgcgcgcacccaagttggtttggtagtggaatctgctgaaccacgtgaagtgcatcatttctgcacacttgtcggatttggagcagatgctatctgcccatatttggctgtagaggccgtttatagattacaggttgatggcaaaataccacccaaatctaatggggaattccattccaaagaagagttggtcaagaagtattacaaggcaagtaactatggaatgatgaaggttcttgccaaaatgggaatttctactctagcctcatacaaaggtgctcagatatttgaagctcttgggctttcatctgaagtaattcagaaatgttttgccggtaccccaagccgagtggaaggagcaacatttgagatgcttgcacgagatggacttcaattgcatgagttggcctttccaacccgtggctatgccccaggaagtgcagaagcttcagcacttaccaaccctggaaactatcactggaggaaaaatggagagattcatctcaacgatcctcttgcaatagccaaattacaagaggcagcacggaccaacagtgtggccgcctacaaggaatactcaaagcgtatcaatgaattgaacaagcaaagtaatttgcgtgggctcatgaagtttaaagacgcagatgtgaaaattccactagatgaagtcgagcctgccagtgaaattgttaagcggttctgcactggtgccatgagttatggatcaatttctctggaggcgcatacaacccttgcaatggccatgaacaagcttggaggaaagtcgaatacaggtgagggaggggaactgccatcccgtatggagcctcttgcggatggttcaaggaaccccaaaagaagttcgatcaaacaaattgctagtggaagatttggagtttctagctactatcttacaaatgctgatgagctgcagataaagatggctcagggtgccaaacctggggaaggtggggagctaccaggccacaaggtcataggagacattgctataaccagaaattccactgctggtgtaggacttatcagtccacctcctcatcatgatatctactctatcgaggatcttgcccagctaattcacgatcttaagaatgccaatcctggcgcacgtattagtgttaagcttgtatctgaagctggtgttggagttattgctagcggtgtggtgaaggggcatgctgaccatgttctgatagcaggtcatgatggaggtactggtgcatctcgctggaccggtattaaaaatgctggtcttccatgggaactgggtctagctgagacacaccaaactcttgttgccaatgaccttcgtggccgtactgttcttcagacagatggccagctaaaaactggcagagacgttgcagttgctgcacttcttggtgcagaagaatttggttttagtactgcaccccttatcacactagggtgtatcatgatgagaaagtgccacaagaacacctgccctgtgggaattgctacccaagatccagttctccgtgaaaaatttgctggggagcctgaacatgttattaacttcttctttatgcttgctgaggaagttagggagatcatgtctggacttggttttagaactgtaactgagatgattggtcgtgcggatatgcttgaacttgatagggaagttgtcaagaacaacgataagctggagaacattgacctatctcttttgctcagacctgctgctgagattcgtcctggggctgctcagtactgtgttcagaaacaagatcatggtttagacatggctttggatcaagagctgattgcattgtctaaatctgctctggagaaatctcttccggtgtacattgaaactcctatctgcaacgttaaccgtgctgttgggacaatgctgagccatgaggtaaccaaacgttaccacttgactgggcttccaaaggacacaattcatatcaagttcacaggaagtgctgggcagagtcttggagctttcttgtgtcctggaattatgctagaacttgaaggagatagcaatgactatgttggaaaagggctctctggaggtaaagttgttgtttaccctccaaaaggaagcagctttgatccaaaagaaaatatcgttattggtaatgtagcactttacggtgccactagtggtgaagcatacttcaatgggatggctgctgaaaggttctctgttcgtaattctggtgctaaagctgttgtggaaggtcttggtgatcatggttgtgagtacatgactggtggtactgttgtggtgcttggaaagactggtagaaactttgctgctggtatgagtggtggtattgcttatgtccttgatgtggacggaaagtttaacaccagatgcaaccttgaactggttgatttggataaagttgaagatgaggaggacaaaatgacgctcaaaatgatgatccagcaacatcaaagacacaccaacagccaacttgctcaagaagttcttgcagactttgagaatttgctgcccaagtttatcaaggttttcccaagagattacaaacgtgttttatcagccatgaaacacgaagaggtctccaagcaagcaatcgagcgggcttctgaggaagctgacgagactgaagagaaagaactcgaggagaaagatgcatttgcagaactgaagaacatggcagctgcttcgtcaaaagaggagatgtcaggaaacggagtggcagctgaagctagaccttctaaggtagataatgctgttaaaaacggtggtttcattgcttatgagcgtgagggagttaagtacagggatcccaatgttcgtcttaatgactggaacgaagtcatggaggaatcaaaacctggaccactccttacaactcagtcagctcgttgcatggattgtggaactccattctgccaccaggagaactctgggtgtcctctcggtaataagatccctgaattcaatgaacttgtctaccagaacagatggcaagaagccttgaatcgtctacttgagacaaacaactttccagaatttactgggcgagtatgccctgcaccatgtgaaggttcttgtgttcttggaataattgagaaccctgtttctatcaaaagcattgaatgtgctattatcgataaagcctttgaggaagggtggatggtaccaaggcctcctctcaagagaacagggaaaaaggttgctattatcggaagtggaccggctgggttagctgcggctgaccagctgaacaaaatgggccatttagtaaccgtgtatgagcgctcggacagaattggtgggctgatgatgtatggagtaccaaacatgaagactgacaaaattgacgtcgttcaacggcgggttgatcttatgaccaaagaaggtatcaactttgtggtcaatgccaatattggaaaggacccatcttactcccttgatggacttaaggaagagaatgatgcaatcgttcttgctgttggttccacaaaaccaagagatcttccagtgcctggtcgtgatctatctggtgttcactttgccatggagtttcttcatgcaaacaccaaaagtttacttgacagcaatcatgaggatggcaattacatttctgcaaaagggaaaaaggttgttgttattggtggaggtgataccggcacagattgcatcggaacatctatccgccatggatgtaccaacattgtaaacctagaacttcttcctcagccaccctcaacaagagctcctggaaacccttggccacagtggcctcgtgtattccgtattgactacggacatcaagaagctaccaccaaattcggaaaagaccctaggacctatgaggtcttaacgaagaggttcataggagatgacaatggaaacgtgaaggggcttgaacttgtgcgtgtgagttgggagaaggatgaaaccgggaggttccagttcaaggagatcgaaggctctgaggaaatcattgaagcagacctcgttttcttggccatgggtttccttggacctgagccaacacttgctgagaagctaggtctcgaatgtgacaacaggtcaaactttaaggccgagtatggccggttttccacaaccgtggaaggtgttttcgcagcaggtgattgtcggagaggccagtctttggttgtctgggctatctcagaaggacgtcaagctgcagatcaggtagacaaattcctcaccaaaacggatgatgacgaagacgccaagctacaacaagaccttaaccagatgaaacacaacactatcacaaactga

SEQ ID NO: 4660 - protein, 2216 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVPLTFFLETKASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 4661 - DNA, 1473 bp, Zymomonas mobilis
  CDS (1)..(1473)
atggcgcaaaataaaatgctgtcctttgttcatctgaaacaggcctatcctgaaaaacgatcagcacaggaaagagacaaagactttaacgagatttatcggtctttctctgacgaacaggcgagctgtcaggcatcccgttgttctcaatgtggggtgccttattgttcagcttactgtccgctgcataacaatattccagactggctaaaaatgacggcagaaggccggttgcaggatgcttatgccctttccagtgcaacctcgaccatgccggaaatttgtggccgcatttgcccgcaagaccgtctttgtgaaggtaactgcgttattgagaattccggtcatggcgctgtaaccattggatcggttgagaaatacatcaccgatacggcatggaaagaaggttgggttgaacccttacagcctataactgaacttggtatttcggttggtattatcggttcagggcctgccggattgacggcggctgagaaattacggcagcaagggtatcaggtgcatgtttatgatcgccatgttcgtgccggtggccttttgacctattgtattccgggcttcagactcgacaaagacattgttgcacgccgtgttaaacggttagccgattgggggtgtcaccttccataccaatttgcacgtcgggtaaagatgccagccttgaagaattgcgtgacgcacgcggctattctgatcgcaaccggtgtttataaagcccgcggtctggctacccccggaaaagaattaaacggtattgttgatgcgctggatttcctgattagctccaaccggaaatcttttggtgacaaggtcgaagcctttgataatggcacccttgatgccaagggtaaaaaagtagtggttatcggtggtggtgataccgcaatggactgcgtcagaacggctatccgtcagggtgcagaatctgtccgctgcctctatcgtcgcgatcgagtcaatatgcccggttccgcacgcgaagtaaaaaatgccgaggatgaaggcgcagaatttgtctggctatctgcaccggaatcttttgtcggaaaagaccatgttcaatctgtaaaagtccgtggaatgcgcctgggtgcgccagatggttctggccgtcgttctcctgaacctgatccagcacgtctttttgacatggatgcggatcttgtcatttgcgctttgggtttttcaccggaagacctgccaacgctgttcaatgcgccggaattatcggttaccccttggggaaccgtagaggctgatccggtcacattacagactagcatcgaaggggtctttgctgctggtgatattgtccgcggtgccagccttgtggtttgggccatccgtgacggtctggtcgcaagcgaacagatgcatcaatggctagcaacccgccagcaggacaaacaggacgcaccgacaaaggctaaaaagaaagctgtttttgcctga

SEQ ID NO: 4662 - protein, 490 aa, Zymomonas mobilis
MAQNKMLSFVHLKQAYPEKRSAQERDKDFNEIYRSFSDEQASCQASRCSQCGVPYCSAYCPLHNNIPDWLKMTAEGRLQDAYALSSATSTMPEICGRICPQDRLCEGNCVIENSGHGAVTIGSVEKYITDTAWKEGWVEPLQPITELGISVGIIGSGPAGLTAAEKLRQQGYQVHVYDRHVRAGGLLTYCIPGFRLDKDIVARRVKRLADWGCHLPYQFARRVKMPALKNCVTHAAILIATGVYKARGLATPGKELNGIVDALDFLISSNRKSFGDKVEAFDNGTLDAKGKKVVVIGGGDTAMDCVRTAIRQGAESVRCLYRRDRVNMPGSAREVKNAEDEGAEFVWLSAPESFVGKDHVQSVKVRGMRLGAPDGSGRRSPEPDPARLFDMDADLVICALGFSPEDLPTLFNAPELSVTPWGTVEADPVTLQTSIEGVFAAGDIVRGASLVVWAIRDGLVASEQMHQWLATRQQDKQDAPTKAKKKAVFA

SEQ ID NO: 4663 - DNA, 1473 bp, Clostridium saccharobutylicum
  CDS (1)..(1473)
atgggtaaaccaactggatttttagagtatgatagagaagtaggcagaaatagagaacctaaagaaagattgaaagattataaagagtttcatcaaaggcttcctctagaaaagcaatgcattcagggcgcaagatgtatggattgtggtgtaccattttgccaagctggagtattattttcaggtatggtatcaggatgtccgcttcacaatttaattcctgaatggaacgatttagtatacagaggaaaatgggaattagcttatgaaagattaaataagactaatccattcccagaatttacaggaagagtatgtccagcaccttgtgaagctggatgtactgcaggattgaatggtccagcaataactattaaggaaaatgaaagatctataatagataatgcatttgaaaatggatttgttaaagcaaatacacctcttaagagaacaggaaagaaagttgcagtaattggttctggtccatcgggattagcggttgctaatacgttaaataaatgtggtcataaggttacagtatttgaaagaagtgatagaccaggtggactattaatgtatggaattcctaatatgaaacttgataaagaagttattttaagaagagttcaccttatggcggaagaaggcataaaatttgtaaacaatgcaaatgttggtgacaactatgatgcaaaggaaattttagatgaatttgatgcagtagttcttgcgacaggagcatctcagcctagagatcttcaagctgaaggaagagataatgttaatggtatccattttgctgtagatttcttaaaagctaatactaagagtcttttagattcagatcatgaagataataattacatttctgcaaaagataaaaatgtaattattattggaggtggagacacaggaacagactgcgttgcaacatctcttagacatggatgtaaatcagtagttcaatttgaaataatgggtgaaccagctcacgaaagaactgaaagcaaccccatgccagaatggcctaaagttcttaaggttgattatggccaagaagaatttatagaactatatggaaaagatcctagagaatatttaacaacagttacagcagttcattcagataaagatggaaatctagaaagcgtagatactgtaaaagttgaatggaaaaaaggtgacaatggaagaatgttcccagctcatgttgaaggttcggaaaagaactggccagcagaacttatattacttgcaatgggattcacaggttcagaagattatcttaaaaatgcctttggtattgaatcagatgaaagaagcaatgtaaaagctggtaatgttgactttatgactaatgtaccgaaagtatttgcaacaggtgatgcaagacgtggtcaatcattagttgtaacagctataagtgaaggtatagcagcaggaatagcagttgataaattcttaagagcttaa

SEQ ID NO: 4664 - protein, 490 aa, Clostridium saccharobutylicum
MGKPTGFLEYDREVGRNREPKERLKDYKEFHQRLPLEKQCIQGARCMDCGVPFCQAGVLFSGMVSGCPLHNLIPEWNDLVYRGKWELAYERLNKTNPFPEFTGRVCPAPCEAGCTAGLNGPAITIKENERSIIDNAFENGFVKANTPLKRTGKKVAVIGSGPSGLAVANTLNKCGHKVTVFERSDRPGGLLMYGIPNMKLDKEVILRRVHLMAEEGIKFVNNANVGDNYDAKEILDEFDAVVLATGASQPRDLQAEGRDNVNGIHFAVDFLKANTKSLLDSDHEDNNYISAKDKNVIIIGGGDTGTDCVATSLRHGCKSVVQFEIMGEPAHERTESNPMPEWPKVLKVDYGQEEFIELYGKDPREYLTTVTAVHSDKDGNLESVDTVKVEWKKGDNGRMFPAHVEGSEKNWPAELILLAMGFTGSEDYLKNAFGIESDERSNVKAGNVDFMTNVPKVFATGDARRGQSLVVTAISEGIAAGIAVDKFLRA

SEQ ID NO: 4665 - DNA, 1521 bp, Corynebacterium glutamicum
  CDS (1)..(1521)
atggccgacccacaaggattcatcaaatactcccgacgcgagcctgcacaccgcccggtcccgctgcgcctcatggactactccgaggtctacgaaaaggcaccggcaggtcagatcgaggaacaggctgcccgctgcatggattgcggtgtcccgttctgccacgaaggctgcccactgggcaacatcatccctgagtggaatgatctggtacgccaaggtcggtggaaggaagcctacgatcgcctgcacgcgaccaacaatttccccgagttcaccggccgtttgtgccccgcaccctgcgaaggcgcctgcgtgctcggcatcaacgatgattctgtcaccatcaaaaacgttgagctggaaatcgtcgaaaaagcattccgcgaaggctgggttcagcctgtcgtcgcatccatgtccaccggcctgtccgtagccgtcgtcggctccggtcccgctggccttgccgccgcgcagcagctcacccgcgcaggtcacagcgtgaccgtcttcgaacgcgacgaccgcctcggcggcctcatgcgctacggcgtgccagaatacaaaatggaaaaccgctggatcgaccgccgcatcgagcaaatggaagcagagggcacaactttccaggtaggcacctcgccacgcgccgctgaactagcgcttttcgacgcgatcctcctcgcaaccggcaccccagtggcccgcgaactctcagttccaggccacgatctcaacggcatccatgcggcaatggattacctcaccgcccaaaaccgcatcaatgaaggcgacggtgaagtctctccaatcaacgccaaaggcaagaaagttgtcatcatcggtggcggcgacaccggcaccgactgctttggtacagcgctgcgccaaggagcggaatcagtcacccaatttgatatccgcccccgcgctcctttccagcgcgccgattccaccccatggccgatgtaccccaacctcttccgcaccgcaacggctcacgaagaaggcgaatacatcatcactggcgatgaatcagccgatgaaatcgcagccctgggcctcgccgaacgcgccgcaggctccacgcttggtgaacgtaaatttgctgtcaacaccgtggaattccacggcaacaacggccacgtcaccggactcaccggcaaccaaatccgagttgtcaacggcaaacgtgaaccaatcgaaggcaccgaatttcccttcgaagcagacctcgttctcgtcgcactcggattcaccggcgcagaacaaggcggattggcacacgaactaggcgtaggtttcgacgaccgaggacgcatcctccgcgattccgaataccgcagccccaccaactcccgcgtttacatcgcaggcgacaacggccgtggccaatccctgatcgtgtgggcaatcgccgaaggccgcgcatgcgccgcagctatcgacgccgacctcatgggtgaaactgcacttccagtagcagttgcaccacaggacgtgccgctggctgtctag

SEQ ID NO: 4666 - protein, 506 aa, Corynebacterium glutamicum
MADPQGFIKYSRREPAHRPVPLRLMDYSEVYEKAPAGQIEEQAARCMDCGVPFCHEGCPLGNIIPEWNDLVRQGRWKEAYDRLHATNNFPEFTGRLCPAPCEGACVLGINDDSVTIKNVELEIVEKAFREGWVQPVVASMSTGLSVAVVGSGPAGLAAAQQLTRAGHSVTVFERDDRLGGLMRYGVPEYKMENRWIDRRIEQMEAEGTTFQVGTSPRAAELALFDAILLATGTPVARELSVPGHDLNGIHAAMDYLTAQNRINEGDGEVSPINAKGKKVVIIGGGDTGTDCFGTALRQGAESVTQFDIRPRAPFQRADSTPWPMYPNLFRTATAHEEGEYIITGDESADEIAALGLAERAAGSTLGERKFAVNTVEFHGNNGHVTGLTGNQIRVVNGKREPIEGTEFPFEADLVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 4667 - DNA, 7037 bp, Oryza sativa
  CDS (262)..(6762)
cgggaagagacccgcgagagaggcggcgccccgtttcgtccccaaaaccgatccattcattcgccaaccacgccgtccgccgcgtcgccggtagagaaggccgccgtgcgtgcgggagagaagggggaagcacaaaccgcgctcggggacgagagccgcgaggcgaaggtgtggggaggatcgggacgcggcgtcggcgtcggtctcacctccgggctacaagagcgagaggtagcagagggagagtcgtgaggtgcagccatgtcggcggcgcaagggatggcctacaagctccgcaccgacgcggcgcccacgggcgctggccgcagggctcggcgcagccactcctccgtggcggcgccttaccgcgcggctaggctggtacagggcggcgtgtccatcgagggcggtttggtcggcggatgccagctcaccgaggagcgcgtcgccgcacggccgccccgcgccgccgcgcgcgacgccgagccggtcaggccactttcgacgctccccgagagcagcattgggctgtacgacccctcgcgcgagcgcgactcgtgcggcgttggtttcgtcgccgagctgtcgggcgattacaagcgcgcgacggtcaatgacgccctcgagatgcttgagagaatggcgcaccgtggtgcctgcggctgtgagaagaacactggcgatggtgccggcatccttgtggctctaccgcataactttttcagagaggtgacaaaggatgctgggtttgagctaccgcagccaggcgagtatgctgtcggtatggtcttcctgccaatcgatgagaagcgccgtgagcggagcaaagctgagtttcagaaggtagcggaatcgctgggacatgtaatacttgggtggcgccgggttcccactgacaactcagacttaggtgaatctgcgctccagactgagccagttattgagcaggttttcctcaccaaaagttcaagttcggaggctgattttgagcagcagttgtatatcctgaggaggctctcgattctatctatccgtgcagctctgaatctccgtcgtggaggaaagagggacttctacatgtgttctctctcctcaaggactattgtctacaagggccagcttaagccatgccaacttaaggggtactactatgcagatctaggtcatgaaaacttcacaagttatatggctctggttcactcaaggttctccacgaacaccttccccagctgggaccgtgcacagccgatgcgtgtattaggtcataatggagagatcaataccctcaaagggaacaagaattggatgaaagcacgagaaggtctcttagagtgtgagaagcttggcctaacaaaggatcagttttcaaaaattctaccaattgtggatgctacctcgtctgattcaggtgctttcgatggtgttcttgaacttcttatccgtggtggaagaagcctgccagaagctgtgatgatgatgatacctgaggcatggcagaacgatgtgaacatggaacctgagaagaaagctctctatgagttcttgtctgcccttatggagccttgggatggacctgctctaatatcttttactgatggccgttaccttggagccaccctggatcgcaatgggttgaggcctggtcgattttatgtgacacacagtggacgtgtagtcatgggaagtgaagttggtgttgttgatgttccttccaaagatgtattgagaaagggtagactaaaccctggaatgatgctgttggttgattttgagaaccatactgtagtggatgatgaagcattgaaggcacagtactcgaaagctcacccatatggggagtggctcaagagacaaaaaatatacctcaaagacattgtagaatctgtgccagaaactgagagagttgctcctggaatttctggttcactcacacaaaagaatgagaaaaaggaacatgcaggcgtcaatgggattgtgactccactaaaagcctttggatacacagttgaagcccttgaaatgctgcttctcccgatggctaaagatggagttgaagctcttggatccatgggaaatgacacacccttggcagtcatgtcaaacagagagaagttgacttttgagtacttcaaacagatgtttgcacaagttacaaacccgccaatcgacccaattagggagaaaattgttacatctatggagtgtatgattgggccagaaggtgacttgttggaaacaactgaaaagcaatgcaaccgccttgcacttgagggtcctttggtgtcgattgatgaaatggaggctattaagaagatgaactaccgtggttggcgaagcaaggtgctcgacataacttatccaaagaagtctggaaggaagggcttggaagaaactttggacagaatttgcacagaagctcggggagctataaagaagggctacactgttttagttctctcagatagaggattttcctcagaccgtgttgctgtcagttcgctcttagcagttggcgcggtacatcagcatcttgtggccaatcttgagaggacgcgcgtaggtttggtggagtctgctgaacctcgtgaagtgcaccacttctgcacccttgttgggtttggtgctgatgctgtatgcccttatttggctatcgaagcaatttggtgcttgcagaatgatgggaagattcctcctaatggtgatgggaaaccctactcaaaggaagaacttgtcaagaaatatttctatgcttctaactatggaatgatgaaagttcttgcaaagatgggaatttccacccttgcatcttacaaaggtgcacagatttttgaagctcttggcctttcctctgaagtcatccgtaagtgttttgatggtacacctagccgaattgaaggcgccacttttgaaatgcttgcacgagatgctctacgtcttcatgagttggcatttccatcaagagcacctccaccaggaagtgcagatgcaaaggcccttcccaatccaggggactaccactggaggaaaaatggtgaagtccacctcaatgatccccttgcaatggcaaaactacaagaagctgctagagtaaacagccgggcagcatacaaagaatattctaggcgtattcaggagctcaacaaaacctgcaacctgcgtggtatgcttaaatttaaagacactgctgacatgatttctgtggacgaggttgaacctgcaagtgagatcgttaaacgctttgttactggtgcaatgagttatggatccatttctttggaagcacatactgcccttgctatggccatgaacaaacttggagggaaatctaatacaggtgagggaggggaacagccttctcgtatggaaccacttgctaatggttcaatgaatccaaaaagaagtgcaatcaagcaagttgccagtggaagatttggagtttcaagctattatctgactaacgctgatgaactgcagataaaaatggctcagggtgctaagcctggtgaaggtggtgagcttccaggccacaaggttattggtgacattgcggttacaagacactctactgctggtgtaggactgattagcccacctcctcaccatgacatatattctattgaggatcttgcacaacttatccacgaccttaagaattcaaatcctagagctcgcataagcgtcaagctagtttctgaggctggtgtaggagttgttgctagtggtgttgtaaaaggacatgcagaccatgtccttatatctggccatgatggagggacgggagcttctaggtggacaggtattaaaaatgctggccttccatgggaacttggattggctgagacacatcaaactctagtggcaaatgggcttcgtggccgagctattctgcaaactgacgggcagttaaaaactggcaaagatgtagctgttgcttgcttacttggcgcagaagaatttggtttcagtactgctccgttgatcacacttggttgcatcatgatgcggaaatgtcataccaacacttgccctgttggtatagctactcaagatccagtgctacgagaaaagtttgctggagaaccagagcatgttatcaacttcttcttcatgcttgctgaggagctaagagaaatcatgtctcagcttggcttccgtaccattactgaaatggttgggcgctctgacatgcttgaggttgatccagaagtagtgaagagcaacgagaaacttgagaacattgatctctcattgattttgaaaccagctgcagagattcgccctggggctgctcagtactgtgttgaaaagcaagatcatggtcttgacatggcattagataacaaactcatagctttatcaaaagctgcacttgagaaggaagttcgtgttttcattgagactccaatccagaatactaaccgagcagtaggcactatgcttagtcatgaagtcacaaagcgttatcacatgaagggattacctgcaggtacgattcatgtgaagctcactggaagtgctggtcaaagtcttggcgcttttctctgtcctggaatcacccttgagcttgaaggagacagcaatgattatgttggcaaaggattgtctggcggaaaaattgttgtctacccaccaagagatagtacatttattccagaagacaatattgtaattggtaatgtggctctatatggtgctactataggagaggcatatttcaatggaatggctgcagaaaggttttgcgtgcgcaattcaggtgctcaagctgtggttgaaggaattggtgatcatgggtgtgagtacatgacagggggtactgtggttatccttggtaaaacaggaagaaactttgctgctgggatgagtggaggcattgcttatgtttatgatattgatgggaaattcagcgtccgctgtaaccatgagttagttgatctctatcatgtggaggaagaggaagacattaccacattgaaaatgatgatagaacaacatcgacttaacactgggagtgttgttgctagagatatactctctaattttgatactcttcttccaaaatttgtcaaggtattcccaagagattataagagggttttggacaatatgaaggctgaaaaggctgctgctaagcttgcaaaggaaccaaagatttcaaatggtgtttctgtaaccactaagaaagtgcaaccggagcaatcaacaaaccgaccaacacgtgtttccaatgccaaaaagtaccgaggtttcatttcatatgagcgagagagtatttcttaccgggatccaaatgagcgtgtaaaagattggaaggaagttgcaattgaatcagtgccagggccactactgaacacacagtctgctcgttgtatggattgtggaactcctttctgtcatcaggaaagctcaggtgctggctgtcctcttggaaataagattccagagttcaatgaactggttcaccagaacagatggcgtgaagcactagatcgtctgcttgagacgaacaacttccctgaatttactggaagagtatgccctgctccctgtgagggatcatgtgttcttggcattattgaaaatccagtatctatcaaaagcatagaatgtgcgatcatagacaaaggttttgaagagggatggatggtaccgcggcctccacttcaaagaacaggaaagaaggttgccatcattggaagtggtccggctggtttggctgctgcagatcaactaaacaaaatgggccattttgttactgtgtttgaacgtgctgatcgtattggtggtctgatgatgtatggagtgccaaacatgaagacagacaagattgaaattgtgcaacgccgtgtcaatttaatggcagaagagggcattacatttgtagtgaacgctaatgtaggcagtgatcctttgtattcaattgagcgcctccgttctgagaatgatgcagtcattttggcttgtggagctactaaaccaagggatctaggtattcctggacgcgagttatcaggagttcattttgccatggagttcctccatgcaaatacgaaaagtttacttgacagcaacttggaggatggtagatacatatctgccaaggggaaaaaggttgtggttattggtggtggtgacacaggcacagattgcattggtacatctattcggcatggttgcaccagcattgtaaaccttgaacttcttaccaaaccaccaagcaagagagcagctgataacccatggccacagtggcctagaatcttccgtgttgactatgggcaccaggaagcatctagtaagtttggaaatgacccaagaacttacgaagtcctgaccaagcgttttattggtgatgaaaatggaaacgtgaaggcccttgaggtggtccgggtcaagtgggagaaagtcgatgggagattccagttgaaagaaattgaaggctcaaacgagaccattgaggctgatcttgtcctcctagctatggggttcctaggccctgaagcgactattgctgagaaactaggtttggagaaagacaaccggtctaacttcaaagctcaatttggaaactttgcaaccagtgtggatggcatttttgctgccggggactgcagacgtggacaatcacttgttgtttgggccatcaccgaggggcggcaagctgctgcagctgtcgacaagtacttgtcaaggaatgaacaagatgccgcagaggacataaccccctcgggtgcaggttttgtgcagcctgttgcagcataaatgaaacaggcaaacttttcaagaccagtgcaatctaaattaggatcaacgtttttagtctttgatcacagcaagttgtctttgaaagataaggccgggctcaatagggaaaagagaagagccttcttatattttggtagataaacaattggaaattttggtgtgttctgcttgttacttttccagtaaaatgatttgcatggtgaaatgccgttttgtaatctgaataataatgtacagttgttttggtttaattaatagatgtaaatttgtct

SEQ ID NO: 4668 - protein, 2166 aa, Oryza sativa
MSAAQGMAYKLRTDAAPTGAGRRARRSHSSVAAPYRAARLVQGGVSIEGGLVGGCQLTEERVAARPPRAAARDAEPVRPLSTLPESSIGLYDPSRERDSCGVGFVAELSGDYKRATVNDALEMLERMAHRGACGCEKNTGDGAGILVALPHNFFREVTKDAGFELPQPGEYAVGMVFLPIDEKRRERSKAEFQKVAESLGHVILGWRRVPTDNSDLGESALQTEPVIEQVFLTKSSSSEADFEQQLYILRRLSILSIRAALNLRRGGKRDFYMCSLSSRTIVYKGQLKPCQLKGYYYADLGHENFTSYMALVHSRFSTNTFPSWDRAQPMRVLGHNGEINTLKGNKNWMKAREGLLECEKLGLTKDQFSKILPIVDATSSDSGAFDGVLELLIRGGRSLPEAVMMMIPEAWQNDVNMEPEKKALYEFLSALMEPWDGPALISFTDGRYLGATLDRNGLRPGRFYVTHSGRVVMGSEVGVVDVPSKDVLRKGRLNPGMMLLVDFENHTVVDDEALKAQYSKAHPYGEWLKRQKIYLKDIVESVPETERVAPGISGSLTQKNEKKEHAGVNGIVTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALEGPLVSIDEMEAIKKMNYRGWRSKVLDITYPKKSGRKGLEETLDRICTEARGAIKKGYTVLVLSDRGFSSDRVAVSSLLAVGAVHQHLVANLERTRVGLVESAEPREVHHFCTLVGFGADAVCPYLAIEAIWCLQNDGKIPPNGDGKPYSKEELVKKYFYASNYGMMKVLAKMGISTLASYKGAQIFEALGLSSEVIRKCFDGTPSRIEGATFEMLARDALRLHELAFPSRAPPPGSADAKALPNPGDYHWRKNGEVHLNDPLAMAKLQEAARVNSRAAYKEYSRRIQELNKTCNLRGMLKFKDTADMISVDEVEPASEIVKRFVTGAMSYGSISLEAHTALAMAMNKLGGKSNTGEGGEQPSRMEPLANGSMNPKRSAIKQVASGRFGVSSYYLTNADELQIKMAQGAKPGEGGELPGHKVIGDIAVTRHSTAGVGLISPPPHHDIYSIEDLAQLIHDLKNSNPRARISVKLVSEAGVGVVASGVVKGHADHVLISGHDGGTGASRWTGIKNAGLPWELGLAETHQTLVANGLRGRAILQTDGQLKTGKDVAVACLLGAEEFGFSTAPLITLGCIMMRKCHTNTCPVGIATQDPVLREKFAGEPEHVINFFFMLAEELREIMSQLGFRTITEMVGRSDMLEVDPEVVKSNEKLENIDLSLILKPAAEIRPGAAQYCVEKQDHGLDMALDNKLIALSKAALEKEVRVFIETPIQNTNRAVGTMLSHEVTKRYHMKGLPAGTIHVKLTGSAGQSLGAFLCPGITLELEGDSNDYVGKGLSGGKIVVYPPRDSTFIPEDNIVIGNVALYGATIGEAYFNGMAAERFCVRNSGAQAVVEGIGDHGCEYMTGGTVVILGKTGRNFAAGMSGGIAYVYDIDGKFSVRCNHELVDLYHVEEEEDITTLKMMIEQHRLNTGSVVARDILSNFDTLLPKFVKVFPRDYKRVLDNMKAEKAAAKLAKEPKISNGVSVTTKKVQPEQSTNRPTRVSNAKKYRGFISYERESISYRDPNERVKDWKEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGKKVAIIGSGPAGLAAADQLNKMGHFVTVFERADRIGGLMMYGVPNMKTDKIEIVQRRVNLMAEEGITFVVNANVGSDPLYSIERLRSENDAVILACGATKPRDLGIPGRELSGVHFAMEFLHANTKSLLDSNLEDGRYISAKGKKVVVIGGGDTGTDCIGTSIRHGCTSIVNLELLTKPPSKRAADNPWPQWPRIFRVDYGHQEASSKFGNDPRTYEVLTKRFIGDENGNVKALEVVRVKWEKVDGRFQLKEIEGSNETIEADLVLLAMGFLGPEATIAEKLGLEKDNRSNFKAQFGNFATSVDGIFAAGDCRRGQSLVVWAITEGRQAAAAVDKYLSRNEQDAAEDITPSGAGFVQPVAA

SEQ ID NO: 4669 - DNA, 4421 bp, Bos taurus
  CDS (75)..(3152)
actttcgtctctggctgaagcctgaggacgcggaagggttcgtggcaaggaaaccccaggctctgggcatcgccatggcccctgtgctaagcaaggacgtggcggatatcgagagtatcctggctttaaatcctcgaacacagtctcgtgcaactctgcgttccactttggccaagaaattagacaagaaacattggaaaagaaatcctgataagaactgctttaattgcgagaagctggagaataattttgatgacatcaagcacacgactcttggtgagcgaggagctctccgagaagcaatgagatgcctgaaatgtgcagatgccccctgtcagaagagctgtccaacaaatctagatatcaaatcgttcatcacaagtatctcaaacaagaactattatggagctgctaagatgatattttctgacaacccacttggtctgacctgtggaatggtatgccccacctctgatctttgtgtaggtggatgtaatttgtatgccactgaagagggaccaattaatattggtggattgcagcaatatgctactgaggtattcaaagcaatgaatatcccacaaatcaggaatccttctctgcctcccccagaaaaaatgcctgaagcctattctgcaaagattgctcttttgggtgctgggcctgcaagtataagttgtgcttcgttcttggctcgattaggctacaatgacatcactatatttgaaaaacaagaatacgttggtggtataagtacttctgaaatccctcagttccggctgccatatgatgtagtaaattttgagattgagcttatgaaggaccttggtgtaaagataatttgtggtaaaagcctttcagtgaatgacattactcttagtactttgaaagaagaagggtacaaagctgctttcattgggataggtttgccagaacccaagaaggatcacatcttccaaggcctgacacaggaccaggggttttacacttccaaagactttctgcctcttgtagccaaaagcagtaaagcaggaatgtgcgcctgtcactctccattgctgtcgatacggggaaccgtgattgtactcggagctggagacacagctttcgactgtgcaacatccgctttacgttgtggagcccgccgagtgttcatcgtcttcagaaaaggctttgttaatataagagctgtccctgaggaggtggagcttgctagagaagaaaaatgtgaatttttgcctttcttgtctccacggaaggttatagtaaaaggtgggagaattgttgccatgcaatttgttcggacagagcaagatgaaactggaaaatggaatgaagatggagatcagatagcctgtctgaaagccgatgtggtcatcagtgcctttggctcagttctgagtgatcctaaagtaaaagaagccttgagccctataaaatttaacagatgggatctcccagaagtagatccagaaactatgcaaaccagtgagccatgggtgtttgcaggtggtgatgtggttggtatagccaacactacagtggaagccgtgaatgatggaaagcaagcctcttggtacattcacagatatatacagtcacaatatggagcttcagtttctgctaagcccgaactccccctgttttatactcccattgatctggtggacattagtgtggaaatggctgcattgaagtttacaaatccttttggtcttgccagtgcaactccaactaccagttcgtcaatgattcgaagagcttttgaagctggatgggcctttgctctgaccaaaactttctctcttgataaggatatagtgacaaatgtttcacccagaatcatccgggggaccacctctggccccatgtatggccctggacaaagctctttcctgaatattgagctcatcagtgaaaaaacggctgcatattggtgtcaaagtgtcactgaactaaaagccgactttccagacaatattgtgattgctagcatcatgtgcagttacaacagaaatgactggatggaactctccagaaaggctgaggcttctggagcagacgccctggagttaaatttatcgtgtccgcatggcatgggagaaagaggaatgggtctggcttgtggacaggatccagagctggtgcggaacatctgtcgctgggttaggcaagctgttcggattcctttttttgccaagttgaccccaaatgtcactgatattgtaagcatagccagagctgcaaaggaaggtggggcaaatggtgttacagctaccaacactgtctcaggtctcatgggattaaaagctgatggcacaccctggccagcagtgggccgtgagaagcggactacatacggcggagtgtccggcacagccatcagacctattgctttgagagctgtgaccaccattgctcgtgctttgcctgaatttcccattttggccactggtggaattgactcagctgaaagtggtcttcagtttctccacggtggtgcttcggtgctccaggtatgcagtgctattcaaaatcaggatttcactatcatccaagactactgcactggcctcaaagccttgctttatctgaaaagcattgaagaactacaggactgggatgggcagagtccagccacgaagagtcaccagaaagggaaaccagtcccttgtattgctgaacttgtgggaaagaaactgccaagctttggaccttatcttgagaagtgcaagaaaatcatagcagaggaaaagttgagactgaaaaaagaaaatgtgaccgttctaccacttgaaagaaaccattttatcccaaaaaaacctattccttctgttaaggatgtgattggaaaagctctgcagtaccttggaacatatggtgaactgaacaacacagagcaggttgtggctgtgatcgatgaagagatgtgtatcaactgtggcaaatgctacatgacctgtaatgactctggctaccaggctatccagtttgatcctgaaacccacctgcccaccgttactgacacttgtacaggctgtaccctgtgtctctccgtctgccctattatcgactgcatcaaaatggtttccaggacaacaccttatgaaccaaagagaggcttgcccttggctgtgaatcctgtgtcttaaggtgatttgtgaaacagttgcagtgaacttcgaggtcacctacttatgctgatcttttcaatagtgatcattatgctcagctttttctaaattcaaacatataatttctaaatttaaaaaaagattatttctaaagaaatttctaaattttaaaaatgtctgctttcagtgatcattcaattaatggtcataaaatagaataattcttttctgagcagaattgttcaatataactatggagcagttaattggatgttcaccatcagttgtccattatgaaaaaattaacttttttgtagcaattaatgctacacttttcaaattgccctatgccgagttctgtctttgatttctaattgtaagggaaattaagtattttagaacaaagtacaatttaacttacaacaaatgtttccaaggaaacattttataattaaaaattacatttaattttaactctgtttctaagcaaaagtaattagctccataaagctcagatgaagtcaaataattatttactgtggtagcaaaagaaagccaatgagggtttgggaaactttccttaaggtctcttcactgaaataactggatactgaaggcgagagtgttcagtaaccatttgtatcaagctatgctattcaccgctcaggcctgagatgtgtgtccaaatgctaccaatgaatcaacatgacattcctgtttaaatatttaaactatgttcctaacaaagtaagacattaggatggaactctggttaaagccactcttttgctgtgcacagatctgttctatctgcttctaatatagtcaccttcgtgatcctagcaattaatgtttgaacacagcacagattatacagaagtggggtcatgtgcttctttattcaagaatgagaaatccagtatgggtaatatatattatatgggtgataccactttaccaactctttattttagtgtccatgttgaatttcgaaagtgattaaaaaagaaatggtattttctgttactgccaaataatatttttatattcctcgatttttaaaatcagcaaatagcatcttataaacttgtttatctcttctttgtggcatattttaatatgaatccataagtagtaaatcttcatgtaatcatccatagcacctttctatgacaaatgcaagatcaagagaaaaataaatgtttgattatgcacttttagaaatgcacatttaccacaaaatctgtatgatcaaataatattaaataaaattttataaagcatttt

SEQ ID NO: 4670 - protein, 1025 aa, Bos taurus
MAPVLSKDVADIESILALNPRTQSRATLRSTLAKKLDKKHWKRNPDKNCFNCEKLENNFDDIKHTTLGERGALREAMRCLKCADAPCQKSCPTNLDIKSFITSISNKNYYGAAKMIFSDNPLGLTCGMVCPTSDLCVGGCNLYATEEGPINIGGLQQYATEVFKAMNIPQIRNPSLPPPEKMPEAYSAKIALLGAGPASISCASFLARLGYNDITIFEKQEYVGGISTSEIPQFRLPYDVVNFEIELMKDLGVKIICGKSLSVNDITLSTLKEEGYKAAFIGIGLPEPKKDHIFQGLTQDQGFYTSKDFLPLVAKSSKAGMCACHSPLLSIRGTVIVLGAGDTAFDCATSALRCGARRVFIVFRKGFVNIRAVPEEVELAREEKCEFLPFLSPRKVIVKGGRIVAMQFVRTEQDETGKWNEDGDQIACLKADVVISAFGSVLSDPKVKEALSPIKFNRWDLPEVDPETMQTSEPWVFAGGDVVGIANTTVEAVNDGKQASWYIHRYIQSQYGASVSAKPELPLFYTPIDLVDISVEMAALKFTNPFGLASATPTTSSSMIRRAFEAGWAFALTKTFSLDKDIVTNVSPRIIRGTTSGPMYGPGQSSFLNIELISEKTAAYWCQSVTELKADFPDNIVIASIMCSYNRNDWMELSRKAEASGADALELNLSCPHGMGERGMGLACGQDPELVRNICRWVRQAVRIPFFAKLTPNVTDIVSIARAAKEGGANGVTATNTVSGLMGLKADGTPWPAVGREKRTTYGGVSGTAIRPIALRAVTTIARALPEFPILATGGIDSAESGLQFLHGGASVLQVCSAIQNQDFTIIQDYCTGLKALLYLKSIEELQDWDGQSPATKSHQKGKPVPCIAELVGKKLPSFGPYLEKCKKIIAEEKLRLKKENVTVLPLERNHFIPKKPIPSVKDVIGKALQYLGTYGELNNTEQVVAVIDEEMCINCGKCYMTCNDSGYQAIQFDPETHLPTVTDTCTGCTLCLSVCPIIDCIKMVSRTTPYEPKRGLPLAVNPVS

SEQ ID NO: 4671 - DNA, 6336 bp, Schizosaccharomyces pombe
  CDS (1)..(6336)
atggctgtcttatcttcagtccaacccatcaatcataactctgccctcgttgaggctcgtgacgaacaagtgaacacgaccgcttgttccgatgaccttctcaatgctcctccctatgagtatgatactgagggaaatccctcttgggctggtgcccttcccaaggctcaagctttatacgatcctgcctacgaaaaagactcttgcggtgttggtttcacttgtcacatcaagggtcaagtctctcacaaaatcgtcaccgatgctcgcttacttttgtgcaacatgactcatcgtggtgccactggtgccgatactcgtgatggtgatggtgcaggtgtcatgaccggtatgccttacacttttatgcaaaaggagtttggtcaaatcggatgtacccttcccaaaagcggcgagtatgccatcggtaatgtgtttttctctcctgaagccgacgtttgtcgtgaagccatgaccgctttcacccaagtcgccgaaaaacttggtcttgcaatccttgcttggcgttccgtcccttgtgataacagcatcttgggccccgctgctctttctcgtgagcctaccatcttacagccttgtgttgtcctcaaggccgcttacgatggtgaagccgagtttgataccgatctcttcgaaagacagctttacgttcttcgcaagcagtcttctcatttgatcggtaaggaaaaatggttctacatttgctctttgcatcgtgagaccattgtctataagggtcaacttgctcctgttcaagtctacaattatttccttgatttgaacaacgccgagtatgtatcccactttgccctcgttcactcccgtttctctacaaacactttcccgtcctgggaccgtgctcaacccatgagattggccgctcacaacggtgaaattaacaccctacgtggtaacaaaaattggatgcatgctcgtgaaggcttgatgaagtccagtcgttttggcgaagagttcgcctctttgcttcccatcatcgagcgcggtggttcggactccgctgcttttgataacgttattgagttgttatgtgctagcggtgttgtctccttacccgaagctgtcatgctcttgattcctgaagcttggcaaaacgacaaaaacatcagcgacgagaaggctgctttttacgagtgggctgcttgtcaaatggagccttgggatggtcctgctttgtttacatttgccgacggtcgctattgcggtgccaatcttgatcgtaacggtcttcgcccttgccgtttctatcttacttccgatgacatgatgatttgcgcttctgaagttggtacagtcggcattgaacctgaccgcatcgttcagaaaggtcgtctatatccaggccgtatgttgcttgttgacaccaaagagggtcgtattgtcgacgataaggagctcaagcacaacattgccagtcgctacgacttccgtagttggctcgaccaagagcttatcgacatgaactcgattgttgactctcttatagaatccactagcgttgatcttactcccattgtcgatgatgttcctcttgccgatgacaaaaccatgttagcatttggttacactttggaacagattaacatgattatggctcccatggctaatggcggcaaggaaactttgggaagtatgggtaatgatgctgcaatcgcatgcctttccgaccagcctcgtttactttacgactatttccgtcaacttttcgctcaagtcactaatcctcctattgatcctattcgtgaggctatcgtaatgagtttgcaatgctacatcggtcctagtggtaacttgcttgaaattaatcaaagccaatgtcgtcgtctccgcatgcctactcccattttgactgttgaggagttcaatgctttgaaaaatgttgaccgtatttaccctgactggaaagtcgcttctatcgacatcacttttttcaagagtgaaggcgttgctggctatgctgccgccatcgagcgtatttgttccgaagctgatactgccgtcaatgagggctataaagctatagtcctttccgaccgtaacgttaacagtgagcgcgtacctttggcttccattgccgcatgcggtgccgttcatcattatttggtacaaaacaaattgcgttctagagttgctcttgtttgtgaatctggtgacgcgcgtgaagttcaccatatgtgcacacttcttggctatggtgccgatgccgtttgtccctatttagccatggaagctttaacaaagctagtcagacagaacgcaatgaaacctggcatcacagaagaaactgccataaagaatttcaagcatgctatcaatggcggtattttgaaggttatgtccaagatgggtatttcaactttgcaatcatataaaggtgcccagatttttgaggctcttggcattgacaacgaggtcatcaacaaatgtttccttggtaccgcatcccgtatccgtggtgtaacttttgagcatattgctcttgatgcttttgctcttcatgagcgtggatatccaaccgatcaatccattcgcagtcttcaaatccccgatatgggtgacttttactatcgtgatggtggtgagcagcacgtcaaccatccaaaggctatcgccagtcttcaagatgccgtccgcaataagaacgaggctgcttatgcggaattctctcgtacacactacgaacaaactaggaggtgtactcttcgtggtatgttggatttcgattttgattcttctcaagctattcccattgaacaggttgagccttggactgagattgttcgccgtttctgcactggtgctatgtcttacggttcgatcagtatggaatctcattcttctttggccattgccatgaatcgtttgggcggtaagtctaacactggtgaaggtggtgaagaccctgctcgcagtcagcgtcttgccaatggcgatacaatgcgttctgccatcaaacagattgcatccggtcgtttcggtgttacttcttggtacttgtctgatgctgatgagcttcaaattaaaatggctcaaggtgccaagcctggtgagggtggtgaattgcctggtaataaggtgagtgaatcaattgcgaaaactcgtcattccactgctggtgttggtttgatttctcctcctcctcatcatgatatctactctattgaagatttgaagcagttgatttatgacatgaagagtgccaaccctcgtgctcgtgtatccgttaagcttgtttctgaagtaggtgtcggtattgttgcttctggtgttgcaaaagccaaagcagatcatattttggtttcaggtcatgatggtggtaccggtgcctctcgttggactggtattaaatacgctggtttaccatgggagctaggtgttgccgaaacccatcaaactttggtattgaacgaccttcgtgggcgagttgttatccaaactgatggtcaaattcgtaccggtcgtgatgttgctatcgcttgcttgcttggtgctgaagaatgggggtttgcgactactcctttgattgcattgggctgtatcatgatgcgtaaatgtcatctgaatacttgtcccgttggtatcgcaactcaagatcctgaattgaggaagaaatttgagggtcaaccggagcacgttgtaaactttttctactacgtcgcagaagagctccgtggaattatggctaaacttggtttccgaactattaatgagatggttggtcgttctgacaagcttaaggtcgccgagccaattaacaacaagtcaaagcttcttgacttgactcccttgctgactcctgctttcactcttcgacctggcgctgctacttacaacgttcgtaagcaagaccatagactttataccagacttgacaacaagctcattgacgaagctgaagttactttggaagaaggcatcccttctgtcgttgaatgtgaaattattaacaccgatcgtactcttggtgctactctttccaataagatcagtaagcgttatggtgaagagggtcttcctactgattctattcgtgtcaatgtttttggttcagctggccaatcttttggtgctttcttagctccaggtgttacactccaattagaaggtgactgtaacgattatgtcggcaaaggcttatctggcggtcgcttgattatttatcctcctagggtttctccctttaagcccgaagaaaatatgatcattggtaatgtctgtctgtatggtgccacttctggtcatgcttttatttctggtgtggcagcagagcgtttcgctgttcgtaactctggtgcaattgctgtagttgaaggcgttggtgaccacggttgtgagtacatgactggtggtcgtgttgtaattcttggttcaactggcagaaacttcgctgctggtatgtctggtggtattgcatatgtctacgatatgcaaatggactttgctggtaaaattaacacagaaatggtcgatatttcttctgtcactgatgctgctgaaattgctttcctcagaggacttattcaagaccataggcattacacgggctcacaggtggctgaccgtatattaagtgatttccctcgtcaccttagccgctttgttaaggttcttccaagagagtacaaggctgtattggaacgtgaagctgctaagaaggaagaagccaagagactacagtatcccaaagctttcatgccaggaaatcctattcgtcaacaaattgaggaaactaatgctcagattgctgatgtggaagataccttaggtgctactgtgaaaaagagcgctcctttggacaagcttcgtggatttatgaaataccaacgccgcagtgaacattatcgtaaccctcttaagagaacgaatgattggaaagaactttccgttcgtcttcgtgaagatgaattacgtgttcaaactgccagatgtatggactgtggtactcctttctgtcaatctgattatggttgtcctatttccaacaaaattttcacttggaatgatttggttttcaaacaacagtggaaagaggccttaacccagcttttgttgaccaataattttccagaatttacaggccgtgtctgccctgctccttgtgaaggcgcttgtaccttaggtattattgaatcgcctgttggaatcaagagtgttgagcgtgctattattgacaaggcttgggaggaaggctggattgtccccagacctcctgctgaacgtactggtcgtcgtgttgccattatcggttctgggcctgcaggtcttgctgccgctgaccaactcaaccgcgctggtcaccatgtagtaatttatgagcgtgccgatcgtccaggtggtcttcttcaatatggtattcctaatatgaaactagacaagaaggttgttgagcgtcgtatccagctcatgattgacgaaggtattgaagtacttacaaacgttgaagtcggtaagaacggtgatgttagccttgatgaacttcacaaggtttacgatgctgttgttctcgcctctggctctacggttcctcgtgatttgcccattcccaaccgtgattctaagggtattcactttgccatggagttccttcacaaaaatactaagagtcttcttgatagtgaactcaaagatggcaattatattagtgctaagggcaaggatgtaattgttattggaggaggtgatactggtaatgattgtttgggtaccagtgttcgtcatggtgctaaaagtgttagaaatttggagttacttcccattcctcctcgtgaacgtgccttcgacaacccttggcctcaataccctcgtgtcttccgcgttgattatggacatgctgaagtacaagctcattatggtcaagatttccgtgaatactctattttaactaagagttttgaaaaggatgaagatggcaatgttaagggtattaatactgttcgtattgagtggactaagaacagtaagggtcgctggatcatgaaggagattcgtaactctgaggagtttttccctgcagatttagtcatccttgctttaggtttcttaggtcctgaggagcaagctactgctggaatgaacgttgatagagatgctcgttctaacatcagcactcctactaaatcgtatgaaactagtgttcctggcatttacgctgctggtgattgccgccgtggtcaaagtttggtcgtatggggtattcaagaaggtcgtcaatgtgctcgtgaaattgatttgaaattccagggtaagacatttttgcctggtgatggaggccttgtaaagcgcactgttaattgttaa

SEQ ID NO: 4672 - protein, 2111 aa, Schizosaccharomyces pombe
MAVLSSVQPINHNSALVEARDEQVNTTACSDDLLNAPPYEYDTEGNPSWAGALPKAQALYDPAYEKDSCGVGFTCHIKGQVSHKIVTDARLLLCNMTHRGATGADTRDGDGAGVMTGMPYTFMQKEFGQIGCTLPKSGEYAIGNVFFSPEADVCREAMTAFTQVAEKLGLAILAWRSVPCDNSILGPAALSREPTILQPCVVLKAAYDGEAEFDTDLFERQLYVLRKQSSHLIGKEKWFYICSLHRETIVYKGQLAPVQVYNYFLDLNNAEYVSHFALVHSRFSTNTFPSWDRAQPMRLAAHNGEINTLRGNKNWMHAREGLMKSSRFGEEFASLLPIIERGGSDSAAFDNVIELLCASGVVSLPEAVMLLIPEAWQNDKNISDEKAAFYEWAACQMEPWDGPALFTFADGRYCGANLDRNGLRPCRFYLTSDDMMICASEVGTVGIEPDRIVQKGRLYPGRMLLVDTKEGRIVDDKELKHNIASRYDFRSWLDQELIDMNSIVDSLIESTSVDLTPIVDDVPLADDKTMLAFGYTLEQINMIMAPMANGGKETLGSMGNDAAIACLSDQPRLLYDYFRQLFAQVTNPPIDPIREAIVMSLQCYIGPSGNLLEINQSQCRRLRMPTPILTVEEFNALKNVDRIYPDWKVASIDITFFKSEGVAGYAAAIERICSEADTAVNEGYKAIVLSDRNVNSERVPLASIAACGAVHHYLVQNKLRSRVALVCESGDAREVHHMCTLLGYGADAVCPYLAMEALTKLVRQNAMKPGITEETAIKNFKHAINGGILKVMSKMGISTLQSYKGAQIFEALGIDNEVINKCFLGTASRIRGVTFEHIALDAFALHERGYPTDQSIRSLQIPDMGDFYYRDGGEQHVNHPKAIASLQDAVRNKNEAAYAEFSRTHYEQTRRCTLRGMLDFDFDSSQAIPIEQVEPWTEIVRRFCTGAMSYGSISMESHSSLAIAMNRLGGKSNTGEGGEDPARSQRLANGDTMRSAIKQIASGRFGVTSWYLSDADELQIKMAQGAKPGEGGELPGNKVSESIAKTRHSTAGVGLISPPPHHDIYSIEDLKQLIYDMKSANPRARVSVKLVSEVGVGIVASGVAKAKADHILVSGHDGGTGASRWTGIKYAGLPWELGVAETHQTLVLNDLRGRVVIQTDGQIRTGRDVAIACLLGAEEWGFATTPLIALGCIMMRKCHLNTCPVGIATQDPELRKKFEGQPEHVVNFFYYVAEELRGIMAKLGFRTINEMVGRSDKLKVAEPINNKSKLLDLTPLLTPAFTLRPGAATYNVRKQDHRLYTRLDNKLIDEAEVTLEEGIPSVVECEIINTDRTLGATLSNKISKRYGEEGLPTDSIRVNVFGSAGQSFGAFLAPGVTLQLEGDCNDYVGKGLSGGRLIIYPPRVSPFKPEENMIIGNVCLYGATSGHAFISGVAAERFAVRNSGAIAVVEGVGDHGCEYMTGGRVVILGSTGRNFAAGMSGGIAYVYDMQMDFAGKINTEMVDISSVTDAAEIAFLRGLIQDHRHYTGSQVADRILSDFPRHLSRFVKVLPREYKAVLEREAAKKEEAKRLQYPKAFMPGNPIRQQIEETNAQIADVEDTLGATVKKSAPLDKLRGFMKYQRRSEHYRNPLKRTNDWKELSVRLREDELRVQTARCMDCGTPFCQSDYGCPISNKIFTWNDLVFKQQWKEALTQLLLTNNFPEFTGRVCPAPCEGACTLGIIESPVGIKSVERAIIDKAWEEGWIVPRPPAERTGRRVAIIGSGPAGLAAADQLNRAGHHVVIYERADRPGGLLQYGIPNMKLDKKVVERRIQLMIDEGIEVLTNVEVGKNGDVSLDELHKVYDAVVLASGSTVPRDLPIPNRDSKGIHFAMEFLHKNTKSLLDSELKDGNYISAKGKDVIVIGGGDTGNDCLGTSVRHGAKSVRNLELLPIPPRERAFDNPWPQYPRVFRVDYGHAEVQAHYGQDFREYSILTKSFEKDEDGNVKGINTVRIEWTKNSKGRWIMKEIRNSEEFFPADLVILALGFLGPEEQATAGMNVDRDARSNISTPTKSYETSVPGIYAAGDCRRGQSLVVWGIQEGRQCAREIDLKFQGKTFLPGDGGLVKRTVNC

SEQ ID NO: 4673 - DNA, 7056 bp, Saccharomyces cerevisiae
  CDS (263)..(6697)
acaccaaactaatcgtctccacatcataggaagataggaaattgctatctcagtcctatactacgcagacggatacctcagttgctctctttcttccccttcttttagctcattgaggtagtgattaacgtttaacttatttatttatttttctgcttcagtttttttttatttatttttgtctttctactctctcttttttcttaatctatttgccatttatttattttgaagaactagaaaaagaattagaaaagaaagcatgccagtgttgaaatcagacaatttcgatccattggaagaagcttacgaaggtgggacaattcaaaactataacgatgaacaccatcttcataaatcttgggcaaatgtgattccggacaaacgaggactttacgaccctgattatgaacatgacgcttgtggtgtcggtttcgtagcaaataagcatggtgaacagtctcacaagattgttactgacgctagatatcttttagtgaatatgacacatcgtggtgccgtctcatctgatgggaacggtgacggtgccggtattctgctaggtattcctcacgaatttatgaaaagagaattcaagttagatcttgatctagacatacctgagatgggcaaatacgccgtaggtaacgtcttcttcaagaagaacgaaaaaaataacaagaaaaatttaattaagtgtcagaagattttcgaggatttagctgcatccttcaacttatccgtattaggttggagaacgtcccgtagattctactatttaggagacgttgcattatctcgtgaacctactattctacagccattattggttccattgtatgatgaaaaacaaccggagtttaatgaaactaaatttagaactcaattgtatcttttaaggaaggaggcctctcttcaaataggactggaaaactggttctatgtttgttccctaaacaataccaccattgtttacaagggtcaattgacgccagctcaagtgtataactactatcccgacttgactaatgcgcatttcaaatcccacatggcgttggtccattcaagattttccactaatactttcccctcttgggatagagctcaacctttacgttggctagctcataatggtgaaattaacaccttaagaggtaacaagaattggatgcgctccagagaaggtgtgatgaattcagcaactttcaaagatgagttagacaaactatacccaattatcgaagaaggtggttctgattcagctgcattggataacgttttagaactattgactattaatggcacattatctctacctgaagctgttatgatgatggttcctgaagcgtatcataaggatatggattctgacctaaaagcatggtacgactgggctgcatgtctgatggaaccttgggatggtccagctttgttaactttcactgatggacgttactgtggtgctatattggatagaaatggtttaagaccttgtcgttattacatcactagtgatgacagagttatctgtgcttcagaggtaggtgtcattcctatcgaaaattcattggttgttcaaaaaggtaaactgaagccaggtgatttgattcctagtgatactcaattgggtgaaatggtcgatactaaaaagttaaaatctcaaatctcaaaaagacaagattttaagtcttggttatccaaagtcatcaagttagacgacttgttatcaaaaaccgctaatttggttcctaaagaatttatatcacaggattcattgtctttgaaagttcaaagtgacccacgtctattggccaatggttataccttcgaacaagtcacatttctgttaactccaatggctttaacaggtaaagaagctttaggttcgatgggtaacgatgcgccactggcttgtttaaatgaaaatcctgtcttactttatgattatttcagacaattgtttgctcaagtgaccaatcctccaattgacccaattcgtgaagcaaatgttatgtcgttagaatgttatgtcggacctcaaggcaaccttttggaaatgcattcatctcaatgtgatcgtttattattgaaatctcctattttgcattggaatgagttccaagctttgaaaaacattgaagctgcttacccatcatggtctgtagcagaaattgatatcacattcgacaagagtgagggtctattgggctataccgacacaattgataaaatcactaagttagcgagcgaagcaattgatgatggtaaaaagatcttaataattactgacaggaaaatgggtgccaaccgtgtttccatctcctctttgattgcaatttcatgtattcatcatcacctaatcagaaacaagcagcgttcccaagttgctttgattttggaaacaggtgaagccagagaaattcaccatttctgtgtcctactaggttatggttgtgatggtgtttatccatacttagccatggaaactttggtcagaatgaatagagaaggtctacttcgtaatgtcaacaatgacaatgatacacttgaggaagggcaaatactagaaaattacaagcacgctattgatgcaggtatcttgaaggttatgtctaaaatgggtatctccactctagcatcctacaaaggtgctcaaatttttgaagccctaggtttagataactctattgttgatttgtgtttcacaggtacttcttccagaattagaggtgtaactttcgagtatttggctcaagatgccttttctttacatgagcgtggttatccatccagacaaaccattagtaaatctgttaacttaccagaaagtggtgaataccactttagggatggtggttacaaacacgtcaacgaaccaaccgcaattgcttcgttacaagatactgtcagaaacaaaaatgatgtctcttggcaattatatgtaaagaaggaaatggaagcaattagagactgtacactaagaggactgttagaattagattttgaaaattctgtcagtatccctctagaacaagttgaaccatggactgaaattgccagaagatttgcgtcaggtgcaatgtcttatggttctatttctatggaagctcactctacattggctattgccatgaatcgtttaggggccaaatccaattgtggtgaaggtggtgaagacgcagaacgttctgctgttcaagaaaacggtgatactatgagatctgctatcaaacaagttgcttccgctagattcggtgtaacttcatactacttgtcagatgctgatgaaatccaaattaagattgctcagggtgctaagccgggtgaaggtggtgaactaccagcccacaaagtgtctaaggatatcgcaaaaaccaggcactccacccctaatgttgggttaatctctcctcctcctcatcacgatatttattccattgaagatttgaaacaactgatttatgatttgaaatgtgctaatccaagagcgggaatttctgtaaagttggtttccgaagttggtgttggtattgttgcctctggtgtagctaaggctaaagccgatcatatcttagtttctggtcatgatggtggtacaggtgctgcaagatggacgagtgtcaaatatgcgggtttgccatgggaattaggtctagctgaaactcaccagactttagtcttgaatgatttaagacgtaatgttgttgtccaaaccgatggtcaattgagaactgggtttgatattgctgttgcagttttattaggggcagaatcttttaccttggcaacagttccattaattgctatgggttgtgttatgttaagaagatgtcacttgaactcttgtgctgttggtattgccacacaagatccatatttgagaagtaagtttaagggtcagcccgaacatgttatcaacttcttctattacttgatccaagatttaagacaaatcatggccaagttaggattccgtaccattgacgaaatggtgggtcattctgaaaaattaaagaaaagggacgacgtaaatgccaaagccataaatatcgatttatctcctattttgaccccagcacatgttattcgtccaggtgttccaaccaagttcactaagaaacaagaccacaaactccacacccgtctagataataagttaatcgatgaggctgaagttactttggatcgtggcttaccagtgaatattgacgcctctataatcaatactgatcgtgcactcggttctactttatcttacagagtctcgaagaaatttggtgaagatggtttgccaaaggacaccgttgtcgttaacatagaaggttcagcgggtcaatcttttggtgctttcctagcttctggtatcacttttatcttgaatggtgatgctaatgattatgttggtaaaggtttatccggtggtattattgtcattaaaccaccaaaggattctaaattcaagagtgatgaaaatgtaattgttggtaacacttgtttctatggtgctacttctggtactgcattcatttcaggtagtgccggtgagcgtttcggtgtcagaaactctggtgccaccatcgttgttgagagaattaagggtaacaatgcctttgagtatatgactggtggtcgtgccattgtcttatcacaaatggaatccctaaacgccttctctggtgctactggtggtattgcatactgtttaacttccgattacgacgattttgttggaaagattaacaaagatactgttgagttagaatcattatgtgacccggtcgagattgcgtttgttaagaatttgatccaggagcattggaactacacacaatctgatctagcagccaggattctcggtaatttcaaccattatttgaaagatttcgttaaagtcattccaactgattataagaaagttttgttgaaggagaaagcagaagctgccaaggcaaaggctaaggcaacttcagaatacttaaagaagtttagatcgaaccaagaagttgatgacgaagtcaatactctattgattgctaatcaaaaagctaaagagcaagaaaaaaagaagagtattactatttcaaataaggccactttgaaggagcctaaggttgttgatttagaagatgcagttccagattccaaacagctagagaagaatagcgaaaggattgaaaaaacacgtggttttatgatccacaaacgtcgtcatgagacacacagagatccaagaaccagagttaatgactggaaagaatttactaaccctattaccaagaaggatgccaaatatcaaactgcgagatgtatggattgtggtacaccattctgtttatctgataccggttgtcccctatctaacattatccccaagtttaatgaattgttattcaagaaccaatggaagttggcactggacaaattgctagagacaaacaatttcccagaattcactggaagagtatgtccagcaccctgtgagggagcttgtacactaggtattattgaagacccactcggcataaaatcggttgaaagaattatcattgacaatgctttcaaggaaggatggattaagccttgtccaccaagtacacgcactggctttacagtgggtgtcattggttctggtccagcaggtttagcgtgtgctgatatgttgaaccgtgccggacatacggtcactgtttatgaaagatccgaccgttgtggtgggttattgatgtatggtattccaaacatgaagttggataaggctatagtgcaacgtcgtattgatctattgagtgccgaaggtattgactttgttaccaacaccgaaattggtaaaaccataagcatggatgagctaaagaacaagcacaatgcagtagtgtatgctatcggttctaccattccacgtgacttacctattaagggtcgtgaattgaagaatattgattttgccatgcagttgttggaatctaacacaaaagctttattgaacaaagatctggaaatcattcgtgaaaagatccaaggtaagaaagtaattgttgtcggtggtggtgacacaggtaacgattgtttaggtacatctgtaagacacggtgcagcatcagttttgaatttcgaattgttgcctgagccaccagtggaacgtgccaaagacaatccatggcctcaatggccgcgtgtcatgagagtggactacggtcatgctgaagtgaaagagcattatggtagagaccctcgtgaatactgcatcttgtccaaggaatttatcggtaacgatgagggtgaagtcactgccatcagaactgtgcgcgtagaatggaagaagtcacaaagtggcgtatggcaaatggtagaaattcccaacagtgaagagatctttgaagccgatatcattttgttgtctatgggtttcgtgggtcctgaattgatcaatggcaacgataacgaagttaagaagacaagacgtggtacgattgccacactcgacgactcctcatactctattgatggaggaaagacttttgcatgtggtgactgtagaagagggcaatctttgattgtctgggccatccaagaaggtagaaaatgtgctgcctctgtcgataagttcctaatggacggcactacgtatctaccaagtaatggtggtatcgttcaacgtgattacaaactattgaaagaattagctagtcaagtctaaaaagcttgagttattatttattttatgatcgtatattatttatttatttatttatttatttatttatttatttatttatttatttattttatttagtttattaattttgctgatgaatgttatttcaattaaacatagttttcaaagaactgaaaaaccctgatttcttcttcttcttcttcttcttctctttaccattgtcatctttcaaattaaacttatcttcatcatcatcgtttaagttatggttgatagtgttcctgcttgactttggagaaattatgtttccagcgccacctcttccaatagcaaatttttccggtgcgcttttgcccttgagcttattttaggcttcttgg

SEQ ID NO: 4674 - protein, 2144 aa, Saccharomyces cerevisiae
MPVLKSDNFDPLEEAYEGGTIQNYNDEHHLHKSWANVIPDKRGLYDPDYEHDACGVGFVANKHGEQSHKIVTDARYLLVNMTHRGAVSSDGNGDGAGILLGIPHEFMKREFKLDLDLDIPEMGKYAVGNVFFKKNEKNNKKNLIKCQKIFEDLAASFNLSVLGWRTSRRFYYLGDVALSREPTILQPLLVPLYDEKQPEFNETKFRTQLYLLRKEASLQIGLENWFYVCSLNNTTIVYKGQLTPAQVYNYYPDLTNAHFKSHMALVHSRFSTNTFPSWDRAQPLRWLAHNGEINTLRGNKNWMRSREGVMNSATFKDELDKLYPIIEEGGSDSAALDNVLELLTINGTLSLPEAVMMMVPEAYHKDMDSDLKAWYDWAACLMEPWDGPALLTFTDGRYCGAILDRNGLRPCRYYITSDDRVICASEVGVIPIENSLVVQKGKLKPGDLIPSDTQLGEMVDTKKLKSQISKRQDFKSWLSKVIKLDDLLSKTANLVPKEFISQDSLSLKVQSDPRLLANGYTFEQVTFLLTPMALTGKEALGSMGNDAPLACLNENPVLLYDYFRQLFAQVTNPPIDPIREANVMSLECYVGPQGNLLEMHSSQCDRLLLKSPILHWNEFQALKNIEAAYPSWSVAEIDITFDKSEGLLGYTDTIDKITKLASEAIDDGKKILIITDRKMGANRVSISSLIAISCIHHHLIRNKQRSQVALILETGEAREIHHFCVLLGYGCDGVYPYLAMETLVRMNREGLLRNVNNDNDTLEEGQILENYKHAIDAGILKVMSKMGISTLASYKGAQIFEALGLDNSIVDLCFTGTSSRIRGVTFEYLAQDAFSLHERGYPSRQTISKSVNLPESGEYHFRDGGYKHVNEPTAIASLQDTVRNKNDVSWQLYVKKEMEAIRDCTLRGLLELDFENSVSIPLEQVEPWTEIARRFASGAMSYGSISMEAHSTLAIAMNRLGAKSNCGEGGEDAERSAVQENGDTMRSAIKQVASARFGVTSYYLSDADEIQIKIAQGAKPGEGGELPAHKVSKDIAKTRHSTPNVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAVLLGAESFTLATVPLIAMGCVMLRRCHLNSCAVGIATQDPYLRSKFKGQPEHVINFFYYLIQDLRQIMAKLGFRTIDEMVGHSEKLKKRDDVNAKAINIDLSPILTPAHVIRPGVPTKFTKKQDHKLHTRLDNKLIDEAEVTLDRGLPVNIDASIINTDRALGSTLSYRVSKKFGEDGLPKDTVVVNIEGSAGQSFGAFLASGITFILNGDANDYVGKGLSGGIIVIKPPKDSKFKSDENVIVGNTCFYGATSGTAFISGSAGERFGVRNSGATIVVERIKGNNAFEYMTGGRAIVLSQMESLNAFSGATGGIAYCLTSDYDDFVGKINKDTVELESLCDPVEIAFVKNLIQEHWNYTQSDLAARILGNFNHYLKDFVKVIPTDYKKVLLKEKAEAAKAKAKATSEYLKKFRSNQEVDDEVNTLLIANQKAKEQEKKKSITISNKATLKEPKVVDLEDAVPDSKQLEKNSERIEKTRGFMIHKRRHETHRDPRTRVNDWKEFTNPITKKDAKYQTARCMDCGTPFCLSDTGCPLSNIIPKFNELLFKNQWKLALDKLLETNNFPEFTGRVCPAPCEGACTLGIIEDPLGIKSVERIIIDNAFKEGWIKPCPPSTRTGFTVGVIGSGPAGLACADMLNRAGHTVTVYERSDRCGGLLMYGIPNMKLDKAIVQRRIDLLSAEGIDFVTNTEIGKTISMDELKNKHNAVVYAIGSTIPRDLPIKGRELKNIDFAMQLLESNTKALLNKDLEIIREKIQGKKVIVVGGGDTGNDCLGTSVRHGAASVLNFELLPEPPVERAKDNPWPQWPRVMRVDYGHAEVKEHYGRDPREYCILSKEFIGNDEGEVTAIRTVRVEWKKSQSGVWQMVEIPNSEEIFEADIILLSMGFVGPELINGNDNEVKKTRRGTIATLDDSSYSIDGGKTFACGDCRRGQSLIVWAIQEGRKCAASVDKFLMDGTTYLPSNGGIVQRDYKLLKELASQV

SEQ ID NO: 4675 - DNA, 1449 bp, Azospirillum brasilense
  CDS (1)..(1449)
atggcgaaccagaggatgttgggcttcgtgcacaccgcgcagcggatgcccgacaaacgcccggccgcggagcgccgccaggatttcgccgagatctacgcccgcttctccgacgagcgcgccaacgagcaggccaaccgctgctcgcagtgcggcgttcccttctgccaggtgcactgcccggtctccaacaacatccccgactggttgaagctgacctccgaaggccggctggaggaggcgtacgaggtctcccaggccaccaacaacttcccggagatctgcggccgcatctgcccgcaggaccgcctgtgcgaaggcaactgcgtcatcgagcagtccacccacggcgccgtcaccatcgggtcggtggagaagtacatcaacgacaccgcctgggatcagggctgggtgaagccgcgcacgccgtcgcgcgagctgggcctgtcggtcggcgtcatcggcgccggtcccgccggcctcgccgccgccgaggaactgcgcgccaagggctacgaggtgcacgtctacgaccgctacgaccgcatgggcggcctgctggtctacggcatccccggcttcaagctggagaagtcggtggtcgagcgccgcgtgaagctgctggccgacgccggggtgatctaccacccgaacttcgaggtcggccgcgacgcctccctgccggagctgcgccgcaagcacgtcgccgtgctggtcgccacgggcgtctacaaggcgcgcgacatcaaggcgccgggctcgggcctgggcaacatcgtggcggcgttggactatctgaccacctccaacaaggtcagcctgggcgacacggtggaggcgtacgagaacggctccctgaacgccgcgggcaagcatgtggtggtgctgggcggcggcgacaccgccatggactgcgtgcgcacggccatccgccagggcgccacgtcggtcaagtgtctgtaccgccgcgaccgcaagaacatgccgggctcgcagcgcgaggtcgcccacgccgaggaagagggcgtggagttcatctggcaggccgcccccgaaggcttcaccggcgatacggtggtgaccggcgtgcgcgccgtgcgcatccatctgggtgtcgccgacgccaccggccgccagaccccgcaggtgatcgaggggtcggagttcaccgtccaggctgatctggtcatcaaggcgctcggcttcgagcccgaggacctgccgaacgccttcgacgagccggaactgaaggtgacccgctggggcacgctgctggtcgatcatcgcaccaagatgaccaacatggacggagtcttcgccgccggtgatatcgtgcgcggcgcctcgctggtggtgtgggccatccgcgacggccgcgacgcggccgagggcatccacgcctacgccaaggcgaaggccgaggcaccggttgccgtggcggctgaataa

SEQ ID NO: 4676 - protein, 482 aa, Azospirillum brasilense
MANQRMLGFVHTAQRMPDKRPAAERRQDFAEIYARFSDERANEQANRCSQCGVPFCQVHCPVSNNIPDWLKLTSEGRLEEAYEVSQATNNFPEICGRICPQDRLCEGNCVIEQSTHGAVTIGSVEKYINDTAWDQGWVKPRTPSRELGLSVGVIGAGPAGLAAAEELRAKGYEVHVYDRYDRMGGLLVYGIPGFKLEKSVVERRVKLLADAGVIYHPNFEVGRDASLPELRRKHVAVLVATGVYKARDIKAPGSGLGNIVAALDYLTTSNKVSLGDTVEAYENGSLNAAGKHVVVLGGGDTAMDCVRTAIRQGATSVKCLYRRDRKNMPGSQREVAHAEEEGVEFIWQAAPEGFTGDTVVTGVRAVRIHLGVADATGRQTPQVIEGSEFTVQADLVIKALGFEPEDLPNAFDEPELKVTRWGTLLVDHRTKMTNMDGVFAAGDIVRGASLVVWAIRDGRDAAEGIHAYAKAKAEAPVAVAAE

SEQ ID NO: 4677 - DNA, 27 bp, artificial sequence
  primer
atgagtcagaatgtttatcaatttatc

SEQ ID NO: 4678 - DNA, 26 bp, artificial sequence
  primer
ttaaacttccagccagttcataatac

SEQ ID NO: 4679 - DNA, 1434 bp, Escherichia coli K12
  CDS (1)..(1434)
atgcaggttttacatgtatgttcagagatgttcccgctgcttaaaaccggcggtctggctgatgttattggggcattacccgcagcacaaatcgcagacggcgttgacgctcgcgtactgttgcctgcatttcccgatattcgccgtggcgtgaccgatgcgcaggtagtatcccgtcgtgataccttcgccggacatatcacgctgttgttcggtcattacaacggggttggcatttacctgattgacgcgccgcatctctatgatcgtccgggaagcccgtatcacgataccaacttatttgcctataccgacaacgtattgcgttttgcgctgctggggtgggttggggcagaaatggccagcgggcttgacccattctggcgtcctgatgtggtgcatgcgcacgactggcatgcaggccttgcgcctgcgtatctggcggcgcgcgggcgtccggcgaagtcggtgtttactgtgcacaacctggcctatcaaggcatgttttatgcacatcacatgaatgacatccaattgccatggtcattctttaatattcatgggctggaattcaacggacaaatctctttcctgaaggccggtctgtactatgccgatcacattacggcggtcagtccaacctacgctcgcgagatcaccgaaccgcagtttgcctacggtatggaaggtctgttgcaacagcgtcaccgtgaagggcgtctttccggcgtactgaacggcgtggacgagaaaatctggagtccagagacggacttactgttggcctcgcgttacacccgcgatacgttggaagataaagcggaaaataagcgccagttacaaatcgcaatggggcttaaggttgacgataaagtgccgctttttgcagtggtgagccgtctgaccagccagaaaggtctcgacctggtgctggaagccttaccgggtcttctggagcagggcgggcagctggcgctactcggcgcgggcgatccggtgctgcaggaaggtttccttgcggcggcagcggaataccccggtcaggtgggcgttcagattggctatcacgaagcattttcgcatcgcattatgggcggcgcggacgtcattctggtgcccagccgttttgaaccgtgcggcttaacgcaactttatggattgaagtacggtacgctgccgttagtgcggcgcaccggtgggcttgctgatacggtttctgactgttctcttgagaaccttgcagatggcgtcgccagtgggtttgtctttgaagatagtaatgcctggtcgctgttacgggctattcgacgtgcttttgtactgtggtcccgtccttcactgtggcggtttgtgcaacgtcaggctatggcaatggattttagctggcaggtcgcggcgaagtcgtaccgtgagctttactatcgcttgaaatag

SEQ ID NO: 4680 - protein, 477 aa, Escherichia coli K12 [sequence omitted]

SEQ ID NO: 4681 - DNA, 1314 bp, Pyrococcus abyssi
  CDS (1)..(1314)
atgaaggtgttattgcttggatttgagtttcttccggttaaagtgggaggccttgctgaggcccttacggcgatatctgaggctttagcatccctcggtcatgaggttctggtatttacaccttcacatggaaggtttcagggtgaggaaataggtaagattagagtctttggggaagaagtccaggtaaaggtaagttacgaggagagagggaacctaaggatatatagaatagggggaggtcttctcgattccgaagatgtttacggcccaggatgggatggtttaattagaaaagctgtaacttttggaagggcaagtgttttgctattgaacgatcttcttagggaggaaccccttccagatgtcgttcacttccatgactggcatacggtatttgcgggggcattaataaagaagtacttcaagatccccgcggttttcacaatacatagactgaacaaatcaaaattgccggctttctacttccatgaagcgggattgtctgagttggctccttatccagatatagatccagagcacactgggggatacatagctgatatcgtgacaaccgtaagtaggggatacctaattgacgaatggggtttctttagaaacttcgagggcaaaataacttacgtcttcaatgggattgattgtagcttttggaacgagtcatatttaacgggaagtagggatgagaggaagaaatccctgctctcaaagtttggaatggacgaaggagtaacattcatgttcattggaaggttcgataggggccaaaagggcgttgatgttctattgaaggcaattgaaattctgtcatctaagaaagaattccaggaaatgagatttataataattggaaagggagatcctgaacttgaaggttgggctagaagccttgaggagaagcatggaaatgtgaaagttatcacggagatgctatcaagggaattcgttagggaactttacggctctgtggatttcgttattataccatcttactttgaaccattcggtttagtggctttagaggcaatgtgtttgggggcgatccctatagcttcagcagttggagggcttagggatatcataacgaacgaaacgggaatcctcgtgaaggctggcgatcctggagaattggcaaatgctatcttaaaggcccttgaactttctaggagcgatctaagtaaattcagggaaaactgcaaaaagagagcaatgtcattttcctgggaaaaatcggcggagagatacgtaaaagcatatacaggaagtatagatagggcgtttgacttcatcctatga

SEQ ID NO: 4682 - protein, 437 aa, Pyrococcus abyssi
MKVLLLGFEFLPVKVGGLAEALTAISEALASLGHEVLVFTPSHGRFQGEEIGKIRVFGEEVQVKVSYEERGNLRIYRIGGGLLDSEDVYGPGWDGLIRKAVTFGRASVLLLNDLLREEPLPDVVHFHDWHTVFAGALIKKYFKIPAVFTIHRLNKSKLPAFYFHEAGLSELAPYPDIDPEHTGGYIADIVTTVSRGYLIDEWGFFRNFEGKITYVFNGIDCSFWNESYLTGSRDERKKSLLSKFGMDEGVTFMFIGRFDRGQKGVDVLLKAIEILSSKKEFQEMRFIIIGKGDPELEGWARSLEEKHGNVKVITEMLSREFVRELYGSVDFVIIPSYFEPFGLVALEAMCLGAIPIASAVGGLRDIITNETGILVKAGDPGELANAILKALELSRSDLSKFRENCKKRAMSFSWEKSAERYVKAYTGSIDRAFDFIL

SEQ ID NO: 4683 - DNA, 1425 bp, Chlamydia muridarum, Chlamydia trachomatis MoPn
  CDS (1)..(1425)
atgaaaattactcacacagctatcgaatttgctccggtaatcaaagccggtggcttaggagacgcactatacggactagcaaaagctttagccgtcaatcatacaacagaagtcgttatccctttatatcccaaattattcacttcgctccacgagcaggatcttttcgcaactcaaaaaatcccttatttttttgccggagaacaagaagcaacagccttctcttatttttatgaaggaatcaaagtaactctactcaaattagactcgcagccagaactatttgaagaagcagaaacgatctatacaaacgatgatgcttttcgtttttgtgctttttctgctgctgctgctgcttacattcaaaaagaaggagcagacattgttcacctgcatgattggcatgttggattagtcgcagggttactcaaacaacagccttgcccccagctacaaaaaatcgtgcttaccttacataattttggctatcggggatatacaacacgagaagtattagaagcgtcttctttgaacgaattttacttgagccactatcaactatttcgcgatccacaaacctgcgtcttattaaaaggagctttatactgttcggactttgtgactacagtttctcctacatatgccaaagaaatccttcaagactattcggactatgaaattcatgacgccattaccgctagacaacatcatcttaaagggatcctgaatggaatagactatacgattttggaccctgaaacagacccccatttagctaagaactatagtaaagtccttttcgaggatcctaaagctttcttcgaagcaaaagcggaaaataaaaaagctctgtacgaaacgttaggactgtctttagacaaatccccctgcatgtgcatcatttctagaattgctgagcaaaaaggcccagaatttatgaagcaagcaattcttcatgcactagaaaacgcctataccctgatcattataggcacctgctatggaggccagatacataaagaattttctaatcttcaagaatctttagcagactcccctaacgtgcggattcttttaacctatagcgatgtactagcacggcaaatttttgctgcagcagatatgatctgcattccctctatgtttgaaccatgcggactcacccaaatgattggcatgcgctatgggaccgtccccgtagtaagagctacaggaggtctggctgacaccgtaacagatggagtaaatggattctctttctctaaccctcatgatttccacgagtttcgaaatatgctttcaaaagcgattgccacctaccgagacgaccaagataagtggcaacagattgttcgctcttgcttagagttttcttcggacttagaaactgcagccaataaatatttagaaatttatcaacaataa

SEQ ID NO: 4684 - protein, 474 aa, Chlamydia muridarum, Chlamydia trachomatis MoPn
MKITHTAIEFAPVIKAGGLGDALYGLAKALAVNHTTEVVIPLYPKLFTSLHEQDLFATQKIPYFFAGEQEATAFSYFYEGIKVTLLKLDSQPELFEEAETIYTNDDAFRFCAFSAAAAAYIQKEGADIVHLHDWHVGLVAGLLKQQPCPQLQKIVLTLHNFGYRGYTTREVLEASSLNEFYLSHYQLFRDPQTCVLLKGALYCSDFVTTVSPTYAKEILQDYSDYEIHDAITARQHHLKGILNGIDYTILDPETDPHLAKNYSKVLFEDPKAFFEAKAENKKALYETLGLSLDKSPCMCIISRIAEQKGPEFMKQAILHALENAYTLIIIGTCYGGQIHKEFSNLQESLADSPNVRILLTYSDVLARQIFAAADMICIPSMFEPCGLTQMIGMRYGTVPVVRATGGLADTVTDGVNGFSFSNPHDFHEFRNMLSKAIATYRDDQDKWQQIVRSCLEFSSDLETAANKYLEIYQQ

SEQ ID NO: 4685 - DNA, 1434 bp, Clostridium acetobutylicum
  CDS (1)..(1434)
atgaaaattttatttgcttcttctgaaagttatccttttataaaaacaggtgggcttggtgatgtatcctatgcccttcctaaagctttaagaaaaataggaattgatgcaagagtaataattccaaaatattcagatatacctgaatactttagatataatactcaccatattgcaagttttggtgttccagttggctggaggagtcagtatggaggccttgaatactatgaatacgatggagttcctttttacttcatagataacgactactatttcaaaagatctggactttatggatactatgatgatggagaacgcttcgcctatttttcaagaggagtacttcaagccataacttatatgcaggactttaatccagatattattcaatgcaacgattggcaaacagcgataatacctgttcttcttaaagatcattatcgaaattacagaaactataatcatataaaaactatatttacaatacacaatctaaaatatcaaggtgtttttggaaaatcagtacttggagagcttttgtgtttaaatgaaggctattataacgaaaatgcattaaagttttacgatggtatttcctttatgaaaggcggtattttattttcagataaactttcaactgtaagcagaacttatgctgaagaaattaaagacccttattatggagaacatcttgatggcttacttagaagtcgttcttatgacttatggggtattgtaaatggaattgattacgatatattaaatcctgaaacagacaaagacttgttttttaattttgattcttcaaccttgtataataaaacaaaaaataaaatagagcttcaaaaaatgctgaatttacctgtgtcagaaaatataccaatgataggtatagtctctagacttgtaagtcaaaaaggtttagatttaatttcctgcgttttagaagacttacttcaagatggaatacaacttgtagtacttggtactggtgatgctaaatatgaaaatatgtttaaatatttcgcatggaagtacccaaataaactatctgcaaatattcaattcaataacagcttagctcaaaaaatatatggtgcatccgatatgttcttaatgccttcaaaattcgaaccttgtggtataggacaattaatagctcttagatacggtagtctccctatagtacgtgagacaggaggtcttaaagacactgtaagaccttttaatccaataacaggtgaaggaaatggtttctcttttaccaattataatgcacatgatatgctgcatgttataagaaatgcagaatatttctattacaacgaaaaatacaattggaataagcttgtacaaactgcaatgaatgatgataacagttggagtaaatcagcagaaatttacagaaatttgtacatgtcagtactttaa

SEQ ID NO: 4686 - protein, 477 aa, Clostridium acetobutylicum
MKILFASSESYPFIKTGGLGDVSYALPKALRKIGIDARVIIPKYSDIPEYFRYNTHHIASFGVPVGWRSQYGGLEYYEYDGVPFYFIDNDYYFKRSGLYGYYDDGERFAYFSRGVLQAITYMQDFNPDIIQCNDWQTAIIPVLLKDHYRNYRNYNHIKTIFTIHNLKYQGVFGKSVLGELLCLNEGYYNENALKFYDGISFMKGGILFSDKLSTVSRTYAEEIKDPYYGEHLDGLLRSRSYDLWGIVNGIDYDILNPETDKDLFFNFDSSTLYNKTKNKIELQKMLNLPVSENIPMIGIVSRLVSQKGLDLISCVLEDLLQDGIQLVVLGTGDAKYENMFKYFAWKYPNKLSANIQFNNSLAQKIYGASDMFLMPSKFEPCGIGQLIALRYGSLPIVRETGGLKDTVRPFNPITGEGNGFSFTNYNAHDMLHVIRNAEYFYYNEKYNWNKLVQTAMNDDNSWSKSAEIYRNLYMSVL

SEQ ID NO: 4687 - DNA, 1431 bp, Yersinia pestis
  CDS (1)..(1431)
atgagggttttacatgtatgttctgagctgttccctttactaaaaacaggcgggttggctgatgttatcggtgctttacccgcagctcagcttgccgagggggctgatgtgcggatcatcttgcccgccttcccggatttgcgtagagggatccctgagaccgtactggtcagggagattgacacttttgcggggcgggtagcattacgctatggccattatcgggggattggcatttatctgattgatgcgccagcgctctatgatcgtgcgggtagcccttatcacgatgcttctttatatgcctatagcgataactatctacgctttgccttgctgggatggatggcgtgcgaactggcttgtggcctggacggttactggcgtccagaggttgtccatgcccatgattggcacgcgggattaacctgtgcttatctggctgcgcgtgggcggcctgcacgatcggtgtttaccgtccataatttggcttatcaggggctattttctgcagatcacttatctgaattacacctgcccgctgagtttttccagatctatgggctggagttttacgggcagatctcttatctgaaagccgggttgttctttgccgaccatgtcacgaccgtcagcccgacctatgcaaaagagatcactcagcctgcttttggctatggcatggaggggttgctacaagcattggcgcgtcaaggccggttgacggggatcctgaacggggtcgacagtgatatttgggatccgcagagcgataccttgctacctactcgttatgatgcggagaacctgcaagcaaaggccatcaataaaacacatttgcaaacggctatgggtttgcaactggcagaaaataaacccatttttgctgttgtcagtcgattgaccgtccagaaagggttggatctggtattggaagcactgcccgaattactggcactgggggggcagttggtcgtcttggggagcggagatgccacgctgcaagaggcatttctagccgccgcagcagagcattctggccaggttggggtgcaaataggttatcacgaggcattctctcatcgaattattgccgggtcggatgtcattctggtgcccagccgctttgaaccctgtgggctaacacagttgtatgggttgaaatatggcacgttgccgctggtgcgacataccggtgggctggctgataccgtggtggattgcgcgttggaaaacctggctgacggcagcgcttcgggatttgtattcaatgaatgtgaggcgcaagccttagtgaaggcgatacgccgtgcctttgtactgtggagcaggccgaagcattggcgtcacgtccagcgccatgcgatgaggctcgactttggttggcaacttgccgccgtagattatttgtcactttatcgacgtctgtaa

SEQ ID NO: 4688 - protein, 476 aa, Yersinia pestis
MRVLHVCSELFPLLKTGGLADVIGALPAAQLAEGADVRIILPAFPDLRRGIPETVLVREIDTFAGRVALRYGHYRGIGIYLIDAPALYDRAGSPYHDASLYAYSDNYLRFALLGWMACELACGLDGYWRPEVVHAHDWHAGLTCAYLAARGRPARSVFTVHNLAYQGLFSADHLSELHLPAEFFQIYGLEFYGQISYLKAGLFFADHVTTVSPTYAKEITQPAFGYGMEGLLQALARQGRLTGILNGVDSDIWDPQSDTLLPTRYDAENLQAKAINKTHLQTAMGLQLAENKPIFAVVSRLTVQKGLDLVLEALPELLALGGQLVVLGSGDATLQEAFLAAAAEHSGQVGVQIGYHEAFSHRIIAGSDVILVPSRFEPCGLTQLYGLKYGTLPLVRHTGGLADTVVDCALENLADGSASGFVFNECEAQALVKAIRRAFVLWSRPKHWRHVQRHAMRLDFGWQLAAVDYLSLYRRL

SEQ ID NO: 4689 - DNA, 1443 bp, Agrobacterium tumefaciens
  CDS (1)..(1443)
atgaatgtcctttcggtttcatccgaaatttatcccctgatcaagaccggagggctcgccgacgttgtcggcgcgctccccatcgcgctcgaagcccatggcgtcagaacgcggacattgatacccggctatccggcggtgaaagccgccgtgacggaccccgtcaaatgttttgagttcaccgacctgcttggcgaaaaggccgatctgctcgaagtccaacacgagaggctagaccttttgatcctcgacgcgcccgcctattacgagcgttccggcggcccctatctcggccagaccggcaaggattatcctgataactggaagcgttttgcggcgctgtcactggcggcggcgcggatcggcgccggtgtgctccccggctggcggccggatatggtgcacgcgcatgactggcaggccgccatgacgcctgtctatatgcgttacgccgaaacaccggaaattccgagccttctcaccatccacaacattgcctttcagggccagttcggcgcaaacatcttcagcaaacttgccctgcccgcccacgccttcggcatggagggcatcgaatattacaacgacgtcagcttcctcaagggcggcttgcagacggcaaccgcgctcagcacggtcagcccatcctatgcggaagaaatcctgaccgcggaattcggcatggggcttgaaggggtgatcggcagccgcgcccatgtgctgcacggcatcgtcaacggcatcgacgccgatgtctggaacccggccaccgaccatctgatccacgacaattattccgccgccaatctcaagaaccgtgccctgaacaagaaggcggtcgccgaacatttccgtatcgatgatgatggcagcccgctattctgcgtcatctcccgcctcacctggcagaagggcatcgacctcatggcggaagccgtggatgagatcgtttccctcggcggccgcctggtcgtgctgggcgcgggcgatgtggcactggaaggcgcgcttcttgcggcggcatcccgccaccatggacgcgtcggtgttgccatcggttacaacgagccgctgtcgcatctcatgcaggcgggttgcgacgcgatcatcattccctctcgcttcgagccctgcggcctgacccagctttacgcgttgcgttacggctgcattccggtcgtcgcccgcaccggcggccttgccgacaccgtgattgacgccaaccatgccgccctcgccagcaaggcggcaactggcgtacaattttcacccgtcacacttgacggtctgaaacaggcgatccgccggaccgtccgttattatcacgacccgaaactgtggacacaaatgcagaaactcggaatgaaatccgatgtttcctgggaaaaaagcgccggtctctacgccgcgctttatagccagcttatttcgaaaggccattga

SEQ ID NO: 4690 - protein, 480 aa, Agrobacterium tumefaciens
MNVLSVSSEIYPLIKTGGLADVVGALPIALEAHGVRTRTLIPGYPAVKAAVTDPVKCFEFTDLLGEKADLLEVQHERLDLLILDAPAYYERSGGPYLGQTGKDYPDNWKRFAALSLAAARIGAGVLPGWRPDMVHAHDWQAAMTPVYMRYAETPEIPSLLTIHNIAFQGQFGANIFSKLALPAHAFGMEGIEYYNDVSFLKGGLQTATALSTVSPSYAEEILTAEFGMGLEGVIGSRAHVLHGIVNGIDADVWNPATDHLIHDNYSAANLKNRALNKKAVAEHFRIDDDGSPLFCVISRLTWQKGIDLMAEAVDEIVSLGGRLVVLGAGDVALEGALLAAASRHHGRVGVAIGYNEPLSHLMQAGCDAIIIPSRFEPCGLTQLYALRYGCIPVVARTGGLADTVIDANHAALASKAATGVQFSPVTLDGLKQAIRRTVRYYHDPKLWTQMQKLGMKSDVSWEKSAGLYAALYSQLISKGH

SEQ ID NO: 4691 - DNA, 1479 bp, Nostoc sp. PCC 7120
  CDS (1)..(1479)
atgtacattgtacagattgcctcggaatgcgctcctgtaattaaggcagggggtttaggggatgtcgtttacggattgagtcgagaattagagattcggggcaattgcgtcgagctaattctgcctaagtatgattgtatgcgctacgaccatgtttggggactgcacgaggcttacttaaacttgtgggttccctggtttggtgcagcaattcactgtactgtctactgcggttgggtacatgggcgagtatgttttttcattgaaccccattccgaggacaatttctttaatcggggctgctattacggttgtgatgatgatgatatgcgctttgccttttttagcaaagccgctttagaatttctccatcaaagcaataagcgccctgatattatccattgtcatgattggcaaacaggcttaattcctgtcatgctctatgagatctacaagtatcatggcatggacacccaacgggtttgctacaccatccacaactttaaacatcaaggaattggtggtgtcaaaactctctgggcgacagggttaaacagagaagcttattacttccaagatgacaagctaagggatgaccataacccctttgcattgaattacatgaaaggcggtatagtctactcgaacgctgtcaccacagtttcaccaaaccacgccttagaagcacaatatacagacgttggttgtggcttaggtcatactttgtatctacacaaagaaaaatttagcggggttctcaacggtattgattacgatttttggaatccagaaattgaccgtcacatccccgataactacagccaagacgattttgaacaaaaactatataacaaaaaagctttgcgtgagcgcttgttgttgcaagctgctgataaaccaatcattgcttacatcgggcgtttagataatcaaaaaggcgtgcatcttgtccaccatgccatttatcatgccttgaataaaggagcgcaatttgtattattgggttcagcaacagaagcaggaatcaatgctcattttcgtcatgaaaaacagtttttaaatagcaatcctgatgtccatttagaattgggctttaacgaagagttgtctcatctgatttatgccggggctgatatgattgttgttcccagcaattatgaaccctgcggtttaacgcaaatgattggtttgaagtatggtactgttcccattgtgcgcggtgttggtggactggtaaatacagtatttgaccgagattacgatcaaaatttaccaccagaaaaacgcaatggttatgtattttatcaatctgataaccaagctttagagtcagcaatgaatcgggcaattgatttgtggtatcagtctcctgaacagttccaacaattagcgattcagggaatgaaatatgactactcatggaataatccaggcacggaatatttaaatatttacgaatggattaagtacaaatggtag

SEQ ID NO: 4692 - protein, 492 aa, Nostoc sp. PCC 7120
MYIVQIASECAPVIKAGGLGDVVYGLSRELEIRGNCVELILPKYDCMRYDHVWGLHEAYLNLWVPWFGAAIHCTVYCGWVHGRVCFFIEPHSEDNFFNRGCYYGCDDDDMRFAFFSKAALEFLHQSNKRPDIIHCHDWQTGLIPVMLYEIYKYHGMDTQRVCYTIHNFKHQGIGGVKTLWATGLNREAYYFQDDKLRDDHNPFALNYMKGGIVYSNAVTTVSPNHALEAQYTDVGCGLGHTLYLHKEKFSGVLNGIDYDFWNPEIDRHIPDNYSQDDFEQKLYNKKALRERLLLQAADKPIIAYIGRLDNQKGVHLVHHAIYHALNKGAQFVLLGSATEAGINAHFRHEKQFLNSNPDVHLELGFNEELSHLIYAGADMIVVPSNYEPCGLTQMIGLKYGTVPIVRGVGGLVNTVFDRDYDQNLPPEKRNGYVFYQSDNQALESAMNRAIDLWYQSPEQFQQLAIQGMKYDYSWNNPGTEYLNIYEWIKYKW

SEQ ID NO: 4693 - DNA, 1419 bp, Nostoc sp. PCC 7120
  CDS (1)..(1419)
atgcggattctatttgtggcagcagaagcagcacccattgcaaaagtaggagggatgggtgatgttgtcggtgcattacctaaggtcttgagaaaaatggggcatgatgtacgtatcttcttgccctattacggctttttgccagacaaaatggagattcccaaagatccaatatggaagggatacgccatgtttcaggactttacagttcacgaagcagttctgcctggtactgatgttcccttgtatttatttggacatccagcctttaccccccggcggatttattcgggagatgatgaagactggcgcttcaccttgttttccaatggtgcggctgagttttgctggaattactggaaacccgacattattcactgtcatgattggcacacgggcatgattcctgtgtggatgaaccaatcaccagatatcaccacagtcttcactatccacaatctggcttaccaagggccttggcgttggtatttagataaaattacttggtgtccttggtatatgcagggacacaacacaatggcggcggctgtccagtttgcggacagggtaaatacagtttctcccacatacgccgagcaaatcaagaccccggcttacggtgagaaaatagaaggtttgctgtctttcatcagtggtaaattatctgggattgttaacggtatagatacggaagtttacgacccagctaatgataaatatattgctcaaacgttcactgccgatactttagataaacgcaaagccaacaaaattgctttacaagaagaagtaggattagaagttaacagcaatgcctttttaattggcatggtgacaaggttagtcgagcagaagggcttagatttagtcatccaaatgctcgatcgctttatggcttatactgatgctcagttcgtcttgttgggaacaggcgatcgctactacgaaacccaaatgtggcaattagcatcccgctaccccggtcgtatggctacttacctcctgtataacgatgccctatctcgccgcatctacgctggtactgatgcctttttgatgcccagtcgctttgaaccatgcggtattagtcaaatgatggctttacgctacggttccattcccatcgtccgccgcactggaggcttggttgacaccgtatcccaccacgaccccatcaacgaagcaggtacaggctactgcttcgaccgctacgaacccctcgacttatttacctgcatgattcgcgcctgggaaggcttccgctacaaaccacaatggcaagaactacaaaaacgcggtatgagtcaagacttcagctggtacaaatccgctaaggaatacgacaaactctatcgctcaatgtacggtttgccagacccagaagagacacagccggagttaattctgacaaatcagtag

SEQ ID NO: 4694 - protein, 472 aa, Nostoc sp. PCC 7120
MRILFVAAEAAPIAKVGGMGDVVGALPKVLRKMGHDVRIFLPYYGFLPDKMEIPKDPIWKGYAMFQDFTVHEAVLPGTDVPLYLFGHPAFTPRRIYSGDDEDWRFTLFSNGAAEFCWNYWKPDIIHCHDWHTGMIPVWMNQSPDITTVFTIHNLAYQGPWRWYLDKITWCPWYMQGHNTMAAAVQFADRVNTVSPTYAEQIKTPAYGEKIEGLLSFISGKLSGIVNGIDTEVYDPANDKYIAQTFTADTLDKRKANKIALQEEVGLEVNSNAFLIGMVTRLVEQKGLDLVIQMLDRFMAYTDAQFVLLGTGDRYYETQMWQLASRYPGRMATYLLYNDALSRRIYAGTDAFLMPSRFEPCGISQMMALRYGSIPIVRRTGGLVDTVSHHDPINEAGTGYCFDRYEPLDLFTCMIRAWEGFRYKPQWQELQKRGMSQDFSWYKSAKEYDKLYRSMYGLPDPEETQPELILTNQ

SEQ ID NO: 4695 - DNA, 1431 bp, Haemophilus influenzae
  CDS (1)..(1431)
atgaaaatactacacgtttgttcggaactctatccgctcttaaaaacaggcgggcttgccgatgttttaggggcattaccccaagcacagaaccaaattgggctagatgcccgctttttattgcctgcttatcctgcaattacaacaggtattccgaatactcaagtggttgctgaatttgacaacttcgctgggcacgtggtgttgcgttatggagaatataatggtgtcgggatctatttgattgacgctccgcacttatacggtcgcgaaggcaatccttatcatgatgcctattacaatgactacggcgacaactacaaacgttttgccttgctcggttgggtgggggcagaattagccacaggtttagatagctggtggcgtgcagaagtggtacacgcccacgattggcacgcaggtttgtgtgtagcatatctgttcaacaaaggcaagccagcaaaatcggtgttcactattcataacttggcgtatcaaggtcagttttcttatcatcatttgtatgaaatcggcttgccaacaggaatgttccacgtagaaggcttggaattatttgggcagatttcttacttgaaatcaggcttgttctattccgatgcaagtacggcggtaagtccaacttatgcccaagaaatcacgacaccagaatttgcctacggtttgcaaggcttgctttctggcttaaaagctcaaggtcgtttggtggggatattaaacggcgtggacgaaaatatttggcatccgaacgtggatcaatacatcccacaccattacaagctgaaatatatggcaggtaaaaagaaaaacaaagctgaactgcaagcctatttcaatttgccacaagatgaatctgctttggcatttgtgatggttacccgtttaaccgagcaaaaaggtgttgatttattaatcgaaagtgcagacgaaatcgtcaaacaaggcgggcagttgatgattttaggttcaggtgcaccgcacttggaacaaggtattcgtgagcttgctgaacgttatccacaaaatattgcggtaaaaatcggctatgatgaagccctttcgcatttaatggtggcaggtggtgatgtgattttagtgccaagccgtttcgagccttgtggcttaacccaactttatggtttgcaatatggcacactgccacttgttcgtaaaacaggtggtttggcagatacggtggtggatagcacttcagaaagcatcaaagctcgcaccgcaacaggttttgtgtttgaaagtgcaacgcctgaagctctccgccattgcttgcaacgtgcctttgccttatggcaaaaaccgcgtgcgtgggcgatggttcgcaccgatgcaatggaacaagacttcagctggcgtaaggctgcagagcaatatagaacactttatgaacgcttgtag

SEQ ID NO: 4696 - protein, 476 aa, Haemophilus influenzae
MKILHVCSELYPLLKTGGLADVLGALPQAQNQIGLDARFLLPAYPAITTGIPNTQVVAEFDNFAGHVVLRYGEYNGVGIYLIDAPHLYGREGNPYHDAYYNDYGDNYKRFALLGWVGAELATGLDSWWRAEVVHAHDWHAGLCVAYLFNKGKPAKSVFTIHNLAYQGQFSYHHLYEIGLPTGMFHVEGLELFGQISYLKSGLFYSDASTAVSPTYAQEITTPEFAYGLQGLLSGLKAQGRLVGILNGVDENIWHPNVDQYIPHHYKLKYMAGKKKNKAELQAYFNLPQDESALAFVMVTRLTEQKGVDLLIESADEIVKQGGQLMILGSGAPHLEQGIRELAERYPQNIAVKIGYDEALSHLMVAGGDVILVPSRFEPCGLTQLYGLQYGTLPLVRKTGGLADTVVDSTSESIKARTATGFVFESATPEALRHCLQRAFALWQKPRAWAMVRTDAMEQDFSWRKAAEQYRTLYERL

SEQ ID NO: 4697 - DNA, 1392 bp, Aquifex aeolicus
  CDS (1)..(1392)
atgagggttttattctgctcaagtgagatttacccttacgcaaaaacggggggactggctgatttttccttttgcttgataaagtatctgaaaaagtacggcgttaaagtcaagggagttatgccctactacaaaactttaaaggcggaaaacctgagaaaaacggataaaggagttactctaaatctcaacggaaaagattacacctttgaggtttacgagagtgaggactgttacttcctgagaaatgacgagctctttgggagggattacatttacggtcctccgggatgggggtatgaggacaacgatatcaggttcgggggatttagcagggctgtttcggagctgataagtactggacagctggaggcggatgtagttcacgcaaacgactggcaaaccgcgcttattcccctttttctgaaggaggtttttaaaactcccgtaaagactgtgtttaccatacacaacttagcttatcagggactatttccaaaggaaacagtagaaagggttggcatccccccttacctgtttcacatggaagcggtagagttttggggactcgtcaacttcatgaaagggggtatagtgttttcagacctgataactaccgtcagcccgacttacgccaaggaaatacaaactcaagaatacggttacggacttgagggagttcttaaaaaatactcttacaaattaaggggaattttaaacggaattgattacgaagtctggaatcctgagaaagataaatacatttaccagaattactccctgaggaattactccaaaaagttcaagaataaggaatttctgtcaaaggaactcggaattgaggctgaaaaaccattaatttccttcataaacaggtttacccatcagaagggtgttgaacttatacttaactgcgcggaagagatgtctaaactcaacgcgaactttgtattcttgggaacgggtgagtacgaaaacgcctttcttgatgtgagtaaaatctacaaaaactttaaagtgtttgccgaatttaacgaaggttttgcgaggaaactttacgcctcttcggacttcatactcatgccctcgtactttgagccctgcggactcactcagatgataggcatgaggtacggatgcgttcccatagtgagaaaaacgggaggccttagggacacggtaaaggacatttcagaaggcgggtacgggatcacctttgaagaaccatcaaaagagactttcctttgttcacttaaaagggccattgaactttacgaaaatgcgaagaagttcagaaattccgttaagatagtgatgagccttgacttttcctgcgataggatgacaaaagaatacatagagtgctatgaagaagttcagtctcatcagtga

SEQ ID NO: 4698 - protein, 463 aa, Aquifex aeolicus
MRVLFCSSEIYPYAKTGGLADFSFCLIKYLKKYGVKVKGVMPYYKTLKAENLRKTDKGVTLNLNGKDYTFEVYESEDCYFLRNDELFGRDYIYGPPGWGYEDNDIRFGGFSRAVSELISTGQLEADVVHANDWQTALIPLFLKEVFKTPVKTVFTIHNLAYQGLFPKETVERVGIPPYLFHMEAVEFWGLVNFMKGGIVFSDLITTVSPTYAKEIQTQEYGYGLEGVLKKYSYKLRGILNGIDYEVWNPEKDKYIYQNYSLRNYSKKFKNKEFLSKELGIEAEKPLISFINRFTHQKGVELILNCAEEMSKLNANFVFLGTGEYENAFLDVSKIYKNFKVFAEFNEGFARKLYASSDFILMPSYFEPCGLTQMIGMRYGCVPIVRKTGGLRDTVKDISEGGYGITFEEPSKETFLCSLKRAIELYENAKKFRNSVKIVMSLDFSCDRMTKEYIECYEEVQSHQ

SEQ ID NO: 4699 - DNA, 1371 bp, Pyrococcus horikoshii
  CDS (1)..(1371)
atgaggatgaactctcaatggggttttaaaatgaagatactcatcatggggtttgaatatctccctgtaaaagtgggaggcttggctgaagctttaacttccattgcagaagccctcgcctctttaggacatgaagtcctagtcttcacgccttcccatggaaggtttcagggttcagaaattgggattataaaagcttttggggggaaagttgccatcaaagttcacttggaggagaatggaaatttgaggatctatagaattggcggggggttgttagatcatcaagacgtatacggcccaggatgggagggtttgataaggaaaaccgttatatttgggaaagctagcgttctcttgctgaatgaactcttaaagagtgaagaccttcccgatgttctccacttccatgactggcacaccgtatttgctggagctttaattaaaaagtactttaggattccagcggtattcacaatccataggcttaacaagtcgaagatcccagcattttatttccatgaagcgggattacctgagctcgctccttatccggatctagaccctgagcacactggaggttacatagctgacatagtgacaacggttagtagggggtacctcctggatgagtgggacttctttaggaacttcaatggaaaggtaacctacgttttcaatggaatagattgtagtttttggaatgagaattatctaaagggttccaggaaggaaagaaggagctccatacttgcgaaatttggaatgagtgatgggataactttcatgttcataggaaggtttgatagaaggcagaagggagttgatactttgctcagggccatagagcttctatccgagagacctgagtttaaggaaatgagatttatcatcattggaatgggggatccagagttggaaaactgggccagggaattagaaaagaggtatgacaacgttagggtattaacggaaatgctcagcagagaattcgtgagagaactctatggttcggtagacttcgtaataatcccttcatattttgaaccatttggactagtttccctagaggcgatgtgtctcggggccattcccatagcttcatcagttggtggacttagggatgtcattgtgagtatagatgaagatcacgttgatggtaccggattactagtaaaacctggagacccatgggatctagctaatgcaattcttaggatgcacagtatcgcaatggataatgagtttgtggagaaattaagggataactgcaagaaaagagcaaagtcattttcctgggagaattcggcaaaaaggtatttaagggcatataaagggaatatcgacaggatttttgactttgcaatgtga

SEQ ID NO: 4700 - protein, 456 aa, Pyrococcus horikoshii
MRMNSQWGFKMKILIMGFEYLPVKVGGLAEALTSIAEALASLGHEVLVFTPSHGRFQGSEIGIIKAFGGKVAIKVHLEENGNLRIYRIGGGLLDHQDVYGPGWEGLIRKTVIFGKASVLLLNELLKSEDLPDVLHFHDWHTVFAGALIKKYFRIPAVFTIHRLNKSKIPAFYFHEAGLPELAPYPDLDPEHTGGYIADIVTTVSRGYLLDEWDFFRNFNGKVTYVFNGIDCSFWNENYLKGSRKERRSSILAKFGMSDGITFMFIGRFDRRQKGVDTLLRAIELLSERPEFKEMRFIIIGMGDPELENWARELEKRYDNVRVLTEMLSREFVRELYGSVDFVIIPSYFEPFGLVSLEAMCLGAIPIASSVGGLRDVIVSIDEDHVDGTGLLVKPGDPWDLANAILRMHSIAMDNEFVEKLRDNCKKRAKSFSWENSAKRYLRAYKGNIDRIFDFAM

SEQ ID NO: 4701 - DNA, 1431 bp, Chlamydophila pneumoniae, Chlamydia pneumoniae
  CDS (1)..(1431)
atgagaatcgtacaagtcgctgtagaattcactccaatcgttaaagtaggcggtctaggcgatgctgtagctagtctatctaaggagttagcgaaacaaaatgatgtggaagtacttctccctcattatcctttaatttccaaattctcttcgtctcaagttctttccgagcgttctttctattatgaatttttaggcaagcagcaagcctctgcaatttcttattcttacgagggtcttacgcttactataattacgttggattcacaaatagagcttttctcaaccacgtccgtgtactctgagaataatgttgtacgtttctctgcttttgcagctgcagctgcagcttatcttcaagaagcggatcctgctgacattgtgcacttgcatgactggcatgtaggtttacttgcgggtttattaaaaaaccctttaaaccctgtgcattcgaagattgtctttactatccataattttggttatcgagggtattgtagtacgcagctattagcagcgtcgcaaattgatgattttcatttgagtcactaccaactatttcgcgatccgcaaacttctgttctaatgaagggagctctctattgttcggattacattacgacagtgtctcttacttatgtgcaggaaattataaacgactattctgattacgaacttcatgatgcgattctagcaagaaattctgtattttctgggatcatcaatggcattgatgaagacgtttggaacccgaagacagatcctgctttagctgtacagtacgatgcaagcctattaagcgaacctgacgttctctttactaaaaaagaagagaacagagcggtattatatgagaagttggggatcagttcagactattttcctttgatttgtgtgatctcacgcattgttgaggaaaagggtcctgaatttatgaaagagattattctccatgctatggagcacagttatgcctttatcttgattgggacaagtcaaaatgaggttcttcttaatgagttccgtaacttacaagattgtttagcgagctcccccaacattcgtttgatcttggactttaatgatcctttagccaggctaacttatgctgctgccgatatgatctgcatcccttcacatagggaggcttgtggacttacccagctgatagcgatgcgttatggcacagttcctttagttcgtaaaactggagggcttgctgatacagtgattcctggggtaaatggtttcactttctttgatacaaacaattttaatgaatttcgggctatgcttagcaacgctgtaacgacgtatcgtcaggagcctgacgtttggttgaatttgattgagtcgggaatgcttcgggcctctggcttagatgccatggctaagcattacgtaaatctttatcaatctttactctcatga

SEQ ID NO: 4702 - protein, 476 aa, Chlamydophila pneumoniae, Chlamydia pneumoniae
MRIVQVAVEFTPIVKVGGLGDAVASLSKELAKQNDVEVLLPHYPLISKFSSSQVLSERSFYYEFLGKQQASAISYSYEGLTLTIITLDSQIELFSTTSVYSENNVVRFSAFAAAAAAYLQEADPADIVHLHDWHVGLLAGLLKNPLNPVHSKIVFTIHNFGYRGYCSTQLLAASQIDDFHLSHYQLFRDPQTSVLMKGALYCSDYITTVSLTYVQEIINDYSDYELHDAILARNSVFSGIINGIDEDVWNPKTDPALAVQYDASLLSEPDVLFTKKEENRAVLYEKLGISSDYFPLICVISRIVEEKGPEFMKEIILHAMEHSYAFILIGTSQNEVLLNEFRNLQDCLASSPNIRLILDFNDPLARLTYAAADMICIPSHREACGLTQLIAMRYGTVPLVRKTGGLADTVIPGVNGFTFFDTNNFNEFRAMLSNAVTTYRQEPDVWLNLIESGMLRASGLDAMAKHYVNLYQSLLS

SEQ ID NO: 4703 - DNA, 1452 bp, Lactococcus lactis subsp. lactis
  CDS (1)..(1452)
atgaaagagagaaaaatgaaagttttatttgcatcgagtgaatgtgcccccttttttaagacgggaggacttggagatgtagctggagcactgcccaaagaattggctaaaaaaagtgaaatagattcagttgctgtgatccttccttattttaagaatgaaatgaaagaagaatatcgttcacttttaaaagatgaattttatgattttgttgatgttggttggcggcacgaatatgttggagttaaaagtctagaaaaagagggtgtgaagtattattttctagataatgaacattattttggtagggggcaactctatggttatggcgatgatggagagcgctttgccttttttgacttggctctttgccaactcttagaaaagttagatttcattccagatgttttgcatgtcaatgattggcagactgcaatggttccctttttacttaaagaaaaatacaactggattaaggcctatgaaaaaattaaaacagtactgaccattcataatattgaatttcaaggcttgatgcatggagatgctttaagtgagctttttggtatgggaatggagcgctattttgaaggagtggtccgtcataatggtatgctaaatatgttaaaaacaggaattttatatgcggatcgggttaatacagtttcgccaacttacgctaaggaaatccagacctcagaatttggttgtggtttagaatcgattttgcaatatgtagatggaaaagtttctggaattttaaatgggatagattatgatatttataatcccgaaaatgatatattaattccttaccatttcagcgaggaagagctttctggtaaaggtcaaatgaaagcagagctccaaaagcgaacaggattaccattgaatccaaatgttccattgattgggatggtttcccgtttaacgaatcaaaaaggatttgatttagttttgagtcagttggaaaaagtattggaagaaaatgtgcaaattgtcctattaggaacaggtttccctgaaattgaagaaggttttagatatttttctcaaaaatatccagataagttgtcagcaaatattgcatttgacattcaatttgcacaggaaatttatgctggttctgatttcttcttgatgccatctgcttttgaaccttgtggcctatcacagatgattgcaatgagatatggaactttaccaatcgttcatgaaattggtggtttgaaagatactgtgattccatttaatcctattagcaaagaaggaacaggatttggttttgttgattttgaaggacagattttagtggagacgattaatcgtgcacttgaagtttatggaaaagaaccagaagtcttaaataaaatggttttatcagcaatgagtaaagatttttcttggggaacgaaggctcagcaatacattgaactctatcaagaattataa

SEQ ID NO: 4704 - protein, 483 aa, Lactococcus lactis subsp. lactis
MKERKMKVLFASSECAPFFKTGGLGDVAGALPKELAKKSEIDSVAVILPYFKNEMKEEYRSLLKDEFYDFVDVGWRHEYVGVKSLEKEGVKYYFLDNEHYFGRGQLYGYGDDGERFAFFDLALCQLLEKLDFIPDVLHVNDWQTAMVPFLLKEKYNWIKAYEKIKTVLTIHNIEFQGLMHGDALSELFGMGMERYFEGVVRHNGMLNMLKTGILYADRVNTVSPTYAKEIQTSEFGCGLESILQYVDGKVSGILNGIDYDIYNPENDILIPYHFSEEELSGKGQMKAELQKRTGLPLNPNVPLIGMVSRLTNQKGFDLVLSQLEKVLEENVQIVLLGTGFPEIEEGFRYFSQKYPDKLSANIAFDIQFAQEIYAGSDFFLMPSAFEPCGLSQMIAMRYGTLPIVHEIGGLKDTVIPFNPISKEGTGFGFVDFEGQILVETINRALEVYGKEPEVLNKMVLSAMSKDFSWGTKAQQYIELYQEL

SEQ ID NO: 4705 - DNA, 1461 bp, Sinorhizobium meliloti
  CDS (1)..(1461)
atgcagatactgtctgtcacggccgaaatttttccgctcgtcaagaccgggggcctggcagatgtagcgggatcgctccccaaggcactcagggcccacggcatccacacgcgcagcttcgttccgggttaccccggcgtcatgcgcgcgctcagcgacgcgaccccggtcgccgagtttgaaagcctgttcggcgaacgcgccactctcatcgcggcgcgggctcacgggctggatctcttcgtgctcgatgcgccggccttctatgacaggcaaggggccctctacgtagacaggcatggccgggattatgcggacaactggaaacgcttcgccgccttctcgctggtcgcatcgcaaatcgcgcgcgggctcgttcccaactggcggccgcacatcattcacgcacatgactggcacgcggcgatgagcctcctctatctgaagtacgccggcgacgacaccattcctcgcgtcctaaccgtgcacaaccttgcgttccaggggcaattcccggcccactacttccccgagctcgggctcccggcggaagcatattcgatcgacggcgtcgaatattacggcgatatcgggttcctcaagggcggcctgcaggcagccgatgcgatcacggtcgtcagccccacctatgcgcgggaaatcatgtccccggccttcggcatggggctggaaggcgtgatgaacgaacggcatgcggatgtcgtgggcatcgtcaacggcatagacctggaagtatgggatccatcctcagatccctgcatcgagcatcactattcggcgcgcgtgccgctgcgccgcctgcccaaccggcaggtgctgctccggcatttcggcctgccggacacctgcggaccgatcttcgccagcgtcaaccggttgacatggcagaagggcatggaccttctcgctgcgaccgccggcgagattgtcaagaatggcggcaccctgatcatccatgggcaaggcgaggagaagctggaagccgcattcatggatctcatgcgacggttcccgcaaaacatcagtgtaagcatcggttatgacgagcacctcgcccacaggattcatgccggcgcggatgcaatgctcgttccgtcccggttcgagccctgcggcctcacgcagctttacgcgctacgctacggctgcgtaccggtcgtcgcccgcacgggcggcctgtcggagaccatcatcgatgccaacgatgccgcgctccatgcccatgtcgcgacgggcatacagtttgcgcccattgacgaggacggactacgccatgcactgcgccgcaccttccggctctaccggctgcgacgcgtctgggagggacttcgccgccagggcatgaaaaccgactgctcgtggcatcgcagtgcggcccgctatgcggacctttacagcgaactcctcaatcccgacatgcgcctggtcggcagcgcttga

SEQ ID NO: 4706 - protein, 486 aa, Sinorhizobium meliloti
MQILSVTAEIFPLVKTGGLADVAGSLPKALRAHGIHTRSFVPGYPGVMRALSDATPVAEFESLFGERATLIAARAHGLDLFVLDAPAFYDRQGALYVDRHGRDYADNWKRFAAFSLVASQIARGLVPNWRPHIIHAHDWHAAMSLLYLKYAGDDTIPRVLTVHNLAFQGQFPAHYFPELGLPAEAYSIDGVEYYGDIGFLKGGLQAADAITVVSPTYAREIMSPAFGMGLEGVMNERHADVVGIVNGIDLEVWDPSSDPCIEHHYSARVPLRRLPNRQVLLRHFGLPDTCGPIFASVNRLTWQKGMDLLAATAGEIVKNGGTLIIHGQGEEKLEAAFMDLMRRFPQNISVSIGYDEHLAHRIHAGADAMLVPSRFEPCGLTQLYALRYGCVPVVARTGGLSETIIDANDAALHAHVATGIQFAPIDEDGLRHALRRTFRLYRLRRVWEGLRRQGMKTDCSWHRSAARYADLYSELLNPDMRLVGSA

SEQ ID NO: 4707 - DNA, 1425 bp, Chlamydia trachomatis
  CDS (1)..(1425)
atgaaaattattcacacagctatcgaatttgctccggtaatcaaagccggaggcctgggagacgcgctatacggactagcaaaagctttagccgctaatcacacaacggaagtggtaatccctttataccctaaattatttactttgcccaaagaacaagatctttgctcgatccaaaaattatcttatttttttgctggagagcaagaagcaactgctttctcctacttttatgaaggaattaaagtaactctattcaaactcgacacacagccagagttattcgagaatgcggaaacaatctacacaagcgatgatgccttccgtttttgcgctttttctgctgctgcggcctcctacatccaaaaagaaggagccaatatcgttcatttacacgattggcatacaggattagttgctggactactcaaacaacagccctgctctcaattacaaaagattgttcttaccctacataattttggttatcgaggctatacaacacgagaaatattagaagcctcctctttgaatgaattttatatcagccagtaccaactatttcgcgatccacaaacttgtgtgttgctaaaaggagctttatactgttcagatttcgtgactacggtttctcctacatacgccaaagaaattcttgaagattattccgattacgaaattcacgatgccattactgctagacaacatcatctccgcgggattttaaatggaatcgacacgacaatttgggggcctgaaacggatcccaatttagcgaaaaactacactaaagagcttttcgagaccccttcaattttttttgaagctaaagccgagaataaaaaagccttgtacgaaagattaggcctctctttagaacactctccttgcgtgtgcattatttctagaattgctgagcagaaaggtcctcactttatgaaacaggccattctccatgcactagaaaacgcttacacgctcattattataggtacctgctacgggaatcaattgcatgaagaatttgcaaatcttcaagaatcattagcgaattcccctgatgtaaggattcttttgacttatagtgatgtgctggcacgacaaattttcgccgctgcagatatgatctgcattccttctatgtttgaaccatgtggactcacacaaatgattggaatgcgttacgggactgtaccgttagtaagagctacaggaggactagcagatactgtagcaaatggaatcaatggattttccttctttaatccgcatgacttctatgaattccgaaacatgctttcggaagcagtgacaacctaccgtaccaaccacgacaagtggcaacatattgtacgtgcttgtctagatttttcttcagacctagaaactgccgccaataaatatttagaaatttataaacaataa

SEQ ID NO: 4708 - protein, 474 aa, Chlamydia trachomatis
MKIIHTAIEFAPVIKAGGLGDALYGLAKALAANHTTEVVIPLYPKLFTLPKEQDLCSIQKLSYFFAGEQEATAFSYFYEGIKVTLFKLDTQPELFENAETIYTSDDAFRFCAFSAAAASYIQKEGANIVHLHDWHTGLVAGLLKQQPCSQLQKIVLTLHNFGYRGYTTREILEASSLNEFYISQYQLFRDPQTCVLLKGALYCSDFVTTVSPTYAKEILEDYSDYEIHDAITARQHHLRGILNGIDTTIWGPETDPNLAKNYTKELFETPSIFFEAKAENKKALYERLGLSLEHSPCVCIISRIAEQKGPHFMKQAILHALENAYTLIIIGTCYGNQLHEEFANLQESLANSPDVRILLTYSDVLARQIFAAADMICIPSMFEPCGLTQMIGMRYGTVPLVRATGGLADTVANGINGFSFFNPHDFYEFRNMLSEAVTTYRTNHDKWQHIVRACLDFSSDLETAANKYLEIYKQ

SEQ ID NO: 4709 - DNA, 1701 bp, Sulfolobus solfataricus
  CDS (1)..(1701)
atgaaaaggattgaatcattgtggttacctgaggacattaaaaaagtgtggatgataacatttgaattgcaaaagatagcaagtgttggaggattaggaaatgctgtatataacatagctaaacatctagctgaaaagggagtagatattacggttttcttgccatctcatggaaggcatctaaatgaatattataggtctctcttaagtttaagacatattgacatgatcgttgagggaagaagaaagggtatagataataactattataattataaaataggatttgaagaaggaaaaatagataatttcaaggtaattttggtaaaaggattagattataacactggtagggtattagattcatggaatatctatgataacacaatggagaaaatttcgctattaacaagaggattagaggggttcactttaggcaatctatctaaccttccagatataatccatgcacaagattggcacgccgtaattcccgcagttaggataaaacaactcttggaagagagacgaataatcgtcccatttatttacactattcacttactgaattacattggtgtaccttggcactacgcttctcaagactggtctggaattgaggattgttggcattatatttggatggtagctaagcatgaattatataaatattcatatgtatgggatgtgttgtcaggtggaaaaattgagaaatttggttgttacgaggctgatatggtgagtagtgtaagttacagttatttaagttttgacgtatttaattttgtaggaaattgggtagccaataaatcatgtgtaacgtataatggtacggattgggatgtggaagagatccaaaataaggctgttacaatgtatggaactaaggacagaagggagttaaggagaaggctactttcatctctgcactccctaagggttattccagaggattacactaccggcaatatgctatggaataatagaaatagactaggattaagagatgattggacttacgacgatttaggggaaggaccccttgttctattcactgggagattagtatatcaaaaaggtgtagatttacttttaagggctatgaaaacagttgtgaatgagataaataatgctaggctcttaatttttgggctaccgtctggggattacaacttactttgggatattatagagagggcttcagaaattaaggataatattaggttaatagtgggtagaatggatttagatttatataaattgtttcactacgtatcttcagtcttcgtcattccatctagatgggaaccatttggcataaattcaattgaggctatggctatggggttgccagtaattgcctatagcgtagggggtttaagagaaacagtcgttgacattagggaggataagaataatgccacaggtctcttaattaagcctgaaagtatagacgaattagctagagccataaggattgcattatatttgtcagaggcttctgagctaaataaaagcgatttgttatataaggcgagtgaggttaaagtagatgatacgagatactgggataaggtacgtgaaaatgcaataactagggttaagagtagatttagatgggatgcagtgataaactccttaactgagtgttatagaaagactctcgatatggctaaatatagggctttagcctctttttga

SEQ ID NO: 4710 - protein, 566 aa, Sulfolobus solfataricus
MKRIESLWLPEDIKKVWMITFELQKIASVGGLGNAVYNIAKHLAEKGVDITVFLPSHGRHLNEYYRSLLSLRHIDMIVEGRRKGIDNNYYNYKIGFEEGKIDNFKVILVKGLDYNTGRVLDSWNIYDNTMEKISLLTRGLEGFTLGNLSNLPDIIHAQDWHAVIPAVRIKQLLEERRIIVPFIYTIHLLNYIGVPWHYASQDWSGIEDCWHYIWMVAKHELYKYSYVWDVLSGGKIEKFGCYEADMVSSVSYSYLSFDVFNFVGNWVANKSCVTYNGTDWDVEEIQNKAVTMYGTKDRRELRRRLLSSLHSLRVIPEDYTTGNMLWNNRNRLGLRDDWTYDDLGEGPLVLFTGRLVYQKGVDLLLRAMKTVVNEINNARLLIFGLPSGDYNLLWDIIERASEIKDNIRLIVGRMDLDLYKLFHYVSSVFVIPSRWEPFGINSIEAMAMGLPVIAYSVGGLRETVVDIREDKNNATGLLIKPESIDELARAIRIALYLSEASELNKSDLLYKASEVKVDDTRYWDKVRENAITRVKSRFRWDAVINSLTECYRKTLDMAKYRALASF

SEQ ID NO: 4711 - DNA, 1566 bp, Methanococcus jannaschii
  CDS (1)..(1566)
atgaaaatagtcatccttgctccaacaataacccctattgtctcttatggaggattaggggatgtaatgagagacttgccaaaatttttaaaaaaaggtaatgaagtagttgttctaactctaaaccattataataggtattttactcttccctatgaagatatcaaaaaaataactgttatctataaaggagctaaaattacatttgatgttttaagaacaaagcatccaacgacaggagtagatttaattgtatttagtaatgaaagtgtcaataacttaaatgtttgggaccctattaagtatgaaatttttgctgatttggttattacatatttagatgaggttaaagatattgatgtagtgtctgggcatgattggatgtgtggtttagctatagccaaatgcaacgatattttagatttaccaacaaccttaaccatacataatgaggcatttaaaggagagatgattgagtataaaggggaagttatgacatttttggagttaggaattaagtatgcagatgccgttaatacagtaagcccttctcatgctgaggaaataaaaaactacccttatataaaaaaatacttaaataataagccattctgtgggattttaaatggaattgatattgatgaatacgaccccatgaagataatagaaaggatgtgcaacctctcaaacaacaaacttgacccaagaaattatgcttatatctctccctattcagctgaagattcccataatataaaaccaaaaataaaatattcatggttttatagaggaggagtttatgaatatgtggaagattggaataagattgataaaggaatatcagctactgatgttgaggtccatggtggggtagatggagatatagaaactccattaattggttttgttggaagggcgacacatcaaaaaggttttaacaccatgtttgaagcaattccagaacttttagaaaaacatgatataagatttgtatttttaacaaagggggatagagatattgaagagagactaaaaaatcttgcaaatgaacatgatggaagaatcttggcattgataggctattccctcccactctcatctttagtatttgctgggagtgattggataattatgccttcatactgggaaccgtgtggtttagtgcaaatggaagctatggcatactgcactccagtcatagctacagaaactggaggtttaaaagataccataattcctcttcatccaaatccttatgaacatccaaattttgataaggcaacgggtgttttatttaaagttccagataaagtggggtttatgtggggggttgagcacgcattaaattggacattctataaacttaatgaaatatgtatgtttatgcagtatataagatataaatgccctaaacatccttatgatgagaactccccattatctatgatgatgaaaaactgctactatcacgtgtttagaaacttaagctggcagaactccccatctataagaaagtataagggcttatttggaggagcaatttataatcactatctacaaccataa

SEQ ID NO: 4712 - protein, 521 aa, Methanococcus jannaschii
MKIVILAPTITPIVSYGGLGDVMRDLPKFLKKGNEVVVLTLNHYNRYFTLPYEDIKKITVIYKGAKITFDVLRTKHPTTGVDLIVFSNESVNNLNVWDPIKYEIFADLVITYLDEVKDIDVVSGHDWMCGLAIAKCNDILDLPTTLTIHNEAFKGEMIEYKGEVMTFLELGIKYADAVNTVSPSHAEEIKNYPYIKKYLNNKPFCGILNGIDIDEYDPMKIIERMCNLSNNKLDPRNYAYISPYSAEDSHNIKPKIKYSWFYRGGVYEYVEDWNKIDKGISATDVEVHGGVDGDIETPLIGFVGRATHQKGFNTMFEAIPELLEKHDIRFVFLTKGDRDIEERLKNLANEHDGRILALIGYSLPLSSLVFAGSDWIIMPSYWEPCGLVQMEAMAYCTPVIATETGGLKDTIIPLHPNPYEHPNFDKATGVLFKVPDKVGFMWGVEHALNWTFYKLNEICMFMQYIRYKCPKHPYDENSPLSMMMKNCYYHVFRNLSWQNSPSIRKYKGLFGGAIYNHYLQP

SEQ ID NO: 4713 - DNA, 1431 bp, Bacillus halodurans
  CDS (1)..(1431)
atgaatgtgttacacgtcgcttcagaatgcaacccttttttcaaaacagggggacttgccgacgttctcggttcgctcccaaaagctcttataaaacaagggatcaatgtttccgtcatcctaccaaaatatggacacctctctgacgaatggcagaaccaattaacgttaaaaaaatcgttcacggtctccgtcacatggcgaaatcaatattgtggactggagcagtttgtagatcaaggagtgacctactacttcatcgataacgaatattactttaagcgggaacgcctttacggctatctcgatgaggctgaacggttcacattttttaatcatgctgttcttagctctttaccgttccttgatgaatcacctgatttaattcattgccatgattggcagtcaggtcttattcctgcctatatgaaaacgggttccgtcgaaaatcccgtaccgacggtgttcacaatccataaccttcgctatcaaggagcctttccccctgatgtttttcgcgaattgcttcactttgcgccagagcactttgctggattagagatggacggtgcgatcaattttttgaagggagcactcgtccattctgaccgggttacaacggtaagcccaacatatgctcaggaaatacaaacccctgcctttggcgaaggcttgcacggattgcttcatcaagaacgaggaaaaacaagaggtattttaaatgggattgacctggaggatttcgatccaaaaaccgatccgcatgttacgtatccttataagcacaatcaaatggaaaaacggaaaaacaaacaggtcatccaacgtctgtttgaattgccagagcgcaaggacattcctcttattgcgatggtcagccgtctcgtagaagagaaaggggtccctcttctcacccaaattgcaggtgaacttgtgacaacggaaaatgtgcagctcgccattctcggtacaggcgatccttctttagaggaccaactgcatcatctagcttctttgcatccacatcaaatttcatttaaatgtgtgtttgcggagccgctcgcgcgtaagctttatgcaggggctgatttattcatcatgccgtcccgattcgaaccgtgcggacttagccaaatgatttcccttcgctacgaaacggttccaattgttcgtgaaacaggagggttatatgacacgattcaatcctataatgaagaaataggcgaaggaaatggattcagttttactcattataacgcccatgatttcttgtatacaatcaagcgagccctccgtttttatcgtacggaaaaagagtgggaaaaccttttgcttaacatctacagctcggaagtaggatgggacgtttccgccaaacaatatacagcgctttatgaagaaatactagggaaaaggaaggtggaggcatga

SEQ ID NO: 4714 - protein, 476 aa, Bacillus halodurans
MNVLHVASECNPFFKTGGLADVLGSLPKALIKQGINVSVILPKYGHLSDEWQNQLTLKKSFTVSVTWRNQYCGLEQFVDQGVTYYFIDNEYYFKRERLYGYLDEAERFTFFNHAVLSSLPFLDESPDLIHCHDWQSGLIPAYMKTGSVENPVPTVFTIHNLRYQGAFPPDVFRELLHFAPEHFAGLEMDGAINFLKGALVHSDRVTTVSPTYAQEIQTPAFGEGLHGLLHQERGKTRGILNGIDLEDFDPKTDPHVTYPYKHNQMEKRKNKQVIQRLFELPERKDIPLIAMVSRLVEEKGVPLLTQIAGELVTTENVQLAILGTGDPSLEDQLHHLASLHPHQISFKCVFAEPLARKLYAGADLFIMPSRFEPCGLSQMISLRYETVPIVRETGGLYDTIQSYNEEIGEGNGFSFTHYNAHDFLYTIKRALRFYRTEKEWENLLLNIYSSEVGWDVSAKQYTALYEEILGKRKVEA

SEQ ID NO: 4715 - DNA, 1455 bp, Vibrio cholerae
  CDS (1)..(1455)
atggaacaattcaacgtttggtttaccgtttcagaagtacaggggctggtaaaaagtggtggcctggccgatgtggcaaaagcgctgccacaagcgttgaaagcgttgcatcagcaggtagccattgcgctgcctgcttatcgttcagtaccgggaaaggaagacgcagagttagtactggaaacagagctgacacactggccgcacacgcagtatcgtgttttaaaacgcgatctagacggtgtgccaatctatctaattgattgccctgcttattttgaccgcccggcgctgtatgctgagaataatcaagcctatgccgataatggtgaacggtttggttttttctctgcagcgtgtttggacgtactgccgaaactcggtattcagcctgacatcattcatgcgaatgattggcacacaggcttagtgccttttttgttgaaaacccgttatcgctatgacagcttttttgagcaagtcaaaagtgtgctgacggtgcataacgcgatttttaaagggatcttttcctaccatcagttagaagtcattcctgagctcaatttatcgggtatggaatttctgcaatacggtcacgatcatgtgagcatgctgcgggcggggatcgcttttgcggataaagtgaatgcggtgagtcctaattatgcggctgagcttttaacgcctcttggggctcacgggctggtggatgattttgtgcgccgagcgcgcgatttacacggtatcgtcaacggttgtgattacagcgagtggaatccaagaaccgaccactatctgccagcaacctacagcgatgagcctgagtcgatgcgcaaggggaaagcgctgtgtaaaacggcgctgcaggaagagttacacctgccggttaccgatgtacctctgtttggtatggtttgccgtttaacgcatcagaaaggctttcattacttgttgccgattttagagcagttcctgcgcaataacgttcaagtggttattgttggtactggtgagccggaagttgctgcgcggttgaataagatcgctcattatcatcgagccaagtttgcgtttgtcgaaacctacagtgagcgtttagcgcactgggttgaagcgggatcggatttcttcttaatgccttctgaatttgaagcctgtgggctcaatcagatttacagcatggcttatggcactctgcctattgttcgtgaagtgggtggcttgaaagatacggtgaacgattacgataaattcccggagcgcgcgacaggctttggttaccaagagcccacgccagaagctctattgatcacgatgcagcgggcactcttgttttatctgcagcagccagaagagatgctgaaagtgcaacaacgtgccatgcagcaaaacttcagttgggaagagtctgcccaagaatatatgaagatgtatcgactcgcgcgatttggctaa

SEQ ID NO: 4716 - protein, 484 aa, Vibrio cholerae
MEQFNVWFTVSEVQGLVKSGGLADVAKALPQALKALHQQVAIALPAYRSVPGKEDAELVLETELTHWPHTQYRVLKRDLDGVPIYLIDCPAYFDRPALYAENNQAYADNGERFGFFSAACLDVLPKLGIQPDIIHANDWHTGLVPFLLKTRYRYDSFFEQVKSVLTVHNAIFKGIFSYHQLEVIPELNLSGMEFLQYGHDHVSMLRAGIAFADKVNAVSPNYAAELLTPLGAHGLVDDFVRRARDLHGIVNGCDYSEWNPRTDHYLPATYSDEPESMRKGKALCKTALQEELHLPVTDVPLFGMVCRLTHQKGFHYLLPILEQFLRNNVQVVIVGTGEPEVAARLNKIAHYHRAKFAFVETYSERLAHWVEAGSDFFLMPSEFEACGLNQIYSMAYGTLPIVREVGGLKDTVNDYDKFPERATGFGYQEPTPEALLITMQRALLFYLQQPEEMLKVQQRAMQQNFSWEESAQEYMKMYRLARFG

SEQ ID NO: 4717 - DNA, 1833 bp, Arabidopsis thaliana (mouse-ear cress)
  CDS (1)..(1833)
atggcaactgtgactgcttcttctaactttgtgtcaagaacttcacttttcaacaatcatggtgcttcttcatgctctgatgtcgctcagattaccttaaaaggccaatccttgactcattgtgggttaaggtcattcaacatggtggataaccttcagaggagatctcaagctaaacctgtttctgctaaatcctcaaagagatcttctaaagttaagactgctggtaagattgtgtgtgagaaaggaatgtctgtgatttttattggagctgaagttggtccatggagtaaaactggtggtcttggtgatgttctcggtggtctacctccagctcttgctgctagaggccaccgtgtgatgacaatttgtcctcggtatgaccaatataaagatgcttgggacacttgtgttgtggttcagatcaaagttggggataaagttgagaatgttcgtttcttccattgctacaaacgaggagttgatcgtgtctttgttgaccatccaatctttcttgctaaggttgtgggcaaaacaggatccaaaatctatggtcctataactggagtagactacaatgacaaccaactccggttcagtttgttgtgtcaggctgctcttgaggcaccacaggttctgaacctgaacagcagcaagtacttctctggaccatatggtgaagatgtagtctttgttgccaatgactggcacactgctctacttccatgttacctcaaatctatgtatcaatcccgcggagtctacatgaatgcaaaggtggtcttctgcattcacaacatagcctaccagggaagatttgcctttgatgactattcccttctcaacttgcccatcagctttaaaagttctttcgacttcatggacgggtatgaaaagccagtaaaaggacggaaaattaactggatgaaggctgcaattctggaagctcaccgtgtcttaacagttagtccatactacgctcaagaactcatctctggagttgatagaggcgtggaattgcataaatatcttcgaatgaaaacagtttccggaattattaatggaatggatgttcaagaatggaacccgtctactgacaagtacatcgacatcaaatacgatattaccactgttacagatgctaaaccattgatcaaagaagcacttcaggctgctgttggacttcccgtggacagggatgtcccggttatcggtttcatagggagattggaggagcagaagggttctgatattctagtggaagctatttccaagttcatggggctcaatgttcagatggttatccttgggactggaaagaagaagatggaggctcagattcttgaactagaagagaagttcccagggaaggcggttggagtggcgaaattcaacgtgccattggctcatatgatcactgctggagctgacttcatcattgtcccaagcaggtttgagccgtgtggtctcattcagctgcacgcaatgagatatggaaccgtccctattgtggcatctactggtggacttgtggacactgtgaaagatggctacacaggtttccacattggaagattcaacgtcaagtgtgaagttgtggatccagatgatgtgatagcaacagcaaaggctgtgacaagagccgttgcagtatatggaacatccgcaatgcaagaaatggtcaagaactgcatggaccaagacttctcctggaagggacctgcgaggttgtgggagaaggtactattgtcccttaatgtggcgggaagtgaagccggaaccgagggtgaagagatagctcctctggccaaggagaacgtagcgacgccgtga

SEQ ID NO: 4718 - protein, 610 aa, Arabidopsis thaliana (mouse-ear cress)
MATVTASSNFVSRTSLFNNHGASSCSDVAQITLKGQSLTHCGLRSFNMVDNLQRRSQAKPVSAKSSKRSSKVKTAGKIVCEKGMSVIFIGAEVGPWSKTGGLGDVLGGLPPALAARGHRVMTICPRYDQYKDAWDTCVVVQIKVGDKVENVRFFHCYKRGVDRVFVDHPIFLAKVVGKTGSKIYGPITGVDYNDNQLRFSLLCQAALEAPQVLNLNSSKYFSGPYGEDVVFVANDWHTALLPCYLKSMYQSRGVYMNAKVVFCIHNIAYQGRFAFDDYSLLNLPISFKSSFDFMDGYEKPVKGRKINWMKAAILEAHRVLTVSPYYAQELISGVDRGVELHKYLRMKTVSGIINGMDVQEWNPSTDKYIDIKYDITTVTDAKPLIKEALQAAVGLPVDRDVPVIGFIGRLEEQKGSDILVEAISKFMGLNVQMVILGTGKKKMEAQILELEEKFPGKAVGVAKFNVPLAHMITAGADFIIVPSRFEPCGLIQLHAMRYGTVPIVASTGGLVDTVKDGYTGFHIGRFNVKCEVVDPDDVIATAKAVTRAVAVYGTSAMQEMVKNCMDQDFSWKGPARLWEKVLLSLNVAGSEAGTEGEEIAPLAKENVATP

SEQ ID NO: 4719 - DNA, 1461 bp, Thermotoga maritima
  CDS (1)..(1461)
atgaaagtggtattcgtttcttacgaggtttttccgttcgcgaaagtaggaggattggcggacgttgctggaactcttccaaagtacttgaagaaacacggggtggatgtcacgatagttatgccgaaacacagaatcgttgaaaaaaatgcggagaaatttgggtatgagatcaagaaagtagccgaaagtctctctgtttctcatgtcaaaaccgatcaaaagttcgatatatatgaatccgttcttcccggtagcgatgtgaaaacgtatttcgttgccaacgattactatttctctgcggaagatgtctacgcggggccagatcttggtgaacaggcgattttcttctgtgcggccactctggatctggtaaaacatcttgatttgaagcccgatatcgtccatgtgaacgactggcaaaccgctttgatccccgtctatttgaaaactgtgtacagggacgatccttacttttccagaacggccacggttttgacaatacacaaccttggataccagggcgtgttcgatccaaagtacctctcttttgcaggccttcccgattatgtttacactatcgacggtcttgagttctacggacagctgaatttcctcaagggcggaatagtgttcagcgatgtgataaacacggttagccccacttacgccgaggaaattcagacggaagagtatggtgagaaactcgatggtgtactgagaatgcgctcgaaggatctctacggtatattgaacggaatagattacgagctttataacccagccacggacagatacatttacgtcaactacgacgtgaatcgtcttgaactcaagtgggaaaacaaggtgaagctccaggaagaactgggacttcccgttaacaaggaaacggctgtagccgggttgatcagcaggctcgtccctcaaaaaggtctggaccttctggttgatgtgatggattatctgacgctctttgatcttcagatcgttgttctaggaacaggagatgaacagtacgagaacgctttcagaaagttccaggaaaggtatccagacaaagtatcagcgaacataaagttcgatgtcgagctggcgcagaagatatacgccggtgcggacatattcctcatgccgagcagatacgaaccgtgcggtttgggacagatgttcagcatgagatacggaacaatccccgttgtgagatacacgggaggcctggcggatactgtgaaagaatacgatccacaatcgatggaaggtacgggttttggattcaagaagtacgattccgctcatcttttgaaggctgtttcgaaggctttgcacttttactacagggaaaaagatcattggaggagaatcatgacaaatgccatgaacacggatctgtcctgggacaggtccgccaaagagtacgttgatctttacaaaaaagcccttgcaaaggttggaaggtga

SEQ ID NO: 4720 - protein, 486 aa, Thermotoga maritima
MKVVFVSYEVFPFAKVGGLADVAGTLPKYLKKHGVDVTIVMPKHRIVEKNAEKFGYEIKKVAESLSVSHVKTDQKFDIYESVLPGSDVKTYFVANDYYFSAEDVYAGPDLGEQAIFFCAATLDLVKHLDLKPDIVHVNDWQTALIPVYLKTVYRDDPYFSRTATVLTIHNLGYQGVFDPKYLSFAGLPDYVYTIDGLEFYGQLNFLKGGIVFSDVINTVSPTYAEEIQTEEYGEKLDGVLRMRSKDLYGILNGIDYELYNPATDRYIYVNYDVNRLELKWENKVKLQEELGLPVNKETAVAGLISRLVPQKGLDLLVDVMDYLTLFDLQIVVLGTGDEQYENAFRKFQERYPDKVSANIKFDVELAQKIYAGADIFLMPSRYEPCGLGQMFSMRYGTIPVVRYTGGLADTVKEYDPQSMEGTGFGFKKYDSAHLLKAVSKALHFYYREKDHWRRIMTNAMNTDLSWDRSAKEYVDLYKKALAKVGR

SEQ ID NO: 4721 - DNA, 1542 bp, Pseudomonas aeruginosa
  CDS (1)..(1542)
atgggacattctgttgcaggcgtttgcctggaagaacccgcggtactgaccgcttttccgtcgctgctgcacccgcaggacccgccgcaacagagggatcggatactcttcgttaccgccgagctcagcgatttcgtcaaggtcggcggactcggcgacttttccgccgcgctgccgagggtcctcaagcgcgagcattcggtgcgagtcctgctgcccggctatcgccaggtgctggagcgctgccgcgacttgcggatcatcggcagcctgcccggccgggcggcgatcccgccctgcgagatcggcctggtgaccctcgacgacggcctggaagtcatgctggtgctctgcccgctgctctacgagcgcgagggtacgccgtacatggacgaccagggcaacgactggccggacaaccacctgcgcttcgcccgcctgtgcctggccgccgccgagatcgccggtggacgcggcgcccagggctggcaaccgggcctggtgcacgccaacgactggccgtcggcgctgacgccggcctacatggcctggaacggcgtgcgcacgccgagcctgtttaccatccacaacctcgcctaccagggcctctgcgacctgcaatgcagcgccgaactgggcctccccgacgaagcgctgagccacgaaagcatggagttccacgggcgcctgtcgttcctcaaggccggcatcgcccatgcccaccacatcaccacggtgagcgagacctacgcccaggaaatcactaccccggaatacggctgcggcctgcacggcatcctcaagtacaaggtcgagaagcgtcagctcagcggcatcgtcaacggtatcgacgatagctggcagccgcactgcgatccgcacctggtggcctgcttcagcgcccgccaatgggccggcaagcgcgccaacacgcgctacgtggaggagcgtttcggcctggagccgggcaaggggccgctgttcgcggtggtctcgcgcctggtgcagcagaaaggcatcgacctgaccctggagatcagcgatgccctgctccaggccggcggccgtctggtcagcatcggccgtggcgagccgaacctggagaaggccatgctcgaactcgcccggcgtcatcccggccaggtcggcgtgcacatcggtttcgacgagaccgaggcccgccgtatctacgccggcagcgacttcctgctcatgccctcgcgttatgagccctgcgggctcagtcagctctatgcgcaatgcttcggctcgctgccgatcgcgcgctgcaccggcggcctcgccgataccatcgtcgacggggtcaccggcttcctgttccgtgaggaaaccgcgcagagctacctcgatgcggtgatgcgcgcgatcaacgtctaccactgtccctcgctgctcaacgccatgcgttgcaaggcgatggccgcgccgatgttctggagcgactcggtggagccttacaaccgcctgtaccggcgcctgttgaggaataccgctccggccctgcgcggggtacgccagtga

SEQ ID NO: 4722 - protein, 513 aa, Pseudomonas aeruginosa
MGHSVAGVCLEEPAVLTAFPSLLHPQDPPQQRDRILFVTAELSDFVKVGGLGDFSAALPRVLKREHSVRVLLPGYRQVLERCRDLRIIGSLPGRAAIPPCEIGLVTLDDGLEVMLVLCPLLYEREGTPYMDDQGNDWPDNHLRFARLCLAAAEIAGGRGAQGWQPGLVHANDWPSALTPAYMAWNGVRTPSLFTIHNLAYQGLCDLQCSAELGLPDEALSHESMEFHGRLSFLKAGIAHAHHITTVSETYAQEITTPEYGCGLHGILKYKVEKRQLSGIVNGIDDSWQPHCDPHLVACFSARQWAGKRANTRYVEERFGLEPGKGPLFAVVSRLVQQKGIDLTLEISDALLQAGGRLVSIGRGEPNLEKAMLELARRHPGQVGVHIGFDETEARRIYAGSDFLLMPSRYEPCGLSQLYAQCFGSLPIARCTGGLADTIVDGVTGFLFREETAQSYLDAVMRAINVYHCPSLLNAMRCKAMAAPMFWSDSVEPYNRLYRRLLRNTAPALRGVRQ

SEQ ID NO: 4723 - DNA, 3078 bp, Arabidopsis thaliana (mouse-ear cress)
  CDS (1)..(3078)
atggctgcttcaggaccaaaaagctcaggtcccagaggttttgggcgacgaacaacagtaggaagtgctcagaaaagaactcagaagaagaatggtgaaaaagatagtaatgccacttctacagcaacaaacgaggtttcagggattagtaagttgcccgcagctaaagtggatgtacagaagcaaagctctgttgttttgaatgagagaaatgtgttagataggtcggatattgaggatggaagtgatcgtttggacaagaaaacaaccgatgatgatgatttgttagaacaaaagttaaaacttgaaagagagaatcttcgtaggaaggaaatagaaacgcttgcagcggaaaatttggcgagaggtgatagaatgtttgtgtatcccgttattgtgaaacctgatgaagacatagaagtgtttctcaacaggaatctgtcgactctgaataacgaacccgatgttttgatcatgggggcgtttaacgaatggagatggaagtctttcacaaggagattggaaaagacctggatccatgaagattggttgtcatgtctccttcatatccccaaagaagcgtataagatggacttcgtgtttttcaatgggcaaagtgtatatgacaacaatgactcaaaagatttttgtgtagagataaaaggtgggatggataaagttgactttgagaattttcttctagaagagaaactgcgagagcaagagaagttagccaaggaagaagctgagagggagaggcaaaaagaagagaagagaagaatcgaagctcaaaaggctgcaattgaagctgatagagcacaagcaaaggcggagactcagaagagacgtgaattgcttcaaccggctattaagaaagctgtagtctcggctgagaatgtttggtacattgagccgagtgatttcaaggctgaagatacagtgaagctatattacaataaaaggtcaggtcctctgactaattccaaagaactgtggttacatggagggtttaataattgggttgatggattatctatcgttgtaaagcttgttaatgctgagttaaaggatgttgatccaaagagcggaaattggtggttcgctgaagttgtagtgcctggcggtgcactagtcattgactgggtctttgctgatggaccacctaaaggagcgtttctgtatgacaataatggttaccaagacttccacgcacttgttcctcaaaaacttcctgaagaactttactggttagaggaagaaaatatgatttttagaaaacttcaggaggataggcggttaaaagaggaagttatgcgtgccaagatggaaaaaacagctcgcttgaaagctgaaactaaggaaagaacactgaaaaagtttctgctatcccagaaagacgtggtttacaccgagcctctagagattcaagcaggaaaccctgtgactgtattgtacaatcctgcaaacacggttttgaatggaaaacctgaagtttggtttagaggctcttttaatcgttggactcaccgcttgggccctttgccacctcagaaaatggaagcaacagatgatgaaagctcacatgtgaagactacggctaaggtcccattggatgcttacatgatggactttgtgttctctgagaaagaggatggcggaatatttgataacaaaaatggtctggattaccatttaccagtcgtgggaggtatttcaaaggaaccaccattgcacattgttcatattgctgttgaaatggcacccatcgcaaaggttggtggcctaggtgatgttgtcactagtctatctcgcgctgttcaagaattaaaccataatgtggatatagtttttccaaagtatgattgcataaagcacaattttgtgaaggacttgcaatttaacagaagctatcactggggaggaactgaaataaaagtttggcatggaaaagtagaaggcctttcggtttacttcttagatccacaaaatggattgtttcagcgaggatgtgtttacggttgtgcagatgatgcaggaagattcggtttcttctgtcatgcggctcttgaatttcttctccaaggaggtttccatccagacattcttcactgtcatgactggtctagtgctccggtttcatggttattcaaggatcattacacacagtacggtttaattaaaacccgtattgtcttcacaattcataatttggaatttggagcgaatgccattggtaaagcaatgacatttgcagacaaagccacaacggtttcaccaacttatgctaaggaagttgctggaaactctgtaatctctgcacatttatacaaatttcacggaattataaacgggattgacccagatatatgggatccatataacgataactttattcccgtaccttatacttcagagaacgttgtagaaggcaaaagagcagccaaggaagaattgcaaaacaggcttggactaaagagtgccgattttccagtagtaggaattattacgcgcttaacacaccagaagggaatacatttgatcaagcacgctatttggcgtaccttggaacggaatggacaggttgtcttattaggttcagctccagatcctcggatccaaaatgattttgtaaacttggcaaaccaattacattcttctcatggtgaccgggctcggcttgttctaacctacgatgaacctctttcccatttgatttatgctggggctgactttattcttgtaccgtcgatatttgagccatgtggactgacacagctcatagccatgagatacggcgctgttcctgttgttagaaaaactggaggactctttgatacggtttttgatgttgaccacgataaagaaagggcacaagctcaagttctagaacctaatggtttcagcttcgacggagctgatgctcctggtgttgattatgctctcaatagggcgatatcggcgtggtacgatggtagagagtggtttaactcgctgtgcaagacggtgatggagcaagactggtcatggaaccgtcctgcacttgagtatcttgagctctatcactctgcacgcaagtaa

SEQ ID NO: 4724 - protein, 1025 aa, Arabidopsis thaliana (mouse-ear cress)
MAASGPKSSGPRGFGRRTTVGSAQKRTQKKNGEKDSNATSTATNEVSGISKLPAAKVDVQKQSSVVLNERNVLDRSDIEDGSDRLDKKTTDDDDLLEQKLKLERENLRRKEIETLAAENLARGDRMFVYPVIVKPDEDIEVFLNRNLSTLNNEPDVLIMGAFNEWRWKSFTRRLEKTWIHEDWLSCLLHIPKEAYKMDFVFFNGQSVYDNNDSKDFCVEIKGGMDKVDFENFLLEEKLREQEKLAKEEAERERQKEEKRRIEAQKAAIEADRAQAKAETQKRRELLQPAIKKAVVSAENVWYIEPSDFKAEDTVKLYYNKRSGPLTNSKELWLHGGFNNWVDGLSIVVKLVNAELKDVDPKSGNWWFAEVVVPGGALVIDWVFADGPPKGAFLYDNNGYQDFHALVPQKLPEELYWLEEENMIFRKLQEDRRLKEEVMRAKMEKTARLKAETKERTLKKFLLSQKDVVYTEPLEIQAGNPVTVLYNPANTVLNGKPEVWFRGSFNRWTHRLGPLPPQKMEATDDESSHVKTTAKVPLDAYMMDFVFSEKEDGGIFDNKNGLDYHLPVVGGISKEPPLHIVHIAVEMAPIAKVGGLGDVVTSLSRAVQELNHNVDIVFPKYDCIKHNFVKDLQFNRSYHWGGTEIKVWHGKVEGLSVYFLDPQNGLFQRGCVYGCADDAGRFGFFCHAALEFLLQGGFHPDILHCHDWSSAPVSWLFKDHYTQYGLIKTRIVFTIHNLEFGANAIGKAMTFADKATTVSPTYAKEVAGNSVISAHLYKFHGIINGIDPDIWDPYNDNFIPVPYTSENVVEGKRAAKEELQNRLGLKSADFPVVGIITRLTHQKGIHLIKHAIWRTLERNGQVVLLGSAPDPRIQNDFVNLANQLHSSHGDRARLVLTYDEPLSHLIYAGADFILVPSIFEPCGLTQLIAMRYGAVPVVRKTGGLFDTVFDVDHDKERAQAQVLEPNGFSFDGADAPGVDYALNRAISAWYDGREWFNSLCKTVMEQDWSWNRPALEYLELYHSARK

SEQ ID NO: 4725 - DNA, 1434 bp, Streptococcus pneumoniae
  CDS (1)..(1434)
atgaaaattttatttgtagcagcagagggtgcacccttttcaaaaacaggtggtttgggagacgtcattggcgctcttccaaaatcactggtaaaagctgggcacgaagttgcagtgattttaccctactatgatatggtagaggctaaatttggaaatcagattgaagatgtgcttcattttgaggtgagcgttggttggcgcagacagtattgtggaattaagaaaacagtattaaatggtgtaaccttctactttattgacaatcaatattatttcttccgtggtcatgtttacggtgattttgatgacggagaacgctttgcctttttccaactggctgccattgaggctatggaaaggattgactttattcctgatcttctccatgttcatgactaccatacagctatgattcctttcttgttgaaggaaaaataccgttggattcaagcctatgaggacattgaaacagttttaaccattcataatttagaattccaaggacaattttcagaaggaatgttgggtgatttgtttggagttggctttgaacgttacgctgatggcacccttcgatggaacaactgtctgaactggatgaaggcaggtattctctatgcgaaccgtgtttcaaccgtttcacctagctatgctcatgaaattatgactagtcagtttggatgtaatttggatcatattcttaaaatggagtctggtaaagtatctggtatcgtgaatgggattgatgctgatctttataatcctcagacggatgctcttttagactatcatttcaatcaggaagatttgtctgggaaagccaaaaataaggcaaaattgcaagaaagagttggcttgcctgttagagcagacgttccactggtgggaattgtttctcgtttgacacgtcaaaaaggttttgatgtggtggtcgaaagtcttcaccatatcttgcaagaagatgttcagattgttcttttgggaactggcgatccagcctttgaaggagctttctcatggtttgctcagatttacccagacaagctatcaacaaatatcacttttgatgtcaaacttgctcaggaaatctacgctgcttgtgacctcttcctcatgccaagtcgttttgaaccgtgtggcttgtctcaaatgatggctatgcgttatggaaccttgccattggtccatgaagttggaggcttgcgagatacagttcgcgctttcaatccaatcgaaggaagcggtactggctttagctttgacaatctatctccttattggttaaattggactttccaaacagcattggacttgtatagaaaccatccagacatttggagaaacctacaaaaacaagctatggagagtgacttctcatgggatacagcctgcaagtcataccttgacttgtaccatagtttagttaattaa

SEQ ID NO: 4726 - protein, 477 aa, Streptococcus pneumoniae
MKILFVAAEGAPFSKTGGLGDVIGALPKSLVKAGHEVAVILPYYDMVEAKFGNQIEDVLHFEVSVGWRRQYCGIKKTVLNGVTFYFIDNQYYFFRGHVYGDFDDGERFAFFQLAAIEAMERIDFIPDLLHVHDYHTAMIPFLLKEKYRWIQAYEDIETVLTIHNLEFQGQFSEGMLGDLFGVGFERYADGTLRWNNCLNWMKAGILYANRVSTVSPSYAHEIMTSQFGCNLDHILKMESGKVSGIVNGIDADLYNPQTDALLDYHFNQEDLSGKAKNKAKLQERVGLPVRADVPLVGIVSRLTRQKGFDVVVESLHHILQEDVQIVLLGTGDPAFEGAFSWFAQIYPDKLSTNITFDVKLAQEIYAACDLFLMPSRFEPCGLSQMMAMRYGTLPLVHEVGGLRDTVRAFNPIEGSGTGFSFDNLSPYWLNWTFQTALDLYRNHPDIWRNLQKQAMESDFSWDTACKSYLDLYHSLVN

SEQ ID NO: 4727 - DNA, 2533 bp, Oryza sativa (rice)
  CDS (114)..(1994)
cgcgactcagcccactcctctctctccaccaccaccaccaccaccaccaccgcccgccaagcgcggcccgcccgacacagcagcagcaggatcggcggagaggaggggggatcatggcgacggcggcggggatggggatcggggcggcgtgcctggtggcgccgcaggtgaggccggggaggaggttgcggctccagcgggtgcggaggcggtgcgtggcggagctgagcagggacggtgggtcggcgcacggcccgctggcaccggcgccgctggtgaagcagccggtcctgccgaccttcctcgtgccgacgtcgacgccacccgcgcccacgcagtcgccggcgccggcgccgaccccgccgccgttgccggactccggcgtgggggagatcgagcccgatctagaaggtctcacagaagattccatcgacaaaacaatttttgtggctagtgagcaggagtctgagatcatggatgtgaaggagcaagctcaagctaaagtaacacgcagcgttgtctttgtaaccggtgaagcttctccttatgcaaagtcaggtggactaggagatgtttgtggttcactgccaattgctcttgctcttcgtggtcatcgtgtgatggttgtaatgccgagatacatgaacggggccttgaacaaaaattttgcaaacgcattttacactgagaagcacattaagattccatgctttggcggagaacatgaagttactttttttcacgagtatagggattctgttgattgggtgtttgttgatcatccctcatatcatagacctggaaatttgtatggagataattttggtgcttttggcgataatcagttcagatacacactcctgtgctatgcggcgtgtgaagccccattaattcttgaactgggaggatatatctatggacagaaatgcatgtttgttgtgaatgattggcatgccagtcttgtgccagtccttcttgctgcaaaatatagaccatatggtgtttacagggatgcccgcagtgttcttgtcatacataatctagcacatcagggtgtggagcctgccagtacatatcctgacctgggattgccacctgaatggtatggagcattagaatgggtgtttccagagtgggcaaggcggcatgcccttgacaagggtgaggcagtcaattttttaaaaggcgcagttgtgacagcagatcgaattgtgactgtcagccaggggtattcatgggaggtcacaactgctgaaggtgggcaaggcctcaatgagctcttaagctcccggaagagtgtattgaatggaattgtaaatggaattgacattaatgattggaacccatccacagacaagtttctcccttatcattattctgttgatgacctgtccggaaaggccaagtgtaaagctgaattgcagaaggagctgggtttacctataaggcccgatgtgcctctgattggctttattggaagattggactatcaaaaaggcattgatctaattaaacttgccattccagatctcatgcgggacaatattcaattcgtcatgcttggatctggtgacccaggttttgaaggatggatgagatccacagaatcagggtacagggataaatttcgtggatgggttggatttagtgttccagtttcccaccgaataactgcaggttgcgatatattgttgatgccatccagattcgaaccttgtggcctcaatcagctatatgctatgcaatatggtacagtgcctgttgttcatggaactggaggcctcagagatacagtggagaattttaacccgtttgctgagaaaggagagcagggtacagggtgggcattctcgccactaaccattgaaaaaaatgctgtgggcattgcggatggcaatttcgacatacagggaacacaagtcctcttgggagggtctaatgaagcgaggcatgtcaagcgactttacatgggaccatgccgcctcacagtatgaacagatcttcgaatgggccttcatggatcaaccatatgtcatgtaaatggatttgaaggaagcagcgaatttctccgaggaccctcaatcttcctgtctttcatgagcggaatgaaaactttgtacactacatggaaagggaaccagttatgcaaagttgcaaacgatcactcaaggttacccttgtaggcctgctacttggccaatatggttccagtgaccatatgcagagtcaggttcagatgaatggcacttgtgagtagtgaagaataagatgaggatgcttgaagcggtttcacatgtggctgataccacgcaagcaacctctcaatgcatcgaaatgtgagtcttggaatcaataggatttagctcccatcaattacagttgtacccttttttgcttaatactttgtcgcctgtgctgttcttatatttgtgtgaagataaattttagtccattaggtaactgtattgttgagtcttaaggtgaagactaaatagtgtttggaagctgtagctactgcgatgtcaagtgtcaa

SEQ ID NO: 4728 - protein, 626 aa, Oryza sativa (rice)
MATAAGMGIGAACLVAPQVRPGRRLRLQRVRRRCVAELSRDGGSAHGPLAPAPLVKQPVLPTFLVPTSTPPAPTQSPAPAPTPPPLPDSGVGEIEPDLEGLTEDSIDKTIFVASEQESEIMDVKEQAQAKVTRSVVFVTGEASPYAKSGGLGDVCGSLPIALALRGHRVMVVMPRYMNGALNKNFANAFYTEKHIKIPCFGGEHEVTFFHEYRDSVDWVFVDHPSYHRPGNLYGDNFGAFGDNQFRYTLLCYAACEAPLILELGGYIYGQKCMFVVNDWHASLVPVLLAAKYRPYGVYRDARSVLVIHNLAHQGVEPASTYPDLGLPPEWYGALEWVFPEWARRHALDKGEAVNFLKGAVVTADRIVTVSQGYSWEVTTAEGGQGLNELLSSRKSVLNGIVNGIDINDWNPSTDKFLPYHYSVDDLSGKAKCKAELQKELGLPIRPDVPLIGFIGRLDYQKGIDLIKLAIPDLMRDNIQFVMLGSGDPGFEGWMRSTESGYRDKFRGWVGFSVPVSHRITAGCDILLMPSRFEPCGLNQLYAMQYGTVPVVHGTGGLRDTVENFNPFAEKGEQGTGWAFSPLTIEKNAVGIADGNFDIQGTQVLLGGSNEARHVKRLYMGPCRLTV

SEQ ID NO: 4729 - DNA, 1818 bp, Zea mays (maize)
  CDS (1)..(1818)
atggcggctctggccacgtcgcagctcgtcgcaacgcgcgccggcctgggcgtcccggacgcgtccacgttccgccgcggcgccgcgcagggcctgaggggggcccgggcgtcggcggcggcggacacgctcagcatgcggaccagcgcgcgcgcggcgcccaggcaccagcagcaggcgcgccgcgggggcaggttcccgtcgctcgtcgtgtgcgccagcgccggcatgaacgtcgtcttcgtcggcgccgagatggcgccgtggagcaagaccggcggcctcggcgacgtcctcggcggcctgccgccggccatggccgcgaacgggcaccgtgtcatggtcgtctctccccgctacgaccagtacaaggacgcctgggacaccagcgtcgtgtccgagatcaagatgggagacgggtacgagacggtcaggttcttccactgctacaagcgcggagtggaccgcgtgttcgttgaccacccactgttcctggagagggtttggggaaagaccgaggagaagatctacgggcctgtcgctggaacggactacagggacaaccagctgcggttcagcctgctatgccaggcagcacttgaagctccaaggatcctgagcctcaacaacaacccatacttctccggaccatacggggaggacgtcgtgttcgtctgcaacgactggcacaccggccctctctcgtgctacctcaagagcaactaccagtcccacggcatctacagggacgcaaagaccgctttctgcatccacaacatctcctaccagggccggttcgccttctccgactacccggagctgaacctcccggagagattcaagtcgtccttcgatttcatcgacggctacgagaagcccgtggaaggccggaagatcaactggatgaaggccgggatcctcgaggccgacagggtcctcaccgtcagcccctactacgccgaggagctcatctccggcatcgccaggggctgcgagctcgacaacatcatgcgcctcaccggcatcaccggcatcgtcaacggcatggacgtcagcgagtgggaccccagcagggacaagtacatcgccgtgaagtacgacgtgtcgacggccgtggaggccaaggcgctgaacaaggaggcgctgcaggcggaggtcgggctcccggtggaccggaacatcccgctggtggcgttcatcggcaggctggaagagcagaagggccccgacgtcatggcggccgccatcccgcagctcatggagatggtggaggacgtgcagatcgttctgctgggcacgggcaagaagaagttcgagcgcatgctcatgagcgccgaggagaagttcccaggcaaggtgcgcgccgtggtcaagttcaacgcggcgctggcgcaccacatcatggccggcgccgacgtgctcgccgtcaccagccgcttcgagccctgcggcctcatccagctgcaggggatgcgatacggaacgccctgcgcctgcgcgtccaccggtggactcgtcgacaccatcatcgaaggcaagaccgggttccacatgggccgcctcagcgtcgactgtaacgtcgtggagccggcggacgtcaagaaggtggccaccacattgcagcgcgccatcaaggtggtcggcacgccggcgtacgaggagatggtgaggaactgcatgatccaggatctctcctggaagggccctgccaagaactgggagaacgtgctgctcagcctcggggtcgccggcggcgagccaggggtcgaaggcgaggagatcgcgccgctcgccaaggagaacgtggccgcgccctga

SEQ ID NO: 4730 - protein, 605 aa, Zea mays (maize)
MAALATSQLVATRAGLGVPDASTFRRGAAQGLRGARASAAADTLSMRTSARAAPRHQQQARRGGRFPSLVVCASAGMNVVFVGAEMAPWSKTGGLGDVLGGLPPAMAANGHRVMVVSPRYDQYKDAWDTSVVSEIKMGDGYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 4731 - DNA, 1455 bp, Bacillus subtilis
  CDS (1)..(1455)
atgaagatattatttgctgtgtcagaatgcaccccatttgtgaaatcaggaggtcttgccgatgtagcaggtgctctgccaaaggcgcttgcgcgattaggcaatgaggtagctgtgatgctgccgaagtacagccaaatacctgaaccgtggaaaaagcgtatgaaaaaacaggctgagtgtaccgtagctgtcggctggcggcagcaatattgcggaattgaacatatggcagagaatgatgtgaattattacttcatcgacaatgagtactatttcaacagggattcgttgtacgggcattatgatgacggtgagcggtttgcctttttttcaagagctgtgctggaggctgccaaagttgtgaatgttcaagccgatattgttcatactcacgattggcatacagcgatggtcaattatttgctgaaagaggagtacagaaaacatcctttttatgaacggatgaaaagcgtgctcacgatccacaacctgcagtttcaaggcatattccctcctgatgtcacacatgacttgctgggtcttgagatggatcattttcattatgaaaggttagaatgcaacggatttgttaattttatgaaagcgggcatcattgcggctgatcatgtgacaactgtgagccccacttacagaaatgaaatcatgacgccgtattatggtgagcagttggaacaggttttgcaatatagggaagatgatgtaaccggcatattaaatggcattgatgatacgttctatcagccgaaaagcgacccttatatagaggcgcaatacgattcaggggatcttgcatgcaagctggaaaacaaaacgaagcttcagcagcggatggggcttccagagaaaaacgatattccgctgatcagtatggtgacaaggctcactaaacaaaaggggcttgatcttgtccgcagaattatgcacgaacttcttgaggagcaagacatacagctggttgtgctaggcacaggagaacgtgaatttgaagattatttccggtatgcagaatttgcttttcatgagaagtgccgggcttatatcgggtttgatgagccgctagcccatcaaatttatgcgggctctgatatgtttttgatgccgtcgaaatttgagccgtgcggtttggggcagctcattgctcttcaatatggcgccattccgattgtcagggaaacgggcggtctttacgacactgtccgtgcctatcaggaggaagagggaacgggcaatggctttacgttttccgcctttaatgcgcatgatctgaaatttacgatagaaagggcgctgtcgttttattgccaacaggatgtatggaagagcatcgtgaagaccgctatgaatgcagattacagctgggggaagtcggctaaagagtatcagcgtattttcgagcaggtgacaaggagtggacgggatgttctcgagtaa

SEQ ID NO: 4732 - protein, 484 aa, Bacillus subtilis
MKILFAVSECTPFVKSGGLADVAGALPKALARLGNEVAVMLPKYSQIPEPWKKRMKKQAECTVAVGWRQQYCGIEHMAENDVNYYFIDNEYYFNRDSLYGHYDDGERFAFFSRAVLEAAKVVNVQADIVHTHDWHTAMVNYLLKEEYRKHPFYERMKSVLTIHNLQFQGIFPPDVTHDLLGLEMDHFHYERLECNGFVNFMKAGIIAADHVTTVSPTYRNEIMTPYYGEQLEQVLQYREDDVTGILNGIDDTFYQPKSDPYIEAQYDSGDLACKLENKTKLQQRMGLPEKNDIPLISMVTRLTKQKGLDLVRRIMHELLEEQDIQLVVLGTGEREFEDYFRYAEFAFHEKCRAYIGFDEPLAHQIYAGSDMFLMPSKFEPCGLGQLIALQYGAIPIVRETGGLYDTVRAYQEEEGTGNGFTFSAFNAHDLKFTIERALSFYCQQDVWKSIVKTAMNADYSWGKSAKEYQRIFEQVTRSGRDVLE

SEQ ID NO: 4733 - DNA, 2168 bp, Manihot esculenta (cassava)
  CDS (75)..(1901)
atcaaatctccactccaccacaaccaccagcggaacctattttgcgcctaagcttctacaccggagagagcaccatggcaactgtaatagctgcacatttcgtttccaggagctcacacttgagcatccatgcattagagactaaggctaataatttgtctcacactggaccctggacccaaactatcactcccaatggtttaaggtccctcaacactatggataaactccaaatgaagacacaatcaaaagctgtgaaaaaggtctctgccaccggcaatggtaggcctgctgccaaaattatttgtggtcatggaatgaatttaatctttgttggagctgaagttggtccctggagcaaaactggtggacttggtgatgttcttggaggactcccccctgccatggccgcaagagggcaccgcgtcatgacagtgtctccccgctatgaccagtacaaggatgcttgggatacctctgtatcggtggagattaaaattggagatagaattgaaactgtccgcttcttccactcctacaaaagaggagttgatcgggtcttcgtggatcatccaatgttccttgagaaggtatggggcaaaactggatctaaaatatatggcccaagagcaggtttggattaccaggacaaccaactgcgatttagcttgttatgccttgctgctctggaggcaccgagagttctgaacttgaacagcagcaaaaatttctcaggaccctacggagaagaagttgccttcattgccaacgactggcacactgctctgcttccatgttatctaaaagccatttaccaacctatggggatttacaaacacgccaaggttgccttttgcatccacaacattgcatatcagggaagatttgccttctcagacttcccacgacttaatctgccagataaattcaaaagctcttttgactttatcgatgggtatgagaagcccgtgaagggaaggaaaatcaattggatgaaggccgggatattggaatcagacagggttttgactgtgagcccatactatgcccaagaagtcatctctggagttgaaagaggcgtcgagctggataacttcattcgtaaaactggcattgctggtattataaatggcatggacgtccaggagtggaatcctgttacagataaatacattgacatccactacgatgccacaactgttatggacgcaaaacctttgttgaaggaagcccttcaagcagaagtcggattgcctgttgataggaatgttcctttgataggcttcattggtagattagaagagcagaagggttcagatatttttgttgcagctatttcccaattggttgaacacaatgtgcagatagtaatccttggaactggcaaaaagaaatttgagaagcagattgagcatctggaggttttgtaccctgacaaggcaagaggagttgcaaaattcaatgtgccgttggcgcacatgatcacagctggtgctgactttatgctggttccaagtagatttgagccctgtggtctcattcagttgcatgctatgcgatatggaacagttcccattgttgcttctactggtggtcttgttgatactgttaaagaaggttacacaggattccaaatgggggccttgcatgttgaatgtgacaaaattgattcagcagatgtagctgcgatagttaaaactgtggcaagagctcttggcacttatgctaccgctgcattaagagaaatgatcctgaattgcatggcccaagacttgtcatggaagggaccagccagaatgtgggagaaaatgctcctggacctggaagttactggcagcgaacctggcactgaaggggaggagatcgctcctcttgctaaggagaacgttcccacgccttgagcagcaaggataatattaatcttgacggtgtagaaatattgacatttatggatatacgttaacgcgcagataaatatccattccagtaggctagtctgctgggatcaaaggcaccctttgtttttctattccaacggccatgatttctttgtgaagggtgaatggtgtctgaatcagtgttaaagagaatttacaactaacgtattacagcctttgcctggcgttatgtgcgtaaataaaggttcatcttctgacaaaaaaaaaaaa

SEQ ID NO: 4734 - protein, 608 aa, Manihot esculenta (cassava)
MATVIAAHFVSRSSHLSIHALETKANNLSHTGPWTQTITPNGLRSLNTMDKLQMKTQSKAVKKVSATGNGRPAAKIICGHGMNLIFVGAEVGPWSKTGGLGDVLGGLPPAMAARGHRVMTVSPRYDQYKDAWDTSVSVEIKIGDRIETVRFFHSYKRGVDRVFVDHPMFLEKVWGKTGSKIYGPRAGLDYQDNQLRFSLLCLAALEAPRVLNLNSSKNFSGPYGEEVAFIANDWHTALLPCYLKAIYQPMGIYKHAKVAFCIHNIAYQGRFAFSDFPRLNLPDKFKSSFDFIDGYEKPVKGRKINWMKAGILESDRVLTVSPYYAQEVISGVERGVELDNFIRKTGIAGIINGMDVQEWNPVTDKYIDIHYDATTVMDAKPLLKEALQAEVGLPVDRNVPLIGFIGRLEEQKGSDIFVAAISQLVEHNVQIVILGTGKKKFEKQIEHLEVLYPDKARGVAKFNVPLAHMITAGADFMLVPSRFEPCGLIQLHAMRYGTVPIVASTGGLVDTVKEGYTGFQMGALHVECDKIDSADVAAIVKTVARALGTYATAALREMILNCMAQDLSWKGPARMWEKMLLDLEVTGSEPGTEGEEIAPLAKENVPTP

SEQ ID NO: 4735 - DNA, 2035 bp, Pisum sativum (garden pea)
  CDS (82)..(1893)
gaattcccactcaccagcaaccaccttccttttgccgtcgatcactcttctctcaccgccgaaacagattttgacacaaaaatggcaacaataacgggatcttcaatgccgacgagaaccgcgtgcttcaattaccaaggaagatcagcagagtctaaactgaatttgcctcagatacacttcaataacaaccaagcgtttccagtattaggtttgagatctctcaacaagctgcacgtgcgtaccgcacgtgctacttccggttcttcagataccagtgaaaagtcattggggaaaatagtgtgtggaatgagcttggtgtttgttggagctgaagttggaccttggagtaaaactggtggactcggtgatgttcttggtggtcttccacctgttttagcaggaaatggacatcgagttatgactgtgtcaccgcgttatgatcaatacaaggatgcatgggatacgaatgtgctggttgaggttaaagttggagataaaattgaaactgtgcgtttctttcactgttacaagagaggagttgatcgtgtttttgtggatcatccacttttccttgaaagggtgtggggaaagactgggtcaaaactttatggtcctaaaactggaattgattatagagataatcaacttagattcagcttgttgtgtcaggctgcacttgaggcaccaagggttttgaacttaaacagcagcaaatatttctcaggaccatatggcgaagatgtaatctttgttgccaatgattggcactctgctcttattccatgctacttgaaatcgatgtacaagtctagagggctttacaaaaacgcaaaggtggccttttgtattcataacatagcttaccagggtagaaacgccttttcagacttctctcttctcaatttacctgatgaattccgaagctctttcgactttattgatgggtataataagccctgtgaagggaagaaaatcaattggatgaaggctggaatattagaatccgaccaagtgttcactgtaagtccacattatgccaaggaacttatttccggagaagacagaggtgtggaattggacaatatcattcgttcaacgggcatcattggtatcgttaatggcatggataatcgagagtggagtccacaaactgatagatacatagatgtacattacaatgaaacaactgtcaccgaagcaaaacctctcttgaaaggaactcttcaagccgagattgggttgccagttgacagcagtatccctttgatagggttcattggcaggctagaagagcagaaaggttcagatattctcgttgaagctattgccaagttcgctgacgaaaatgttcagatagtagttcttggaactggcaaaaagatcatggaaaagcaaatcgaggtactggaggaaaaatatcccggcaaagcaattgggataacaaaattcaacagccccttggctcacaaaattattgctggagctgactttatagtgatcccaagtagatttgagccctgtggtctagttcagttgcatgccatgccatatggaacggtgcctatagtttcctcaactggtggacttgttgacactgtgaaagaaggctatacaggattccacgctgggccgttcgatgtagagtgtgaagatgttgatccagatgatgtagataagttagcagcaactgtaaagagagcccttaaaacctatggtactcaagccatgaaacagataatcctgaactgcatggcccaaaacttctcgtggaagaaaccagccaaactgtgggagaaggcgctgttgaacctagaagtcacaggcaacgtagctggaatagatggggacgagattgctcctcttgcaaaggaaaatgtggctactccttgagaggagtgtcctcgtaaattcgcagttgatgaacaagttctacatgatcgaaaacatgaaccaatatgctaaaagtaatgtaaggtttctttggagtaaggtctttgtaagcaatctatgtagtttcaagaacatgagttgt

SEQ ID NO: 4736 - protein, 603 aa, Pisum sativum (garden pea)
MATITGSSMPTRTACFNYQGRSAESKLNLPQIHFNNNQAFPVLGLRSLNKLHVRTARATSGSSDTSEKSLGKIVCGMSLVFVGAEVGPWSKTGGLGDVLGGLPPVLAGNGHRVMTVSPRYDQYKDAWDTNVLVEVKVGDKIETVRFFHCYKRGVDRVFVDHPLFLERVWGKTGSKLYGPKTGIDYRDNQLRFSLLCQAALEAPRVLNLNSSKYFSGPYGEDVIFVANDWHSALIPCYLKSMYKSRGLYKNAKVAFCIHNIAYQGRNAFSDFSLLNLPDEFRSSFDFIDGYNKPCEGKKINWMKAGILESDQVFTVSPHYAKELISGEDRGVELDNIIRSTGIIGIVNGMDNREWSPQTDRYIDVHYNETTVTEAKPLLKGTLQAEIGLPVDSSIPLIGFIGRLEEQKGSDILVEAIAKFADENVQIVVLGTGKKIMEKQIEVLEEKYPGKAIGITKFNSPLAHKIIAGADFIVIPSRFEPCGLVQLHAMPYGTVPIVSSTGGLVDTVKEGYTGFHAGPFDVECEDVDPDDVDKLAATVKRALKTYGTQAMKQIILNCMAQNFSWKKPAKLWEKALLNLEVTGNVAGIDGDEIAPLAKENVATP

SEQ ID NO: 4737 - DNA, 1476 bp, Synechocystis sp
  CDS (1)..(1476)
atgtacatcgttcaaattgcctcagaatgcgcccccgtcattaaggctgggggattgggggatgttatttacggcctaagccgtgaattggaactgcggggccattgcgtcgagctaatcctacccatgtacgattgcatgcgctatgaccacatctggggtttacacgatgcttaccgcaacctagaggtgccctggtatggaagctcaatcttctgtgatgttttttgtggctgggttcacggtaggctctgcttcttcattcagcccaaatcttctgataactttttcaatcggggtcattattatggcgctctagacgaccatatgcgctttgcctttttctccaaggcggccatggagtttttgctacgcagtaacaaacgcccagacattatccactgccacgattggcaaacgggactggtgccggtgttgttgtatgaaatttaccgtttccatggcatggaccatcaacgggtttgttacaccatccacaatttcaaacaccagggtattgctggagccaatattctccacgccactgggctcaataatgacagttattatttcagctacgatcgcctgcaggataatttcaatcccaatgcgattaacttcatgaaggggggcattgtctactccaactatgtcaacaccgtttccccccaccatgcttgggaagcccgtttttccgatatttcctgtggcttgggccataccctggaaatccatcagcaaaaattcggcggtattttgaacggtttggattacgaagtgtggaacccagaaattgatcctttactggcgagtaacttcagtgtcaaaacctttggcgataaggcaaaaaataagcaagcgttacgggaaagattactgttagaaacggatgataaaaaacccatgctctgctttattggccgcttggatggacaaaaaggtgtgcacttggtgcatcactccatctactacgccctcagccagggagcgcaatttgtcctgctcggctccgccaccgaacccaatctgagcaaatggttctggcatgaaaaacaacatctcaacgataaccccaatgtccatctagagttgggctttgacgaggagctggcccacttaatttacggagcggcggacattattgtggtgcccagtaactacgaaccctgtggtttgacccaaatgattggtctgcgttatggggccgttccggtggtgcggggagtaggcggtttggtaaatactgttttcgaccgggattatgaccagaaccatcccccggagaaacgtaatggttttgttttctatcaaccggatgagtatgccctggaaacggccctcagtcgggcgatcgccttgtataaggatgatcccgtggcttttaaaaccttggccttgcagggcatggcctacgactactcttggaataaaccagggctccaatatgtggaagcctacgaatacatccgggcttaa

SEQ ID NO: 4738 - protein, 491 aa, Synechocystis sp
MYIVQIASECAPVIKAGGLGDVIYGLSRELELRGHCVELILPMYDCMRYDHIWGLHDAYRNLEVPWYGSSIFCDVFCGWVHGRLCFFIQPKSSDNFFNRGHYYGALDDHMRFAFFSKAAMEFLLRSNKRPDIIHCHDWQTGLVPVLLYEIYRFHGMDHQRVCYTIHNFKHQGIAGANILHATGLNNDSYYFSYDRLQDNFNPNAINFMKGGIVYSNYVNTVSPHHAWEARFSDISCGLGHTLEIHQQKFGGILNGLDYEVWNPEIDPLLASNFSVKTFGDKAKNKQALRERLLLETDDKKPMLCFIGRLDGQKGVHLVHHSIYYALSQGAQFVLLGSATEPNLSKWFWHEKQHLNDNPNVHLELGFDEELAHLIYGAADIIVVPSNYEPCGLTQMIGLRYGAVPVVRGVGGLVNTVFDRDYDQNHPPEKRNGFVFYQPDEYALETALSRAIALYKDDPVAFKTLALQGMAYDYSWNKPGLQYVEAYEYIRA

SEQ ID NO: 4739 - DNA, 1434 bp, Synechocystis sp
  CDS (1)..(1434)
atgaagattttatttgtggcggcggaagtatcccccctagcaaaggtaggtggcatgggggatgtggtgggttccctgcctaaagttctgcatcagttgggccatgatgtccgtgtcttcatgccctactacggtttcatcggcgacaagattgatgtgcccaaggagccggtctggaaaggggaagccatgttccagcagtttgctgtttaccagtcctatctaccggacaccaaaattcctctctacttgttcggccatccagctttcgactcccgaaggatctatggcggagatgacgaggcgtggcggttcacttttttttctaacggggcagctgaatttgcctggaaccattggaagccggaaattatccattgccatgattggcacactggcatgatccctgtttggatgcatcagtccccagacatcgccaccgttttcaccatccataatcttgcttaccaagggccctggcggggcttgcttgaaactatgacttggtgtccttggtacatgcagggagacaatgtgatggcggcggcgattcaatttgccaatcgggtgactaccgtttctcccacctatgcccaacagatccaaaccccggcctatggggaaaagctggaagggttattgtcctacctgagtggtaatttagtcggtattctcaacggtattgatacggagatttacaacccggcggaagaccgctttatcagcaatgttttcgatgcggacagtttggacaagcgggtgaaaaataaaattgccatccaggaggaaacggggttagaaattaatcgtaatgccatggtggtgggtatagtggctcgcttggtggaacaaaaggggattgatttggtgattcagatccttgaccgcttcatgtcctacaccgattcccagttaattatcctcggcactggcgatcgccattacgaaacccaactttggcagatggcttcccgatttcctgggcggatggcggtgcaattactccacaacgatgccctttcccgtcgagtctatgccggggcggatgtgtttttaatgccttctcgctttgagccctgtgggctgagtcaattgatggccatgcgttatggctgtatccccattgtgcggcggacagggggtttggtggatacggtatccttctacgatcctatcaatgaagccggcaccggctattgctttgaccgttatgaacccctggattgctttacggccatggtgcgggcctgggagggtttccgtttcaaggcagattggcaaaaattacagcaacgggccatgcgggcagactttagttggtaccgttccgccggggaatatatcaaagtttataagggcgtggtggggaaaccggaggaattaagccccatggaagaggaaaaaatcgctgagttaactgcttcctatcgctaa

SEQ ID NO: 4740 - protein, 477 aa, Synechocystis sp
MKILFVAAEVSPLAKVGGMGDVVGSLPKVLHQLGHDVRVFMPYYGFIGDKIDVPKEPVWKGEAMFQQFAVYQSYLPDTKIPLYLFGHPAFDSRRIYGGDDEAWRFTFFSNGAAEFAWNHWKPEIIHCHDWHTGMIPVWMHQSPDIATVFTIHNLAYQGPWRGLLETMTWCPWYMQGDNVMAAAIQFANRVTTVSPTYAQQIQTPAYGEKLEGLLSYLSGNLVGILNGIDTEIYNPAEDRFISNVFDADSLDKRVKNKIAIQEETGLEINRNAMVVGIVARLVEQKGIDLVIQILDRFMSYTDSQLIILGTGDRHYETQLWQMASRFPGRMAVQLLHNDALSRRVYAGADVFLMPSRFEPCGLSQLMAMRYGCIPIVRRTGGLVDTVSFYDPINEAGTGYCFDRYEPLDCFTAMVRAWEGFRFKADWQKLQQRAMRADFSWYRSAGEYIKVYKGVVGKPEELSPMEEEKIAELTASYR

SEQ ID NO: 4741 - DNA, 2868 bp, Zea mays (maize)
  CDS (670)..(2868)
gcggccgcttttttttaaaatctgtggagaaggctttattattagctcataatacttttgatgcatcaataggcctctcccacctcacattagtctcaacattgacttcatattatacaaccctaagaaggttgatcggctgcaacaattgaaatctaaagactacgtcaagcgcttccctcttgtgatatcatcagtttgctggaaccttgtagcttccgcactggaagccatgctcaaatggcctcttacactgctcagcaacatacacaaccttctccatgcacacaaccttctcagtttctttggtgaccttggagcacaagcaagaaacgtttgccttcttgatgacaccacagcaagcatccgaaggagggacctttggattagctgggaacatcacgtatgtcttgcagtcacttatcaggctttggaggtcattctcacagtctccatcagcatgagagcctatggcaaacatagctgctacaaaggagagggctaagaacaggctcaacagttttgccatgtttactagttcttgggggacgcctattgaaagctgtccgctgcccaccgcgtgcgctgcgctcccgtgcggcactgccggcggcgcgaccccgcgcccattggacgagcttccgccccgccccgatcgatcccgccgccatgtcgtcggcggccgtgtcgtcctcttcctccaccttcttcctcgcgctcgcctccgcctcccccgggggccgcaggcgggctagggtcggctcctcgccgttccacaccggcgccagcctgagtttcgcgttctgggcgccaccgtcgccgccgcgcgcgccccgggacgcagcgctggtgcgcgctgaggctgaggccgggggcaaggacgcgccgccggagaggagcggcgacgccgccaggttgccccgcgctcggcgcaatgcggtctccaaacggagggatcctcttcagccggtcggccggtacggctccgcgacgggaaacacggccaggaccggcgccgcgtcctgccagaacgccgcattggcggacgttgagatcaagtccatcgtcgccgcgccgccgacgagcatagtgaagttcccagcgccgggctacaggatgatccttccctctggggacatagcgccggagactgtcctcccagccccgaagccactgcatgaatcgcctgcggttgacggagattcaaatggaattgcacctcctacagttgagccattagtacaggaggccacttgggatttcaagaaatacatcggttttgacgagcctgacgaagcgaaggatgattccagggttggtgcagatgatgctggttcttttgaacattatggggacaatgattctgggcctttggccggggagaatgttatgaacgtgatcgtggtggctgctgaatgttctccatggtgcaaaacaggtggtcttggagatgttgtgggagctttacccaaggctttagcgagaagaggacatcgtgttatggttgtggtaccaaggtatggggactatgtggaagcctttgatatgggaatccggaaatactacaaagctgcaggacaggacctagaagtgaactatttccatgcatttattgatggagtcgactttgtgttcattgatgcccctcttttccggcaccgtcaagatgacatatatgggggaagtaggcaggaaatcatgaagcgcatgattttgttttgcaaggttgctgttgaggttccttggcacgttccatgcggtggtgtgtgctacggagatggaaatttggtgttcattgccaatgattggcacactgcactcctgcctgtttatctgaaggcatattacagagaccatgggttaatgcagtacactcgctccgtcctcgtcatacataacatcgcccaccagggccgtggtcctgtagatgaattcccgtacatggacttgcctgaacactaccttcaacatttcgagctgtacgatcccgtcggtggcgagcacgccaacatctttgccgcgggtctgaagatggcagaccgggtggtgactgtcagccgcggctacctgtgggagctgaagacagtggaaggcggctggggcctccacgacatcatccgttctaacgactggaagatcaatggcatcgtgaacggcatcgaccaccaggagtggaaccccaaggtggacgtgcacctgcggtcggacggctacaccaactactccctcgagacactcgacgctggaaagcggcagtgcaaggcggccctgcagcgggagctgggcctggaagtgcgcgacgacgtgccgctgctcggcttcatcgggcgtctggatggacagaagggcgtggacatcatcggggacgcgatgccgtggatcgcggggcaggacgtgcagctggtgatgctgggcaccgggcgcgccgacctggaacgaatgctgcagcacttggagcgggagcatcccaacaaggtgcgcgggtgggtcgggttctcggtgcctatggcgcatcgcatcacggcgggcgccgacgtgctggtgatgccttcccgcttcgagccctgcgggctgaaccagctctacgcgatggcgtacggcaccgtccctgtggtgcacgccgtgggcgggctcagggacaccgtggcgccgttcgacccgttcggcgacgccgggctcgggtggacttttgaccgcgccgaggccaacaagctgatcgaggcgctcaggcactgcctcgacacgtaccggaagtacggggagagctggaagagtctccaggcgcgcggcatgtcgcaggacctcagctgggaccacgcggctgagctctacgaggacgtccttgtcaaggccaagtaccagtggtag

SEQ ID NO: 4742 - protein, 732 aa, Zea mays (maize)
MSSAAVSSSSSTFFLALASASPGGRRRARVGSSPFHTGASLSFAFWAPPSPPRAPRDAALVRAEAEAGGKDAPPERSGDAARLPRARRNAVSKRRDPLQPVGRYGSATGNTARTGAASCQNAALADVEIKSIVAAPPTSIVKFPAPGYRMILPSGDIAPETVLPAPKPLHESPAVDGDSNGIAPPTVEPLVQEATWDFKKYIGFDEPDEAKDDSRVGADDAGSFEHYGDNDSGPLAGENVMNVIVVAAECSPWCKTGGLGDVVGALPKALARRGHRVMVVVPRYGDYVEAFDMGIRKYYKAAGQDLEVNYFHAFIDGVDFVFIDAPLFRHRQDDIYGGSRQEIMKRMILFCKVAVEVPWHVPCGGVCYGDGNLVFIANDWHTALLPVYLKAYYRDHGLMQYTRSVLVIHNIAHQGRGPVDEFPYMDLPEHYLQHFELYDPVGGEHANIFAAGLKMADRVVTVSRGYLWELKTVEGGWGLHDIIRSNDWKINGIVNGIDHQEWNPKVDVHLRSDGYTNYSLETLDAGKRQCKAALQRELGLEVRDDVPLLGFIGRLDGQKGVDIIGDAMPWIAGQDVQLVMLGTGRADLERMLQHLEREHPNKVRGWVGFSVPMAHRITAGADVLVMPSRFEPCGLNQLYAMAYGTVPVVHAVGGLRDTVAPFDPFGDAGLGWTFDRAEANKLIEALRHCLDTYRKYGESWKSLQARGMSQDLSWDHAAELYEDVLVKAKYQW

SEQ ID NO: 4743 - DNA, 2480 bp, Zea mays (maize)
  CDS (58)..(2154)
gcggccgcctggtaggcgctggtacaagcggaagcagcagtagcgtgaggcatccccatgccgggggcaatctcttcctcgtcgtcggcttttctcctccccgtcgcgtcctcctcgccgcggcgcaggcggggcagtgtgggtgctgctctgcgctcgtacggctacagcggcgcggagctgcggttgcattgggcgcggcggggcccgcctcaggatggagcggcgtcggtacgcgccgcagcggcaccggccgggggcgaaagcgaggaggcagcgaagagctcctcctcgtcccaggcgggcgctgttcagggcagcacggccaaggctgtggattctgcttcacctcccaatcctttgacatctgctccgaagcaaagtcagagcgctgcaatgcaaaacggaacgagtgggggcagcagcgcgagcaccgccgcgccggtgtccggacccaaagctgatcatccatcagctcctgtcaccaagagagaaatcgatgccagtgcggtgaagccagagcccgcaggtgatgatgctagaccggtggaaagcataggcatcgctgaaccggtggatgctaaggctgatgcagctccggctacagatgcggcggcgagtgctccttatgacagggaggataatgaacctggccctttggctgggcctaatgtgatgaacgtcgtcgtggtggcttctgaatgtgctcctttctgcaagacaggtggccttggagatgtcgtgggtgctttgcctaaggctctggcgaggagaggacaccgtgttatggtcgtgataccaagatatggagagtatgccgaagcccgggatttaggtgtaaggagacgttacaaggtagctggacaggattcagaagttacttattttcactcttacattgatggagttgattttgtattcgtagaagcccctcccttccggcaccggcacaataatatttatgggggagaaagattggatattttgaagcgcatgattttgttctgcaaggccgctgttgaggttccatggtatgctccatgtggcggtactgtctatggtgatggcaacttagttttcattgctaatgattggcataccgcacttctgcctgtctatctaaaggcctattaccgggacaatggtttgatgcagtatgctcgctctgtgcttgtgatacacaacattgctcatcagggtcgtggccctgtagacgacttcgtcaattttgacttgcctgaacactacatcgaccacttcaaactgtatgacaacattggtggggatcacagcaacgtttttgctgcggggctgaagacggcagaccgggtggtgaccgttagcaatggctacatgtgggagctgaagacttcggaaggcgggtggggcctccacgacatcataaaccagaacgactggaagctgcagggcatcgtgaacggcatcgacatgagcgagtggaaccccgctgtggacgtgcacctccactccgacgactacaccaactacacgttcgagacgctggacaccggcaagcggcagtgcaaggccgccctgcagcggcagctgggcctgcaggtccgcgacgacgtgccactgatcgggttcatcgggcggctggaccaccagaagggcgtggacatcatcgccgacgcgatccactggatcgcggggcaggacgtgcagctcgtgatgctgggcaccgggcgggccgacctggaggacatgctgcggcggttcgagtcggagcacagcgacaaggtgcgcgcgtgggtggggttctcggtgcccctggcgcaccgcatcacggcgggcgcggacatcctgctgatgccgtcgcggttcgagccgtgcgggctgaaccagctctacgccatggcgtacgggaccgtgcccgtggtgcacgccgtgggggggctccgggacacggtggcgccgttcgacccgttcaacgacaccgggctcgggtggacgttcgaccgcgcggaggcgaaccggatgatcgacgcgctctcgcactgcctcaccacgtaccggaactacaaggagagctggcgcgcctgcagggcgcgcggcatggccgaggacctcagctgggaccacgccgccgtgctgtatgaggacgtgctcgtcaaggcgaagtaccagtggtgagcgaattaattggcgacgcgacgccgctcctgtcgcaggacctggacgttatttagaaggctcttctccctggcggctttgatgcgtgcgtcgcatttgcgccgggcggacgggcgacggtggttggcctaccgcctacgtcggctgcgtgccctgggaatttgggcgggcacgatgatgccactgggcaccgggcgcggggtagtatgatatgaaaccgacggcgatggagatgaggcgcatggcattttcccactgataaatggggagttgtatgctactttaatatcgccactcctgttagtatttatattgatggcggccgc

SEQ ID NO: 4744 - protein, 698 aa, Zea mays (maize)
MPGAISSSSSAFLLPVASSSPRRRRGSVGAALRSYGYSGAELRLHWARRGPPQDGAASVRAAAAPAGGESEEAAKSSSSSQAGAVQGSTAKAVDSASPPNPLTSAPKQSQSAAMQNGTSGGSSASTAAPVSGPKADHPSAPVTKREIDASAVKPEPAGDDARPVESIGIAEPVDAKADAAPATDAAASAPYDREDNEPGPLAGPNVMNVVVVASECAPFCKTGGLGDVVGALPKALARRGHRVMVVIPRYGEYAEARDLGVRRRYKVAGQDSEVTYFHSYIDGVDFVFVEAPPFRHRHNNIYGGERLDILKRMILFCKAAVEVPWYAPCGGTVYGDGNLVFIANDWHTALLPVYLKAYYRDNGLMQYARSVLVIHNIAHQGRGPVDDFVNFDLPEHYIDHFKLYDNIGGDHSNVFAAGLKTADRVVTVSNGYMWELKTSEGGWGLHDIINQNDWKLQGIVNGIDMSEWNPAVDVHLHSDDYTNYTFETLDTGKRQCKAALQRQLGLQVRDDVPLIGFIGRLDHQKGVDIIADAIHWIAGQDVQLVMLGTGRADLEDMLRRFESEHSDKVRAWVGFSVPLAHRITAGADILLMPSRFEPCGLNQLYAMAYGTVPVVHAVGGLRDTVAPFDPFNDTGLGWTFDRAEANRMIDALSHCLTTYRNYKESWRACRARGMAEDLSWDHAAVLYEDVLVKAKYQW

SEQ ID NO: 4745 - DNA, 6027 bp, Zea mays (maize)
  CDS (120)..(5144)
gaattccctagttcagagaaagaaagaagttgagaatgagaagcaagtgaggcgcgtttgctgggaagtggttcttgtgaggtttaggagttcacccttcttttcttccccttctagaaatggagatggtcctacggtcgcagagccctctctgccttcggagtgggccggtgctcatttttcgaccaaccgtcgcgggcggaggagggggcactcagtctttgttgaggactaccagatttgcgagaagaagggtcattcgatgcgttgtagcaagtccaggttgtcctaataggaaatctaggacagcgtctcccaacgtaaaagtagctgcttatagcaactatgcgccaagactcctcgttgagtcaagctccaagaagagcgaacaccatgatagcagcagacaccgtgaagaaactattgatacatacaatgggctgtcaggttctgatgcagcagaattgacaagtaatagagatgtagaaattgaagtggatttgcagcacatttctgaggaggaattgccaggaaaagtatcgattaatgcatcattaggagaaatggaaacagtggatgaagctgaggtcgaggaggataagtttgaggtagatacctcaggaattgtattgcgcaatgttgcagttcgggaagtggatccaaaggatgaacataatgctaaagatgtatttgtggtagattcgtcaggaactgcaccagataatgctgcagtggaggaagtggtagatgaagctgaggttgaagaggatatggttgatgtggatatcttgggacttgacttgaataatgcaacgatcgaggaaattgatttgatggaagaggctttactggagaacttcgacgtggattcaccaggcaatgcttctagtggtcgaacctatgggggtgtggatgagttgggtgagctgccttcaacatccgtggattgcatcgccattaacggaaaacgtagaagtttgaagcctaagcccttgccaattgtcaggttccaggaacaagaacagatagttttaagcattgttgacgaagaagggttgattgctagttcatgtgaagaaggccaaccggtggtagattacgataagcaagaggaaaactctaccgctttcgatgaacagaagcaattaactgatgatttccctgaagaaggcatatctatagttcacttccctgagccaaacaatgatattgttggatcctcaaaattcttggagcaaaaacaagaattggatggttcttataaacaagatcgatcaaccactggattgcatgaacaagatcagtctgttgttagttcacacggacaagataaatcaattgttggtgtgcctcagcaaatccagtacaatgatcaatctattgctggttctcatagacaagatcaatcaattgccggtgcacctgagcaaatccaatccgttgctggctatataaaaccaaatcaatctattgttggttcttgtaaacaacatgaattgattattcctgagcctaagaaaatcgaatccatcatcagttacaatgaaatagatcaatctattgttggttctcacaaacaagacaaatctgttgttagtgtgcctgagcaaatccaatccattgttagtcacagcaaaccaaatcaatctactgttgattcttatagacaagctgaatcaattattggtgtgcctgagaaagtccaatccatcaccagttacgataaactagaccagtccattgttggttctcttaaacaagatgagcctattattagcgtgcctgagaaaatccaatccattgtccattacactaaaccaaatcagtctattgttggcttgcccaaacaacaacaatcaattgttcatatcgttgaaccaaaacagtccatagatggtttccctaaacaagatctatcaatcgttggtatctccaatgagtttcaaacaaagcaactggctactgttgggactcatgatggattgcttatgaagggtgtggaagctaaggagacatctcaaaagactgaaggggatacacttcaggcaacgttcaatgtcgacaacttgtcacagaaacaggaaggcttaactaaagaagcagacgagataacaattattgagaaaatcaatgatgaagaccttgtgatgattgaagaacagaaaagcatagccatgaatgaagaacagacgattgttaccgaagaagacattccaatggctaaggttgagataggaattgacaaggccaaatttttacatctgctttctgaagaagagagttcatgggatgaaaatgaagtgggaataattgaggctgatgaacagtatgaagtcgatgagacatctatgtccactgaacaagatatccaggaatcacctaatgatgatttggatccacaagcactatggagtatgcttcaagagcttgctgaaaaaaattattcgctgggaaacaagttgtttacttatccagatgtattgaaagctgattcaacaattgatctctatttcaatcgtgatctatcagctgtggccaatgagcctgatgtacttatcaaaggagcattcaatgggtggaagtggagatttttcactgaaaaattgcacaagagcgagctggcaggggactggtggtgctgcaaactatacattcctaagcaggcatacagaatggactttgtgttttttaacggacacacggtatatgaaaataataacaataatgatttcgtgatacaaatagaaagcaccatggatgaaaatttatttgaggatttcttggctgaagaaaagcaacgagaacttgagaaccttgcaaatgaggaagctgaaaggaggagacaaactgatgagcagcggcgaatggaggaagaaagggccgcagataaagctgacagggtacaagccaaggttgaggtagagacgaagaagaataaattgtgcaatgtattgggtttagccagagctcctgttgataatttatggtacattgagcccatcacgactggacaagaggctactgtcagattgtattataacataaactcaagacctctagttcacagtactgagatatggatgcatggtggctataacaattggattgatggactctcttttgctgaaaggcttgttcatcatcatgacaaagattgtgattggtggtttgcagatgttgtcgtgcctgaaagaacatatgtattggactgggtttttgctgacggcccaccagggagtgcaaggaattatgacaacaatggaggacatgattttcatgctacccttccaaataacatgactgaggaagagtattggatggaagaagaacaaaggatctatacaaggcttcaacaagagaggagggaaagggaggaggctattaaaaggaaggctgagagaaatgcaaaaatgaaagctgagatgaaggaaaagactatgagaatgttcctggtttctcagaaacacattgtttacaccgaaccacttgaaatacatgctggaactactattgatgtgctttataatccttctaatacagttctaactggaaagccagaggtttggtttcgatgttcctttaatcgttggatgtatccaggtggggtgttgccacctcagaagatggtacaagcagaaaatggttcacacctaaaagcaacagtttacgttccacgagatgcctatatgatggacttcgttttctcggagtcagaagaaggtggaatttatgataacagaaatgggttagactatcatattcctgtttttgggtcaattgcaaaggaaccacctatgcacattgtccacattgctgttgagatggcaccaatcgcaaaggttggaggtcttggtgatgttgtcactagtctttcacgtgctgtgcaagatttaggacacaatgtggaggttattcttccaaagtacggttgcttgaatctaagcaatgtcaagaatctacaaatccatcagagtttttcttggggtggttctgaaataaatgtgtggcgtggactagtcgaaggcctttgtgtttacttcctggaacctcaaaatgggatgtttggagtcggatatgtatatggcagggacgatgaccgccgatttggcttcttctgtcgttctgctctagagtttctcctccaaagtggatcttctccgaacataatacattgccatgattggtcaagtgctcctgttgcctggctacacaaggaaaactacgcgaagtctagcttggcaaacgcacgggtggtattcaccatccacaatcttgaatttggagcgcatcatattggcaaagcaatgagatattgtgataaagcaacaactgtctctaatacatattcaaaggaagtgtcaggtcatggtgccatagttcctcatcttgggaaattctatggcattctcaatggaattgatccggatatatgggatccgtacaatgacaactttatcccggtccactacacttgtgagaatgtggttgaaggcaagagggctgctaagagggcactgcagcagaagtttgggttacagcaaatcgatgtccccgtcgtaggaatcgtcactcgcctgacagcccaaaaggggatccacctgatcaagcatgcgattcaccgtacactcgaacggaacggacaggtggttttgcttggttcagcgccggactctcgaatccaagctgattttgtcaacctggcgaatacgctccacggcgtaaaccatgggcaagtgaggctttccttgacctacgacgagcctctctcgcatctgatatacgctggctctgacttcattctggtcccatctatatttgagccttgcggcctaactcagctcgtcgccatgcggtatggaaccatcccgattgtccgcaagactggagggctcttcgacactgtcttcgatgtggacaatgacaaggaacgagcccgagatcgaggccttgagcccaacgggtttagctttgacggagctgatagcaacggtgttgactacgcgctgaacagggcgatctcagcttggttcgatgcccggagctggttccactccctttgcaagagagtcatggagcaggactggtcgtggaaccgacctgccctcgactacatcgagctctaccgttcagcgtccaaattgtaataatccaaacaacggccaatgtagtgtgttgtctgcaggtctcagatgcagccattcagcttttgcaggttcctgggcattgctgtacagcctccttgtctttagttagctccattccccgaggagcacagtgcaattttttatcctcagttattatgcatagattgtctcagtagaatgctttcttcgggcatgtatgtttgtttcctctgttgttgaattctggtgttaagtcgcgtataggaatctacaggaaatgaaaaagtccatttcctgcgtcaaccttttagggctaccatgcacatgagacctttcaagtgcaaagaatattaggactagactactagtatgtgaactctatttttccaagagatttcaatttttccaatgaaaaataaactaatttttcttggaaaaatggaaatcccttggaaaaatggggttcccaaactagcccgtagagtatagatcatagaattggtctagtggttcctcgagagagaaaaaaacatagacttttcttgtcatatgcttatttaagtttattttgtacaaactttgagaaccttcaaaaacaccccaatggctggttaagtgaccagggaaataaagaggatctatagggaggaatcccccgcctctctctcacagatgttgcctagcaccggccagcctcatccgtccagtggaattaaggttggttgcgacgacagcccatcaatggaaaccaacctcgtgccccgtgccgggatctaccttccttcctcaccaccacgccgatctcaccttccataggagcttcctatgcactgttacctattataggtacatgacattgtacatctttgtatgaacttacatcaatgccaaaaatccggaattc

SEQ ID NO: 4746 - protein, 1674 aa, Zea mays (maize)
MEMVLRSQSPLCLRSGPVLIFRPTVAGGGGGTQSLLRTTRFARRRVIRCVVASPGCPNRKSRTASPNVKVAAYSNYAPRLLVESSSKKSEHHDSSRHREETIDTYNGLSGSDAAELTSNRDVEIEVDLQHISEEELPGKVSINASLGEMETVDEAEVEEDKFEVDTSGIVLRNVAVREVDPKDEHNAKDVFVVDSSGTAPDNAAVEEVVDEAEVEEDMVDVDILGLDLNNATIEEIDLMEEALLENFDVDSPGNASSGRTYGGVDELGELPSTSVDCIAINGKRRSLKPKPLPIVRFQEQEQIVLSIVDEEGLIASSCEEGQPVVDYDKQEENSTAFDEQKQLTDDFPEEGISIVHFPEPNNDIVGSSKFLEQKQELDGSYKQDRSTTGLHEQDQSVVSSHGQDKSIVGVPQQIQYNDQSIAGSHRQDQSIAGAPEQIQSVAGYIKPNQSIVGSCKQHELIIPEPKKIESIISYNEIDQSIVGSHKQDKSVVSVPEQIQSIVSHSKPNQSTVDSYRQAESIIGVPEKVQSITSYDKLDQSIVGSLKQDEPIISVPEKIQSIVHYTKPNQSIVGLPKQQQSIVHIVEPKQSIDGFPKQDLSIVGISNEFQTKQLATVGTHDGLLMKGVEAKETSQKTEGDTLQATFNVDNLSQKQEGLTKEADEITIIEKINDEDLVMIEEQKSIAMNEEQTIVTEEDIPMAKVEIGIDKAKFLHLLSEEESSWDENEVGIIEADEQYEVDETSMSTEQDIQESPNDDLDPQALWSMLQELAEKNYSLGNKLFTYPDVLKADSTIDLYFNRDLSAVANEPDVLIKGAFNGWKWRFFTEKLHKSELAGDWWCCKLYIPKQAYRMDFVFFNGHTVYENNNNNDFVIQIESTMDENLFEDFLAEEKQRELENLANEEAERRRQTDEQRRMEEERAADKADRVQAKVEVETKKNKLCNVLGLARAPVDNLWYIEPITTGQEATVRLYYNINSRPLVHSTEIWMHGGYNNWIDGLSFAERLVHHHDKDCDWWFADVVVPERTYVLDWVFADGPPGSARNYDNNGGHDFHATLPNNMTEEEYWMEEEQRIYTRLQQERREREEAIKRKAERNAKMKAEMKEKTMRMFLVSQKHIVYTEPLEIHAGTTIDVLYNPSNTVLTGKPEVWFRCSFNRWMYPGGVLPPQKMVQAENGSHLKATVYVPRDAYMMDFVFSESEEGGIYDNRNGLDYHIPVFGSIAKEPPMHIVHIAVEMAPIAKVGGLGDVVTSLSRAVQDLGHNVEVILPKYGCLNLSNVKNLQIHQSFSWGGSEINVWRGLVEGLCVYFLEPQNGMFGVGYVYGRDDDRRFGFFCRSALEFLLQSGSSPNIIHCHDWSSAPVAWLHKENYAKSSLANARVVFTIHNLEFGAHHIGKAMRYCDKATTVSNTYSKEVSGHGAIVPHLGKFYGILNGIDPDIWDPYNDNFIPVHYTCENVVEGKRAAKRALQQKFGLQQIDVPVVGIVTRLTAQKGIHLIKHAIHRTLERNGQVVLLGSAPDSRIQADFVNLANTLHGVNHGQVRLSLTYDEPLSHLIYAGSDFILVPSIFEPCGLTQLVAMRYGTIPIVRKTGGLFDTVFDVDNDKERARDRGLEPNGFSFDGADSNGVDYALNRAISAWFDARSWFHSLCKRVMEQDWSWNRPALDYIELYRSASKL

SEQ ID NO: 4747 - DNA, 2991 bp, Zea mays (maize)
  CDS (602)..(2470): n means a or g or c or t/u, s means g or c
gaattcgcggccgccttatttctggttggccacatacatcatccaaaaaactttattattgaattacaactaataagcaatctaaaagagggcaccaccaatgatgtgttgttggtaggaggccgctgggtctgtcaaagcaagttggacaaagggcaacaattgttgtagttgtaagagggttgcggggttagccgcaaactgctggtagaaaggcagcaactgttgctgtgtcaagaaggaagcacggtttgctgcagctgttgtgccctgatggtttgtaccaatgactgcaccaaagatagggctggcgattgttgaaacaacaagggcgataaaggtatgttgcttgctgcgattgcttgttgaagcctatatggttgaagagctgggttttcacatattgaagctataattgatggaaggtatgggggaagaagggaagctataggagcttgtgagcattgagggaaaattgtcgcgttagcaacacatgtagaaagagcaaggagcataaggagggaaaatatcttggtcgccattgttgcgcgcgatccacggcccccgccccccgcgctcctgtctgctctccctctccgcaatggcgacgccctcggccgtgggcgccgcgtgcctcctcctcgcgcgggccgcctggccggccgccgtcggcgaccgggcgcgcccgcggcggctccagcgcgtgctgcgccgccggtgcgtcgcggagctgagcagggaggggcccgcgccgcgcccgctgccacccgcgctgctggcgcccccgctcgtgcccggcttcctcgcgccgccggccgagcccacgggtgagccggcatcgacgccgccgcccgtgcccgacgccggcctgggggacctcggtctcgaacctgaagggattgctgaaggttccatcgataacacagtagttgtggcaagtgagcaagattctgagattgtggttggaaaggagcaagctcgagctaaagtaacacaaagcattgtctttgtaaccggcgaagcttctccttatgcaaagtctgggggtctaggagatgtttgtggttcattgccagttgctcttgctgctcgtggtcaccgtgtgatggttgtaatgcccagatatttaaatggtacctccgataagaattatgcaaatgcattttacacagaaaaacacattcggattccatgctttggcggtgaacatgaagttaccttcttccatgagtatagagattcagttgactgggtgtttgttgatcatccctcatatcacagacctggaaatttatatggagataagtttggtgcttttggtgataatcagttcagatacacactcctttgctatgctgcatgtgaggctcctttgatccttgaattgggaggatatatttatggacagaattgcatgtttgttgtcaatgattggcatgccagtctagtgccagtccttcttgctgcaaaatatagaccatatggtgtttataaagactcccgcagcattcttgtaatacataatttagcacatcagggtgtagagcctgcaagcacatatcctgaccttgggttgccacctgaatggtatggagctctggagtgggtattccctgaatgggcgaggaggcatgcccttgacaagggtgaggcagttaattttttgaaaggtgcagttgtgacagcagatcgaatcgtgactgtcagtaagggttattcgtgggaggtcacaactgctgaaggtggacagggcctcaatgagctcttaagctccagaaagagtgtattaaacggaattgtaaatggaattgacattaatgattggaaccctgccacagacaaatgtatcccctgtcattattctgttgatgacctctctggaaaggccaaatgtaaaggtgcattgcagaaggagctgggtttacctataaggcctgatgttcctctgattggctttattggaaggttggattatcagaaaggcattgatctcattcaacttatcataccagatctcatgcgggaagatgttcaatttgtcatgcttggatctggtgacccagagcttgaagattggatgagatctacagagtcgatcttcaaggataaatttcgtggatgggttggatttagtgttccagtttcccaccgaataactgccggctgcgatatattgttaatgccatccagattcgaaccttgtggtctcaatcagctatatgctatgcagtatggcacagttcctgttgtccatgcaactgggggccttagagataccgtggagaacttcaaccctttcggtgagaatggagagcagggtacagggtgggcattcgcacccctaaccacagaaaacatgtttgtggacattgcgaactgcaatatctacatacagggaacacaagtcctcctgggaagggctaatgaagcgaggcatgtcaaaagacttcacgtgggaccatgccgctgaacaatacgaacaaatcttccagtgggccttcatcggatcgacccgatgttcaatggaaaaaagggaccaaagttggttggttccttgaagattatcagttcatcatcctatagtaagctgaatgatgaaagaaaacccctgtacattacatggaaggcagaccggctattggctccattgctccaatgtctgctttggctgccttgcctcgatggaccggatgcagtgaggaatccagncgaacgacagttttgaaggataggaaggggagctggaagcagtcacgcaggcaggcaagccttcgccgttaattcatatggaacaagctggagtcagtttctgctgtgccactcactgtttaccttaagattattacctgtgttgttctcctttgctcgttagggctgataacataatgactcattaagaatataattcactctgcctcgtttttaatcttaagtgaagtcgagatctacttcgtcattccttccccgtttaaaaaaaaaaaaaaaaaaaaa

SEQ ID NO: 4748 - protein, 622 aa, Zea mays (maize)
MATPSAVGAACLLLARAAWPAAVGDRARPRRLQRVLRRRCVAELSREGPAPRPLPPALLAPPLVPGFLAPPAEPTGEPASTPPPVPDAGLGDLGLEPEGIAEGSIDNTVVVASEQDSEIVVGKEQARAKVTQSIVFVTGEASPYAKSGGLGDVCGSLPVALAARGHRVMVVMPRYLNGTSDKNYANAFYTEKHIRIPCFGGEHEVTFFHEYRDSVDWVFVDHPSYHRPGNLYGDKFGAFGDNQFRYTLLCYAACEAPLILELGGYIYGQNCMFVVNDWHASLVPVLLAAKYRPYGVYKDSRSILVIHNLAHQGVEPASTYPDLGLPPEWYGALEWVFPEWARRHALDKGEAVNFLKGAVVTADRIVTVSKGYSWEVTTAEGGQGLNELLSSRKSVLNGIVNGIDINDWNPATDKCIPCHYSVDDLSGKAKCKGALQKELGLPIRPDVPLIGFIGRLDYQKGIDLIQLIIPDLMREDVQFVMLGSGDPELEDWMRSTESIFKDKFRGWVGFSVPVSHRITAGCDILLMPSRFEPCGLNQLYAMQYGTVPVVHATGGLRDTVENFNPFGENGEQGTGWAFAPLTTENMFVDIANCNIYIQGTQVLLGRANEARHVKRLHVGPCR

SEQ ID NO: 4749 - DNA, 2360 bp, Solanum tuberosum (potato)
  CDS (68)..(1993)
agattttctatattgaaagattttgtctttacatgattcttgattttacagcaggtgtcaataccaaatggggtctctgcaaacacccacaaatcttagcaataagtcatgtttatgtgtgtcagggagagttgtgaagggtttgagggtagaaagacaagtggggttggggttttcttggttgttgaagggacgaagaaacagaaaagttcaatctttgtgtgttacaagtagtgtttcagatggttcatcaattgctgaaaataagaatgtgtcagaagggcttcttttgggtgctgagagagatggttctggctctgttgttggttttcaattgattccacattctgttgcaggagatgcaacaatggtagaatctcatgatattgtagccaatgatagagatgacttgagtgaggatactgaggagatggaggaaaccccaatcaaattaactttcaatatcatttttgttactgctgaagcagctccatattctaagactggtggattaggagatgtttgtggttctttgccaatggcactagctgctcggggtcatcgtgtaatggtcgtttcacctaggtatttgaatggaggtccttcagatgaaaagtacgccaatgctgttgaccttgatgtgcgggccactgtccattgctttggtgatgcacaggaagtagccttctaccatgaatacagggcaggtgttgattgggtatttgtggaccactcttcttactgcagacctggaacgccatatggtgatatttatggtgcatttggtgataatcagtttcgcttcactttgctttctcacgcagcatgtgaagcgccattggttcttccactgggagggttcacttatggagagaagtgcttgtttctcgctaatgattggcatgctgccctggttcctttacttttagcggccaagtatcgtccttatggtgtttacaaggatgctcgtagtattgtcgcaatacacaacattgcacatcagggagtggagcctgcagtaacctacaataatttgggtttgcctccacaatggtatggagcagttgaatggatatttcccacatgggcaagggcgcatgcgcttgacactggtgaaacagtgaacgttttgaaaggggcaatagcagttgctgatcggatactgacagttagccagggatactcatgggaaataacaactcctgaagggggatatgggctacatgagctgttgagcagtagacagtctgttcttaatggaattactaatggaatagatgttaatgattggaacccgtcgacagatgagcatattgcttcgcattactccatcaatgacctctccggaaaggttcagtgcaagactgatctgcaaaaggaactgggccttccaattcgacctgattgtcctctgattggatttattggaaggctggactaccagaaaggtgttgacataatcctgtcagcaattccagaacttatgcagaatgatgtccaagttgtaatgcttggatctggtgagaaacaatatgaagactggatgagacatacagaaaatctttttaaagacaaatttcgtgcttgggttggatttaatgttccagtttctcataggataacagcaggatgcgacatactattgatgccctcaagattcgaaccgtgtggcttaaaccaattgtatgcaatgagatatggcaccatacctattgttcatagcacggggggcctaagagacacagtgaaggattttaatccatatgctcaagaaggaataggtgaaggtaccgggtggacattttctcctctaacgagtgaaaagttgcttgatacactgaagctggcaatcgggacttatacagaacataagtcatcttgggagggattgatgaggagaggtatgggaagggactattcctgggaaaatgcagccattcaatatgaacaagttttcacctgggcctttatagatcctccatatgtcagatgatttatcaagaaagattgcaaacgggatacatcattaaactatacgcggagcttttggtgctattagctactgtcattgggcgcggaatgtttgtggttctttctgattcagagagatcaagttagttccaaagacatacgtagcctgtccctgtctgtgagggagtaaaactacaaaaggcaattagaaaccaccaagaactggctcctttgggagaagagtggaaatatgtaaaaaagaattttgagtttaatgtcaattgattaattgttctcatttttaaaaaaaacatctcatctcatacaatatataaaattgatcatgattgatgaaaaaaaaaaaaaaaaaaaaaaaaaaaaaaaaaaaa

SEQ ID NO: 4750 - protein, 641 aa, Solanum tuberosum (potato)
MGSLQTPTNLSNKSCLCVSGRVVKGLRVERQVGLGFSWLLKGRRNRKVQSLCVTSSVSDGSSIAENKNVSEGLLLGAERDGSGSVVGFQLIPHSVAGDATMVESHDIVANDRDDLSEDTEEMEETPIKLTFNIIFVTAEAAPYSKTGGLGDVCGSLPMALAARGHRVMVVSPRYLNGGPSDEKYANAVDLDVRATVHCFGDAQEVAFYHEYRAGVDWVFVDHSSYCRPGTPYGDIYGAFGDNQFRFTLLSHAACEAPLVLPLGGFTYGEKCLFLANDWHAALVPLLLAAKYRPYGVYKDARSIVAIHNIAHQGVEPAVTYNNLGLPPQWYGAVEWIFPTWARAHALDTGETVNVLKGAIAVADRILTVSQGYSWEITTPEGGYGLHELLSSRQSVLNGITNGIDVNDWNPSTDEHIASHYSINDLSGKVQCKTDLQKELGLPIRPDCPLIGFIGRLDYQKGVDIILSAIPELMQNDVQVVMLGSGEKQYEDWMRHTENLFKDKFRAWVGFNVPVSHRITAGCDILLMPSRFEPCGLNQLYAMRYGTIPIVHSTGGLRDTVKDFNPYAQEGIGEGTGWTFSPLTSEKLLDTLKLAIGTYTEHKSSWEGLMRRGMGRDYSWENAAIQYEQVFTWAFIDPPYVR

SEQ ID NO: 4751 - DNA, 2124 bp, Ipomoea batatas (sweet potato)
  CDS (23)..(1849)
cggtggtgtgagactgtgagtgatggcgactataactgcctcacactttgtttctcatgtctgtgggggtgccacttctggagaatcaaaagtggggttgggtcaattagccctgaggagccaagctgtgactcacaatgggttgagacctgtgaacaagattgacatgttacaattgagaacaagtgcaagaaacctagcaaaaatggaaggaaaaatgagggtggaatggcaagcaggaactattgtgtgtaaacaacaagggatgaacttggtctttgtggggtgtgaggagggtccctggtgcaaaactggtggacttggagatgttcttggaggattgcctccagccttggcagctcgcgggcatagagttatgacagtgtgtccccgttatgatcagtacaaagatgcttgggaaacctgtgtggttgttgagccacaagttggagacagaattgaacctgttcgtttcttccattcatacaaacgcggagttgatcgcgtttttgtggatcatcctatgttcctggagaaggtttggggaaaaactggatctatgctctatggccccaaggctgggaaagattacaaggacaaccagttgcggttcagtttgttgtgccaagcagcacttgaggcaccgagagttttgaatcttaactccagcaaatacttcagtggaccttatggtgaggatgttgttttcgttgccaatgattggcacactgctctccttccatgctatctgaaaaccatgtaccagtcgagaggaatctacatgaacgccaaggttgctttctgcattcacaacattgcctaccaaggcagattcgccttttcagacttttctcttctgaatctgcctgacgagtacaagggttcttttgattttattgatgggtatgacaagccagtgaaggggagaaagataaactggatgaaagctggaatccgtgaagcagacagggtttttactgtgagcccaaactacgccaaggagcttgtttcttgcgtttcgaagggtgtggaattggacaaccacatccgagactgtggcatcacgggtatttgtaatggaatggatacccaagagtggaaccctgcaactgacaagtaccttgctgttaaatatgatatcacaactgttatgcaagcgaagcccttgttgaaggaagctcttcaagctgcagttggtttgccggttgacaggaatattccgttgattggttttatcggcagacttgaagagcagaaaggctcagacattctttatgctgcgatttctaagttcatttcaatggatgttcagatattgattcttggaactggaaagaagaaatttgagcagcagattgagcagcttgaagtgatgtatccagataaagctagaggagtggcgaagttcaacgttcctttggctcacatgattactgctggcgctgattttatgttgatcccgagcagatttgaaccgtgtggtctcattcagttgcatgctatgcgatatggaacaccgtgcatctgtgcctcaactggcggactcgttgacactgtgaaagaaggttatacagggttccacatgggggctttcaatgtcgactgtgaaactgttgacccagaggacgtgctgaaggtgataaccactgttggtagagcacttgcaatttacggaacccttgcattcactgaaatgatcaagaactgcatgtcacaagagctctcgtggaagggacctgccaagaattgggaaacagtgttgttgagcttaggagttgctgggagcgagcccggggttgaaggagaggaaattgcaccgcttgcaaaggaaaacgtcgctactccatgaaaactatggtctcaaaacctacaataagctggcatatgaaactaaagttttatatatgttgaaagagcggaggcgttttggtgctcttgagcattatgaggtgatgaaagagtcaatgggggactctttctttattgttttttggtttgcccaggtggtagtaaatagagagttcaaactaactagtttggtgttttaagacattgggaacttgcacttcagcaggctaaatgtataatataaataaacaatagcctcttgtggttttgtgatta

SEQ ID NO: 4752 - protein, 608 aa, Ipomoea batatas (sweet potato)
MATITASHFVSHVCGGATSGESKVGLGQLALRSQAVTHNGLRPVNKIDMLQLRTSARNLAKMEGKMRVEWQAGTIVCKQQGMNLVFVGCEEGPWCKTGGLGDVLGGLPPALAARGHRVMTVCPRYDQYKDAWETCVVVEPQVGDRIEPVRFFHSYKRGVDRVFVDHPMFLEKVWGKTGSMLYGPKAGKDYKDNQLRFSLLCQAALEAPRVLNLNSSKYFSGPYGEDVVFVANDWHTALLPCYLKTMYQSRGIYMNAKVAFCIHNIAYQGRFAFSDFSLLNLPDEYKGSFDFIDGYDKPVKGRKINWMKAGIREADRVFTVSPNYAKELVSCVSKGVELDNHIRDCGITGICNGMDTQEWNPATDKYLAVKYDITTVMQAKPLLKEALQAAVGLPVDRNIPLIGFIGRLEEQKGSDILYAAISKFISMDVQILILGTGKKKFEQQIEQLEVMYPDKARGVAKFNVPLAHMITAGADFMLIPSRFEPCGLIQLHAMRYGTPCICASTGGLVDTVKEGYTGFHMGAFNVDCETVDPEDVLKVITTVGRALAIYGTLAFTEMIKNCMSQELSWKGPAKNWETVLLSLGVAGSEPGVEGEEIAPLAKENVATP

SEQ ID NO: 4753 - DNA, 2287 bp, Sorghum bicolor (sorghum)
  CDS (207)..(2033)
caagaaataaaccactgccagccagtgacacggatcggagtccgacggacggacgcgcgcaccacgccggccggccgctcgatcgcatcgccgggatcgatactgctttgaacgggcgcctcacagtgctgctagctcctccatcgatcagctactgcacggccgcgccccgccggctgctctcatctcatccatcaggcatcagcatgtcgactctagccacgtcgcagctcgtcgccacgcacgccggcctaggcgtcccggacgcgtccatgttccgccgcggcggcgtgcagggcctgagggcggcggcccgggcatcggcggcagcaggggacgcgctcagcatgcggaccagcgcgtgtccggctccgaggcagcagccggcggcgcgccgcgggggccgcggaggaaggttcccgtcgctcgtcgtgtgcgccaccgccggcatgaacgtcgtcttcgttggcgccgagatggcgccctggagcaagaccggcggcctcggcgacgtcctcggcggcctgccgccggccatggccgcgaatgggcaccgtgtcatggtcgtctctccccgctacgaccagtacaaggacgcctgggacaccagcgtcgtgtccgagatcaagatgggagacgggtacgagacggtgaggtttttccactgctacaagcgcggagtcgaccgtgtgttcattgaccacccgctgttccttgagagggtttggggaaagacggaggagaagatctacgggcctgacgctggaacggactacaaggacaaccagctgcgtttcagcctgctatgccaggcggcacttgaagctcctaggatcctaagcctcaacaacaacccatacttctctggaccatatggggaggatgtcgtgttcgtctgcaatgactggcataccggccctctgtcatgctacctcaagagcaactaccagtccaatggcatctacaaggacgcaaagacggctttctgcatccacaacatctcctaccagggcaggttcgccttctcggacttcccagagttgaacctccctgagagattcaagtcatccttcgatttcatcgacggctacgagaagcccgtggaaggccggaagatcaactggatgaaggccgggatccttgaagccgacagggtcctcaccgtgagcccctactacgcggaggagctcatctccggcatcgccaggggctgcgagctcgacaacatcatgcgcctcaccggcatcaccgggatcgtcaacggcatggacgtcagcgagtgggatcccagcaaggacaagtacatcgccgtcaaatacgacgtgtcaacggctgtcgaggcaaaggcactgaacaaggaggcgctgcaggccgaggtcgggctcccggtggaccggaagatcccgctggtggcgttcatcggcaggctggaggagcagaagggccccgacgtcatggcggccgccatcccgctgctcatggaggaggacatacagatcgttctgctgggcactggcaagaagaagttcgagcgcatgctgatgagcgccgaggagaagtaccccgacaaggtgcgcgccgtggtcaagttcaacgcggcgctggcacaccacatcatggccggcgccgacctgctggccgtcaccagccgcttcgagccctgcggcctcatccagctccaggggatgcgatacggaacgccctgcgcctgcgcgtccaccggcggactcgtcgacaccatcatcgaaggcaagacaggattccacatgggccgcctcagcgtcgactgcaacgtcgtggagccggccgatgtgaagaaggtggcgaccaccttgaagcgtgccatcaaggtggtcggcacgccggcgtacgaggagatggtcaagaactgcatgatccaggatctgtcctggaagggccctgccaagaactgggagaacgtgctgctcagcctgggtgtcgccggcggcgagccggggatcgaaggcgaggagatcgcgccgctcgccaaggagaacgtggccgcaccctgaaggaggcgaggacccctgatatcgcgtgtagaacaaagatgatgaatcaagtgaacatgcatcttcgtatatatatgtgtcgtctatgagtatatatgaagaactatatagctgcttgtggtagtgtaatgtagtggtggccagtggcacaacctaataataagtacatgaactagttgcttgtgtgtgtaattaagtaccgatcggcaataatatattgctagtgaataaatggacttatatttgcgaagtca

SEQ ID NO: 4754 - protein, 608 aa, Sorghum bicolor (sorghum)
MSTLATSQLVATHAGLGVPDASMFRRGGVQGLRAAARASAAAGDALSMRTSACPAPRQQPAARRGGRGGRFPSLVVCATAGMNVVFVGAEMAPWSKTGGLGDVLGGLPPAMAANGHRVMVVSPRYDQYKDAWDTSVVSEIKMGDGYETVRFFHCYKRGVDRVFIDHPLFLERVWGKTEEKIYGPDAGTDYKDNQLRFSLLCQAALEAPRILSLNNNPYFSGPYGEDVVFVCNDWHTGPLSCYLKSNYQSNGIYKDAKTAFCIHNISYQGRFAFSDFPELNLPERFKSSFDFIDGYEKPVEGRKINWMKAGILEADRVLTVSPYYAEELISGIARGCELDNIMRLTGITGIVNGMDVSEWDPSKDKYIAVKYDVSTAVEAKALNKEALQAEVGLPVDRKIPLVAFIGRLEEQKGPDVMAAAIPLLMEEDIQIVLLGTGKKKFERMLMSAEEKYPDKVRAVVKFNAALAHHIMAGADLLAVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGGEPGIEGEEIAPLAKENVAAP

SEQ ID NO: 4755 - DNA, 4110 bp, Schizosaccharomyces pombe
  CDS (1)..(4110)
atgaatataaagaaaaagagctttctctttcaatttttgttcggatggattgtactgtcttcggctcaatggctatcggttttggatgaggcagagaatttgaactcttctttttcattagaaagtgttgattcttttgctccagtaagaccaaggtttataatcgatgaagactttgctgaagattacaaccttactgttgatatcttgcatcgtccacttcaggaaaatttcgattctttctttccaaacgttgaagcgtatgttgaaagtggaaattctaatggtgatttgatgagcgacaatggtaaactagatgatttaaattctcgagcggcctattctgcccttaaagcccttcaaaactcttatggatcatcccatctttatcgctttacaccctatgaattgtttgggcaatctatttggattgaagaagcacctgaagtgaatcatgtcggttggtctattatgttcgataaccttggccgttactttttactagagttgcgcggtctacgcgaggttacttttgctttgtttattactttttcaatcgttcctattattacaggaatccttactgtttacatttacaagaagaaatactgtgtcataaaattcaataagtccggtcgttctaagaagaaggatagctggttgaaaaggtctaaggatgaattacttcgtacggatagcgcaaatcttctgactttgaatgataatgatgagcctgtaatgattagacattcatgtaaaaggacgtgcattcttttcgcaacactcgaatataacattccggaatggaatataaaaattaaaattggaggtttaggagtgatggctgaattaatgagtaagacattaaagcagtatgatttggtttgggtcgttccttgtgtgggagatatcacatatccagtggctgaaactgctccatctttggtagttaaagtggttaaccaagactatgaagtgaaagttttctatcattataaagacaacatcaaatatgttcttctcgactctcccatattcagaaagcggacatcacacgatccttatcctcctcgtatggatgatatatcttcagccattttttacagtgtttggaatcagtccattgctgctataatacgtcgtgaaaaggttgatatctatcatattaatgattatcatggtgcacttgctccaatttataatcttccagaggtcatcccttgtgcaatttcactccataatgccgaattccaaggtttgtggcctttacagtccagtattgatgaaagagaggtttgtggtttattcaatgtttccaaaaccatttgcagagaatacattcaattcggtaatgctttcaacctgatgcattgcggtgtttcttatgttcgtcgtcatcagtccggttacggagtagttggtgtttctaacaaatatggccaacgctcatgggttcgatatccagttttttggagtctcaaaaaaattggacaattgcctaaccctgatcctaccgacatcggtttgagtgttaatcctgtgaatcaacaacttcctgactttgcagaatatgcttcggtaaggaaggaaaacaagagaaaggcacaagaatgggccggtttgacaatcgatgatgaagcggatcttctggtatttgtaggtagatggtcagtgcaaaaaggtattgatattttagctgatctcgcgccaaccctcttagaaaagttcaacattcaattaattgttgttgggcctctaattgatttatatggtaaatttgcggcagaaaagttcatgtacataatggaacgttatccagggcgcgttttctcaaaacccgagttcgttcatctaccacccttcatttttgaaggagctgactttgccctaattccttctcgtgatgaaccttttggtttagtcgcggtagaatttggcaggagaggtgctatttgtatcggctcaagagtcggaggtttaggagaaatgccaggatggtggtattctgttgaatctagctcaaccgcctatttactgaaacaacttgagaagtcttgtactctggctctaaaatcaactcctgaaatgcgccataaactgagaatcgccgcccttcagcaacgctttcctgtagatgagtgggtggcattgtatgacagacttatacgaaactgtattaaggctcataacaaacagcagcaaagaagaagcataaaatcatttttcagttgcattacaccgaacaagcctactaaagatgttaacgatattttatccgaaaaaagtgcattttctcctgcagattatgagcactctatagatattagagaacatacatcatatgatgccaattcaatggataatgattctgatgaagataattatgaacaagcagaatcaattatttcatcactaagtagttcagcactttccgaattatcttacatatctgagagttccatgaatataggttctaggcttgatgaacgctttatcgatgcaaatggcgttgcaataagggatttttctgctgagttaacttatttgactcctgaaaactcaaaaggaaaattatctatcgatcatttcttgaacaaagtccaatcacgttggcatgacgaagaacatcactattacaagacaggatttaggaagcgtgtttacaaatatttaaagatcaaagacaaaaagtctaaagatgtggaccctgatgatgacttggtaaaccaacttcctttaaatgcttacacgaaaccccgatataagagtgcggctagtactcgactaaacatttatcaaagaattctatatcttaaagttttcacttggccgctttacacaatcttcctctcgttaggccaaattttatctatttcatcgtttcaactttctcttttatcaggatttgaagataataatcaaatatctttgtacgtaatcacaggcgtttttattctttcaacgattgtttggtggggtttgtatcggaaccttccaagtgttcattccttatcgcttccttttgcagtgtatgctttggctttcctgtttactggcatttcatctatgtcactaccttaccatattcgtggatggctaagttacgctgcgacatgggtttatgcaatagctgctgcgagtgggccattgtatttcactctgaattttgaagatgaacattgttcggggttgggatcttcgatcacacgtgcttgtgttttacaaggagttcaacaactttggttatcgtttctttggctctggggaaccttatccagtcgtttggactataactataaagtgctactacaacccattaatagtgtttatgttgtagcaggagtttggccggtatcattcgttcttctatcagtatgtattcttttatataaggggttgccacctttctatcgacaaaaacccggatcgatccctgcattttctaaatctttattacaccgaaaggtggtaatatgtttcctgatttcagtcatcaatcaaaatttttggatgtctacattaattagccaagcttggagatttttctggggttccaaacttaccaaattatggaagattgttgtaatgactgtatcctttttagttggtgcgtggttaataattttttatgtgcttcgaaaactttcgaataagcacacttggatggttcctgtactaggattagggtttggtgctattaaatggatgcatgtcttctggggaacttcaaacgttggaattttcttaccgtgggcgggcattgcaggaccatatcttagtcgtgccttgtggctttggttgggaatactcgattccattcaaggcattggcaatggcctaattttacttcaaaccttgtcaagaagacacgtaactaacacattaatgataagccaacttgccggttctgccacctcaatacttgcacgctttgtgtcgccaacaaagactggaccagctaatgtttttccagatttgactggatacactccagtagaccgtgcaaagccagtggctaatgctccgttttggatttgcctgatcttgaatgtagctctatgtatcatgtatcttcggtgctatcatagagaaaacattagcagaccgtga

SEQ ID NO: 4756 - protein, 1369 aa, Schizosaccharomyces pombe
MNIKKKSFLFQFLFGWIVLSSAQWLSVLDEAENLNSSFSLESVDSFAPVRPRFIIDEDFAEDYNLTVDILHRPLQENFDSFFPNVEAYVESGNSNGDLMSDNGKLDDLNSRAAYSALKALQNSYGSSHLYRFTPYELFGQSIWIEEAPEVNHVGWSIMFDNLGRYFLLELRGLREVTFALFITFSIVPIITGILTVYIYKKKYCVIKFNKSGRSKKKDSWLKRSKDELLRTDSANLLTLNDNDEPVMIRHSCKRTCILFATLEYNIPEWNIKIKIGGLGVMAELMSKTLKQYDLVWVVPCVGDITYPVAETAPSLVVKVVNQDYEVKVFYHYKDNIKYVLLDSPIFRKRTSHDPYPPRMDDISSAIFYSVWNQSIAAIIRREKVDIYHINDYHGALAPIYNLPEVIPCAISLHNAEFQGLWPLQSSIDEREVCGLFNVSKTICREYIQFGNAFNLMHCGVSYVRRHQSGYGVVGVSNKYGQRSWVRYPVFWSLKKIGQLPNPDPTDIGLSVNPVNQQLPDFAEYASVRKENKRKAQEWAGLTIDDEADLLVFVGRWSVQKGIDILADLAPTLLEKFNIQLIVVGPLIDLYGKFAAEKFMYIMERYPGRVFSKPEFVHLPPFIFEGADFALIPSRDEPFGLVAVEFGRRGAICIGSRVGGLGEMPGWWYSVESSSTAYLLKQLEKSCTLALKSTPEMRHKLRIAALQQRFPVDEWVALYDRLIRNCIKAHNKQQQRRSIKSFFSCITPNKPTKDVNDILSEKSAFSPADYEHSIDIREHTSYDANSMDNDSDEDNYEQAESIISSLSSSALSELSYISESSMNIGSRLDERFIDANGVAIRDFSAELTYLTPENSKGKLSIDHFLNKVQSRWHDEEHHYYKTGFRKRVYKYLKIKDKKSKDVDPDDDLVNQLPLNAYTKPRYKSAASTRLNIYQRILYLKVFTWPLYTIFLSLGQILSISSFQLSLLSGFEDNNQISLYVITGVFILSTIVWWGLYRNLPSVHSLSLPFAVYALAFLFTGISSMSLPYHIRGWLSYAATWVYAIAAASGPLYFTLNFEDEHCSGLGSSITRACVLQGVQQLWLSFLWLWGTLSSRLDYNYKVLLQPINSVYVVAGVWPVSFVLLSVCILLYKGLPPFYRQKPGSIPAFSKSLLHRKVVICFLISVINQNFWMSTLISQAWRFFWGSKLTKLWKIVVMTVSFLVGAWLIIFYVLRKLSNKHTWMVPVLGLGFGAIKWMHVFWGTSNVGIFLPWAGIAGPYLSRALWLWLGILDSIQGIGNGLILLQTLSRRHVTNTLMISQLAGSATSILARFVSPTKTGPANVFPDLTGYTPVDRAKPVANAPFWICLILNVALCIMYLRCYHRENISRP

SEQ ID NO: 4757 - DNA, 1812 bp, Hordeum vulgare (barley)
  CDS (1)..(1812)
atggcggctctggccacgtcccagctcgccacctccggcaccgtcctcggcgtcaccgacagattccggcgtccaggttttcagggactcaggccccggaacccggcggatgcggcgcttggtatgaggactatcggagcaagcgccgccccgaagcaaagccggaaagcgcaccgcgggagccggcggtgcctctccgtggtggtgagcgccacgggcagcggcatgaacctcgtgttcgtcggcgccgagatggcgccctggagcaagaccggcggccttggcgatgtcctcggcggcctccccccggccatggccgccaacggtcaccgggtgatggtcgtctccccgcgctacgatcagtacaaggacgcctgggacaccagcgtcatctccgagatcaaggtcgctgacgagtacgagagggtgaggttcttccactgctacaagcgcggagtggaccgcgtgttcatcgaccacccgtggttcctggagaaggtccggggcaagaccaaggagaagatctacgggcccgacgccggcacagactatgaggacaaccagcagcgcttcagccttctctgccaggcagcactcgaggcacccaggatcctcaacctcaacaacaacccctacttttctggtccctacggggaagacgtggtgttcgtgtgcaacgactggcacacgggccttctggcctgctacctcaagagcaactaccagtccaatggcatctacaggacggccaaggtggccttctgcatccacaacatctcgtaccagggccgcttctccttcgacgactttgcgcagctcaacctgcccgacaggttcaagtcgtccttcgacttcattgacggctacgacaagcccgtggaggggcgcaagatcaactggatgaaggccgggatcctgcaggccgacaaggtgctgacggtgagcccctactacgctgaggagctcatctctggcgaagccaggggctgcgagctcgacaacatcatgcgcctcacggggatcaccggaatcgtcaacggcatggacgtcagtgagtgggaccccaccaaggacaagttcctcgccgtcaactacgacatcaccaccgcgttggaggccaaggcgctgaacaaggaggcgctgcaggccgaggtggggctgccggtggacaggaaggtgccgctggtggccttcatcggcaggctggaggagcagaagggccccgacgtgatgatcgccgccatcccggagatcctgaaggaggaggacgtccagatcattctccttggcaccgggaagaagaagtttgagaagctgctcaagagcatggaggagaagttcccgggcaaggtgagggccgtggtcaggttcaacgcgccgctagctcaccagatgatggccggcgccgacttgctcgctgtcaccagccgcttcgagccctgcggcctcatccagctccagggaatgcgctatggaacgccgtgcgtgtgcgcgtccaccggcgggctcgtcgacacgatcgtggagggcaagaccgggttccacatgggccgcctcagcgtcgactgcaacgtggtggagccggcggacgtgaagaaggtggcgaccaccctgaagcgggccgtcaaggtcgtcggcacgccggcgtaccaggagatggtcaagaactgcatgatccaggatctctcctggaagggacctgccaagaactgggaggacgtgcttctggaactgggggtggaggggagcgagccggggatcgtcggcgaggagatcgcgccgctcgccatggagaacgtcgccgctccctga

SEQ ID NO: 4758 - protein, 603 aa, Hordeum vulgare (barley)
MAALATSQLATSGTVLGVTDRFRRPGFQGLRPRNPADAALGMRTIGASAAPKQSRKAHRGSRRCLSVVVSATGSGMNLVFVGAEMAPWSKTGGLGDVLGGLPPAMAANGHRVMVVSPRYDQYKDAWDTSVISEIKVADEYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKGPAKNWEDVLLELGVEGSEPGIVGEEIAPLAMENVAAP

SEQ ID NO: 4759 - DNA, 2161 bp, Solanum tuberosum (potato)
  CDS (37)..(1860)
cttggtagattcccctttttgtagaccacacatcacatggcaagcatcacagcttcacaccactttgtgtcaagaagccaaacttcactagacaccaaatcaaccttgtcacagataggactcaggaaccatactctgactcacaatggtttaagggctgttaacaagcttgatgggctccaatcaagaactaatactaaggtaacacccaagatggcatccagaactgagaccaagagacctggatgctcagctaccattgtttgtggaaagggaatgaacttgatctttgtgggtactgaggttggtccttggagcaaaactggtggactaggtgatgttcttggtggactaccaccagcccttgcagcccgcggacatcgggtaatgacaatatccccccgttatgaccaatacaaagatgcttgggatactagcgttgcggttgaggtcaaagttggagacagcattgaaattgttcgtttctttcactgctataaacgtggggttgatcgtgtttttgttgaccacccaatgttcttggagaaagtttggggcaaaactggttcaaaaatctatggccccaaagctggactagattatctggacaatgaacttaggttcagcttgttgtgtcaagcagccctagaggcacctaaagttttgaatttgaacagtagcaactacttctcaggaccatatggagaggatgttctcttcattgccaatgattggcacacagctctcattccttgctacttgaagtcaatgtaccagtccagaggaatctatttgaatgccaaggtcgctttctgcatccataacattgcctaccaaggccgattttctttctctgacttccctcttctcaatcttcctgatgaattcaggggttcttttgatttcattgatggatatgagaagcctgttaagggtaggaaaatcaactggatgaaggctgggatattagaatcacatagggtggttacagtgagcccatactatgcccaagaacttgtctctgctgttgacaagggtgttgaattggacagtgtccttcgtaagacttgcataactgggattgtgaatggcatggatacacaagagtggaacccagcgactgacaaatacacagatgtcaaatacgatataaccactgtcatggacgcaaaacctttactaaaggaggctcttcaagcagcagttggcttgcctgttgacaagaagatccctttgattggcttcatcggcagacttgaggagcagaaaggttcagatattcttgttgctgcaattcacaagttcatcggattggatgttcaaattgtagtccttggaactggcaaaaaggagtttgagcaggagattgaacagctcgaagtgttgtaccctaacaaagctaaaggagtggcaaaattcaatgtccctttggctcacatgatcactgctggtgctgattttatgttggttccaagcagatttgaaccttgtggtctcattcagttacatgctatgcgatatggaacagtgccaatctgtgcatcgactggtggacttgttgacactgtgaaagaaggctatactggattccatatgggagccttcaatgttgaatgcgatgttgttgacccagctgatgtgcttaagatagtaacaacagttgctagagctcttgcagtctatggcaccctcgcatttgctgagatgataaaaaattgcatgtcagaggaactctcctggaaggaacctgccaagaaatgggagacattgctattgggcttaggagcttctggcagtgaacccggtgttgaaggggaagaaatcgctccacttgccaaggaaaatgtagccactccctaaatgagctttggttatccttgtttcaacaataagatcattaagcaaacgtatttactagcgaactatgtagaaccctattatggggtctcaatcatctacaaaatgattggtttttgctggggagcagcagcatattaggctgtaaaatcctggttaatgattttgtaggtaagggctatttaaggttgtgtggatcaaagtcaatagaaaatagttattactaacgtttgcaactaaatacttagtaatgtagcataaataatactagtagctaatatatatgcgtgaatttgttgtacct

SEQ ID NO: 4760 - protein, 607 aa, Solanum tuberosum (potato)
MASITASHHFVSRSQTSLDTKSTLSQIGLRNHTLTHNGLRAVNKLDGLQSRTNTKVTPKMASRTETKRPGCSATIVCGKGMNLIFVGTEVGPWSKTGGLGDVLGGLPPALAARGHRVMTISPRYDQYKDAWDTSVAVEVKVGDSIEIVRFFHCYKRGVDRVFVDHPMFLEKVWGKTGSKIYGPKAGLDYLDNELRFSLLCQAALEAPKVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDSVLRKTCITGIVNGMDTQEWNPATDKYTDVKYDITTVMDAKPLLKEALQAAVGLPVDKKIPLIGFIGRLEEQKGSDILVAAIHKFIGLDVQIVVLGTGKKEFEQEIEQLEVLYPNKAKGVAKFNVPLAHMITAGADFMLVPSRFEPCGLIQLHAMRYGTVPICASTGGLVDTVKEGYTGFHMGAFNVECDVVDPADVLKIVTTVARALAVYGTLAFAEMIKNCMSEELSWKEPAKKWETLLLGLGASGSEPGVEGEEIAPLAKENVATP

SEQ ID NO: 4761 - DNA, 2825 bp, Triticum aestivum
  CDS (162)..(2561)
cttcggcctgaccccgttcgtttacccccacacagagcacactccagtccagtccagcccactgccaccgcgctactctccactcccactgccaccacctccgcctgcgccgcgctctgggcggaccaacccgcgaaccgtaccatctcccgccccgatccatgtcgtcggcggtcgcgtccgccgcatccttcctcgcgctcgcgtcagcctcccccgggagatcacgcaggcgggcgagggtgagcgcgcagccaccccacgccggggccggcaggttgcactggccgccgtggccgccgcagcgcacggctcgcgacggagctgtggcggcgctcgccgccgggaagaaggacgcggggatcgacgacgccgccgcgtccgtgaggcagccccgcgcactccgcggtggcgccgccaccaaggtcgcggagcgaagggatcccgtcaagacgctcgaccgcgacgccgcggaaggcggcgggccgtccccgccggcagcgaggcaggacgccgcccgtccgccgagtatgaacggcatgccggtgaacggcgagaacaaatctaccggcggcggcggcgcgactaaagacagcgggctgcccacgcccgcacgcgcgccccatccgtcgacccagaacagagcaccggtgaacggtgaaaacaaagctaacgtcgcctcgccgccgacgagcatagccgaggccgcggcttcggattccgcagctaccatttccatcagcgacaaggcgccggagtccgttgtcccagctgagaagacgccgccgtcgtccggctcaaatttcgagtcctcggcctctgctcccgggtctgacactgtcagcgacgtggaacaagaactgaagaagggtgcggtcgttgtcgaagaagctccaaagccaaaggctctttcgccgcctgcagcccccgctgtacaagaagacctttgggatttcaagaaatacattggtttcgaggagcccgtggaggccaaggatgatggccgggctgtcgcagatgatgcgggctcctttgaacaccaccagaatcacgactccggacctttggcaggggagaatgtcatgaacgtggtcgtcgtggctgctgagtgttctccctggtgcaaaacaggtggtctgggagatgttgcgggtgctctgcccaaggctttggcaaagagaggacatcgtgttatggttgtggtaccaaggtatggggactatgaagaagcctacgatgtcggagtccgaaaatactacaaggctgctggacaggatatggaagtgaattatttccatgcttatatcgatggagttgattttgtgttcattgacgctcctctcttccgacaccgtcaggaagacatttatgggggcagcagacaggaaattatgaagcgcatgattttgttctgcaaggccgctgttgaggttccatggcacgttccatgcggcggtgtcccttatggggatggaaatctggtgtttattgcaaatgattggcacacggcactcctgcctgtctatctgaaagcatattacagggaccatggtttgatgcagtacactcggtccattatggtgatacataacatcgctcaccagggccgtggccctgtagatgaattcccgttcaccgagttgcctgagcactacctggaacacttcagactgtacgaccccgtgggtggtgaacacgccaactacttcgccgccggcctgaagatggcggaccaggttgtcgtggtgagccccgggtacctgtgggagctgaagacggtggagggcggctgggggcttcacgacatcatacggcagaacgactggaagacccgcggcatcgtcaacggcatcgacaacatggagtggaaccccgaggtggacgcccacctcaagtcggacggctacaccaacttctccctgaggacgctggactccggcaagcggcagtgcaaggaggccctgcagcgcgagctgggcctgcaggtccgcgccgacgtgccgctgctcggcttcatcggccgcctggacgggcagaagggcgtggagatcatcgcggacgccatgccctggatcgtgagccaggacgtgcagctggtgatgctgggcaccgggcgccacgacctggagagcatgctgcagcacttcgagcgggagcaccacgacaaggtgcgcgggtgggtggggttctccgtgcgcctggcgcaccggatcacggcgggggcggacgcgctcctcatgccctcccggttcgagccgtgcgggctgaaccagctctacgccatggcctacggcaccgtccccgtcgtgcacgccgtcggcggcctcagggacaccgtgccgccgttcgaccccttcaaccactccgggctcgggtggacgttcgaccgcgccgaggcgcacaagctgatcgaggcgctcgggcactgcctccgcacctaccgagacttcaaggagagctggagggccctccaggagcgcggcatgtcgcaggacttcagctgggagcacgccgccaagctctacgaggacgtcctcgtcaaggccaagtaccagtggtgaacgctagctgctagccgctccagccccgcatgcgtgcatgacaggatggaactgcattgcgcacgcaggaaagtgccatggagcgccggcatccgcgaagtacagtgacatgaggtgtgtgtggttgagacgctgattccaatccggcccgtagcagagtagagcggaggtatatgggaatcttaacttggtattgtaatttgttatgttgtgtgcattattacaatgttgttacttattcttgttaaaaaaaaaaaaaaaaaa

SEQ ID NO: 4762 - protein, 799 aa, Triticum aestivum
MSSAVASAASFLALASASPGRSRRRARVSAQPPHAGAGRLHWPPWPPQRTARDGAVAALAAGKKDAGIDDAAASVRQPRALRGGAATKVAERRDPVKTLDRDAAEGGGPSPPAARQDAARPPSMNGMPVNGENKSTGGGGATKDSGLPTPARAPHPSTQNRAPVNGENKANVASPPTSIAEAAASDSAATISISDKAPESVVPAEKTPPSSGSNFESSASAPGSDTVSDVEQELKKGAVVVEEAPKPKALSPPAAPAVQEDLWDFKKYIGFEEPVEAKDDGRAVADDAGSFEHHQNHDSGPLAGENVMNVVVVAAECSPWCKTGGLGDVAGALPKALAKRGHRVMVVVPRYGDYEEAYDVGVRKYYKAAGQDMEVNYFHAYIDGVDFVFIDAPLFRHRQEDIYGGSRQEIMKRMILFCKAAVEVPWHVPCGGVPYGDGNLVFIANDWHTALLPVYLKAYYRDHGLMQYTRSIMVIHNIAHQGRGPVDEFPFTELPEHYLEHFRLYDPVGGEHANYFAAGLKMADQVVVVSPGYLWELKTVEGGWGLHDIIRQNDWKTRGIVNGIDNMEWNPEVDAHLKSDGYTNFSLRTLDSGKRQCKEALQRELGLQVRADVPLLGFIGRLDGQKGVEIIADAMPWIVSQDVQLVMLGTGRHDLESMLQHFEREHHDKVRGWVGFSVRLAHRITAGADALLMPSRFEPCGLNQLYAMAYGTVPVVHAVGGLRDTVPPFDPFNHSGLGWTFDRAEAHKLIEALGHCLRTYRDFKESWRALQERGMSQDFSWEHAAKLYEDVLVKAKYQW

SEQ ID NO: 4763 - DNA, 2771 bp, Triticum aestivum
  CDS (280)..(2550)
cgccactccactcgccttgccccactcccactcttctctccccgcgcacaccgagtcggcaccggctcatcacccatcacctcggcctcggccaccggcaaaccccccgatccgcttttgcaggcagcgcactaaaaccccggggagcgcgccccgcggcagcagcagcaccgcagtgggagagagaggcttcgccccggcccgcaccgagcggggcgatccaccgtccgtgcgtccgcacctcctccgcctcctcccctgtcccgcgcgcccacacccatggcggcgacgggcgtcggcgccgggtgcctcgcccccagcgtccgcctgcgcgccgatccggcgacggcggcccgggcgtccgcctgcgtcgtccgcgcgcggctccggcgcttggcgcggggccgctacgtcgccgagctcagcagggagggccccgcggcgcgccccgcgcagcagcagcaactggccccgccgctcgtgccaggcttcctcgcgccgccgccgcccgcgcccgcccagtcgccggccccgacgcagccgcccctgccggacgccggcgtgggggaactcgcgcccgacctcctgctcgaagggattgctgaggattccatcgacagcataattgtggctgcaagtgagcaggattctgagatcatggatgcgaatgagcaacctcaagctaaagttacacgtagcatcgtgtttgtgactggtgaagctgctccttatgcaaagtcaggggggttgggagatgtttgtggttcgttaccaattgctcttgctgctcgtggtcaccgagtgatggttgtaatgccaagatacttaaatgggtcctctgataaaaactatgcaaaggcattatacactgcgaagcacattaagattccatgctttgggggatcacatgaagtgaccttttttcatgagtatagagacaacgtcgattgggtgtttgtcgatcatccgtcatatcacagaccaggaagtttatatggagataattttggtgcttttggtgataatcagttcagatacacactcctttgctatgctgcatgcgaggccccactaatccttgaattgggaggatatatttatggacagaattgcatgtttgttgtgaacgattggcatgccagccttgtgccagtccttcttgctgcaaaatatagaccatacggtgtttacagagattcccgcagcacccttgttatacataatttagcacatcagggtgtggagcctgcaagtacatatcccgatctgggattgcctcctgaatggtatggagctttagaatgggtatttccagaatgggcaaggaggcatgcccttgacaagggtgaggcagttaactttttgaaaggagcagttgtgacagcagatcggattgtgaccgtcagtcagggttattcatgggaggtcacaactgctgaaggtggacagggcctcaatgagctcttaagctcccgaaaaagtgtattgaatggaattgtaaatggaattgacattaatgattggaaccccaccacagacaagtgtctccctcatcattattctgtcgatgacctctctggaaaggccaaatgtaaagctgaattgcagaaggagttgggtttacctgtaagggaggatgttcctctgattggctttattggaagactggattaccagaaaggcattgatctcattaaaatggccattccagagctcatgagggaggacgtgcaatttgtcatgcttggatctggggatccaatttttgaaggctggatgagatctaccgagtcgagttacaaggataaattccgtggatgggttggatttagtgttccagtttcccacagaataactgcaggttgcgatatattgttaatgccatcgagatttgaaccttgcggtcttaatcagctatatgctatgcaatatggtacagttcctgtagttcatggaactgggggcctccgagacacagtcgagaccttcaacccttttggtgcaaaaggagaggagggtacagggtgggcgttctcaccgctaaccgtggacaagatgttgtgggcattgcgaaccgcgatgtcgacattcagggagcacaagccgtcctgggaggggctcatgaagcgaggcatgacgaaagaccatacgtgggaccatgccccgagcagtacgagcagatcttcgagtgggccttcgtggaccaaccctacgtcatgtagacggggactggggaggtccaagtgcgagtctccttcagctctgaagacatcctcttcatccttccgcggcccggaaggatacccctgtacattgcgttgtcctgctacagtagagtcgcaatgcgcctgcttgctttggttcgccggttcgagaacatatgacggctgtgctgctgcggcggtgacagcttcgggtggacgacagttacagttttggggaataaggaagggatgtgctgcaggatggttaacagcaaagcaccactcagatggcagcctctctgtccgtgttacagctgaaatcagaaaccaactggtgactctttagccttagtgattgtgaagtttgttgccttctgtgtatgttgtcttgtccttagccgacaaatatttgacctgttggagaattttatctttgctgctgtttttttttaatcaaaagagggggtttcctccgatttcattaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4764 - protein, 756 aa, Triticum aestivum
MAATGVGAGCLAPSVRLRADPATAARASACVVRARLRRLARGRYVAELSREGPAARPAQQQQLAPPLVPGFLAPPPPAPAQSPAPTQPPLPDAGVGELAPDLLLEGIAEDSIDSIIVAASEQDSEIMDANEQPQAKVTRSIVFVTGEAAPYAKSGGLGDVCGSLPIALAARGHRVMVVMPRYLNGSSDKNYAKALYTAKHIKIPCFGGSHEVTFFHEYRDNVDWVFVDHPSYHRPGSLYGDNFGAFGDNQFRYTLLCYAACEAPLILELGGYIYGQNCMFVVNDWHASLVPVLLAAKYRPYGVYRDSRSTLVIHNLAHQGVEPASTYPDLGLPPEWYGALEWVFPEWARRHALDKGEAVNFLKGAVVTADRIVTVSQGYSWEVTTAEGGQGLNELLSSRKSVLNGIVNGIDINDWNPTTDKCLPHHYSVDDLSGKAKCKAELQKELGLPVREDVPLIGFIGRLDYQKGIDLIKMAIPELMREDVQFVMLGSGDPIFEGWMRSTESSYKDKFRGWVGFSVPVSHRITAGCDILLMPSRFEPCGLNQLYAMQYGTVPVVHGTGGLRDTVETFNPFGAKGEEGTGWAFSPLTVDKMLWALRTAMSTFREHKPSWEGLMKRGMTKDHTWDHAPSSTSRSSSGPSWTNPTSCRRGLGRSKCESPSALKTSSSSFRGPEGYPCTLRCPATVESQCACLLWFAGSRTYDGCAAAAVTASGGRQLQFWGIRKGCAAGWLTAKHHSDGSLSVRVTAEIRNQLVTL

SEQ ID NO: 4765 - DNA, 4121 bp, Zea mays
  CDS (442)..(3954)
gaattcggcacgagccgctttggatccacctctctgcgcgcggggccgcgcctgcacttcgcacagtggcaggcggcagcccccaacgccatccacacatcccccggcaaaatccttacccaccgaaaaaagggaaaaatggaggcaggcaggcggcactgcggcagtcacacatgcgcacgggcacggtaaaagtacgagccaccttttccctctcgatcgagcggccgaggaggaggagagcctctctgtctctggcgaggggcgactgggcgagcgcttcgtctagacagcccagctgcgcatttggatgcaaattacgtgtggaggatggagtaaaatactgagcaagggagagggaagaggagacggtcttttcttttcttgagccgaggagggggatcaggtggagtgagcgagggggaggttttgccgccggcaatggagatgaatctccgggcggagagcccactctgctcccggggccgccccgccctcgtcgtgcgcccggccgctgcagccactggcctcgcgctgtctgtcgtaaggtgcagcagatttacgagaggcgggctcgttcgatgcatggtatcaagttcagattatcccaagaggaatccgaggagggcatcgacttctaagagcaagggcgttgcctctggagggtatgcttcgagacctactgctgaatccagtacgaagaagatagaacagagcaggaacaatgaaggtgatttcagcagagccaatgggtcactctatggcgaggcagcagagcaggcaagtactgctgaagaatcgtctcaggtttacatgacaggagacattttaagtggcgcagaaagggacggagctggtaccgaagaagaggctgaccaaaatcaatcttcagcgttgccttccgcgtccatggatgatgactcaatcgaccggcaacttgatgagtaccgtggtaaaataagtgctctagtaagttccaaacctgaaccttcgtcacttgcaagtgttgctggacaaaacgaatcagttggcggttttcacggccagcacgaaccaataactggttctgaggaacatggcagttcaattgttgatgcaccaataaaaggcaggctatttgctgaggccgttgtgggtcataaggattttactgaatcagcagcaggaaaggcaagcagcgagaatgaggaagggcaagctgtctcgttagaagatgatgtcgggataagtacagacgcagatgaagagcttccggtatctgaagatgatccagaagtgctactgaggaggcttcaagagcttgctgatgagaattattcgactgggaacaactgttttgttttccctgaagtagtgaaggctgattcgatgattgatctttacttaaaccgcagcatgtcggccttagctagtgagtccgacgtttttgtaaaaggagcattcaatggttggagatggaaccgtttcactgaaacaatgcatagaagcgaattaagaggggattggtggtgctgcaagctctacattcccaagcaggcatacagactagactttgtattctttaacggtgacactgtctatgaaaataacaatcacaacgattttttcctggaaatagaaagtgacatagatgaacactcatttgaggacttcttggttgaagaaaagcgaaaggaactcgagaggcttgctgcagaagaagctgaaaggaaaagacaagctgaggagcggcacaggagagaggaagaaagggccgcgatggaagctgacagggcacaagcaaggtctgaggtcgagatgaagaaagagaaattgcgccagatgttgagttcggctagcagatatgctgagaacttatggtacatagaacctaacacctacagaggaggagacagagttagattgtactataatagaagctcgagatcactaatgcataacactgagatttggatgcatggaggttataacaactggattgatggactctcaatagctgaaagacttgtcaaatctcatgaaaaggaaggcgattggtggtatgtagaagttacattacctgaaagggcattggtgttggattgggtttttgctgatggaccacctgggaatgcaaggaattatgataacaatggaaggcaggattttcatgccatcgttcctaataacatatcggatgatatcttttgggtggaagaagaacataggatctttacaaggcttcaacaagagagaagagaaagggagagtgccgaaagaataaaggctgagagatctgcaaaaatgaaggctgagatgaaggaaaagactatgagagcgtttctgctctcacaaaaacatattgtgtatactgagccactcgaagtacgtgcaggaaccactgtggacgttctttataatccttctaacacagtgctgaatggaaagtcagaggtttggttcagaggttcctttaaccgttggactcatccaagtggtcccttaccaccacagaagatggtaaaggctgagaatagttcacacttacgaacaacagtcagtgttcccctggatgcatatatgatggactttgttttctctgagtcggaagaaggtggaagatatgacaataggaacgggatggattatcatattcctgtgtctgattcggttgcaagggaacctccaatgcatattgtacacattgcagtggaaatggctcctatcgcaaaggttggaggccttggtgatgttgttacaagcctttcacgagctgttcaggatttaggccataaagttgaggttattctgccgaagtatgattgtttaatcctaagcagtgtgaaggatttacactaccaacaaagttttgcttcgggtggcacagaggtaaaagtatggtttggaaaggttgaagatctgccagtttacttcttggaaccacaaaatggcatgttttgggttggatgtgtgtatgggaagaatgatgagagtagatttggcttcttctgtcattctgctctggagtttctgctccaaaaaggatcttctcctgatatcatacattgtcatgactggtcaagtgctcccgttgcttggctatacaaggaacagtatgctcttaatgggctgggaaatggtcggattgtatttaccatccacaatcttgagtttggagcgcatcacattggcaaggcaatggcacattgtgacaaggctacaactgtctctgatacatattcaaaggaagtggctggacatggagctattgcacctcactactataaattccatggaattcgaaatggaattgatcctgacatttgggatccatatactgacagatttattccggttcattatacatcagagaatgttcttgagggcaagggtgctgcaaaaaaggcattgcagcagatgcttggattacagcaaactgatagccctgttgttggaatcatcactcgtctaacagtgcagaagggaatccaccttatcaaacatgcaatgcatcgagctcttgaacgcaatgggcaggtggttttactgggttctgcaccagatcatcgcatacaaggtgactttacaaatttagccagtaagctgcatggtgaataccatggccgggtgaagctatgtttaacctatgacgagccactgtcacatttgcttattgctatgcgctacggatccatcccgattgttcggaaaactggaggcctgtacgacaccgtctttgacgtcgacgatgataaggatcgggctcaagcacaaggcctcgagccaaatggattcagtttcgaaggagctgatagcagtggtgtagattatgctctcgacagagctataaccgcgttttatgatgcccgcgactggttcaactcccttagcaagagggtaatggagcaagattggtcatggaatagacctgcactagactacatggagttgtaccattctgctcgcaaaaactgatacattttaccacaagggaaaacaggcccagtttgcccagtttatgagcatctcagatgcaacacagagtgtatagttagagaatgccacccgttgtacgttactgccgttacatgcatgtgtatacacatctaaaaaaaaaaaaaaaaaaacggcacgagctcgtg

SEQ ID NO: 4766 - protein, 1170 aa, Zea mays
MEMNLRAESPLCSRGRPALVVRPAAAATGLALSVVRCSRFTRGGLVRCMVSSSDYPKRNPRRASTSKSKGVASGGYASRPTAESSTKKIEQSRNNEGDFSRANGSLYGEAAEQASTAEESSQVYMTGDILSGAERDGAGTEEEADQNQSSALPSASMDDDSIDRQLDEYRGKISALVSSKPEPSSLASVAGQNESVGGFHGQHEPITGSEEHGSSIVDAPIKGRLFAEAVVGHKDFTESAAGKASSENEEGQAVSLEDDVGISTDADEELPVSEDDPEVLLRRLQELADENYSTGNNCFVFPEVVKADSMIDLYLNRSMSALASESDVFVKGAFNGWRWNRFTETMHRSELRGDWWCCKLYIPKQAYRLDFVFFNGDTVYENNNHNDFFLEIESDIDEHSFEDFLVEEKRKELERLAAEEAERKRQAEERHRREEERAAMEADRAQARSEVEMKKEKLRQMLSSASRYAENLWYIEPNTYRGGDRVRLYYNRSSRSLMHNTEIWMHGGYNNWIDGLSIAERLVKSHEKEGDWWYVEVTLPERALVLDWVFADGPPGNARNYDNNGRQDFHAIVPNNISDDIFWVEEEHRIFTRLQQERRERESAERIKAERSAKMKAEMKEKTMRAFLLSQKHIVYTEPLEVRAGTTVDVLYNPSNTVLNGKSEVWFRGSFNRWTHPSGPLPPQKMVKAENSSHLRTTVSVPLDAYMMDFVFSESEEGGRYDNRNGMDYHIPVSDSVAREPPMHIVHIAVEMAPIAKVGGLGDVVTSLSRAVQDLGHKVEVILPKYDCLILSSVKDLHYQQSFASGGTEVKVWFGKVEDLPVYFLEPQNGMFWVGCVYGKNDESRFGFFCHSALEFLLQKGSSPDIIHCHDWSSAPVAWLYKEQYALNGLGNGRIVFTIHNLEFGAHHIGKAMAHCDKATTVSDTYSKEVAGHGAIAPHYYKFHGIRNGIDPDIWDPYTDRFIPVHYTSENVLEGKGAAKKALQQMLGLQQTDSPVVGIITRLTVQKGIHLIKHAMHRALERNGQVVLLGSAPDHRIQGDFTNLASKLHGEYHGRVKLCLTYDEPLSHLLIAMRYGSIPIVRKTGGLYDTVFDVDDDKDRAQAQGLEPNGFSFEGADSSGVDYALDRAITAFYDARDWFNSLSKRVMEQDWSWNRPALDYMELYHSARKN

SEQ ID NO: 4767 - DNA, 3240 bp, Chlamydomonas reinhardtii
  CDS (138)..(2264)
acgaggtccactcttagcacgcgactcaaagtagtcgcttaagacgtcgcaaaccccagcggtcgtcgccgaaacctacgacgatgcagactcttgccggccagcgcgtggccgcgcccgtccgccaggcggagcgtatggctgttgcctctaccagccgccccagcagcgcgcgtcctatcgtcatcaatgccgcgtcgttcggtgtcaagaagaccgcgaaccagctgctgcgtgagcttgctcgtggctccgcacgcaagtccacctcgcgctcggctgttactggtgccactggtgccacttgcgcgctggacatcgtgatggttgctgctgaggtcgccccttggtccaagacgggcggcctgggcgatgtgactggtggcctgcctattgagctggtcaagcgcggccaccgcgtcatgaccattgcccctcgctacgaccagtacgctgacgcctgggacacctcggtggtcgtggacatcatgggcgagaaggtccgctacttccactccatcaagaagggcgtgcaccgcgtgtggattgaccacccctggttcctggccaaggtctggggcaagaccggctccaagctgtacggcccccgctccggcgctgactacctggacaaccacaagcgcttcgccctgttctgcaaggccgctattgaggctgcccgcgtgctgcccttcggccccggcgaggactgcgtcttcgtggccaacgactggcactccgccctggtgcccgtcctgctgaaggacgagtaccagcccaagggccagttcaccaaggccaagtcggtgctggctatccacaacatcgccttccagggccgcatgtgggaggaggctttcaaggacacgaagctgccccaggccgcctttgacaagctggccttctcggacggctatgccaaggtttacactgaggccacccccatggaggaggacgagaagcccccgctgacgggaaagacctacaagaagatcaactggctgaagggtggcattatcgccgccgacaagctggtgactgtgtcgcccaactacgcgaccgagatcgctgccgatgccgccggcggtgtggagctggacaccgtcatccgcgccaagggcattgagggcattgtgaacggcatggacattgaggagtggaaccccaagaccgacaagttcctgtctgtgccctacgaccagaacagcgtctacgccggcaaggccgccgccaaggaggccctgcaggccgagctgggcctgcctgtggaccccaccgcccccctgttcgccttcatcggccgcctggaggagcagaagggtgtggacatcatcctggccgccctgcccaagatcctggccacccccaaggtgcagatcgccatcctgggtaccggcaaggccgcctacgagaagctggtgaacgccatcggcaccaagtacaagggccgcgccaagggcgtggtcaagttctcggcgcccctggcgcacatgctcaccgccggcgccgacttcatgctggtgccctcgcgcttcgagccctgcggcctgatccagctgcacgccatgcactacggtaccgtgcccgtggtagcctccaccggcggcctggtcgacaccgtcaaggagggcgtcaccggcttccacatgggcgccctgaaccccgacaagctggacgaggctgacgccgacgccctggccgccaccgtgcgccgtgccagcgaggtgtttgcgggcggccgctaccccgagatggtggccaactgcatcagccaggacctgtcctggtccaagcccgcccagaagtgggagggcctgctggaggaggtggtgtacggcaagggcggcgtggccaccgccaagaaggaggagatcaaggtgcccgttgccgagaagatccccggcgacctgcccgccgtgtcctacgcccccaacaccctgaagcccgtgtccgcctccgtggagggcaacggcgccgccgcgcccaaggtcggcaccaccgcccccgccatgggcgcgtggcgcgcgaccaccccctcgggcccctcgcccgccgccgccacccccaaggtgaccacctacaagcccgccctgcccgccaccgccaagcccaagaccgctggcctcaagctggccggtgaggcctccaccacctcgacctcggagaacggcgctgcctccaacggcaacggcaacggtgcctcggcctccaagacctcggctgccaagcccctggtctccgccgccacccgcaagtccgcctaaagcggcagtagccgcagaggcggcgacagcatgagcggctcgaccaaagctgtggcaggaacggctgtagcagcggcaggcggccgccaccggcgaggagcaggcttgcggcagcgagggcgatgagcttagcggccgtgagcatggcaggcggaaacgtgtgtactgaaatgtggtgcatgagagtgtcgtgctgtaatgaagtcggttttgcgagaccggagaaacgccggtttggttttgtagtgcagggcctgtggtttcggttttgcccaagtccaaaagaagagtaacgaaactgtagcagtagcagagcacttgcgcggcgcggcgaccacgccggcccgtgcgcagcctgtcctgccctcagccttgtgattcggcggcaagagggcgggtctgtacactccatccattccaggatttttgcaggctgcctgagagtttgccattttgtgggacgtgagcggcgggacggccgcgccgggctctcctaccgcctccggcaacggagaagtgggaggcgctgtagcccggtgaccccccaatgtagaggatgggatacataagagcgtgtggaatggtggtaaaagaggaggggcctgggtcgcccctcgatggttttgttgaggtgcagacggcaccgtcggcgtcaaaggccctcgcaaggcccgggtgccttgggctcatttttggtgcccgtcgatgatgagagattggccagcggttttttgaggctggctcgaagcgagggtttgtggaagtggagcgaggagggttggagaaagaggcggacatgcttgactggaggtacacaaagtggagcgtgcgacggcacggaggcattggcggactattgacccagtagtgtggaaagtagttggacctgaattctttgagagtaccgcgcattaatccgtgagagagtaacaaagatggcacctgaaaaaaaaaaaaaaaaaaaaaaaaaaaaaaa

SEQ ID NO: 4768 - protein, 708 aa, Chlamydomonas reinhardtii
MAVASTSRPSSARPIVINAASFGVKKTANQLLRELARGSARKSTSRSAVTGATGATCALDIVMVAAEVAPWSKTGGLGDVTGGLPIELVKRGHRVMTIAPRYDQYADAWDTSVVVDIMGEKVRYFHSIKKGVHRVWIDHPWFLAKVWGKTGSKLYGPRSGADYLDNHKRFALFCKAAIEAARVLPFGPGEDCVFVANDWHSALVPVLLKDEYQPKGQFTKAKSVLAIHNIAFQGRMWEEAFKDTKLPQAAFDKLAFSDGYAKVYTEATPMEEDEKPPLTGKTYKKINWLKGGIIAADKLVTVSPNYATEIAADAAGGVELDTVIRAKGIEGIVNGMDIEEWNPKTDKFLSVPYDQNSVYAGKAAAKEALQAELGLPVDPTAPLFAFIGRLEEQKGVDIILAALPKILATPKVQIAILGTGKAAYEKLVNAIGTKYKGRAKGVVKFSAPLAHMLTAGADFMLVPSRFEPCGLIQLHAMHYGTVPVVASTGGLVDTVKEGVTGFHMGALNPDKLDEADADALAATVRRASEVFAGGRYPEMVANCISQDLSWSKPAQKWEGLLEEVVYGKGGVATAKKEEIKVPVAEKIPGDLPAVSYAPNTLKPVSASVEGNGAAAPKVGTTAPAMGAWRATTPSGPSPAAATPKVTTYKPALPATAKPKTAGLKLAGEASTTSTSENGAASNGNGNGASASKTSAAKPLVSAATRKSA

SEQ ID NO: 4769 - DNA, 3049 bp, Chlamydomonas reinhardtii
  CDS (190)..(1920)
cgttggggagtgcatggccgaaaaaatgtggataaggcgtaaacgcgccagcggttgccggttccgttgacctgaccgactcgtggcgtcgcttacgcatgggccgatgtgggtcagcacctgcgtatgctttctgagtccagtggttgccccggctgtacgataggtggagctgccgcttaagagcatatgcttatccgcatcggagccccgccgcggggcccgcggcgaccctgcatacccgcagcgcaccagctccgcttagctagcagtgtcatcattgcattcgtcctccgtgggtgcccccgtgtgcagctgtccctgccgctggagtcggagatgtacattgaaccggctgcgccggtggcggaggcgcccgaggcggaggaggaggagccaccggccgtggagaagccgccgccgctggccggacctaacgttatgaacgtggtcatggtgggagccgagtgcgcgccctggtccaagactggcggcctgggtgacgtgatggcggcgctgcccaaggcgctggtccgccgcggccaccgcgtgatggtggtggtgccccggtatgagaactacgacaacgcctgggagacaggcatccgcaaaatctactcggtcttcaactccaaccaagaggtgggctacttccacgcatttgtggacggcgtggactacgtgtttgtggaccaccccacgttccacggccgggggaagaacatctacggcggcgagcgccaggagattctgtttcgctgcgcgctgctgtgcaaggcggcgctggaggctgtctggcacgtgccgtgcggcggcatcacctatggcgatgacaacctgtgcttcatcgccaacgactggcacacggcgttgctgcccgtgtacctgcaggcgcactaccgtgactacggcgagatgacgtacgcgcgctgcgccttcgtcatccacaacatggcgcaccagggccgcggcccctttgtggagagcgagcacctggagctgaacgaggagtaccgcgagcgcttccgcctgtacgaccccattggcggcgagcacatgaacgtgatgaaggctggcctggagtgcgcccaccgcctggtggctgtgtccaaatgctacgcctgggagtgccagaccgtggagggcggctgggggctgcacgaggtgatcaaggtgaacaactggaagctgcgcggcattgtgaacggcatcgactacaaggagtggaaccccatctgtgacgagttcctcacgacggacggctacgcgcactacgacgtggacacgctggctgagggcaaggccaagtgcaaggcggcgctgcagaaggagctgggcctgccggtggacccggacgccccgatgctgggcttcatcgggcggctggactaccagaagggcgtggacctcatccgcgacaactacgactacatcatgggcgagaagtgccagctggtgatgctgggcagcgggcggcaggacctggaggacgcgctgcgggacatggagaacaggaacaagaaccagtgccgcggctgggtgggcttttccaacaagatggcgcaccgcatcaccgccgccgccgacatcctgctcatgccctcgcgctttgagccgtgcggcttgaaccagctgtacgccatggcttacggcaccgtgcccatcgtgcactctgtgggcggcctgcgcgacaccgtcaagcagtacagcccctttgagaacgtgggcaccggctgggtgtttgagcgcgccgaggcgaacaagctgcgcgagagcattaacaacgctctgtacacctaccgccagttccgtgactcgttccgcggtatccagcgccgcggcatggagcaggacctgacctgggacaacgccgcctccatctatgaggaggtgctggtggccgccaagtaccagtggtagatgcgatatgcaggcgggacgcactgtgacatacgcttgtgatgtgttgtgcatgtgtgtgcatgagaccgcgctgtttgtgggtgttgggaggtcctgcagccttgccttgcaagcctggtgccgagctgcggctgtaagagcccgcgaggggagtggttagggcgtgtgggcttgaaggtggtgcgcccaagggtgcgcctgctagactctagagaagaatgtgtagctgttgacagatacggtagatcatgggtgtggttacatttggtgggacagtgcttgccgggcaacatggcggtgcctgcggatgttaaaatgcgtcgtggagtgggtgccgccccggctgctgtgtcattttagggctccacatctaggccggcttcagtgcccggcaagagcgtgtgtgcacgtttgtgtatgatgtgtttgggaaggccacttttgtggaggggctcagccccttttcccgtgaccggggaacacttgtcccgtggttatgcgcggcgcggataccttccgcagagagaatgcgagtctgggcatgcactgcagcggctcacccacgcagcgttgagagccgagcgcatttgcttgttgcgctgagagaaaataatgctgtcagctgtgatgaagggctgccagggtagcaaggctacctcaggtagaatgggctgagtgatttgttttcaggtaccgataattatattcagccgcacgggtgacggaatgctgcacgtcggcacctatacgtcatgtgatggttttttttggccaacccgtgttttttgatggcgtggataggcttgagttgtgatgcagctgatttccctgacacctgggacggtcctttgttagactacccttgttggtaaacttgcaattatttgaagggccttgcataatcagcccttttcctgccataaggcagccacctccttgttgaagggccttgcgtaattttgttcttttgcacagtgcggggacgtggaacgcatgtcacgcgctgcaggcagcaagtcgtacatttgccggcgcggcttacccgtggccaaatgcaccctctgtgctgtaactctctgatgagaaaaaaaaaaaaaaaaaaaaaaaaaaaaaaaaaaaaaaaaaa

SEQ ID NO: 4770 - protein, 576 aa, Chlamydomonas reinhardtii
MLIRIGAPPRGPRRPCIPAAHQLRLASSVIIAFVLRGCPRVQLSLPLESEMYIEPAAPVAEAPEAEEEEPPAVEKPPPLAGPNVMNVVMVGAECAPWSKTGGLGDVMAALPKALVRRGHRVMVVVPRYENYDNAWETGIRKIYSVFNSNQEVGYFHAFVDGVDYVFVDHPTFHGRGKNIYGGERQEILFRCALLCKAALEAVWHVPCGGITYGDDNLCFIANDWHTALLPVYLQAHYRDYGEMTYARCAFVIHNMAHQGRGPFVESEHLELNEEYRERFRLYDPIGGEHMNVMKAGLECAHRLVAVSKCYAWECQTVEGGWGLHEVIKVNNWKLRGIVNGIDYKEWNPICDEFLTTDGYAHYDVDTLAEGKAKCKAALQKELGLPVDPDAPMLGFIGRLDYQKGVDLIRDNYDYIMGEKCQLVMLGSGRQDLEDALRDMENRNKNQCRGWVGFSNKMAHRITAAADILLMPSRFEPCGLNQLYAMAYGTVPIVHSVGGLRDTVKQYSPFENVGTGWVFERAEANKLRESINNALYTYRQFRDSFRGIQRRGMEQDLTWDNAASIYEEVLVAAKYQW

SEQ ID NO: 4771 - DNA, 2716 bp, Chlamydomonas reinhardtii
  CDS (93)..(2048)
tggcgctggttgattcgcgctaggggtttgcaattttgctcgcacacagcctgtcacccggccagcccgctattgggctttttgtactagaaatgaagagcttcatgcggagggatgcgctcggcgcggggctccgcggtgcagccagcacaaagcccgtctcaagggtcgccagcgtgaggcctgcgcctaccgcctaccgcactgcctgccaagttgcgaaggtggatgaaatggtgtcggtggatgaggagcttactcgtctccgcaaggagaacgagctcctgcgcgcccaactggcgctgtaccagcagaaccagcagccgtccgtgggtgccgctgccgttgccccgcctgctgccgccacgaaggtgctggagaagccggcgccggccaagcaggcttccgtggatggtggcatcatctggcccaagccgggtgaggcgttctgggagcgcagcccccgcgcatcgcccatgccgctgcaaggcggtgcggcggaggcgccccccgttgagcgtgacggtaaccccatgcacatcattcacatcaccgccgagatggcaccaattgccaaggtgggcggcctaggcgacgtggtgactgggctggccaaggcggcgctggcgcgcggccacttcgtgacggtcatgctgccgttctacgagtgcctgcccaaggaccagattgagggcctcaagcacgaatgcgacatcgaggtgcccaagggctaccgctgggacggcgagatccgcgtgggcccgctcaagacgtcagtgttctggggccgtgtccagggctgccccgtgtacctgatcaagcccgctgacgacaccaactgcaacatcttccgcggcggccgcatttacggcggctcctacaacgagatggaggcctacctgtacttctgcagggcctgcctggagtacctgaacgtgtcgcagcagaacccgcacgtgttgcagctgcacgactggcacgccgccgccgcgtccatgctgtactgggacgtgtacaaccccaacggcttcagtcgcacgcgcctgatgctcaccatccacaacctggacaacaccggcgagacccgccaggacgagttcttcttcacaggtgtgccgggtgagaacttcgccaccattgataaggcgctggacgagcgcaccatcggccacaaccctgagcgcctcaacctcatgaagggcggcatcgtgtactgcaacgcggtgaccaccgtgtcgcctacctatgccaacgaggtcctcaacggcggcgcggctggctggctgcggagcaccttcgcgcgccccgagctgcgctccaagttccacggcatcctgaacggcattgactgtgaggagtggaacccggccactgacgcgctgctgccagccaacttcgacgccgaccgccccgccgggaaggcgctgtgcaaggagtttctgcagaagggtctgggcctggaggtggacccccgcaagccgctggtggcggtggtgagccggctggtgccgcagaagggcatccacctcatcaaggccgcgctgtttcgcaccgtggagaagggcggccagttcgtgctgctgggctcgggccactcggacccggccttcaggcagctggctgacgggcagttcaaggaccaccccaactgcaggctgaagatcatgtacagcgagcgcctggcgcacatgatttacgccgctgctgacgtggtggtggtgccgtccatgtttgagccgtgcggcctcacgcagatgattgcgctgcgctacggcgcggtgccgctggtgcgccgcacgggcggcctggcagacacggtgtttgatgtggacggcccggccggcgggcccgcgcagccccgcaacggcttcgtgttcgacggctccgacgacggcgcgctgcatggcgccctggaccgcgccctgaccctgtacaccacgcagcctgagcgctgggcggcgctgcagcaggacaacatgcgcctggacgtcagctggggcaagtcggcgaagagctacgtggacgtgtaccgctccatcagcgcctgagcaggaagattgagatgactcaacagagattggagaaaaggacgagggcgcagcacgtcctgcatagtgcaagagtgctgcgggcgcagtggcagcgaaggagcaggcacggcgtaacgtcacacatgcacgctaatgggtgtgccccgctgcggggacggcattggttctggggaccgctcgtgagttcacctattgtttactgctggcctggtcttcagacggggctgcagtgcttgtattatcagcaagggacttatttttgccggtggcatagtaacggtaccatttgagagagaggtatcacagagaggcatggcaccgtacatccgatgatttgggtggggcgctggcggttttgcgggagcgcacgacacgcgttgcgcacaagtagcccgcgagttttgtacctcgcctcgaaccacgtttttggggtgcgtttgagggcgaaaccattttgcagggagatgagagaggacgaggttggcagaacgcggtggtgccatacatggaacgattgcgccacccgtaggccagtggtaccgtatccgccggggaattccgagcgagccttgtacgtcacgcttgtacgtaactcggttactgcggacacagaacttgctatttttatatttaaggaattcggccactaaaaaaaaaaaaaaaaa

SEQ ID NO: 4772 - protein, 651 aa, Chlamydomonas reinhardtii
MKSFMRRDALGAGLRGAASTKPVSRVASVRPAPTAYRTACQVAKVDEMVSVDEELTRLRKENELLRAQLALYQQNQQPSVGAAAVAPPAAATKVLEKPAPAKQASVDGGIIWPKPGEAFWERSPRASPMPLQGGAAEAPPVERDGNPMHIIHITAEMAPIAKVGGLGDVVTGLAKAALARGHFVTVMLPFYECLPKDQIEGLKHECDIEVPKGYRWDGEIRVGPLKTSVFWGRVQGCPVYLIKPADDTNCNIFRGGRIYGGSYNEMEAYLYFCRACLEYLNVSQQNPHVLQLHDWHAAAASMLYWDVYNPNGFSRTRLMLTIHNLDNTGETRQDEFFFTGVPGENFATIDKALDERTIGHNPERLNLMKGGIVYCNAVTTVSPTYANEVLNGGAAGWLRSTFARPELRSKFHGILNGIDCEEWNPATDALLPANFDADRPAGKALCKEFLQKGLGLEVDPRKPLVAVVSRLVPQKGIHLIKAALFRTVEKGGQFVLLGSGHSDPAFRQLADGQFKDHPNCRLKIMYSERLAHMIYAAADVVVVPSMFEPCGLTQMIALRYGAVPLVRRTGGLADTVFDVDGPAGGPAQPRNGFVFDGSDDGALHGALDRALTLYTTQPERWAALQQDNMRLDVSWGKSAKSYVDVYRSISA

SEQ ID NO: 4773 - DNA, 2325 bp, Ipomoea batatas
  CDS (155)..(2047)
ccatggtacccggatcctcggaattcgaggatccgggtaccatgggggagtactatctacttcaagtgaacaagcaactcttgacttggaagaatatccacaattagctgtaagcgaacattttgttgaaacttctcaaacaggtaaaaaggacatgcctcgtaagggggcaaccttgaacaaagattcagacaaaaaaactacaaaaagaaatccaaagactgtgggatctactgaaaggccagctgtgaaatcaaaagtgtctttgagtccaagtcaagtgacttcttcaacagtaaattctcaggagccagcaaaagctacctatgaaactgtgaagtccagtcaagtgatgccactggacgtggattcacaaaagaatgtgacatccttttctagggagattcttttgtctgaggttccttcctcctcttcaatggcatctgcatctactttagaggatgagaaaagagatcatagagagtcaagttcaaaggagatagatgttgggactgaagatcctgtaaatgaagacttgaagccacctccattggcgggaaccaatgtcatgaatgttatattagtttgtgcagagtgtgctccatggtcaaaaacaggtgggcttggtgatgttgctggagcactacccaaggctttggctcggcgtggacacagagttatggttgtggttcctctttatggaaactatgctgaacctcaacatactggagttcgaaaaatgtttaagattgatggtcaggatatggaggtgaattactttcatgcctacatcgataatgtggattttgtcttcattgatagtcctatattccagcatagaggaaacaatatatatggaggaaatcgtgtggacattttgaagcgcatggacttattttgcaaagcagctattgtggttccgtggcatgttccgtgcggtggtatttgctatggagatggaaacttagtgttcattgcaaatgattggcatactgcattactgccagtctatctgaaagcatatttccgtgacaatggagtaatgaaattcactcgatccgtgcttgtcattcataacatagctcaccagggtcgcgggcctatggatgatttttccattgtggacctaccagctcaatatgcagacctttttaagctgtatgatccagtaggaggtgatcatttcaacatatttgcagctggtctaaagacagctgaccgtgtagtcacagtgagtcatggatatgcctgggagcttaaaacttctgaaggtggatggggtttgaatgggatcaggaatgagaatgagtggaaactgcaggggattgtcaatgggattgatattgaagagtggaatccccaattggatgtttacttgaaatctgatggctatgccaactattccctggacaccttgcagactggtaaacctcagtgcaaggcagcattgcaaaaggaaatgaatttgcctgttcgcgatgatgtcccactaattggtttcattgggaggcttgaccaccaaaaaggtgttgatttgatagccgaggcaatcccttggatgatgggccaagatgtgcagctggttatgctgggcacaggcaggcctgaccttgaacagatgctcaagcagattgaaggtcaatacggtgacaaagtaagaggatgggttggtttctcagtaaagactgcacaccggataactgcgggtgcagacattctgctgatgccatcaagatttgagccttgtggactgaaccagctgtatgctatgagctatgggacagtcccagttgtccatgctgtgggtggacttagagatacggtgcagccttttgatcctttcaatgaatcagggtatggatggacattcggtagggctgaggcaaatcagctgattgatgcactagggaattgcttattaacataccggcagtacaagcagagttgggaggggctccagaggcgtggaatgatgcaagacttaagctgggatcacgctgccgagaagtacgaggaagttcttgttgctgcaaagtatcagtggtgaggtttactacaatcactgctgacaacaggatcagaaatcatgcattccgaacatgccccatcgcccattgccagccattcactactatctattttcatatctttgccaagagaaaaggatgggacagattaccaacttattgtataggcagtaggctccctcaaatgtttgaagtgagatcaaattttatagttggttttagtttatttaataaccttaatctatatatagtccgtcctatcccagcctgcctggcctgggtacttctaaaaaaaaaa

SEQ ID NO: 4774 - protein, 630 aa, Ipomoea batatas
MPRKGATLNKDSDKKTTKRNPKTVGSTERPAVKSKVSLSPSQVTSSTVNSQEPAKATYETVKSSQVMPLDVDSQKNVTSFSREILLSEVPSSSSMASASTLEDEKRDHRESSSKEIDVGTEDPVNEDLKPPPLAGTNVMNVILVCAECAPWSKTGGLGDVAGALPKALARRGHRVMVVVPLYGNYAEPQHTGVRKMFKIDGQDMEVNYFHAYIDNVDFVFIDSPIFQHRGNNIYGGNRVDILKRMDLFCKAAIVVPWHVPCGGICYGDGNLVFIANDWHTALLPVYLKAYFRDNGVMKFTRSVLVIHNIAHQGRGPMDDFSIVDLPAQYADLFKLYDPVGGDHFNIFAAGLKTADRVVTVSHGYAWELKTSEGGWGLNGIRNENEWKLQGIVNGIDIEEWNPQLDVYLKSDGYANYSLDTLQTGKPQCKAALQKEMNLPVRDDVPLIGFIGRLDHQKGVDLIAEAIPWMMGQDVQLVMLGTGRPDLEQMLKQIEGQYGDKVRGWVGFSVKTAHRITAGADILLMPSRFEPCGLNQLYAMSYGTVPVVHAVGGLRDTVQPFDPFNESGYGWTFGRAEANQLIDALGNCLLTYRQYKQSWEGLQRRGMMQDLSWDHAAEKYEEVLVAAKYQW

SEQ ID NO: 4775 - DNA, 1440 bp, Erwinia carotovora subsp
  CDS (1)..(1440)
atgcgggtcttacatgtttgttcagagctatttccactattgaaaaccggcggactggcggatgtggctggtgcgttgcccggcgcgcagattgcggcggggatggatgttcgcgtcatcttgcctgccttccccgatctgaaaaaaggcattgctaacctacaggttgtgcgtgagctggataccttcgccggacacgtgaccttgctgttcggccattttaacggcgtcggtatttatttgattgatgtgcccgagctatatgaacgcgcgggcagcccttatcacgacccggcgctttacgcttatgccgataactacctgcggttcgcgctgctggggtggatgggatgcgaaatggcgtgcgggctggaccactattggcggcccgatattgtgcatgcccatgactggcacgcggggctgacctgtgcttatctggcggctcgcaaccgcccagcgaaatcggtctttaccgttcacaatctcgcctatcagggactgttcgctgccggacatatggcgaatcttcacttgccgagcgacttctttcaggtctacgggctagagttctacggtcagatttcctacctcaaggcagggttgttctacgcggatcatattacgaccgtgagcccgacctacgcgcatgagatcacgctgccagcctatggctatggtatggaaggcttgctgaagacgcgtgaagaagaagggcgcctgtccggtatcctcaatggcgtagacgagacgatttggaatccgacgcacgatcctttactgactaaccattacagccgcgaggcgctggcgaacaaagccgaaaacaagcgacatctgcaaacggcgatgggcctgaaagtggacgataaggcgccggttttcgctatcgtcagccgcctgaccagccagaaaggactcgatatcgcgttaagcgcgatacccgatctgttggagcagggcggccaactggtagtgttgggcgcaggggatgccgatttgcaggaaggttttctggctgccgctgcggaatatcacggtcaggttggcgtacagattggctatcacgaagccttctcgcaccgcatcattggcggcgcggatgtcatcatggttcccagccgatttgagccttgcgggttaacgcagctctacggcttgaagtatggcacgttgccgctggtgcgccgaactggggggctggcggatacggtatccgactgttcgctggagaatttggcggatggtctggcaagcgggtttgtctttaacgattgcagcgtgggatcgctatcccgcgcgattcgtcgtgtgttcgtgttgtggtcccgacctacgctatggcgctatgtgcagcgtcaggcgatggcaatggactttggttggcaggtttctgctcaggcttatggtgcgctatatcaacgcttgcatacccactag

SEQ ID NO: 4776 - protein, 479 aa, Erwinia carotovora subsp
MRVLHVCSELFPLLKTGGLADVAGALPGAQIAAGMDVRVILPAFPDLKKGIANLQVVRELDTFAGHVTLLFGHFNGVGIYLIDVPELYERAGSPYHDPALYAYADNYLRFALLGWMGCEMACGLDHYWRPDIVHAHDWHAGLTCAYLAARNRPAKSVFTVHNLAYQGLFAAGHMANLHLPSDFFQVYGLEFYGQISYLKAGLFYADHITTVSPTYAHEITLPAYGYGMEGLLKTREEEGRLSGILNGVDETIWNPTHDPLLTNHYSREALANKAENKRHLQTAMGLKVDDKAPVFAIVSRLTSQKGLDIALSAIPDLLEQGGQLVVLGAGDADLQEGFLAAAAEYHGQVGVQIGYHEAFSHRIIGGADVIMVPSRFEPCGLTQLYGLKYGTLPLVRRTGGLADTVSDCSLENLADGLASGFVFNDCSVGSLSRAIRRVFVLWSRPTLWRYVQRQAMAMDFGWQVSAQAYGALYQRLHTH

SEQ ID NO: 4777 - DNA, 1497 bp, Bacillus thuringiensis serovar konkukian str
  CDS (1)..(1497)
atgaaaactcgaagggaggaagctgcaagggaagtagtagaagcttttcgtgcagtgggacaacaagtgaatattttatttgcagtatcagaatgtgtgccatttgtgaaatctggaggattagctgatgtagcaggtgcgctcccaaaagagctaaaaaaattaggtgtggaagttcgcattatacttccgaattatagtcttattccgcaaaaattaagggatggatgtacgctacataaagtaattaacgtcccgcttggctggagaaatcaatattgtggaattttaaaaggtgagcaagacgggattacgtattacttaatagataatgaatattattttaagagggattctctgtatggtcattatgatgatggagagcgtttttcttatttctcgaaagcagtattagagtgtattccgcatcttgatttcgaagtggatgttcttcatagccacgattggcatacagccatggtgaattttttactgcgtgaaaagtatcaagataacccgtcatatgagcatattaaaacggtatatacgattcataacttgcagttccaaggtgtattttctcctgaagtgatgtacgacttgttagaacttggtgatgaatattttcatagtgagcagttagagttttatggaaatgtgaactttatgaagggtggcattatcgcctctgatcaaattacagcggttagcccgacgtataaagaagaaattcaatatgaatttttcggtgagaagttagatggattactgcgaaaatataatgataagcttagcggcattgtaaatggaattgatacgagcgtgtacaatccagaaacggattcgtatattactgcgcagtacgatgcggattcattatatgaaaagaatgaaaataaacgcgcgttgcagcgttattttggtttgccagaaaaagaagatacaccaattatttcaatggtaacgagattaacgaagcaaaaaggtcttgatttagtacgtactgtattccgagaaataatggaagaagatgtacaatgtattattttagggtcaggtgattctgaatatgaacaattctttgagtggatggcatatgagtatcctgagaaggtaaaagtgtatatcggctttaatgaggagttagcgcaccaagtgtatgcgggaagtgatttattcttaatgccatcactgtttgagccgtgtggccttggacaacttatcgcattagcgtatggtacgattccaattgtaagggaaacaggcggattaaatgatacggtacaatcttatgacgaagaaactggagaaggaaatggtttcagtttcacgaactttaatgcacatgatatgttgcacacggttcttcgtgcaattgaattttatcatgataaaccggtatgggatcagcttgtaaaacaagcgatgactgaagattatagctgggagaaatcagctcttgcttataagaaattgtataaaagtctcatggaataa

SEQ ID NO: 4778 - protein, 498 aa, Bacillus thuringiensis serovar konkukian str
MKTRREEAAREVVEAFRAVGQQVNILFAVSECVPFVKSGGLADVAGALPKELKKLGVEVRIILPNYSLIPQKLRDGCTLHKVINVPLGWRNQYCGILKGEQDGITYYLIDNEYYFKRDSLYGHYDDGERFSYFSKAVLECIPHLDFEVDVLHSHDWHTAMVNFLLREKYQDNPSYEHIKTVYTIHNLQFQGVFSPEVMYDLLELGDEYFHSEQLEFYGNVNFMKGGIIASDQITAVSPTYKEEIQYEFFGEKLDGLLRKYNDKLSGIVNGIDTSVYNPETDSYITAQYDADSLYEKNENKRALQRYFGLPEKEDTPIISMVTRLTKQKGLDLVRTVFREIMEEDVQCIILGSGDSEYEQFFEWMAYEYPEKVKVYIGFNEELAHQVYAGSDLFLMPSLFEPCGLGQLIALAYGTIPIVRETGGLNDTVQSYDEETGEGNGFSFTNFNAHDMLHTVLRAIEFYHDKPVWDQLVKQAMTEDYSWEKSALAYKKLYKSLME

SEQ ID NO: 4779 - DNA, 1431 bp, Mycoplasma mobile
  CDS (1)..(1431): transl-table=4
atgaaaattttatatataagtgttgaatgctttccattcataaaaactggaggactaggagatgtagcttattctttccctaagactttaaaaaaattaggaaatgatataaaagtttttttaatctatagtgactcaattagtgaaaaatataaagaaaagatgcgtagcgcttactttttttctttggatttaaatggaaaatcttttcctgttgaaattttttctttagttatggatgatattgaatatttattttttaatgacccaagttttaaaaacattgaaagaactgcttatcttgatttacatgaaaactctactttttacttaatttttaataaagcaatttcaaaatttttagaattaagtgcttttaaaccagaaattattcatgcaaatgattgacatacaggaatacttcctttgtttttgtctggtgaaaaaaatgaaaattccaaattaaaagttgttttcacaattcacaatttacaatatcaaggagtttttggagcttcaaatgttttaaaatatttaaatgaaaaagaaagatcgaattctcttttaagtgaaatcataagtaatgatatttttaattttatgaaagctggaattatttctagtgatattgtcacaactgtttctgaaacttataaagaagaaataaaacaaccaatgcaaggtatgggtcttgagtcagttttaaataaatataacagtaaattaagaggaattataaatgggttagattatgatatttttaatccaagtattgataaatacatcgaggcaaaatatgatgtgtcaaattataaagaggcaaaattaatcaataaaattgcattgcaaaaggaattaaatcttgaacaaaataaaaaaatctttttaattggaatgatttcaagattagcgaatcaaaaaggaattgatttagttttaaattccttatgaaatattgtaaaagataatgatattcaatttgttgttttaggaacaggtgatgtaaattatgaatctaatttaaaatcttttggaaataaatatccaagaaattttaagtttattaataaatttagtgatgaattaagtcataaattatatgcaggacttgatgcttttttaatcccgtctttatttgagccatgtggattaactcaattaatttcacttaaatatggttgtataccaatagctagagcaacaggcggattaattgatactattacttcttataatgacaaacaagaaaatgcaaatggatttttatttaaagaatatactccagaagctttatataaatctgtgaaattagcaaaaaatttattttataataacaaaccggagtgaaataaacttatttattttggaatggatcaaagatttggatgagaagaaattgcaaagaaatatttagaaagtatttacaaataa

SEQ ID NO: 4780 - protein, 476 aa, Mycoplasma mobile
MKILYISVECFPFIKTGGLGDVAYSFPKTLKKLGNDIKVFLIYSDSISEKYKEKMRSAYFFSLDLNGKSFPVEIFSLVMDDIEYLFFNDPSFKNIERTAYLDLHENSTFYLIFNKAISKFLELSAFKPEIIHANDWHTGILPLFLSGEKNENSKLKVVFTIHNLQYQGVFGASNVLKYLNEKERSNSLLSEIISNDIFNFMKAGIISSDIVTTVSETYKEEIKQPMQGMGLESVLNKYNSKLRGIINGLDYDIFNPSIDKYIEAKYDVSNYKEAKLINKIALQKELNLEQNKKIFLIGMISRLANQKGIDLVLNSLWNIVKDNDIQFVVLGTGDVNYESNLKSFGNKYPRNFKFINKFSDELSHKLYAGLDAFLIPSLFEPCGLTQLISLKYGCIPIARATGGLIDTITSYNDKQENANGFLFKEYTPEALYKSVKLAKNLFYNNKPEWNKLIYFGMDQRFGWEEIAKKYLESIYK

SEQ ID NO: 4781 - DNA, 1815 bp, Hordeum bulbosum
  CDS (1)..(1815)
atggcggctctggtcacgtcccagctcgccacctccggcaccgtcctcggcatcaccgacaggttccggcgtccaggttttcagggcctcaggccccggaacccggcggatgcggcgctcggcatgaggaccatcggagcaagcgccgccccgaagcaaagccggaaagtgcaccgcgggagcaggcggtgcctctccgtggtggtgcgcgccacgggcagcagcggcatgaacctcgtgttcgtcggcgccgagatggcgccctggagcaagaccggcggccttggcgacgtcctcggcggccttcccccggccatggccgccaacggtcaccgtgtgatggtcgtctccccgcgctacgatcagtacaaggacgcctgggacaccagcgtcgtctccgagatcaaggtggctgacgggtacgagagggtgaggttcttccactgctacaagcgcggagtggaccgcgtgttcatcgaccacccgtggttcctggagaaggtccggggcaagaccaaggagaagatctatgggcccgacgccggcacggactacgaggacaaccagcagcgcttcagccttctctgccaggcagcactcgaggcacccaggatcctcaacctcaacaacaacccctacttttctgggccctacggggaagacgtggtgttcgtgtgcaacgactggcacacgggccttctggcctgttacctgaagagcaactaccagtccaatggcatctacaggaccgccaaggtggccttctgcatccacaacatctcgtaccagggccgcttctccttcgacgacttcgcgcagctcaacctgccggacaggtttaagtcgtccttcgatttcattgacggctacgacaagcccgtggaggggcgcaagatcaactggatgaaggccgggatcctgcaggctgacaaggtgctgacggtgagcccctactacgctgaggagctcatctctggcgaagctaggggctgcgagctcgacaacatcatgcgcctcacggggatcaccggcatcgtcaacggcatggacgtcagtgagtgggaccccaccaaggacaagttcctcacagtcaactacgacatcaccaccgcgttggaggccaaggcgctgaacaaggaggcgctgcaggccgaggtagggctgccggtggacaggaaggtgccgctggtggccttcataggcaggctggaggagcagaagggccctgacctgatgatcgccgccatcccggagatcgtgaaggaggaggacgtccagatcattctccttggcaccgggaagaagaagtttgagaagctgctcaagagcatggaggagaagttcccgggcaaggtgagggccgtggtcaggttcaacgcgccgctagctcaccagatgatggccggcgccgacttgctcgctgtcaccagccgctttgagccctgcggcctcatccagctccagggaatgcgctatggaacgccgtgcgtgtgcgcgtccaccggcgggctcgtcgacacgatcgtggagggcaagaccgggttccatatgggccgcctcagcgtcgactgcaacgtggtggagccggccgacgtgaagaaggtggcgaccaccctgaagcgcgccgtcaaggtagttcgcacgccggcgtaccaggagatggtcaagaactgcatgatccaggacctctcctggaagggacctgccaagaactgggaggacgtgcttctggaactgggggtggaggggagcgagccggggatcgtcggcgaggagatcgcgccgctcgccatggagaacgtcgccgctccctga

SEQ ID NO: 4782 - protein, 604 aa, Hordeum bulbosum
MAALVTSQLATSGTVLGITDRFRRPGFQGLRPRNPADAALGMRTIGASAAPKQSRKVHRGSRRCLSVVVRATGSSGMNLVFVGAEMAPWSKTGGLGDVLGGLPPAMAANGHRVMVVSPRYDQYKDAWDTSVVSEIKVADGYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLTVNYDITTALEAKALNKEALQAEVGLPVDRKVPLVAFIGRLEEQKGPDLMIAAIPEIVKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVRTPAYQEMVKNCMIQDLSWKGPAKNWEDVLLELGVEGSEPGIVGEEIAPLAMENVAAP

SEQ ID NO: 4783 - DNA, 1527 bp, Photobacterium profundum
  CDS (1)..(1527)
atggctactaagaaaacgtcgttaacaaagcatccattgaaaattttatttgtttcatctgaagtagaagggtttgcaaaaacaggagggttagccgatgttgctaagtctctgcctgcggccttgaagaagatggggcacgatgttcgaattgtaatgcctttctatcagacaattaacggtaaagataacgctgttgctattttgtctaccgagctgcttgttgagtcacagccatttgctgtgagttatcaagtgatgcaactcgatgaaggtaatgtgcctgtctatgcgttagatgcaccacaatattatgatcgaccagaattgtatgcggaaaacaatcaagcatatgcagataatggtgagcgttttacatttttaagcgccgcatcgttagatttgtgtgaaaaactgggttttcaacccgatgtgattcactgtaacgattggcataccgggttaattccattcttattaaaaacgcgttacgcagagagtgatttctttgctaaatcgaaaagtgtgataacgattcataatgccgtttttaagggggtatttaactacgatcaatacagcctaatacctgaattgattcaacgtcgctatatcaatgctgaaatggatccatcgcatatcagcatgcttaaagcgggtgttgcgtatgcagataaagtgaacgcggttagccctaattatgcatcagagcttttaacacatttaggttcgcatggtatggaagctgatttccaaaatcgtgctaaagatttgtatggcatcattaatgggtgcgactacgatgattggaatcctgaaactgatgtgtacataaagcaaaagtttaaagccaataaagtgagcttagctcgcgggaaaaaagcgtgtcgacgtgatttgcaaaaacaagttaacttacctgaagtagatgtacctgtttatggaatggtttgtcgcttgaccgagcaaaaagggcttcactatttaattcctgtgcttgaagattttttattgaatgacgtacaagtggtgattgtcggaacgggtgatccaacgttagccagtgctctgcgtgacattagcgaacagcatagtgataaatttgcttttgttgaaacatacagcaacccactagcacactgtgtagaagcgggtgttgatttctttatgatgccttctgaatttgaaccatgtggtttgaatcagatgtacagtttagcgtatggcacattacctatcgttcgcagcgtcggtggtctaaaagatactgttatcgattacgatcaaacaccgcaggtcgccactggctttatttatgatacgccaactccagaggcgttattaataaagttacaacgaagcttgctactttattgtcagcgtcctcaagaatttaaacgattacagcaaaatgcgatggcgtgtaaatttaattgggatgaatcagcagagcaatatctagatatgtatctaggtggtgagcaaagtttggtcaatgaaatctgcaatgacaaggtagacgcttag

SEQ ID NO: 4784 - protein, 508 aa, Photobacterium profundum
MATKKTSLTKHPLKILFVSSEVEGFAKTGGLADVAKSLPAALKKMGHDVRIVMPFYQTINGKDNAVAILSTELLVESQPFAVSYQVMQLDEGNVPVYALDAPQYYDRPELYAENNQAYADNGERFTFLSAASLDLCEKLGFQPDVIHCNDWHTGLIPFLLKTRYAESDFFAKSKSVITIHNAVFKGVFNYDQYSLIPELIQRRYINAEMDPSHISMLKAGVAYADKVNAVSPNYASELLTHLGSHGMEADFQNRAKDLYGIINGCDYDDWNPETDVYIKQKFKANKVSLARGKKACRRDLQKQVNLPEVDVPVYGMVCRLTEQKGLHYLIPVLEDFLLNDVQVVIVGTGDPTLASALRDISEQHSDKFAFVETYSNPLAHCVEAGVDFFMMPSEFEPCGLNQMYSLAYGTLPIVRSVGGLKDTVIDYDQTPQVATGFIYDTPTPEALLIKLQRSLLLYCQRPQEFKRLQQNAMACKFNWDESAEQYLDMYLGGEQSLVNEICNDKVDA

SEQ ID NO: 4785 - DNA, 1569 bp, Methanococcus maripaludis
  CDS (1)..(1569)
atgaaaatagttacattaacaccgacaatagcgcctttaacgtcgatagggggactaggggatattttagaagatttaccaaaatttttaaagaatttaggaaatgaagtatatgtaataacatatgatcatcaaaacaaaatttcaaaaagacctcatgaaattataaaaaaaatagaagtaaaatatcaaggctcaaaactcttttttgacgtgataaaagcagttcatccaagttctaattttgagatttttgcattcagtaatcctgaaataaatcagcttgatagctgggatcctataaaatacgaaatttttgcagatttagttgtatctttcctttcagatattgaaaacattgaatgtgtgtcaggacacgactggccttgcggacttgcaattgcaaaatgtcacgaaaaattaaatcttccaacgacacttacaatacataacgaagcatttaaaggcccaataattgaatataaggggcacatattctcatttttagaacacgggatatactttagtgatgcagtcaatactgtaagtcctaaccatgcagaagaaatacgaaatttagactttttaaaaaaattatgtaaagaaaaaccttttcacgggataattaatggaatagatacagatgtttattctccagaatcgattattgaaagaatgaaaaatttaagcaacggaaaactaaacccacaagattactgctatattgaaaactacgatatttcaaatgcagcggtagtaaaaccaaaaataaaagaatcgtggttttgtaaatgcgaaaatttaaaaaaatatattaatgattggaacgagatggataaaagtaatatttcgggcagcgatattgaaatacacggtaatatcaaaggaaaattgaaaactccaatgatcggatttgtaggccgtgctacctatcaaaaaggttttgatttgatatttgaaacaatgcccgaagtattggaagaaaataacgctaatttcgtacttgtatcaaaaggggaaaaatccattgaggaaaaaataaaagattttgcagaaagttatcctgacaaaatcatggctctcgttggacattgccctccaataattcccattatttatgcaggatgcgactggactgttgtgccgtctctttgggaaccttgcggattaacacagatggaatcaatgtcgtatggaactccagtaattgcaagaaatactggaggtttaagtgatactgtaatttcacttcaccctgatccgcataaaaatccaaattttgatatagcaacaggtgttttgtttaatgattatgataaatacggatttaaatggggtattgaacacgggctctactggtcgttttacaatttagaagaagcctgtctttttataaattataaacacgtgcactgcccagaaagtccgtatgaggaaaatagtccattatacatgttaattaaaaactgctaccaccacgtacaaaaaaacctgagctggcaaaataacgacagttctgaacgatacagggcactttttggcggtgcaatgtacaaacactacttttaa

SEQ ID NO: 4786 - protein, 522 aa, Methanococcus maripaludis
MKIVTLTPTIAPLTSIGGLGDILEDLPKFLKNLGNEVYVITYDHQNKISKRPHEIIKKIEVKYQGSKLFFDVIKAVHPSSNFEIFAFSNPEINQLDSWDPIKYEIFADLVVSFLSDIENIECVSGHDWPCGLAIAKCHEKLNLPTTLTIHNEAFKGPIIEYKGHIFSFLEHGIYFSDAVNTVSPNHAEEIRNLDFLKKLCKEKPFHGIINGIDTDVYSPESIIERMKNLSNGKLNPQDYCYIENYDISNAAVVKPKIKESWFCKCENLKKYINDWNEMDKSNISGSDIEIHGNIKGKLKTPMIGFVGRATYQKGFDLIFETMPEVLEENNANFVLVSKGEKSIEEKIKDFAESYPDKIMALVGHCPPIIPIIYAGCDWTVVPSLWEPCGLTQMESMSYGTPVIARNTGGLSDTVISLHPDPHKNPNFDIATGVLFNDYDKYGFKWGIEHGLYWSFYNLEEACLFINYKHVHCPESPYEENSPLYMLIKNCYHHVQKNLSWQNNDSSERYRALFGGAMYKHYF

SEQ ID NO: 4787 - DNA, 1503 bp, Parachlamydia sp
  CDS (1)..(1503)
atgcacatcattcatatagcctcagaacttgcccctttagccaaagttggaggattagcagacgttgttctaggtctttgccgtgagttatcttggaaagggcatgatgttgacatcattattcctaagtatgattgcatggatagcgagcaaatccgagacctgacagtggattattttgaactcccctcattttataatggagaatggtttttcaatacagtttggatgggatgggtggaaaatttaaaagtttattttattgaaccccatcaccctcgcttcttttttaatcgcggctgcttttatggttgtgaagatgatctcgaacgtttcttatacttttctcgtacagctctagagtttttgtataaaaagtctatcttgccggatattattcatctccatgattggcaaacagctgttattgctcctctgtacaaagacatgtatcaaaagcttgggtacacaaaaccaaaaatattgtttacaattcacaacatggaatatcagggaaaatgtgcagcacatgatttgaattacattggcctcgatggcaatcgatatcaacaacatagttttatgcaagacaatctctaccctcatttaattaatttgctcaagggcggcatcgtttattcagatttcgtaaccactgtatctcctaattatgcaaaagaggttttaacaccgaaggaaggaagaggacttgaagccaccttagtagaatatcagcataaattcaaagggattttaaatggaattgactactcttattggaatccagaaattgatcgatttttgcccgctcattattctttaagagaaatgcctaaaaataaaaaagatcgaaatactgttgataaaaaaggttttatcaaaaaaattttaagagaaaaactttatttggccgaggaacatagacctattattggatgcataactagacttgtcccacaaaaaggaatcgatttgattaaacatacgattagacatatcgttgaaaaaaaaggacagtttatcttactaggctcaagtcctatccctagtattaatgatgaatttcatcgtttaaagcatcaatacaccgaccatccacatattcacttaattttgcatcatagcgaagaacttgctcatctcatttatgcgggctctgacatgtttattgttccctcactttttgaaccttgcggccttacacaaatcattgctcttaaatatggcactgttcccattgttcgtcgcacaggaggattagctgacacaattatcgacgtcgatcatacagatcaacaacctgataaaaaaaatggatatgtttttgacgatccagatgctaatggaatagattctgccatcgaccgcgccattcattgttggtttgaagaacctgaaaaatggcgtcagttgatgcttaatggaatgaaaatggattttagctggaatcaatcttcagattgttatctgaaaatttatcaagctatctcagcaaaaaattaa

SEQ ID NO: 4788 - protein, 500 aa, Parachlamydia sp
MHIIHIASELAPLAKVGGLADVVLGLCRELSWKGHDVDIIIPKYDCMDSEQIRDLTVDYFELPSFYNGEWFFNTVWMGWVENLKVYFIEPHHPRFFFNRGCFYGCEDDLERFLYFSRTALEFLYKKSILPDIIHLHDWQTAVIAPLYKDMYQKLGYTKPKILFTIHNMEYQGKCAAHDLNYIGLDGNRYQQHSFMQDNLYPHLINLLKGGIVYSDFVTTVSPNYAKEVLTPKEGRGLEATLVEYQHKFKGILNGIDYSYWNPEIDRFLPAHYSLREMPKNKKDRNTVDKKGFIKKILREKLYLAEEHRPIIGCITRLVPQKGIDLIKHTIRHIVEKKGQFILLGSSPIPSINDEFHRLKHQYTDHPHIHLILHHSEELAHLIYAGSDMFIVPSLFEPCGLTQIIALKYGTVPIVRRTGGLADTIIDVDHTDQQPDKKNGYVFDDPDANGIDSAIDRAIHCWFEEPEKWRQLMLNGMKMDFSWNQSSDCYLKIYQAISAKN

SEQ ID NO: 4789 - DNA, 1452 bp, Rhodopseudomonas palustris
  CDS (1)..(1452)
atgacgacactggcggttctatctgttgcgtcggaactgtttccgctgatcaagaccgggggcctcgccgatgtggccggcgcattgccggccgccctgcgtgccaacgacgtcgccgtcacctcgctgctgccgggctacccggcggtgctcggcgggatcgaggatccgcagcaggtccacagcttcaacgagctgttcggcggcacggcgcggctgctggcggcgcgctgcggcgatctcgatctatttgtgctcgacgcgccgcatctctatgtccggcccggcaatccctatgtcggcccggacggcaaggattggccagacaacggcctgcgttttgcggcgttggcgcaggtcggcgccgcgctcggccagggcctgctgccgcactacaagccggatgtgctgcacgcccacgactggcagaccgggctgttgccggcctatctgaaatacagcggccggcctgggccgaagactgtcttcaccatccacaatctggcgttccaggggaggtttccctacgagctgctcggcaggctgggcctgccggagcgcgccttcggtctcgacggtatcgagtactacggcggtatcggttatctcaaggccggcctgcaactcgccgaccgcatcaccaccgtgtcgccgacctacgcggccgagatccagggttcggaagccggcatgggcctcgacggcctgctgcggctgcgcgccgatcggctgtccggcatcctcaacggcatcgacaccgacgtctggaatccggccagcgatgcgttgatctccgccacctacgatgtcgaaagcatcgcagcccgcgcccgcaacaagaaggtgctgcaggcgcggttcggtctgaagcccgagccgggcgcactgctgtacggcgtgatcagccggctgtcgtggcagaaggggctcgacctcttgctcgaagccctgccgcaattgatcggcggtggcgcccagctcgccctgctcggctccggcgatgccgaactcgaacagggctacgcggccgcggctcgcaagtatcccggccaggtcggcgcagtgatcggctacgacgaagcgctcgcgcatcagatccaggccggcgccgacgcgctgcttgtgccgtcgcgattcgaaccctgcggcctgacgcagctctgcgccttgcgctatggcgcggtgccggtggtggcgcgggtgggcggtctggccgatacggtggtcgacgccaacgagatggcgaccgccacaggcgtcgcgaccggcgtccagttcgcaccggtgacgactgacgcgctgatcaaggcgttcggcaaaacccgcgcgctgtttgcagacgtcgtcgcctggcgcaatctgcaaatcaacggcatgaccaccgatgtgtcgtggaagaacccggcgcagcactacgcgaagctgtatcgcgatctggtggcggagcgctga

SEQ ID NO: 4790 - protein, 483 aa, Rhodopseudomonas palustris
MTTLAVLSVASELFPLIKTGGLADVAGALPAALRANDVAVTSLLPGYPAVLGGIEDPQQVHSFNELFGGTARLLAARCGDLDLFVLDAPHLYVRPGNPYVGPDGKDWPDNGLRFAALAQVGAALGQGLLPHYKPDVLHAHDWQTGLLPAYLKYSGRPGPKTVFTIHNLAFQGRFPYELLGRLGLPERAFGLDGIEYYGGIGYLKAGLQLADRITTVSPTYAAEIQGSEAGMGLDGLLRLRADRLSGILNGIDTDVWNPASDALISATYDVESIAARARNKKVLQARFGLKPEPGALLYGVISRLSWQKGLDLLLEALPQLIGGGAQLALLGSGDAELEQGYAAAARKYPGQVGAVIGYDEALAHQIQAGADALLVPSRFEPCGLTQLCALRYGAVPVVARVGGLADTVVDANEMATATGVATGVQFAPVTTDALIKAFGKTRALFADVVAWRNLQINGMTTDVSWKNPAQHYAKLYRDLVAER

SEQ ID NO: 4791 - DNA, 1173 bp, Corynebacterium diphtheriae
  CDS (1)..(1173)
atgagagttgcgatgatgaccaaagaatacccacctgagatctacggcggtgcaggagttcacgtcgccgagctcacccgccacatgcgcgacattgtcgatgtcgacgtccattgcatgggcgctccacgaaacgaagacaacgtctacacctatggctttgaccctgaactcacctcggccaacgccgccttacaaaccatgtccacaggactacgcatggcacacgccgcagcctacgctgatgtagtccactcccacacgtggtacacgggactaggagggcatctagcggggcttcttcacgaagtaccccacattgtcacagcccactcccttgaacccgaccgcccatggaagcgggaacaacttggtggtggctacgatgtctcctcctggtcagaacaaaatgccatggaatacgccgacgttgtgatcgcagtgtcagccggaatgaaagacgctattctgcgcgcttacccgcgcatcgacgccgataaaatccgcgtcgtactcaacggcatcgacacacagctttggcaaccacgccccacttttgacgacgccgaacactcagtactccgcgacctcgggatcaaaccagaccagcccatagtcgcctttgttggccgaatcacacgccaaaaaggcgtggaacacttagtcaaagccgctcgctacttcagcccaggagtccagctcgttttgtgcgccggagcccccgacaccccagaaattgcggcacgcacccaacacctcgtagaagaactacaagcagaacgcgaaggcgttgtttgggtacaagaaatgctgagcaaggacaagattcaagagatcctcaccgccgctgacgctttcgtctgcccctccatctacgaaccactcggaatcgtcaatctcgaggccatggcatgcgccaccgccgttgtcgcctcagatgtgggcggaatccccgaggtagtcgtcgacggcactaccggaagcctcgtccactacgaccccaacgacaccgataccttcgaacacgacctcgccgaagccgtcaacgccatggtcaccgatcgaaaacgcgccgcagctttcggtgtagcaggacgcaaccgcgcagtatccgagttctcatggggcttcatcgcacaacaaaccgtcgatgtgtactcctccctcctatag

SEQ ID NO: 4792 - protein, 390 aa, Corynebacterium diphtheriae
MRVAMMTKEYPPEIYGGAGVHVAELTRHMRDIVDVDVHCMGAPRNEDNVYTYGFDPELTSANAALQTMSTGLRMAHAAAYADVVHSHTWYTGLGGHLAGLLHEVPHIVTAHSLEPDRPWKREQLGGGYDVSSWSEQNAMEYADVVIAVSAGMKDAILRAYPRIDADKIRVVLNGIDTQLWQPRPTFDDAEHSVLRDLGIKPDQPIVAFVGRITRQKGVEHLVKAARYFSPGVQLVLCAGAPDTPEIAARTQHLVEELQAEREGVVWVQEMLSKDKIQEILTAADAFVCPSIYEPLGIVNLEAMACATAVVASDVGGIPEVVVDGTTGSLVHYDPNDTDTFEHDLAEAVNAMVTDRKRAAAFGVAGRNRAVSEFSWGFIAQQTVDVYSSLL

SEQ ID NO: 4793 - DNA, 1578 bp, Ostreococcus tauri
  CDS (1)..(1578)
atgaacatcgtgttcgtctcgagcgaagtcgcgccgtggtcgaagactgggggattgggcgacgtgtgcggagcgctgccgcaagcgctcgtcgcgcgcggacatcgcgtcatggtgatctcgccaaagtatcaaaacggatccaaggcggacgccctgtacaacggcgcgttagatacgtgcacgcgagcaaagattgggtgtttcggcgccgagcatgaggtgggattctttcatcaaattaaaaacggagtggattacgtcttcgtcgatcacgcatccttccatcgcaaggggagcttgtacggagattctttcggggtatacggagacaaccaattcagatttacgcttttagcgcacgcagcgtgcgaagcacccctgcagttggcgtttgaaggttgcggcgatcgatacggcaaggatatcgtcttcgtcgccaacgactggcacgccggtttagtccccactttggtcgcatcaaagtaccgtcctcacggtgtttacagggacgcgcgcacaatttgcgcaattcacaatatttttcaccaaggcgtcgagccatcgacgacgttcccgtgcctcggcgtaccgaccgagtggtacggcgcgctcgagtatcagtacccgcatcacatgcgagcgcacgaactcgacgagggtagagtggtgaacatcttaaagggggcgattgcgacctcggatcgcgtgctcaccgtctcccaaggctacgcttacgagatcacgaccccagagggaggcaagggcatggaagggttgctcctcagcagggcgaacaaactcgacggcatcgcgaacgggatagacatggacgagtggaacccggaggccgatccggactgcgccgctccttattccgtgatagatctcgccgggaagctcgagtgcaagcgcgcacttcaaaaggaacttgggctgcccgagcgagacgacgtcccactcatgggcttcatcgggcgtttggattggcaaaaggggccggatctgctccagcaagcgctccacgacatgatgcgcgaggacatccaggtggtgatgcttggaagcggcttgcccgagctcgaggatttcatgcgatgggccgagggtgagtacaaggacaagttccgcggatgggtcggcttttccgtcccgatggcgcaccgcatcacggcgggttgtgacctcttgctcatgccgtcgcgattcgagccttgcggtctgaaccaactgtacgcgatgcgttatggcactttgcccatcgcgcacgccaccggaggactgaaggatacgatcactccgcacaacgcgttcggagacgccgacaaggttctcgccggcacggcggacgtcaatcagggcgaaggcgtcggcaccggttggctgtttaacgacatgaacgccgacgcgctgatgtgggcgatccgatcggcgtgcgacgtttatcgatccgacaagaagttctggcgcgcaatgcagacgcaggcgatgacgcaagacttgtcttggaacaacgcggcgcgaaagtgggagcaggtcttcgagtgggccaagatggatcctccgcactgcggctaa

SEQ ID NO: 4794 - protein, 525 aa, Ostreococcus tauri
MNIVFVSSEVAPWSKTGGLGDVCGALPQALVARGHRVMVISPKYQNGSKADALYNGALDTCTRAKIGCFGAEHEVGFFHQIKNGVDYVFVDHASFHRKGSLYGDSFGVYGDNQFRFTLLAHAACEAPLQLAFEGCGDRYGKDIVFVANDWHAGLVPTLVASKYRPHGVYRDARTICAIHNIFHQGVEPSTTFPCLGVPTEWYGALEYQYPHHMRAHELDEGRVVNILKGAIATSDRVLTVSQGYAYEITTPEGGKGMEGLLLSRANKLDGIANGIDMDEWNPEADPDCAAPYSVIDLAGKLECKRALQKELGLPERDDVPLMGFIGRLDWQKGPDLLQQALHDMMREDIQVVMLGSGLPELEDFMRWAEGEYKDKFRGWVGFSVPMAHRITAGCDLLLMPSRFEPCGLNQLYAMRYGTLPIAHATGGLKDTITPHNAFGDADKVLAGTADVNQGEGVGTGWLFNDMNADALMWAIRSACDVYRSDKKFWRAMQTQAMTQDLSWNNAARKWEQVFEWAKMDPPHCG

SEQ ID NO: 4795 - DNA, 1725 bp, Ostreococcus tauri
  CDS (1)..(1725)
atgagtcgaacggcgttcgaggcgaagacgaatgcgcgtcgggcgggacgcgcgggcgttcgcgcgcgggcgaaggaatcgacgacgacgatcgcggagatcgcgaagagtacgcgaccgatgaagattgtttttgtttccgcggagtgctcgccgtggagtaagaccggggggctcggggacgtcgtcgggtcgcttccggtggagctcgcgaagcgcgggcacaaggtgatgaccgtctctccgcgttacgatcagtacgctggcgcgtgggacacctccgtgcacgtcgaagcgctcggcaagtctgtcgggttcttccacgagaagaagcagggcgtcgatcgcatcttcgtcgatcaccccgacttcttggccaaggtttggggcaagacgggttccaagctgtacggcgaaaagtctggccacgacttcgccgacaaccaagagcgcttcgcgatgttctgccacgccgctctcaaggcgccgatggcgctcaccgatcttggttacggcgaggacgtcatcttcgtcgctaacgactggcattctgcgctcgttccggtcatcttgaacaaggtgctcaagccggcgggcatgtttgccaaggccaagtgcgcgatgaccatccacaacatcgccttccaaggtcgcttcttcccgcagccgatgtccaagtacggcttgccggaagacgcggctgacgacttcttcttcgaagacggttactccaaggtgtacgacgaaaacacgccggccaaggagcaaggtaaggaggacttcgacggcaagatttaccgcaaggtcaactggctcaaggctggtttcatgaactccgacaggaacttgaccgtgtccgagaactacgccaaggaaatcgcttccagcaaagccaagggcgtcgaactggaccacgtcatccgcgagttcggtatggaaggcatcgtcaacggcatggacccggcggagtggaacccggcgaaggacaagttcatcgacgtgccgtacgacaagaccaccgtcgtcgaaggcaaggctgcggccaagcaagcgcttcaagccgaagttggacttccgctcgacccgaccgcgccggtcttcggttacatcggtcgtctcgaagagcaaaagggctgcgacatcatgttcgaagccgtcccgaagcttctcaaggctgtcccgaacgcgcaagtcgtcatcttgggcacgggtaagaaggttatggaaacggcgctcgaaaagctcgatgccgccgaaccgaactgcgccggcgtcgtcaagttctccgctccgttggcgcacttcatcaacgctggtgccgacttcttgatggttccgtctcgcttcgagccgtgcggcttgatccaacttcacgccatgcaatacggcaccgtcccgatcgtctcttccaccggcggtctcgtcgataccgtcaaggagggtgtcacgggttaccacatgggcgccatggatgccgatgacctcctcccggcggacgtcgacgccatggttgagacgtgcgcttctgccgcggcggacttctcgactccgctgtacaagaagatgtctgccacgtgcatttcccaagacttgacttgggcggagccggcgaagaagtgggaaggcgtgctcgaagaaatgtacttcggcactccggagacgaccaagaaggctgaggttgtcgttcccatcgccaaggcagacgcgctcgccgctcagacgtga

SEQ ID NO: 4796 - protein, 574 aa, Ostreococcus tauri
MSRTAFEAKTNARRAGRAGVRARAKESTTTIAEIAKSTRPMKIVFVSAECSPWSKTGGLGDVVGSLPVELAKRGHKVMTVSPRYDQYAGAWDTSVHVEALGKSVGFFHEKKQGVDRIFVDHPDFLAKVWGKTGSKLYGEKSGHDFADNQERFAMFCHAALKAPMALTDLGYGEDVIFVANDWHSALVPVILNKVLKPAGMFAKAKCAMTIHNIAFQGRFFPQPMSKYGLPEDAADDFFFEDGYSKVYDENTPAKEQGKEDFDGKIYRKVNWLKAGFMNSDRNLTVSENYAKEIASSKAKGVELDHVIREFGMEGIVNGMDPAEWNPAKDKFIDVPYDKTTVVEGKAAAKQALQAEVGLPLDPTAPVFGYIGRLEEQKGCDIMFEAVPKLLKAVPNAQVVILGTGKKVMETALEKLDAAEPNCAGVVKFSAPLAHFINAGADFLMVPSRFEPCGLIQLHAMQYGTVPIVSSTGGLVDTVKEGVTGYHMGAMDADDLLPADVDAMVETCASAAADFSTPLYKKMSATCISQDLTWAEPAKKWEGVLEEMYFGTPETTKKAEVVVPIAKADALAAQT

SEQ ID NO: 4797 - DNA, 2022 bp, Ostreococcus tauri
  CDS (1)..(2022)
atgctaaggaaccaaaagttgaatccccgtgttcgcgatcaaggtgactgggtagtgggtgagttcgacgtccacgaaggagcaagttcgatagatttcgttttcagcgatgcgaatgatgtttacgacaacaattcaaggaaagactatcagtgtgcggtggagcaagaccaacaacgatcacacgaagatctgatcgtggagcaaattgagactgatttagcgagcaaacgtgattttatcgaaaagtgcgctcagagagcgggagaaagagcggagagtcatgaacgtcgccgctcccgatcgctccttgctaagaccagagatggctcgctgaatcgtgtgcatacgattccgcaccagccggaggccggggagaatgtcacgatttattatagagtcgaaggtagcgctctggcgaactcgcaaaaggttcactgtcaaggctcctggaaccgttggaaccatgaaaactcttttggtccgtcaatcatgcagtttagcgattcgttgggttgcatgcagctaactgtgaaggccccacaagacgcacacgtgcttgacttgaagtttatggactcagatgtcccatccgaggtgtctcaagtggatgacaacaacggcatggactatcacaccgtcattgtcaacggctcgggaccagcgcccatcctgaaagtcgtccacgtcgcagttgaaatggccccgatcgcaaaggttggtggtatgggtgacgtcgtaacagcactggcccgggcaacccaagaagacgggcaccaggtcgaagtttttgtccctcattacgacatcgcacagtttgaaaatgttgacggatatcaccgcgcaggagagttcaaacatgaaaaaactgtcgtccaggtgtacaagggatgggttgaagacgtcccagtgactcttctgcgacctgaaaatggttttttcgatgtcgggtgcatctatgggcgtggagacgatcacgtacgttttgatttcttcaccgacgcgacgcttacttggttgcgaagcaagcaacaggaagtggacgtgatccacacgcacgactggcaaaccgcggcggcgacttgggctggttacccgaacgctgcgaccgcactcacggttcataatttgcagtttggtgtcgatcgtatacgtcgaggaatggagtcctgtgacattgccacgaccgtgagtccgacgtacgcagacgaagtacgctttcatcacgccatcgctccctcaaaagacaagtttatcgggattcggaacggaatcgacacggatatttggaatcctgccaacgacaagtttctgcccgtcggctacaacagatccaacgctatcgacggtaaacgcgccgccgctgccgaactctgcaaccgtctcggtctggagcatccggaaggatcccctattgttggcgttgtctcacgccttaccgctcaaaaaggtatccatctcatcaaacacgcgtgttaccgcgttttggagcggggagctaccttcgtcttgctcggaaatgcgcccgatccagcgcaccagcacgatttcaactcgctcgccaaggagatgaaggaaaagtatcctggtcgaagcggcttcatgttcaaatacgacgagccgctctcgcacttgatttacgccggttgcgatttcctcctcgtcccgtcaatgtttgagccgtgcggtctgacacagatgatcgccatgcgctacgggaccgttccggtagttcgtcgaactggaggcttggctgacaccgtcttcgacgtcgaaaacgacagcacgcgctgcgccacggcgggcatcccgccgaatggcttcgtcttcgacggcacggagactcgagacatcgattccgccgtcattcgcgctctcgacgccttctacgatcgcgaacgctgggagtccctcgccctcgtcgaccgcgcgatgtcctgtgactggggctggttcgagccgagcaagcgatacgaggatctctactggtccgctttgagcaagaagagaaacacacggtag

SEQ ID NO: 4798 - protein, 673 aa, Ostreococcus tauri
MLRNQKLNPRVRDQGDWVVGEFDVHEGASSIDFVFSDANDVYDNNSRKDYQCAVEQDQQRSHEDLIVEQIETDLASKRDFIEKCAQRAGERAESHERRRSRSLLAKTRDGSLNRVHTIPHQPEAGENVTIYYRVEGSALANSQKVHCQGSWNRWNHENSFGPSIMQFSDSLGCMQLTVKAPQDAHVLDLKFMDSDVPSEVSQVDDNNGMDYHTVIVNGSGPAPILKVVHVAVEMAPIAKVGGMGDVVTALARATQEDGHQVEVFVPHYDIAQFENVDGYHRAGEFKHEKTVVQVYKGWVEDVPVTLLRPENGFFDVGCIYGRGDDHVRFDFFTDATLTWLRSKQQEVDVIHTHDWQTAAATWAGYPNAATALTVHNLQFGVDRIRRGMESCDIATTVSPTYADEVRFHHAIAPSKDKFIGIRNGIDTDIWNPANDKFLPVGYNRSNAIDGKRAAAAELCNRLGLEHPEGSPIVGVVSRLTAQKGIHLIKHACYRVLERGATFVLLGNAPDPAHQHDFNSLAKEMKEKYPGRSGFMFKYDEPLSHLIYAGCDFLLVPSMFEPCGLTQMIAMRYGTVPVVRRTGGLADTVFDVENDSTRCATAGIPPNGFVFDGTETRDIDSAVIRALDAFYDRERWESLALVDRAMSCDWGWFEPSKRYEDLYWSALSKKRNTR

SEQ ID NO: 4799 - DNA, 2939 bp, Colocasia esculenta
  CDS (220)..(2634)
ggtgcgtgtgtgcttatagtgtcctccatttcccccctcctcctccctctagcaggccaggcagccagggcttaccatcggcgaggttttttgcattccccctcctttaaagggattcctttccgccgggcagtcgggggagcagtacatgacacctttttaatcagttttcgcgggaggcccagctaaaggtgaggaggaaaagaggaagacagaaagatggcatctttgggacgagctgggacggctgctttcttcctggagccgtcaaggagctgcgggcagccgcgggctgctgggttctgtgtgcctgtccggtgcaggttgaattgtcttgatctccattcgcgcgctggggaattcaggtttctgcgggcgggcaatggcgaaaggcacatgggttttacatggagagacagggggacgggtagggttctgccggcagtgggaagaaaaggtgctgcagatggagctgaggatggcggcgaggacgatatgggcgacgtggatgtggatggcgacgaggtgcttaaggcgactatcgagaagaccaagagggcgctgtccgtgcagaagagcctgctcgaacagattgttgaaaggagaaaacttgtttcttccatgaaagagagtgtcatcaagacaggaaaggaaacagtccctcccaataaaagtgatgcctctttctccagtttgagctcagataccacgagtggtatggctcgtaacaaatataaaaagttttcttactccacttcggaggcagcagaaacactgtctgctaataccaatggggctgctataaaaaagaaatttcagaatgaagaagtggaagtctctggtgatgctaaggagatttctatgcttagttcaaaaatagaaagctcagatgatgaaaagaaggaaaatgaagatggcttacttgcagaaagctcgatagcagaatctcttggactgctaagagaacccagttcaaaagtttctcagtctaaggcagtgccctctttgcttccaaaagtgtctgaagctttcacggccaaggatgaacaacgtgaggaatcggaagagaaaagccaagatgatccagatgataaaacagatgtagctcccaaggaagaagatgtaaaatcccctccattggctggattaaatgttatgaatgttatcttggtagctgcagaatgtgctccttggtccaaaactggtgggcttggagatgttgctggagctttaccaaaggccttggccagacgtgggcatagagttatggttgtggttccccgatatggcaactattctggacctcaagaaataggtctacgcaagcgttacaaggtggatggacaggatatggaggtaacatattatcttacctacattgatggtgtggatttcgttttcatcgatagtcctatttttcgccatcgtgaaagcaacatatatggtggggaacgtgcggatattttaaaacgaatggtccttttatgcaaggcagctgttgaggttccatggcatgttccttgtggtggagtctgctatggtgatggaaaccttgttttcattgcaaatgattggcacacagcactgctacctgtttatctaaaagcatattatcgtgacaatggctcgatgaaatacacccggtctgtcttggttatacacaatatagctcaccagggtcgtgggcctgtagatgagttccgcattgtggatttacctggtcattatgtcgatctatttaggttgtatgacctagttggtggtgagcacttaaacatctttgctgcgggcttgaaaactgctgaccgtgtagtcacagtgagccatggttattcatgggagcttaaaacattggaaggtggttggggactgcacgagattatcaatgagaatgattggaaacttcgaggtattgtgaatggaatcgacacagaagattggaacccggaagttgatgtgcacttaaaatctgatgggtataccaactactcattggagactcttaatatgggtaagcctcaatgcaaggctgcacttcagaaagaacttggccttcctgttcgaccagaagttcctgttgttgcctttattgggaggctagatcatcaaaagggagtggatatcattgcagaggccattccctggatggtcagtcaggatatgcagttagtcatgctgggtactggaaggtcagatctggaggacatgcttcggagttttcagggcaatcactgtggcaaggtcaggagttgggttggtttttctgttaaaatggcacataggataactgcaggtgcagacgtcctgttaatgccatccaggttcgagccgtgcggcctgaaccagctgtatgccatgatgtacggaaccattcctcttgttcatgcagttggtggactgagagacactgtagtgcccttcaatccatatgaggagagtggatttgggtggacatttgacagagccaaggcagggaagctgattgacgcgctgcgcaactgtttcaacactttctggaattacaaggagagctgggaggggttgcagagacgtggtatgttgcaggaccttagctgggatcatgccgctcagctatatgaggaagtccttgttgctgccaagtaccagtggtgaatcctttgagcataaacggttcacttggggccgaacaaatttggatgggacttcagtgatccttattggtaggtcttttgctagggcgtagctgctggagagagcctcccccacctcctgatgtatattgcttattcctttttgctactttcgtgatctcctccattttactaggtccaccgacgatcatgaatactgcgagtattgcagccgtgtagtatggctcatttctctcctttgtagcccttctgaatcattagttttgctggtttttcccccaaaaaaaaaaaaaaaaaaaacaaaaa

SEQ ID NO: 4800 - protein, 804 aa, Colocasia esculenta
MASLGRAGTAAFFLEPSRSCGQPRAAGFCVPVRCRLNCLDLHSRAGEFRFLRAGNGERHMGFTWRDRGTGRVLPAVGRKGAADGAEDGGEDDMGDVDVDGDEVLKATIEKTKRALSVQKSLLEQIVERRKLVSSMKESVIKTGKETVPPNKSDASFSSLSSDTTSGMARNKYKKFSYSTSEAAETLSANTNGAAIKKKFQNEEVEVSGDAKEISMLSSKIESSDDEKKENEDGLLAESSIAESLGLLREPSSKVSQSKAVPSLLPKVSEAFTAKDEQREESEEKSQDDPDDKTDVAPKEEDVKSPPLAGLNVMNVILVAAECAPWSKTGGLGDVAGALPKALARRGHRVMVVVPRYGNYSGPQEIGLRKRYKVDGQDMEVTYYLTYIDGVDFVFIDSPIFRHRESNIYGGERADILKRMVLLCKAAVEVPWHVPCGGVCYGDGNLVFIANDWHTALLPVYLKAYYRDNGSMKYTRSVLVIHNIAHQGRGPVDEFRIVDLPGHYVDLFRLYDLVGGEHLNIFAAGLKTADRVVTVSHGYSWELKTLEGGWGLHEIINENDWKLRGIVNGIDTEDWNPEVDVHLKSDGYTNYSLETLNMGKPQCKAALQKELGLPVRPEVPVVAFIGRLDHQKGVDIIAEAIPWMVSQDMQLVMLGTGRSDLEDMLRSFQGNHCGKVRSWVGFSVKMAHRITAGADVLLMPSRFEPCGLNQLYAMMYGTIPLVHAVGGLRDTVVPFNPYEESGFGWTFDRAKAGKLIDALRNCFNTFWNYKESWEGLQRRGMLQDLSWDHAAQLYEEVLVAAKYQW

SEQ ID NO: 4801 - DNA, 1554 bp, Thermoproteus tenax
  CDS (1)..(1554)
atgatgcacgcgccggaggcaatccgcaaggtctatatcctcacgttcgagtacggcggattgatcaaggtgggcggcttgggtgaggcagtgagacagtatgcagccgctctggccaggcggggctactcagtcactgtgctcatgccctcgcacgggagacatctggatcctaacagagggttcccgctgaggcctctcgacttcgccgcgtgtggagagaggagaggtctcgacggacggatctatccctattgcatcggcgctgaggagacggaggccgacggcgcaaggattgtgatgttcaaggggctcgatactcccacagggctcgtcttcgacaaatggtacccctacgataacgtggaggagaaagcggcgctgttcgcgagagcggtcgtggcatacgccgagaggtacggcctgccggacttagtccacgcaaacgactggcattcaggcctcgcgggggtggcgctcaaggattacgcagagaggagtggggtggcgcttcccctagtctacaccgtacatctatcctcgggctacgccttcccgtggcactacgcttcatctgactgggccagtatatcggacagacctcacctcgtatggcgcgtctgttgtcacaagtgggagcgctacagcgatgtgtggaactctgtgggcggcacagcagaggcgttcgcggccgttgaagccgatgccctctcgagcgtcagctggggctatctgaacgagttcctctccaaatatggcgagtggatgaggggcaagtcctgcgtcctctacaacgcgaccgactggaggctcgaggaggccgaggctcatttcgcgaggctcgcccccgatggctctccgtggaggctcgtcgaggccgtgccccatatggaggggcggcttgatagagatggctccctcttcgtggccgtaggaagggcaacgagccaaaagggcctcgatgtggccgtaaaggcgttggactacgcgccgtccgcgaggctcttggtattggctgtgtccgtcggcgacagagggtatgaggactacctcaaggagttggtcagagcgaggcccggcagagctgccatcaccttcgcgagagttcccaaggatctctatatggctctgatctatgcgtccacggctttggtgatgccctcccgttgggagcccttcggcatctccgccatcgaggccatggccgtcggcacgccggtgatagctacggccgttggcgggctccccgaggtggtgcgggactttagagccggggagggcacgggcctggtggtgccccccgaggatgcctactccgttggattggccatggagtacctagcccgctggctctggcgcggcaatcccaacgaggttccagacccggctatgagagctgcagcacgacgttggcccagatatataccggacctaaaacggtatatatcagcatacgtggacgagagattcagagaaaaaaacttgtacgagcagctcaaagattgttacgagagagcgaggctaatggcctattatcgcgctataacattgtag

SEQ ID NO: 4802 - protein, 517 aa, Thermoproteus tenax
MMHAPEAIRKVYILTFEYGGLIKVGGLGEAVRQYAAALARRGYSVTVLMPSHGRHLDPNRGFPLRPLDFAACGERRGLDGRIYPYCIGAEETEADGARIVMFKGLDTPTGLVFDKWYPYDNVEEKAALFARAVVAYAERYGLPDLVHANDWHSGLAGVALKDYAERSGVALPLVYTVHLSSGYAFPWHYASSDWASISDRPHLVWRVCCHKWERYSDVWNSVGGTAEAFAAVEADALSSVSWGYLNEFLSKYGEWMRGKSCVLYNATDWRLEEAEAHFARLAPDGSPWRLVEAVPHMEGRLDRDGSLFVAVGRATSQKGLDVAVKALDYAPSARLLVLAVSVGDRGYEDYLKELVRARPGRAAITFARVPKDLYMALIYASTALVMPSRWEPFGISAIEAMAVGTPVIATAVGGLPEVVRDFRAGEGTGLVVPPEDAYSVGLAMEYLARWLWRGNPNEVPDPAMRAAARRWPRYIPDLKRYISAYVDERFREKNLYEQLKDCYERARLMAYYRAITL

SEQ ID NO: 4803 - DNA, 1470 bp, Desulfovibrio vulgaris
  CDS (1)..(1470)
atgcaacggcaggtcgtgttcgccacatcggagatgtaccccttctccaaaagcggggggctgggcgatgtgcttggtgcgctgccccttgccctgcaccgcatgggcgtgcccacggcggtggtgacacccttctatggcagattgcgaacggcggactatcccatccggctgacggtctccgactgccatgtgggctacccgtgggcccccatcacctgcgacgtcttcgaggccgactatcatggcatgccggtctacttcatccaccggggcgagtatttcgacaggcgttactactacaacgaccacaagggcgactacttcgacaactgcgaacgcttcgtcttcttctgccgcgcgctgctggcgctgatgcgccgtctggggcagcccccggcagtgctgcacgcccacgactggcagacggcacttgtgcccgcctttctctacttcctgcggcagaccgacccgttctggcaggatacgcgcagtgtgctcaccatacacaacctcgccttccaggggcgtttcgcctcgcgtcttttcgagacttcgggcctgcccccgcaggcatggagcgtggacggcgcggaattctggggcgacttcaacctgctcaaggcgggcatcgcctatgccgacaaggtgaccacggtcagccccagctatgcgcgtgagattctcggccccgcctatggcagcggtctcgacggtatcctgcggaagcgtgcccacgccctgcacggcatcctcaacggtgcggactacgacatctggtcgcccggcaacgaccgcttcctcccctgccgctatacgcccacggaccttgcaggaaaggcgcagtgcaagcgcgccctcatcgaagaactcggcctcgacccgcaccttgccaggcgtcccatcctcggcttcatcggcagactgcgcgggcagaaggggatagacctgctgctcgacatcctgccccgcctcatggagagcgacgtcggggtcatcatcctcggcgagggcaatctgacccatgaggcgcgggcccttgagctgatggaggcctaccggggccgggtgtgcaccatcgtcagctacaccgaagacctcgcccaccgcatccaggcgggcagcgacatctttctcatgccgtcgcggtacgaaccgtgcggcctcacccagatgtacgccctgcgctacggcacaccgcccgtggccacggccgtgggcgggctgcgcgacaccatcgtcccgtggccctcgccggagagcacgggcttcaccttcggccggtgcgagtccgcggcctttctgcgggccatcctcgatgcggtgcacctgtggaccacggcccccggcgactggcagggcatggtgcgacgcgccatggcacaggccttcacctgggaacgcgccggacgcgcctacctcgacctttacgcccaactgggggtctcccccggtgaggagggcgcgtga

SEQ ID NO: 4804 - protein, 489 aa, Desulfovibrio vulgaris
MQRQVVFATSEMYPFSKSGGLGDVLGALPLALHRMGVPTAVVTPFYGRLRTADYPIRLTVSDCHVGYPWAPITCDVFEADYHGMPVYFIHRGEYFDRRYYYNDHKGDYFDNCERFVFFCRALLALMRRLGQPPAVLHAHDWQTALVPAFLYFLRQTDPFWQDTRSVLTIHNLAFQGRFASRLFETSGLPPQAWSVDGAEFWGDFNLLKAGIAYADKVTTVSPSYAREILGPAYGSGLDGILRKRAHALHGILNGADYDIWSPGNDRFLPCRYTPTDLAGKAQCKRALIEELGLDPHLARRPILGFIGRLRGQKGIDLLLDILPRLMESDVGVIILGEGNLTHEARALELMEAYRGRVCTIVSYTEDLAHRIQAGSDIFLMPSRYEPCGLTQMYALRYGTPPVATAVGGLRDTIVPWPSPESTGFTFGRCESAAFLRAILDAVHLWTTAPGDWQGMVRRAMAQAFTWERAGRAYLDLYAQLGVSPGEEGA

SEQ ID NO: 4805 - DNA, 1323 bp, Thermus thermophilus
  CDS (1)..(1323)
atgggcgttatgcgcgtgctccacgtggcccccgaggcctaccccctggccaaggtgggagggcttgccgacgtggtgggggccctccccaaggccctggggcctttgggggtggaggcccatgtcctcctcccctggcacggggggctagaggccaggcgggtgggggaggtggcctttgccttcttcgggcgggaggagagggcccccttgggggagcgggtggagggtggggtgcggtttctcctcctcggggtggaggggtttgggcgggagcgggtctacggctaccccgacgacgccgagcgctacctccgcttcgccctggcggccaaggaggtggcgagagggtacgacctggtccacgcccacgactggacggcggccctcctcgccctctacgcccccacggtctacaccatccacaacctggcccaccagggtctcgtggacccggggctcttcttttcctggaccgggcttccctggagcctcttccacatggaggccctggagttctacggccgggtgaacctgatgaagggggggatcgtcttcgcccgccgggtcaccacggtgagcccctcctacgccgaggagatccagacccccgagttcggcatgggcctggacggggtcttgaggaggcacgccgggaagcttaggggcatcttgaacggcctggacacggaggtctttgaccccggcaaagacccctacctccccgccccctacacccgggaggacccctcggggaaggcccgggccaaggaggccttccgggagaggacggggcttaggccccccgtcctcgcctacgtgggccgcctggattaccagaagggcctggacctcgtcttaaaggccctcccccgcctcctggagatgggctttcgcctctacgtccagggcgtgggggacggggggcttcaggaggcgttcctccgggcggaggaggaaaaccccgaaggggtacgcttcctccccgcctacgacgaggccatggcccgcctggcctacgccggggcggaggcggtcttggtcccgagccgctttgagccctgcggcctggtgcagatgatcgcgagccgctacggcacccctcccgtggcccgggcggtgggggggctcaaggacaccgtggaggacgggagggccggggtcctttttgagacctaccaccccgaggggcttctttacggcgtgctccgcctcttccgcctgggggcggaggagatgggccttagggccatggagaaggacttctcctgggaggggccggcgcgggcctaccgggaggtgtaccgggaggccttgggctag

SEQ ID NO: 4806 - protein, 440 aa, Thermus thermophilus
MGVMRVLHVAPEAYPLAKVGGLADVVGALPKALGPLGVEAHVLLPWHGGLEARRVGEVAFAFFGREERAPLGERVEGGVRFLLLGVEGFGRERVYGYPDDAERYLRFALAAKEVARGYDLVHAHDWTAALLALYAPTVYTIHNLAHQGLVDPGLFFSWTGLPWSLFHMEALEFYGRVNLMKGGIVFARRVTTVSPSYAEEIQTPEFGMGLDGVLRRHAGKLRGILNGLDTEVFDPGKDPYLPAPYTREDPSGKARAKEAFRERTGLRPPVLAYVGRLDYQKGLDLVLKALPRLLEMGFRLYVQGVGDGGLQEAFLRAEEENPEGVRFLPAYDEAMARLAYAGAEAVLVPSRFEPCGLVQMIASRYGTPPVARAVGGLKDTVEDGRAGVLFETYHPEGLLYGVLRLFRLGAEEMGLRAMEKDFSWEGPARAYREVYREALG

SEQ ID NO: 4807 - DNA, 1431 bp, Bacillus cereus
  CDS (1)..(1431)
atgaatattttatttgcagtatcagaatgtgtaccatttgttaaatcgggaggattagctgatgtagcaggtgcgctcccaaaagagctaaaaaaattaggtgtggaagttcgcattatactcccgaattatagtcttattccgcaaaaattaagggatggatgtacgctacataaagtaattaacgtcccgcttggctggagaaatcaatattgcggaattttaaaaggtgagcaagacgggattacgtattacttaatagataatgaatattattttaagagggattctctgtatggtcattatgatgacggagagcgtttttcttatttttcgaaagcagttttagagtgtattcctcatcttgatttcgaagtggatgttcttcatagccatgattggcatacagctatggtaaatttcttactacgtgaaaagtatcaagataacccattatatgagcatattaaaacggtatatacgattcataacttgcagttccaaggtgtatttcctcctgaagtgatgtacgacttgctagaacttggtgatgaatattttcatagtgagcagttagaattttatgggaatgtgaactttatgaagggtggcattatcgcttctgatcaaattacagcggttagcccgacatacaaagaggaaatccaatatgagtttttcggtgagaagttagatggattactgcgaaaatataatggtaagcttagcggcattgtaaatggaattgatacgagcgtgtacaatccagaaacggattcgtatattactgctcagtacgatgcagattcattatatgaaaagagtaaaaataaacgcgcgttgcagcgttattttggtttgccagaaaaagaagatacaccaattatttctatggtaacgagattaacgaagcaaaaaggtcttgatttagtacgtactgtattccgagaaataatggaagaagatgtacaatgtattattttaggatcaggtgattcggaatatgagaaattctttgagtggatggcatatgagtatcctgagaaggtaaaagtgtatattggctttaatgaagaattagcccaccaagtatatgcgggaagtgatttattcttaatgccatcactatttgaaccatgtggacttggacaacttatcgcattagcgtacggtacgattccaattgtaagggaaacaggcggattaaatgatacggtacaatcttatgacgaagagactggagaaggaaatggtttcagtttcacgaactttaatgcacatgacatgttgcacacggttcgtcgtgcaattgaattttatcatgataaaccggtgtgggagcagcttgtaaaacaagcaatgactgaagattatagctggggaaaatcagctctggcttataagaaattgtataaaagtctcatggaataa

SEQ ID NO: 4808 - protein, 476 aa, Bacillus cereus
MNILFAVSECVPFVKSGGLADVAGALPKELKKLGVEVRIILPNYSLIPQKLRDGCTLHKVINVPLGWRNQYCGILKGEQDGITYYLIDNEYYFKRDSLYGHYDDGERFSYFSKAVLECIPHLDFEVDVLHSHDWHTAMVNFLLREKYQDNPLYEHIKTVYTIHNLQFQGVFPPEVMYDLLELGDEYFHSEQLEFYGNVNFMKGGIIASDQITAVSPTYKEEIQYEFFGEKLDGLLRKYNGKLSGIVNGIDTSVYNPETDSYITAQYDADSLYEKSKNKRALQRYFGLPEKEDTPIISMVTRLTKQKGLDLVRTVFREIMEEDVQCIILGSGDSEYEKFFEWMAYEYPEKVKVYIGFNEELAHQVYAGSDLFLMPSLFEPCGLGQLIALAYGTIPIVRETGGLNDTVQSYDEETGEGNGFSFTNFNAHDMLHTVRRAIEFYHDKPVWEQLVKQAMTEDYSWGKSALAYKKLYKSLME

SEQ ID NO: 4809 - DNA, 1476 bp, Treponema denticola
  CDS (1)..(1476)
atgaaaataatgatggttacaagcgagcttgttccttttgcaaaagtaggaggtttggctgatgccgttacagctttatcaatagctcttgcagaaaaaagacatgatgtaagggttgtaatgcctcgttattataaaatcgatcgaaaaaacttaaagcaaattccgggggctatggccgttcatcttgggccttatgaacactgggtaggagtttatgagtcaaatctgccttcttcaaaggtaaaggtttattttatagaccatgaacaagcctttggcagagatggcgtttacggttcagcttttgaacctgatttttccgataatacgaaaagattttcacttttagcccatgcagcttttcaagtttgcagaaaacaggcatggattcccgacgttgtacatgcccatgattgggctgcgggcttggtacccgtacttttacgctttacagaaaaaaatacggaatttaaaaatacggcaagtgtttttaccattcataatatgggttaccaaggtgtttattcaaagcatacctttcccgacacaggccttgattggaacgacttttatactacaggctttgaagactgggatagaataaactttttaaaagcggcccttgtttcttccgatatgcttacaaccgtttctccttcttatgcggaagaaattaaacgccccgaattcggctttaggatggatggtattttgcggtacagggaaaaagaactgacaggaattttaaatggggtagacacctcaatttggaatccttcaaaagacgagtatattccttaccgatacaattctaaaacccttgaggaaaaggaaaaaaataaatccgttttacaggaaaggttcggtctcgaaatagatatttccgttccggtattcggtatgataagccgattggttgatcaaaagggtatttcagagcttttcggacccatgtacggttcagcctttaagatatgttccgatataaaacttcaaatggttgttttgggctcaggtgaatcttggtgcgaaaaagagctcaattttctttcacaaaggctgcctaattttagatgttatataggctataatgaagaattaagtcatttaatcgaagccggaagcgactttttcttgatgccttcaagatatgaaccatgcggcttaaaccaaatgtattccctcctttacggaaccttgcccatagtccgaaagactggagggctcgcagatacggtagaaaactataatgaagaaacaggcgagggtacgggttttgtgcttgactacttaagccctcaaagtatttacgatacggtcggctgggcagcttatgcatggtataataaaaaagatcacataaaaaagatgagaaccaaggccatgagtaaaaagttcggatggaatatagccgcggaaaaatatttaaaagtatatgccgatgctattgaaaaaaaagcttccatgttatag

SEQ ID NO: 4810 - protein, 491 aa, Treponema denticola
MKIMMVTSELVPFAKVGGLADAVTALSIALAEKRHDVRVVMPRYYKIDRKNLKQIPGAMAVHLGPYEHWVGVYESNLPSSKVKVYFIDHEQAFGRDGVYGSAFEPDFSDNTKRFSLLAHAAFQVCRKQAWIPDVVHAHDWAAGLVPVLLRFTEKNTEFKNTASVFTIHNMGYQGVYSKHTFPDTGLDWNDFYTTGFEDWDRINFLKAALVSSDMLTTVSPSYAEEIKRPEFGFRMDGILRYREKELTGILNGVDTSIWNPSKDEYIPYRYNSKTLEEKEKNKSVLQERFGLEIDISVPVFGMISRLVDQKGISELFGPMYGSAFKICSDIKLQMVVLGSGESWCEKELNFLSQRLPNFRCYIGYNEELSHLIEAGSDFFLMPSRYEPCGLNQMYSLLYGTLPIVRKTGGLADTVENYNEETGEGTGFVLDYLSPQSIYDTVGWAAYAWYNKKDHIKKMRTKAMSKKFGWNIAAEKYLKVYADAIEKKASML

SEQ ID NO: 4811 - DNA, 1173 bp, Mycobacterium paratuberculosis
  CDS (1)..(1173)
atgcgggtggcgatgatgacgcgggaatacccaccggaggtctacggaggggcgggggtacacgtcaccgaactcgtcacccagctgcgccggctgtgcgcggtggacgtgcactgcatgggtgctctacgcccgggcgcggccggggtgcaggtgcatcagcccgacccgcggctgcagggcgccaacccggccatgtcgaccctgtccgccgacctgatgatggccaacgccgccgcgcaggccagcgtcgtgcactcacacacctggtacaccggcatggccgggcatctggccgcgctgctgcacgacatcccgcacgtgctgaccgcgcattcgctcgagccgctgcgcccctggaaggccgagcagctgggcgggggctaccggatctcgacctgggtcgagcacaccgcggtgctggccgcccacgccgtgatcgcggtcagctccgcgatgcgcgaggacatcctgcgggtctacccggcactggatcccagtgcggtgcacgtcatccgcaacggcgtcgacaccgacgtctggtatcccgccggcccggtgcagaccggatcgatgctggccgaactgggcgtcgacccggcccggcccctggtggtgttcgtgggccggatcacccggcagaaggggctcgcgcatctggtggcggccgcgcaccggttcagccccgaggcgcaggtgctgttgtgcgccggtgcgccggacaccccggaaatcgccgacgagatccgcgacgcggtggccgccctggcccgcggccgcaccggcgtgttctggatccgggaaatgcttcccatcggggaactacgcgaaatactgtcggccgcatcggttttcgtgtgcccctcggtgtacgagccgttgggcatcgtgaacctggaggcgatggcctgcgcggcgccggtggtggcctccgacgtcggcggcatcccggaggtggtcgccgacggggtcaccggctcgctggtgcattacgacccgcgcgacccggcgggctatcaggccggattggccgaggcggtcaacgagctcatcgccgaccgggaaaaggcgcagcgctacggcagggcaggacgccagcgctgcgtcgaggagttctcctgggcccacgtcgccgagcagaccctggagatctatcggaaagtgtgtgcatag

SEQ ID NO: 4812 - protein, 390 aa, Mycobacterium paratuberculosis
MRVAMMTREYPPEVYGGAGVHVTELVTQLRRLCAVDVHCMGALRPGAAGVQVHQPDPRLQGANPAMSTLSADLMMANAAAQASVVHSHTWYTGMAGHLAALLHDIPHVLTAHSLEPLRPWKAEQLGGGYRISTWVEHTAVLAAHAVIAVSSAMREDILRVYPALDPSAVHVIRNGVDTDVWYPAGPVQTGSMLAELGVDPARPLVVFVGRITRQKGLAHLVAAAHRFSPEAQVLLCAGAPDTPEIADEIRDAVAALARGRTGVFWIREMLPIGELREILSAASVFVCPSVYEPLGIVNLEAMACAAPVVASDVGGIPEVVADGVTGSLVHYDPRDPAGYQAGLAEAVNELIADREKAQRYGRAGRQRCVEEFSWAHVAEQTLEIYRKVCA

SEQ ID NO: 4813 - DNA, 2486 bp, Phaseolus vulgaris
  CDS (39)..(2255)
caccctttctcgtggaggccaatgctgactccactttgatgatggggatgtttcaccacaggaatctcaagctttcttctcctaagtttggccctttgagtggttcatcgtttggacattcgggggcaagagggtgggggcgtggaagagtgaaccatgggtgtagcaggggtttgttgtgtttggtggagaagaataggaggataaaagctttggggaagggttcttggatgagtgaggagtcagaggaaatacttcagggcacaattgagaagagtaagaaggttattgctttgcaaagggagctgcttcaaaagatttctgaaagaaggaaactgcttcatgcaatagatagtcaaataaacagtatttcagatgagcacagcaatgaatccctattaagtactattgagaaccaaaatggtggcactgtttcaagcagttacgtccaatctagtgagaaggaaatatcgaatgtctcgagtttagccactgatcgtggttttgataagggtgaagaggaagatgataaattgtctcttgctgaaaaggcttcagctacacagtattttgatgaacttttgaatagcaatagatatgagacaattgcccctgataccctgccaatggaaatcccaagtggcaccaaaaccaccagtcagattattgaaatactggaaggtatcgatgaatcaagttttgatgaggttgctgataaagctgacaatgttgagagtgaaggtgaaaaacccccaccgttggctggggagaatgctatgaatgttatattggcggcagtagaatgtgctccctggtcaaaaacaggtgggcttggagatgttgctggatcattacctaaggctttggctaagcgtggacacagggttatggttgtagcacctcgatatagtaattatgctgaagcagtagagattggagtacggaaacagtacaaagtggatggtcaggacatggaagtaacatatttccatgcttttatagatggtgttgactttgtttttcttgacagtccaaactttcgcaatttacagaataacgtatatggtggaaaccgaatggatattctaaaacgcatggtgctgttttgcaaggcagctgcagaggttccatggcatgttccatgtggtggtatttgctatggagatggaaatttggccttcattgcaaatgattggcatactgcattgttgcctgtgtacctcaaggcatatttccgtgataatggtttaatgaagtacacaagatctattcttgtgattcataacatagcacaccagggtcgggggccacttgatgaattccgttacacggatttaccgcagcattacatagaccttttccaattatatgatcctgttggaggtgagcacttgaatatcttagcagccggtttaaaggcagcagaccggattgtcactgtcagtcatggatatgcatgggagatcaaaacttctgaaggtggttggggtttgcatgggatcataaatgagaatgactggaaactgaggggaattgtcaatggaattgataccaaagattggaaccccaagtttgatgttcacttgaaatcagatggatacactaactactcggttgagaccctgcaaagtggcaagcgtcaatgcaaagctgccctgcaaaaggaactcggttttccggttcgtgaggatgttccgttgatcggattcattggaaggctggatcatcagaaaggcatcgatatcattgccgaagcaattccatggatggtgggccaggatatgcaacttgccttgctgggaaccggaaggcctgacttagaagatatgcttaagcaaattgtgtcccaacacaatgacaaaatcaaaggattgattggtttttctgtgaagatggctcacaggataacagcaggtgcagacatattgctcatgccatcaagatttgagccatgtggattgaatcaactctatgccatgaactatggaacaatcccagttgtgcatgctgtgggtggactgagggataccgtgacaccttttaatccatttgaagagtctggccttggatggacatttgacagtgcagaacctaataagctagtaaacgcattagggaactgcttgatgacctttaagcagtttaagcagagttgggaagggatccaacggcgtgggatgatgcaggatctcagttgggacaatgctgctcagcagtacgaggaggttcttgttgctgccaagtaccaatggtaaaatcttagcttctactctaccaaccacactcatcaatatgactgcattcaggctgctgagttatatcatggtctgtgcaagggaaaggaccaggtcattttggccaagttgttacaactttcttgttgcaggtcctggaggaagattttgcccctaatctaaggtttatgtaataatcacttgttatatatgtggcacatgtagctggaaagttaatcaaacaactttata

SEQ ID NO: 4814 - protein, 738 aa, Phaseolus vulgaris
MMGMFHHRNLKLSSPKFGPLSGSSFGHSGARGWGRGRVNHGCSRGLLCLVEKNRRIKALGKGSWMSEESEEILQGTIEKSKKVIALQRELLQKISERRKLLHAIDSQINSISDEHSNESLLSTIENQNGGTVSSSYVQSSEKEISNVSSLATDRGFDKGEEEDDKLSLAEKASATQYFDELLNSNRYETIAPDTLPMEIPSGTKTTSQIIEILEGIDESSFDEVADKADNVESEGEKPPPLAGENAMNVILAAVECAPWSKTGGLGDVAGSLPKALAKRGHRVMVVAPRYSNYAEAVEIGVRKQYKVDGQDMEVTYFHAFIDGVDFVFLDSPNFRNLQNNVYGGNRMDILKRMVLFCKAAAEVPWHVPCGGICYGDGNLAFIANDWHTALLPVYLKAYFRDNGLMKYTRSILVIHNIAHQGRGPLDEFRYTDLPQHYIDLFQLYDPVGGEHLNILAAGLKAADRIVTVSHGYAWEIKTSEGGWGLHGIINENDWKLRGIVNGIDTKDWNPKFDVHLKSDGYTNYSVETLQSGKRQCKAALQKELGFPVREDVPLIGFIGRLDHQKGIDIIAEAIPWMVGQDMQLALLGTGRPDLEDMLKQIVSQHNDKIKGLIGFSVKMAHRITAGADILLMPSRFEPCGLNQLYAMNYGTIPVVHAVGGLRDTVTPFNPFEESGLGWTFDSAEPNKLVNALGNCLMTFKQFKQSWEGIQRRGMMQDLSWDNAAQQYEEVLVAAKYQW

SEQ ID NO: 4815 - DNA, 2570 bp, Phaseolus vulgaris
  CDS (135)..(2309)
acagatgtactcattcagttcaagttccatagtttatctctttctacaccttgttatccttcatctgccaaattccttatcatctctgctaagtttgtgaaagcaattaaccctgttgttattcttagtttctcatggcatcatcaataagtgcccaagctttggttctgcttcacagcagaggaaacccttgtctcagatttcgacagaaaaatgttgtcgtgtttgagcattcgtgcataagggcaacaggtggtaacagtttaggaacaggtgaggataaagatgatgctgaaggtgtgtttttggccatcaatgaaaagaaaaataaggtgctagctttgcaaaaggatctacttcaacaggttgtggaaataaagaaactggtttcttccgaaaagagtgagaacactcttgaatcagaagtgaacagtacatcttatgaactcggtaaaaaatctttcacaaataaatcaagtccacagaatgcttccaccagtggtaacaatgcagtaaaaaatcaaaatggaattattgcttcaccaaactatgtccaatctagtgaagggtctgtggaatccccacctataagcactaatggaggctttaaggaagctagggaggaagatgttaaacccccacttggaatggcttcatctggcatatatttaaatgaaaagttgaaagacaaagcacttgagactaataggcctgatactctctcagcctttgcaaatgatactgaacatttgagtttagaggttgagaatcaggttggtatgagtgaaggtgaaactgaaataccccaacccttggctgggaccaatgttatgaatgtcatattagtggcagcagaatgtgctccctggtcaaaaacaggtgggcttggagatgtagttggttccttgccaaaggctttggctagacgtggacatagagttatggctgtgacacctcgatatggtaattatgcagaagcccaagatacaggagtgcgaaaatggtacaaagtagatggtcatgatgcggaagtaaaatatttccaagcctacattgatggtgtagatttcgttttcattgacaatccactttttcatcatctagaacgtaacatatatgggggaagccgattggatattctaaaacgtatggtgctgttttgcaaggcagcagttgaggttccatggcacattccatgtggaggtgtttgctatggagatggaaatttggccttcatagcaaatgattggcatactgcattgctgccagtgtatctgaaggcatattatcgtgagcagggtttgatgaagtatacaagatcagttcttgtgattcataacatagctcaccagggtagggggcctgttgatgattttttctttgtggatttacctgaacaccacatggaccttttcaaattatctgaccccattggaggtgaccatttcaacatctttgcagctggtttaaagacagcagaccgtgttgtcacggttagtcatgggcatgcatgggagctcaaaacttctgaaggtggttggggcttgcatgggatcataaaggacaatgattggaaattgaggggcattgtgaatggagttgacaacaaagaatggaaccctcggtttgatgttcacttgaaatcagatggctacactaactactcccttgagacactttctagtggcaagcgtcaatgtaaaacagcattgcaaagggagcttggtttgcctatccgtgaggaagtcccactaattggcttcattggaaggttggatccacagaaaggagttgatctcatagctgaagctattccttggttgatgagtcaggatgtgcaattagtcatgttaggctctggaaggcctgatctagaaaacatgcttaggcaatttgaaagccaacaccgtgacaagataaggggatgggttggcttttcagtgaagatggctcacaggataactgcaggctctgacatattgctcatgccatcaaggtttgagccgtgtggattgaaccaactttatgccatgaactatggaacagttcctgttgtacatgctgttggtggactgaaagacacagtgcagccttttgatcctttcagtgagtcaggccttggatggacgtttgaaagtgcagattcaggtaagtcatcacatgcattagggaactgcctattgacctatagggagtataagaagagctgggaaggccttcaaaagagaggaatgacactagatcttagttgggacagtgctgctcagcagtatgaggaggtgcttcttgctgccaaataccaatggtgaactttttgcatttatttccttcaaagcaaacttttcagcatggagctaattcatgttataaccgtgccagcagttaaaattctacaggttatagttagaggcttcatgatggggattggaaagcaaagttttggcgctgaaaggattatgtaattgcaatgctgtggattgcatttgttcagctgctcaattgtacttatgatagtatgcaaatctgattttctataataaggttttacctttatttgtcaaaaaaaaaaa

SEQ ID NO: 4816 - protein, 724 aa, Phaseolus vulgaris
MASSISAQALVLLHSRGNPCLRFRQKNVVVFEHSCIRATGGNSLGTGEDKDDAEGVFLAINEKKNKVLALQKDLLQQVVEIKKLVSSEKSENTLESEVNSTSYELGKKSFTNKSSPQNASTSGNNAVKNQNGIIASPNYVQSSEGSVESPPISTNGGFKEAREEDVKPPLGMASSGIYLNEKLKDKALETNRPDTLSAFANDTEHLSLEVENQVGMSEGETEIPQPLAGTNVMNVILVAAECAPWSKTGGLGDVVGSLPKALARRGHRVMAVTPRYGNYAEAQDTGVRKWYKVDGHDAEVKYFQAYIDGVDFVFIDNPLFHHLERNIYGGSRLDILKRMVLFCKAAVEVPWHIPCGGVCYGDGNLAFIANDWHTALLPVYLKAYYREQGLMKYTRSVLVIHNIAHQGRGPVDDFFFVDLPEHHMDLFKLSDPIGGDHFNIFAAGLKTADRVVTVSHGHAWELKTSEGGWGLHGIIKDNDWKLRGIVNGVDNKEWNPRFDVHLKSDGYTNYSLETLSSGKRQCKTALQRELGLPIREEVPLIGFIGRLDPQKGVDLIAEAIPWLMSQDVQLVMLGSGRPDLENMLRQFESQHRDKIRGWVGFSVKMAHRITAGSDILLMPSRFEPCGLNQLYAMNYGTVPVVHAVGGLKDTVQPFDPFSESGLGWTFESADSGKSSHALGNCLLTYREYKKSWEGLQKRGMTLDLSWDSAAQQYEEVLLAAKYQW

SEQ ID NO: 4817 - DNA, 2444 bp, Phaseolus vulgaris
  CDS (78)..(2015)
cctctttttgttcttttcgcagccacttttcttcttggttcacgatcccttccctcctgcatcagacttctcttctcatggactctctacaactccatgctcttctacatccgcatctatgcgcatcatcatcatcaccatcactaaggcagctgcgtttccctcttccgttaatacgaaattcaagaaatcgcaacttccgattgttttctgctcacaatggcggcgctgcttcgcaagacggtcccttcgcttttgaagaaaaagttgtctcttcccccaaagatgatagaggtctcgtgctggccagagaaaccgacgattttggttatctcgttggctttcgcttgattccggagtcaggtcttgaagagttgatgagtgtgcaacatgcaatagctgaggaagactctagtagcgacttggctaaaaaacctgggattaaggatacaggtgaagaggaagccgagactagagtgtcccacaacattatttttgtgactgctgaagctgcgccatattccaagactggtggtcttgctgatgtttgtggctctttgccaattgctctggcggctcgcgggcaccgtgtgatggttgtcacgcccagatacattcatggtacttctgaggatgctaagtttgctggggcagttgatctggagcaacgcaccaaagtgtcgtgctttggaggtgctcaagaagttggctttttccatgagtatagggaaggggttgattgggtatttgtggaccacccctcgttccatagaccagggaatccgtatggggacaagtttgggacttttggggataatcagtttcggttcactttactttcccatgcagcgtgtgaagcgccattggtgcttccattggggggtttcacttacggagaaaaatgtttattccttgctaatgattggcatgccagcctagttccagtacttttggcagcgaagtatcgtccacatggggtatatagggatgctcgcagtatattagtgatacataatatagcacatcagggagtggaacctgcaattacatacagtagtttggggctgcctacagaatggtatggagcactggaatgggtgttccctacgtgggcaaggacgcatgctcttgacacaggtgaagctgtcaactttctaaaaggtgctgttgttacagctgaccggattgtgacagtaagcaagggctattcctgggagataactacaagtgaaggtggaaatggtctacatgaattattaaatggtcgaaaaagtattctcagtgggatcacaaatggaattgacgtcactgaatgggacccatcatgtgataaacatattgctttcaactactctgctgatgacctttccgggaaggccaaatgcaagtatgctttgcagaaggaattgggtcttccagtgaggtctgattgtccattgattgggttcattggaagactggactaccagaaaggtattgacttgatccgcttggcaatgccagagctcatggaagcggatgttcagtttgtaatgcttgggtcaggaaaccctatttatgaagactggatgagagcaacagagtccgtttatagagataaatttcggggttgggtgggatttaatgttccaatatctcataaaataactgcaggctgtgatatattgttgatgccatctgcgtttgagccctgtggactgaatcagttgtatgcaatgagatatggaactatacccgtagttcatgaaactgggggcctaagagatactgttcataattttagtccatatactgaagacagcaaagctgaaagcactgggtggacgttttctccactaacaaaagagagcatgttaacggctctaagatatgccattcagacatacaatgaacacaagtcttcgtgggagggattgatgctaagaggcatgacaaaagattacacatgggtaaatgcagctactcaatacgagcaaatcattgagtgggcattcatcggcccaccctattgctgaaatgaagattgcataaatgatccacgcaaggatttctccaataccaagctacttagaggattatcatgctcataattaagtcataatagtttccttcaaggaggcagatgtctcacttgtctaagccgtactcctttgatgatatgatattgggtacataaactcagctaggcactctcgaggaattttttacactgattggaactccaatttggaaccacgccaatgtatagtgctgttagaagttttttaccttttttgtttctttaaagggttttagaatgggtcatgtgacacatggaatttgtaccatgtgagagtgtgcgtgtattggcactgttattgcgagtgaccgacatgatttgtaagatgcgtcaatctctgtcttgtgcatgcatctatttggtatcaataaaaaaaaaaaaaaaa

SEQ ID NO: 4818 - protein, 645 aa, Phaseolus vulgaris
MDSLQLHALLHPHLCASSSSPSLRQLRFPLPLIRNSRNRNFRLFSAHNGGAASQDGPFAFEEKVVSSPKDDRGLVLARETDDFGYLVGFRLIPESGLEELMSVQHAIAEEDSSSDLAKKPGIKDTGEEEAETRVSHNIIFVTAEAAPYSKTGGLADVCGSLPIALAARGHRVMVVTPRYIHGTSEDAKFAGAVDLEQRTKVSCFGGAQEVGFFHEYREGVDWVFVDHPSFHRPGNPYGDKFGTFGDNQFRFTLLSHAACEAPLVLPLGGFTYGEKCLFLANDWHASLVPVLLAAKYRPHGVYRDARSILVIHNIAHQGVEPAITYSSLGLPTEWYGALEWVFPTWARTHALDTGEAVNFLKGAVVTADRIVTVSKGYSWEITTSEGGNGLHELLNGRKSILSGITNGIDVTEWDPSCDKHIAFNYSADDLSGKAKCKYALQKELGLPVRSDCPLIGFIGRLDYQKGIDLIRLAMPELMEADVQFVMLGSGNPIYEDWMRATESVYRDKFRGWVGFNVPISHKITAGCDILLMPSAFEPCGLNQLYAMRYGTIPVVHETGGLRDTVHNFSPYTEDSKAESTGWTFSPLTKESMLTALRYAIQTYNEHKSSWEGLMLRGMTKDYTWVNAATQYEQIIEWAFIGPPYC

SEQ ID NO: 4819 - DNA, 1827 bp, Hordeum spontaneum
  CDS (1)..(1827)
atggcggctctggccacgtcccagctcgccacctccggcaccgtcctcggcgtcaccgacaggtcggcgccgtccatgttccggcatgctggttttcagggcctgaggccccggaagcccgcagatgggacgtttggtatgaggactgtcggagcaagcgccgccccgaagcaaagccggaaagcgcaccgcgggaaccggcggtgcctctccgtggtggtgcgtgccacgggcagcggcatgaacctcgtgttcgtcggcgccgagatggcgccctggagcaagaccggcggccttggcgacgtcctcggcggccttccaccagccatggccgccaacggtcaccgggtgatggtcgtctccccgcgctacgatcagtacaaggacgcctgggacaccagcgtcatctccgagatcaaggtcgctgacgagtacgagagggtgaggttcttccactgctacaagcgcggagtggaccgcgtgttcatcgaccacccgtggttcctggagaaggtccggggcaagaccaaggagaagatctacgggcccgacgccggcacggactacgaggacaaccagcagcgcttcagccttctctgccaggcagcgctcgaggcacccaggatcctcaacctcaacaacaacccctacttttctggtccctacggggaagacgtggtgttcgtgtgcaacgactggcacacgggccttctggcctgctacctcaagagcaactaccagtccaatggcatctacaggacggccaaggtggccttctgcatccacaacatctcgtaccagggccgcttctccttcgacgactttgcgcagctcaacctgcccgacaggttcaagtcgtccttcgacttcattgacggctacgacaagcccgtggaggggcgcaagatcaactggatgaaggccgggatcctgcaggccgacaaggtgctgacggtgagcccctactacgctgaggagctcatctctggcgaagccaggggctgcgagctcgacaacatcatgcgcctcacggggatcaccggaatcgtcaacggcatggacgtcagtgagtgggaccccaccaaggacaagttcctcgccgtcaactacgacatcaccaccgcgttggaggccaaggcgctgaacaaggaggcactgcaggccgaggtggggctgccggtggacaggaaggtgccgctggtggccttcatcggcaggctggaggagcagaagggccccgacgtgatgatcgccgccatcccggagatcctgaaggaggaggacgtccagatcattctccttggcaccgggaagaagaagtttgagaagctgctcaagagcatggaggagaagttcccgggcaaggtgagggccgtggtcaggttcaacgcgccgctagctcaccagatgatggccggcgccgacttgctcgctgtcaccagccgcttcgagccctgcggcctcatccagctccagggaatgcgctatggaacgccgtgcgtgtgcgcgtccaccggcgggctcgtcgacacgatcgtggagggcaagaccgggttccacatgggccgcctcagcgtcgactgcaacgtggtggagccggcggacgtgaagaaggtggcgaccaccctgaagcgggccgtcaaggtcgtcggcacgccggcgtaccaggagatggtcaagaactgcatgatccaggatctctcctggaagggacctgccaagaactgggaggacgtgcttctggaactgggggtggaggggagcgagccggggatcgtcggcgaggagatcgcgccgctcgccatggagaacgtcgccgctccctga

SEQ ID NO: 4820 - protein, 608 aa, Hordeum spontaneum
MAALATSQLATSGTVLGVTDRSAPSMFRHAGFQGLRPRKPADGTFGMRTVGASAAPKQSRKAHRGNRRCLSVVVRATGSGMNLVFVGAEMAPWSKTGGLGDVLGGLPPAMAANGHRVMVVSPRYDQYKDAWDTSVISEIKVADEYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKGPAKNWEDVLLELGVEGSEPGIVGEEIAPLAMENVAAP

SEQ ID NO: 4821 - DNA, 1248 bp, Gloeobacter violaceus
  CDS (1)..(1248)
atgtacggacggattgcactgatctctgtgaatggcgacccctcggcggtcatcggcgcagaggaagcaggtggacaaaatgtctatgttcgagaggtcggcaagcatctggcaagtctcggccaccaggtagacatgttcactcgccgtatagatccgtcacaagaagaggtcgtcgaagaagctcccaactgccgcacgatccgcctcgccgccgggcctttggagtttgtgaagcgcgacgacttacacagctatattccccattttgtggaaagcttgacggcctacgcccggcgccactcctacgacgcggtacacacccactattggcattcggggatggtggggctggcactgcgcgagaaattgggtatacccgtggtacacacttaccactccctgggtgccgtcaaatacatgaacgtcgcagagattcccgcctcggcacagctgcgcctgaacggtgagcgccggattctggagcaggcggaccgggtcgtggccaccagccctcaagaggcggagcatatgcgctcttacgtctcgcgcaaaggctcggtggatgtcattccttgcggtgtagacatcggccacttcgtggagaccgatcgggccgaggcgcggcgggtactcggctgggctgagcaggagaaagtggtgctctacgtgggccgcttcgacaagcgcaaggggatcgagaccctggtgcgcgcggtggcccagattgaggaaccggtgcgtctggtcatcggcggcggctatacgcccgatcgcggcgacggcgtcgagttcgagcgcatccgcagtgtagtcgaggaggtgggtctaaccggtcggaccgagtttacgggccgcatcgaccaggcggatctgcccaactattacacggcagcggacgtgtgcgtggtgccaagccactacgaaccgtttggtttggtggccatcgaagcgatggcctgcggcacaccggtgatcgccagcgcggtaggtgggctatgctacagcgtcgtcaacaacgagacgggtctgctggtaccgccgcgcgatgccgagcgcttcgccggggccattcgccgggtgattaccgatgccgggttgcgcgagcggttgtcgctcgccggtgttcgccgcatccatgaccacttcacctgggccggggtgagccgccaactcgggcgcctttatgcgaacctggcggcccgtcgggtttctaatcgcccgcaaaagcagcagtctgtggcctga

SEQ ID NO: 4822 - protein, 415 aa, Gloeobacter violaceus
MYGRIALISVNGDPSAVIGAEEAGGQNVYVREVGKHLASLGHQVDMFTRRIDPSQEEVVEEAPNCRTIRLAAGPLEFVKRDDLHSYIPHFVESLTAYARRHSYDAVHTHYWHSGMVGLALREKLGIPVVHTYHSLGAVKYMNVAEIPASAQLRLNGERRILEQADRVVATSPQEAEHMRSYVSRKGSVDVIPCGVDIGHFVETDRAEARRVLGWAEQEKVVLYVGRFDKRKGIETLVRAVAQIEEPVRLVIGGGYTPDRGDGVEFERIRSVVEEVGLTGRTEFTGRIDQADLPNYYTAADVCVVPSHYEPFGLVAIEAMACGTPVIASAVGGLCYSVVNNETGLLVPPRDAERFAGAIRRVITDAGLRERLSLAGVRRIHDHFTWAGVSRQLGRLYANLAARRVSNRPQKQQSVA

SEQ ID NO: 4823 - DNA, 3219 bp, Oryza sativa
  CDS (1)..(3219)
atggcggcggcggccgtctcctccctcctcgccccttcgggatcctgctactcccccggatgccacagctgctggggtcccgggcccggaggcgggcggcgcctaccttccccgcgccggcgcccgattaccgccgcggctcgccctacttgggcagtgccgaggaggagcaggttggagtgggggcgtgtggaggctcagaattcgggcgctcgcaccagctgccgagcagcactgcaatggctatcatccacggcaaggtcccatgtgaatgttggttatgggtcgccgctggtgttcccagggaatcaagttggtgacgatagtgatgatggaatcaaggttaccaatgagaagcttcgtgctgttatccgcaagagcaaagaggtgttggagatccatcggaatctacttgagaaggtacataaattgaaaatacaagattactatgaacttcccaaaatatcggcatcagaaaggaagaagatcacttcaattatagaggacagttccatttataatgagcaagatccatttggtcaaagagatagttctttttatcatcttgatgaagttccagacgatgatgaatttagctatgacctacagatgtaccttgatagacgtccagatcaatctgaagttgttgcaactcaggattatgaggcacaactaagtcaaataagtgaaatgggacagtcagttgctgagggcactagtgatgatccatctgcttcagctgctgtagatcttatcaatatcatattggtagcggcggagtgtgctccttggtccaaaacaggcaagatcataatagccacataccttctaattttttcagtttccatgaaaggacattgcgggtttaacctagtacctgtgctggtagaagcgtgtgctgcccgcatgaggttgagagcgtccggtcacgcgccgtgttcagggggttttgggttttccgtgggccgtcttaacccaccagttgagtttttattgtttttagtgacctttttagggcatgagctggaccaacgtgggcttggagatgttgctggagctttgccaaaggctttggctaggagaggtcaccgtgtcatggtagtagtgccaatgtataaaaactacgcagaacctcaacagctaggagagccaaggagataccaggttgcagggcaggatatggaggtaatttattatcatgcatacatagatggtgtggattttgttttcattgacaatcctatcttccaccacgttgagaatgacatttatggcggagaccgaacagacatcttaaaacggatggttttgttgtgcaaagcggctatagaggttccatggtatgttccttgtggtggctactgctacggtgatggaaatcttgtgttccttgcaaatgattggcatactgcactactgcctgtttatttgaaggcatactatcatgacaatggtttcatgatatatgcccgttctgttcttgtcatacacaatatagcacatcagggtcgtggcccattagatgacttcagttatctggatttgccagttgattacatggatcttttcaaactttatgacccatttgggggtgatcacctaaacatatttgcagctggtattaaagctgctgaccgtttgcttactgtaagccatggttatgcatgggagctcaaaacagctgaaggtggttggggtcttcatgggatcatcaatgaaagcgattggaaatttcagggcattgtaaatggcattgatacaactgattggaatcctaggtgtgatatccacctaaaatctgatgggtacaccaattattctctagaaacagttcaggcaggtaaacagcaatgtaaggcagcattgcagaaggaacttggtctcccagttcgtggcgatgttcctgtcattgctttcattggacggctagaccatcaaaaaggtgtagaccttatagcagaagcaatgccatggattgctggccaagatgtacagttaataatgttgggcactggacggcaagacctcgaagatacattgaggaggcttgagagccaacattacgatagagttagggggtgggttggtttttccatcaggttggctcatcgaatgacagcaggggctgatatactattgatgccatcaaggtttgagccatgtggattgaatcagctctatgccatgatgtatgggactgtcccagtagtccatgcggtcggtggtcttcgagacaccgttgagcactacaatccctacgaggagtccggacttggttggacttttgaaaaggcagaggcaaacagactgattgatgctctagggcactgcttgaacacgtacaggaactacaggactagttgggagggactccaaaagagagggatgatgcaagatctaagttgggataatgctgctaagctgtatgaggaagtcctcctagctgccaagtatcaatgtttttttgtcagatctgacatcattttcaagaaggcacatgatgaacctacttcccaggtgaatacagcagcggacgatgcctttgttggaaggtggcaaaacacatggaagattcagccgtctgccagcatgcacctctgtcctaaggagaggctccaagccccattgtgcgctctggagaggctccaaaccaccattgttcgcccctggattcctcgactggtccattggcacatgaaagaaaaggagattgcaagtatgcaacgaccgtgtgggtatcagcgtgtgcaatgctcgcaagctcgcatgaggtggccgcaagcctgcgacgccggatgcttagccccaaggagagacggtgacatacaagggtacaagaaggagcacatcaaggtgcagctggtccgcagccggcggcggctggtcgtgagcggcgagtgccccgtcgccggcgagaccaaccggtggagccgcttccggctgcagttcccggtgcccgacggctgcgacctcaaggccatccaggcgaggctccacgacggcgtcatccgcgtcaccctgcccggcgtcaagccgcagcagcagccgccgcccgccaagacggccgccgccgccgcggtagtaggaggggatcagcggggcggcggcgaacgatgccaattcctccgggagcggggaaagctcgcgaccaccctgctcggcgtggtgctcgtcttgtttagcttcgtcatctacatcaggtacagcgtgaagccatga

SEQ ID NO: 4824 - protein, 1072 aa, Oryza sativa
MAAAAVSSLLAPSGSCYSPGCHSCWGPGPGGGRRLPSPRRRPITAAARPTWAVPRRSRLEWGRVEAQNSGARTSCRAALQWLSSTARSHVNVGYGSPLVFPGNQVGDDSDDGIKVTNEKLRAVIRKSKEVLEIHRNLLEKVHKLKIQDYYELPKISASERKKITSIIEDSSIYNEQDPFGQRDSSFYHLDEVPDDDEFSYDLQMYLDRRPDQSEVVATQDYEAQLSQISEMGQSVAEGTSDDPSASAAVDLINIILVAAECAPWSKTGKIIIATYLLIFSVSMKGHCGFNLVPVLVEACAARMRLRASGHAPCSGGFGFSVGRLNPPVEFLLFLVTFLGHELDQRGLGDVAGALPKALARRGHRVMVVVPMYKNYAEPQQLGEPRRYQVAGQDMEVIYYHAYIDGVDFVFIDNPIFHHVENDIYGGDRTDILKRMVLLCKAAIEVPWYVPCGGYCYGDGNLVFLANDWHTALLPVYLKAYYHDNGFMIYARSVLVIHNIAHQGRGPLDDFSYLDLPVDYMDLFKLYDPFGGDHLNIFAAGIKAADRLLTVSHGYAWELKTAEGGWGLHGIINESDWKFQGIVNGIDTTDWNPRCDIHLKSDGYTNYSLETVQAGKQQCKAALQKELGLPVRGDVPVIAFIGRLDHQKGVDLIAEAMPWIAGQDVQLIMLGTGRQDLEDTLRRLESQHYDRVRGWVGFSIRLAHRMTAGADILLMPSRFEPCGLNQLYAMMYGTVPVVHAVGGLRDTVEHYNPYEESGLGWTFEKAEANRLIDALGHCLNTYRNYRTSWEGLQKRGMMQDLSWDNAAKLYEEVLLAAKYQCFFVRSDIIFKKAHDEPTSQVNTAADDAFVGRWQNTWKIQPSASMHLCPKERLQAPLCALERLQTTIVRPWIPRLVHWHMKEKEIASMQRPCGYQRVQCSQARMRWPQACDAGCLAPRRDGDIQGYKKEHIKVQLVRSRRRLVVSGECPVAGETNRWSRFRLQFPVPDGCDLKAIQARLHDGVIRVTLPGVKPQQQPPPAKTAAAAAVVGGDQRGGGERCQFLRERGKLATTLLGVVLVLFSFVIYIRYSVKP

SEQ ID NO: 4825 - DNA, 2547 bp, Oryza sativa
  CDS (97)..(2022)
tctctccaccaccaccaccaccaccaccaccaccgcccgccaagcgcggcccgcccgacacagcagcagcaggatcggcggagaggaggggggatcatggcgacggcggcggggatggggatcggggcggcgtgcctggtggcgccgcaggtgaggccggggaggaggttgcggctccagcgggtgcggaggcggtgcgtggcggagctgagcagggacggtgggtcggcgcagcgcccgctggcaccggcgccgctggtgaagcagccggtcctgccgaccttcctcgtgccgacgtcgacgccacccgcgcccacgcagtcgccggcgccggcgccgaccccgccgccgttgccggactccggcgtgggggagatcgagcccgatctagaaggtctcacagaagattccatcgacaaaacaatttttgtggctagtgagcaggagtctgagatcatggatgtgaaggagcaagctcaagctaaagtaacacgcagcgttgtctttgtaaccggtgaagcttctccttatgcaaagtcaggtggactaggagatgtttgtggttcactgccaattgctcttgctcttcgtggtcatcgtgtgatggttgtaatgccgagatacatgaacggggccttgaacaaaaattttgcaaacgcattttacactgagaagcacattaagattccatgctttggcggagaacatgaagttactttttttcacgagtatagggattctgttgattgggtgtttgttgatcatccctcatatcatagacctggaaatttgtatggagataattttggtgcttttggcgataatcagttcagatacacactcctgtgctatgcggcgtgtgaagccccattaattcttgaactgggaggatatatctatggacagaaatgcatgtttgttgtgaatgattggcatgccagtcttgtgccagtccttcttgctgcaaaatatagaccatatggtgtttacagggatgcccgcagtgttcttgtcatacataatctagcacatcagggtgtggagcctgccagtacatatcctgacctgggattgccacctgaatggtatggagcattagaatgggtgtttccagagtgggcaaggcggcatgcccttgacaagggtgaggcagtcaattttttaaaaggcgcagttgtgacagcagatcgaattgtgactgtcagccaggggtattcatgggaggtcacaactgctgaaggtgggcaaggcctcaatgagctcttaagctcccggaagagtgtattgaatggaattgtaaatggaattgacattaatgattggaacccatccacagacaagtttctcccttatcattattctgttgatgacctgtccggaaaggccaagtgtaaagctgaattgcaggaggagctgggtttacctataaggcccgatgtgcctctgattggctttattggaagattggactatcaaaaaggcattgatctaattaaacttgccattccagatctcatgcgggacaatattcaattcgtcatgcttggatctggtgacccaggttttgaaggatggatgagatccacagaatcagggtacagggataaatttcgtggatgggttggatttagtgttccagtttcccaccgaataactgcaggttgcgatatattgttgatgccatccagattcgaaccttgtggcctcaatcagctatatgctatgcaatatggtacagtgcctgttgttcatggaactggaggcctcagagatacagtggagaattttaacccgtttgctgagaaaggagagcagggtacagggtgggcattctcgccactaaccattgaaaaaatgctgtgggcattgcggatggcaatttcgacatacagggaacacaagtcctcttgggagggtctaatgaagcgaggcatgtcaagcgactttacatgggaccatgccgcctcacagtatgaacagatcttcgaatgggccttcatggatcaaccatatgtcatgtaaatggatttgaaggaagcagcgaatttctccgaggaccctcaatcttcctgtctttcatgagcggaatgaaaactttgtacactacatggaaagggaaccagttatgcaaagttgcaaacgatcactcaaggttacccttgtaggcctgctacttggccaatatggttccagtgaccatatgcagagtcaggttcagatgaatggcacttgtgagtagtgaagaataagatgaggatgcttgaagcggtttcacatgtggctgataccacgcaagcaacctctcaatgcatcgaaatgtgagtcttggaatcaataggatttagctcccatcaattacagttgtacccttttttgcttaatactttgtcgcctgtgctgttcttatatttgtgtgaagataaattttagtccattaggtaactgtattgttgagtcttaaggtgaagactaaatagtgtttggaagctgtagctactgcgatgtcaagtgtcaaaagagatcttggaaatcaaaaaaaaaaaaaaa

SEQ ID NO: 4826 - protein, 641 aa, Oryza sativa
MATAAGMGIGAACLVAPQVRPGRRLRLQRVRRRCVAELSRDGGSAQRPLAPAPLVKQPVLPTFLVPTSTPPAPTQSPAPAPTPPPLPDSGVGEIEPDLEGLTEDSIDKTIFVASEQESEIMDVKEQAQAKVTRSVVFVTGEASPYAKSGGLGDVCGSLPIALALRGHRVMVVMPRYMNGALNKNFANAFYTEKHIKIPCFGGEHEVTFFHEYRDSVDWVFVDHPSYHRPGNLYGDNFGAFGDNQFRYTLLCYAACEAPLILELGGYIYGQKCMFVVNDWHASLVPVLLAAKYRPYGVYRDARSVLVIHNLAHQGVEPASTYPDLGLPPEWYGALEWVFPEWARRHALDKGEAVNFLKGAVVTADRIVTVSQGYSWEVTTAEGGQGLNELLSSRKSVLNGIVNGIDINDWNPSTDKFLPYHYSVDDLSGKAKCKAELQEELGLPIRPDVPLIGFIGRLDYQKGIDLIKLAIPDLMRDNIQFVMLGSGDPGFEGWMRSTESGYRDKFRGWVGFSVPVSHRITAGCDILLMPSRFEPCGLNQLYAMQYGTVPVVHGTGGLRDTVENFNPFAEKGEQGTGWAFSPLTIEKMLWALRMAISTYREHKSSWEGLMKRGMSSDFTWDHAASQYEQIFEWAFMDQPYVM

SEQ ID NO: 4827 - DNA, 1242 bp, Streptomyces avermitilis
  CDS (1)..(1242)
atgtaccagccagcaaccgccccttcgccgcgcgtcctccacgtcacccagccggtggacggcggcgtcgcccgcgtggtcaccgagctggtgcgtgcgcagcgtgcggccggtttcgacgtcacggtcgcgtgtcccggccacggcctcgcccaggcagtacgggaactcggcgcaggcgtacggcactggtccgccacgcgggcgccgggaccgtcgctccccggtgaggtgcgccggctcgctcgcctcgtcgaggaggtccggcccgacgtgctgcacgcccacagcgccaaggccggtctcgccgcccggctggcggtacgggggcggatcccgacggtgttccagccgcacgcctggtcgttcgaggcggtcggcggggtcacggcggcggtcgccacggcgtgggagcggtggggggcgcggtgggccgcccgcgtggtgtgcgtcagcgaggcggagcgcgcgcgaggcgtacgcgccggggtacgcgcccactggcgggtgatccccaacggcatcgacccggggcgcttccaccccgccgccgtcaccaccgtacgagccgccctcgcaccgctcgccggcctcgatccggccgctccgctggtggtctgcgtgggacggctgtgccggcagaaggggcaggacgtgctgctcgaggcgtggtcctcggtgcggcggcgggtgcccggggcccggctggcgctcgtcggggacgggccacaggagcggccactgcgtcacctcgcgcccgagggcgtgctgttcgccggggccgtcgccgatgccgtcccctggtaccaggccgccgacctggtggtgctgccgtcccgctgggagggcatggcgctggccccgctggaggcgatggcgtgcaggcgtcccgtggtggtcacggacgtggccggggcgcgcgagagtctgccgcccggccaccgggagcactgtctggtgcccgccggccggccgggcccgctggccgacgcgctcaccagggcgctgctcgatccgctgctgcgcgaatcgctcggccaccaggggcgccgccacgtactgaccgcgcacgacgtgcggcactcggccgaggcggtcgcggccctctaccgcgaactcctcggcaccgggcgcacttcggccgaccccgcggaacacgccgagtgcgccgaccccgcggaacacacccagtgcgccgacctcgcggaacacaccgagtgcagggagtccatccgctcgtga

SEQ ID NO: 4828 - protein, 413 aa, Streptomyces avermitilis
MYQPATAPSPRVLHVTQPVDGGVARVVTELVRAQRAAGFDVTVACPGHGLAQAVRELGAGVRHWSATRAPGPSLPGEVRRLARLVEEVRPDVLHAHSAKAGLAARLAVRGRIPTVFQPHAWSFEAVGGVTAAVATAWERWGARWAARVVCVSEAERARGVRAGVRAHWRVIPNGIDPGRFHPAAVTTVRAALAPLAGLDPAAPLVVCVGRLCRQKGQDVLLEAWSSVRRRVPGARLALVGDGPQERPLRHLAPEGVLFAGAVADAVPWYQAADLVVLPSRWEGMALAPLEAMACRRPVVVTDVAGARESLPPGHREHCLVPAGRPGPLADALTRALLDPLLRESLGHQGRRHVLTAHDVRHSAEAVAALYRELLGTGRTSADPAEHAECADPAEHTQCADLAEHTECRESIRS

SEQ ID NO: 4829 - DNA, 2208 bp, Phaseolus vulgaris
  CDS (144)..(1991)
aagcaattcaagaatttaatgataatttttcattccaatgctttatacttctgattaaccttgcaacttggtctttcaaatctcacaaacttcaatcagttctctctcccaaactgtgtgtgcttcattgcctggtaccaaaaatggcaactttgactgcttcaagtaacttggtctctggaagttctcatgtccaccatggaccaactgcatcatatgagtctaaagcagtgacaatggggcttaaatctctaaagcagaccaatactcataatggactgagaattttgaacccggtggatgagctaagaaacaggaccccagttaaaatcaactcaaaagctacgaggaagggacttcaaggcaagaatgtcaagcctaaaggtgaaatcatatgtggcatgaaattgatttttgttggaatggaggtgggtccatggagcaaaactggtgggttaggagatgttcttgggggtcttccaccagcattagcagcttatggacatcgagttatgactatcgcgccacgttacgaccaatacaaagatgcctgggatacaagtgttgtagttgagctgaaagtaggggacagaactgaaaaggttcgctacttccattgctacaagaggggagttgatcgtgtctttgtggatcaccctttgtttctttcaaaggtctgggggaaaaccggaaccaaactttatggactaactacaggagatgattatgaagacaaccaactacgttttagtctattttgccaggcagctttggaagcaccaagggttctgaatctcaattccagtaaatatttctctggaccatatggtgaagatgtaattttcatcgccaacgattggcacaccgcccttctcccctgctacttgaaaactatgtaccagtcagtaggcatctttaagaatgctcgagttgttttatgtatccacaacattgcttaccaaggaagatttgcattcacagactatgcacttctaaatctccctgaccaatttaaaagctcctttgactttattgatgggcatgttaaaccagtgattggaaggaaaatcaattggatgaaagctggaattttagaatcatggtttgtgataactgttagtccaaactatgctaaagaactattgtcaggtccagataaaggagtggaactggacaacatccttcgcaaaaatgaagatcgtttaattggaattgtgaatggcatggatgttcaggagtggaatccatccactgacaagtatatagccgtcaaatacgatgcttcaacagttttggaagcaaaggctcttttgaaagaagccctccaagcagaagttggattgccagtggacagaaatattcctctcattggtttcattggtaggcttgaagagcaaaaaggttctgatattcttgcagaagccattccacaatttatcgaggagaatgttcagttggtagccctaggaacaggaaaaaaacaaatggaaaaacagcttcaggaacttgaaatatcataccctgacaaggccagaggagtggcaaaattcaatgttcccctagcccacatgataattgctggtgctgattttatattggttcctagcagatttgagccttgtggtctcattcagttgcaagctatgcgctatggatcagtacctattgtttcctcaaccggtggattagttgatactgtcgaagaaggcttcactggatttcagatgggttccttcaatgttgaatgtgaagctgtggatgctgctgatgttgatgctatagcaaagactatcaaaagggcccttgcactctacggaactccagctttcacagaaatgatcaagaattgcatggctcaagatctttcatggaagggacctgctaagaagtgggaggacgtgctgctaagcttggaagtacctggcagtgaacctggaattgatggagaagaaattgctccacaggcaaaggaaaatgtggcaactccataataagagcatatatgtgaaggaagcctcttttagtagtctcatgaagttcccttagctccttacttcttattgtgcttctatcctacttccattttttgttttcttcaaaatatatcatagaaattaatgtacatggacacggtgattacactgttagaatcagtgttttcaaccctatttataagagtatgtcttcaagattgaaaaaaaaaaaaaa

SEQ ID NO: 4830 - protein, 615 aa, Phaseolus vulgaris
MATLTASSNLVSGSSHVHHGPTASYESKAVTMGLKSLKQTNTHNGLRILNPVDELRNRTPVKINSKATRKGLQGKNVKPKGEIICGMKLIFVGMEVGPWSKTGGLGDVLGGLPPALAAYGHRVMTIAPRYDQYKDAWDTSVVVELKVGDRTEKVRYFHCYKRGVDRVFVDHPLFLSKVWGKTGTKLYGLTTGDDYEDNQLRFSLFCQAALEAPRVLNLNSSKYFSGPYGEDVIFIANDWHTALLPCYLKTMYQSVGIFKNARVVLCIHNIAYQGRFAFTDYALLNLPDQFKSSFDFIDGHVKPVIGRKINWMKAGILESWFVITVSPNYAKELLSGPDKGVELDNILRKNEDRLIGIVNGMDVQEWNPSTDKYIAVKYDASTVLEAKALLKEALQAEVGLPVDRNIPLIGFIGRLEEQKGSDILAEAIPQFIEENVQLVALGTGKKQMEKQLQELEISYPDKARGVAKFNVPLAHMIIAGADFILVPSRFEPCGLIQLQAMRYGSVPIVSSTGGLVDTVEEGFTGFQMGSFNVECEAVDAADVDAIAKTIKRALALYGTPAFTEMIKNCMAQDLSWKGPAKKWEDVLLSLEVPGSEPGIDGEEIAPQAKENVATP

SEQ ID NO: 4831 - DNA, 2748 bp, Oryza sativa
  CDS (1)..(2748)
atggcgtgcttggcggcgggcgccgaggcggcccctctcctcttccggcggcggctagcgccgtccccagtcgccgcgcgccgccgccttctcgtgtcgtgccgagctcgccgccgcggtctcaggactgctgcagaacttcctcggaagagtacaagtaatgataaacaccataatagggtgaatatgcagagagatgaagcatctgtttccagtgataaagaacggcaagagaaatatggagatgaaaatggtatatcaaaccttcaattggaagatttgatacaaatgatacaaaacactgagaagaatataatgcttctgaatcaagctcgtcttcaagcattggaacatgttgaaacagttcttaaagaaaaagaagacttacagaggaagttgaaaattttggagacgagattgtcagaaacagatgcacggcttaagctttcagctgaagggcagttcggtactgagattaatgactctctaccagtactggaattagatgatataaaggaagagaatatgctactgaaggatgacatacaatttctgaaaacaatgcttattgaggttgctgagacagagaacagtatattcacattagagaaggagcgtgctcttttagatgcttcgcttagggagctggagtctagatttatagatgcccaagcagatatgttgaagtctgatcctaggcagtatgatgcatggtgggagaaagtagaaaatttgggggacttgcttgagactgcaacaaacaaagtagagaatgctgctatggttctgggacgcaatcatgatttggaagataaggtcgacaaactagaggcatcgttggctgaagcaaatatatcaaagttctcttgttattttgttgatcttttgcaggaaaagataaaatcagtagaagagcgcttccaagtatgtaatcatgaaatgcattctcaaattgaactctatgagaattcaatagcggaatttcacgatattcttagcaagctagtggaggaaactgagaaacgatcactagagcattcagcaagtagcatgccttcagaattgtggagtaggatatctcttctgattgatggttggttgctcgagaagagaatatcctacaatgatgcaaatacattacgggaaatggtcaggaaaagggatagttgtcttcgggaagcatacttgtcatgcagaggtatgaaagatagggaaattgtggacaattttctaaagatcacattgccagggactagttctggcttgcacatcatccacatagcagcagagatggctcctgttgcaaaggttggtggtttggcggatgtgatatctggtcttggcaaggcacttcagaaaaagggccacctagtagagattattcttccaaaatatgactgcatgcagaatgaccaagttaataaccttaaggttttagatgttgttgtacaatcctactttgaaggaaatttgttcaacaacaaaatatggactgggactgttgaaggccttccagtctattttatcgagccacaacatccagcaaaattcttttggagggcacaatactatggagaacacgatgactttaaacgttttgcatacttcagccgtgcagcactggaattactttaccaatcgcagaagaaaattgacatcatccattgccatgactggcagactgcatttgtggcacctctttattgggaagcatatgcaaatctgggcttcaactcagctagaatttgcttcacctgccataattttgaatatcaaggagctgctcctgctcaagatttagcatgctgtggccttgatgttcagcaacttgatagggaagacaggatgcgggacaattcacatggcagaataaatgttgtcaagggtgcaattgtgtattccaacattgtgacaactgtatcaccaacatatgcactagaggtgcgatcagagggtggacgtggactacaagattcactcaaattacattccaggaaatttgttgggatacttaatggaatcgacacagacacatggaatccttcaacagatagacatctcaaggttcaatataatgctaatgatctccagggtaaggcagcaaacaaagcagctctcagaaagcagctaaacttatcttctacaaatgcttctcaaccactggttgggtgtattacaaggctagttcctcaaaagggtgtacatctcatcaggcatgcaatatacaaaacagctgagctaggaggacagtttgttcttctgggctcaagtccagtaccacacattcaaagagagtttgagggtattgcagaccattttcagaacaataacaatatccgactgcttttgaagtatgatgattctttatcccattggatttatgcagcatctgacatgttcattgttccatccatgtttgagccatgtggcctcacacagatgattgccatgagatatggttctgtgccgattgttcggaaaaccggtggattgaatgacagtgtcttcgatttcgacgacgaaacgatacctaaggagctgcggaatggctttacgtttgtgcatcctgatgaaaaggctctaagtggtgcaatggagagagcgttcaactactacaatagaaagcctgaggtctggaaacagctggtgcagaaggacatgaggatagatttcagctgggcctcttcagcttcccagtacgaagatatctatcaaagagcagtggctcgagcgagggcagcagcatga

SEQ ID NO: 4832 - protein, 915 aa, Oryza sativa
MACLAAGAEAAPLLFRRRLAPSPVAARRRLLVSCRARRRGLRTAAELPRKSTSNDKHHNRVNMQRDEASVSSDKERQEKYGDENGISNLQLEDLIQMIQNTEKNIMLLNQARLQALEHVETVLKEKEDLQRKLKILETRLSETDARLKLSAEGQFGTEINDSLPVLELDDIKEENMLLKDDIQFLKTMLIEVAETENSIFTLEKERALLDASLRELESRFIDAQADMLKSDPRQYDAWWEKVENLGDLLETATNKVENAAMVLGRNHDLEDKVDKLEASLAEANISKFSCYFVDLLQEKIKSVEERFQVCNHEMHSQIELYENSIAEFHDILSKLVEETEKRSLEHSASSMPSELWSRISLLIDGWLLEKRISYNDANTLREMVRKRDSCLREAYLSCRGMKDREIVDNFLKITLPGTSSGLHIIHIAAEMAPVAKVGGLADVISGLGKALQKKGHLVEIILPKYDCMQNDQVNNLKVLDVVVQSYFEGNLFNNKIWTGTVEGLPVYFIEPQHPAKFFWRAQYYGEHDDFKRFAYFSRAALELLYQSQKKIDIIHCHDWQTAFVAPLYWEAYANLGFNSARICFTCHNFEYQGAAPAQDLACCGLDVQQLDREDRMRDNSHGRINVVKGAIVYSNIVTTVSPTYALEVRSEGGRGLQDSLKLHSRKFVGILNGIDTDTWNPSTDRHLKVQYNANDLQGKAANKAALRKQLNLSSTNASQPLVGCITRLVPQKGVHLIRHAIYKTAELGGQFVLLGSSPVPHIQREFEGIADHFQNNNNIRLLLKYDDSLSHWIYAASDMFIVPSMFEPCGLTQMIAMRYGSVPIVRKTGGLNDSVFDFDDETIPKELRNGFTFVHPDEKALSGAMERAFNYYNRKPEVWKQLVQKDMRIDFSWASSASQYEDIYQRAVARARAAA

SEQ ID NO: 4833 - DNA, 1605 bp, Shewanella oneidensis
  CDS (1)..(1605)
atgaaacgcatattaatggttgcagccgaaaatggggcactcaaaggggcaaaagtgggggggatggcggatgtgatccgcgatttaccccaagctctcgcgggcgttgggatccaagccgatgtcattatgccaagctacggctttttaaccgcccaaggtgctaagcaaattggtgagtttgatgtgagctttgccgggcgacatgagcttataaagctatattggctggcgcatcctctggtaccaggcgccaatatttacttgctcgagcatgggctttggcaatcgatccccgggcaaatttacagccaaggcactaaggatcgcccctttgccgatgatgcgactaagtttgccttcctgtgtgtaagcgttgccaaagctttagtgactgggcttgtgcccatgccgcagctgctgcatctgcatgactggcatacgggatgtttagccatgctgcgggcattagcgcctgaatatcaggcattgcaagccattgaatgtgtgttttcaattcacaatctggcgttacaggggattaggccgctcggccatgatgcatcctctttcgcggcttggtttcctagcctgtttgcccacttggatgtgactcaactcgcggacattattgatccccgttatccccattgtattaacccgatgcggatgggtattcgactcgccgatagggtgcatttagtctcacccacttatgccaaggaagtgctattaccctcgcaacccgagcgaggttttttcggtggcgaagggcttgaggccgatttgcaacataaagctgaccaaggtcgggtgttggggattttaaatggttgtgattatccccaagcgttgacgaaaaagtctttcaagcgaatgggattagctgagtttacggccttactgagtgatattgagtcggctttagtacagtggcaggcgactcaaagtcaggttcgtggcgtcgatatgatcgcttttactcggctgcaagcgctttggcgtcaagcatcattggaggcgtttccagcctttttgctgacctccgttgggcgtcttactgaccaaaaggtgttgatcttacgccatattctaccttcagggttatctgtgttggagacgctgctgttacagttacagcaaacgcagcctaacgcgctgtttgtgctgcttggcagtggtgacccagagataggacaattttttcaaacccttgcggctaagtatgctcattttgtatttttacagggctaccacgaagcactctcgcaatgtctttaccaatatggggacttattgcttatgccgagttcctttgagccctgcggtatcagccaaatgctcgccatgcgtagcggtcaaccctgcctagtgcatggcgttggcggattacaggatacggtcgaggatggtgtcgatggctttgtcttttatggcgaagatatcaaaagtcagggcgaggctttgctggcgaagctggccgaagcactagagaaatttgacagtagtgattggacgcaactaaagcgtaaggcaaaagcacggcgttttgattggcgtagcatcgcccttgattacaagaaacaactttataacattttgtga

SEQ ID NO: 4834 - protein, 534 aa, Shewanella oneidensis
MKRILMVAAENGALKGAKVGGMADVIRDLPQALAGVGIQADVIMPSYGFLTAQGAKQIGEFDVSFAGRHELIKLYWLAHPLVPGANIYLLEHGLWQSIPGQIYSQGTKDRPFADDATKFAFLCVSVAKALVTGLVPMPQLLHLHDWHTGCLAMLRALAPEYQALQAIECVFSIHNLALQGIRPLGHDASSFAAWFPSLFAHLDVTQLADIIDPRYPHCINPMRMGIRLADRVHLVSPTYAKEVLLPSQPERGFFGGEGLEADLQHKADQGRVLGILNGCDYPQALTKKSFKRMGLAEFTALLSDIESALVQWQATQSQVRGVDMIAFTRLQALWRQASLEAFPAFLLTSVGRLTDQKVLILRHILPSGLSVLETLLLQLQQTQPNALFVLLGSGDPEIGQFFQTLAAKYAHFVFLQGYHEALSQCLYQYGDLLLMPSSFEPCGISQMLAMRSGQPCLVHGVGGLQDTVEDGVDGFVFYGEDIKSQGEALLAKLAEALEKFDSSDWTQLKRKAKARRFDWRSIALDYKKQLYNIL

SEQ ID NO: 4835 - DNA, 1173 bp, Corynebacterium efficiens
  CDS (1)..(1173)
atgaaagttggaatgatgaccagagaatatccgccggaggtctacggcggagcaggtgtccacgtaaccgagctgacccggttcatgcgggagatcgcggaggtggatgtccattgcatgggcgccccacgtgacgccgagggggtctacgtccacggcgtggacccggccctggacaatgccaacccggccatcaagaccctgtccaccggtctgcgcatggcagaggccgccaacaatgtggatgtggttcactcccacacctggtacgcgggtctgggtggtcatctcgccgcacgtctgcacggcatcccccatgtggccaccgcccactcactggaaccggaccgcccgtggaagcgtgagcagctcggtggtggatacgatgtgtcctcctggtcagagaagaacaccatggagtacgccgatgccgtcatcgcggtgtccgcacgcatgaaggattccatcctcgccgcctacccccgcatcgaacctgacaatgtccgcatcgtgctcaacggcatcgacaccgaactgtggcagccccgccccaccttcgatgacgcggaggaatccgtgttgcgcaagctcggtgtggatccccagcgacccatcgtggcgttcgtcggtcgcatcacccgccagaagggtgtggagcatttggtcaaggccgccgcccacttcgatgagggtgtacagctggtgctgtgtgcaggcgcaccggacaccccggagatcgcggaacgcaccagggctctcgtggaggcgctgcagtcccagcgcgacgggatcttctgggtccaggagatgctggacaagaagggcatccaggagatcctcaccgcagccgacacctttgtctgcccctcaatctacgagccgctgggcatcgtcaacctcgaggccatggcctgcaacaccgccgtggtcgcctccgacgtgggcggtatcccggaggtcgtggtcgatggtgagaccggcaccctggtccactacgacgagaatgacaccgaaaccttcgagcgtgacatcgccgaggccgtgaacaagatggtcgcggaccgtgaggtggcgaagaagttcggtatcgccgggcgtgagcgtgccatcaacgagttctcctgggccaccatcgcccagcagaccgtcgatgtctacaaatcactgatgtag

SEQ ID NO: 4836 - protein, 390 aa, Corynebacterium efficiens
MKVGMMTREYPPEVYGGAGVHVTELTRFMREIAEVDVHCMGAPRDAEGVYVHGVDPALDNANPAIKTLSTGLRMAEAANNVDVVHSHTWYAGLGGHLAARLHGIPHVATAHSLEPDRPWKREQLGGGYDVSSWSEKNTMEYADAVIAVSARMKDSILAAYPRIEPDNVRIVLNGIDTELWQPRPTFDDAEESVLRKLGVDPQRPIVAFVGRITRQKGVEHLVKAAAHFDEGVQLVLCAGAPDTPEIAERTRALVEALQSQRDGIFWVQEMLDKKGIQEILTAADTFVCPSIYEPLGIVNLEAMACNTAVVASDVGGIPEVVVDGETGTLVHYDENDTETFERDIAEAVNKMVADREVAKKFGIAGRERAINEFSWATIAQQTVDVYKSLM

SEQ ID NO: 4837 - DNA, 2340 bp, Colocasia esculenta
  CDS (155)..(2086)
gatcgcaaaggcagacatcacacctccacacgcgcacgttggtcggttccagaaggcggaagcaactgctctccgctcctgcctcccttttatccccgctcctctggatctccccatcttccatctctctctctctctctctctctctccgatcatggaggttctacgggtagcacgccccgcattggccgccagcagcgcccccggatcgcggccactgcgtggggctccacgccgcccgccgcctggagcttggcgggccgccggctccgccccgcgtctgcgccggcggctcggggatctccctctgacgttctgcgctgcggagaagagggaggaggtgttgcctccggctttcgaggagaaggatgtgtcagaggtgttgctccccgcggaggcgcctgggagtggtccttgctttgatgaggcgccggaggtcctcggggcggaaggaagtaaagggagaatgagatccagtactattgcagctactgttagtggagagaagcatgagaatgttggtgaggagaagcaatctcgacctgtgataagaaataacattatttttgtcactgcagaagctgctccttactccaagactggaggtctgggagatgtatgtggttctttgcctattgcccttgctgcccgtggtcatcgtgtcatggtcgtctcaccaaggtatttagatggtgtatcagatgagaaatttgcaaatgcagttgatactgggcgccgcatcaagatttcatgctttggaggacagcaagaagttgctttttttcaagagtatagggctggtgtagattgggtgtttgttgatcatctctcgtatcacagaccagggaacccttatggtgatgtatatggtgcgtatggtgataatcagtttcggttcacactgctctgccatgcagcatgtgaggctccactggtgcttccactgggaggatttacctacggagataagtgcttgttccttgccaatgattggcatgcagccctggtgccagtccttctgagtgcaaaataccgcccaaatggtgtttacaaagatggtcgctgcattcttgtcattcataaccttgcacatcagggcgtggagccagagacgacttatccgttcctaggattgccatccgagtggtatgggtctgttgagtgggtctttcctacttgggcaaggacacatgctcttgatccaggcaagtctgtcaatcttctgaaaggagcagtagtcacagtagatcgcatagtcacagttagtcagggttactcttgggagataacaacccctgagggaggatatggtctccatgaactcttaaatagcagaaagagtgtactcaatggaattactaatggcattgatgttggtgactgggatccagcctcggaccagcacatacaatttcattattctgtcaatgacctatctgggaaggtcaaatgcaaaatggctttgcaggaggaatttggccttgatgttcgtcctgattgcccattgattggtttcattggaaggctagatatgcagaaagggactgatttgatcatgatggcaatgccggagcttatgaaagaagatattcaatttgttatgcttggttctggagatgcaggtacagaacaatggatgagaactgcagaatctatttatagagacaagttccgtggatgggttgggtttaatgttgctatttctcatcggataactgctgggtgtgacatactgttaatgccatcaaggtttgaaccttgtggtcttaatcaattgtatgctatgagatatggaactgttccagttgtccatgccactggtggccttaaggatacggttgagaatttcaatccatatgctaatgaaaggagtggtaagggaacagggtgggctttttctcctttatcaaaggatagcatgctgaaggcattgaacttggcaattcggacatacagggatttcaagccctcatgggaaggactcatgaaacgagggatgtcaaaagatttcacatgggacaacgccgctgctcaatatgagcaagtgttcgggtgggccttcatagatcctccttatgtcagatgatgcccagacaaacccctgtcggccagattctttccctgatttcttccccacgttccagttttgcagtagctaacacatacttttcgtcttctcactgttcaaatgtcaagggtggtccaaagggcagcaggaactttggtgaaatgtctctgtcaccttccttccggacattggaaaccaataaagcccctgcataagcaatgacgttgtacagtggacatttcaatatttagttctattctttgtgtaatgcc

SEQ ID NO: 4838 - protein, 643 aa, Colocasia esculenta
MEVLRVARPALAASSAPGSRPLRGAPRRPPPGAWRAAGSAPRLRRRLGDLPLTFCAAEKREEVLPPAFEEKDVSEVLLPAEAPGSGPCFDEAPEVLGAEGSKGRMRSSTIAATVSGEKHENVGEEKQSRPVIRNNIIFVTAEAAPYSKTGGLGDVCGSLPIALAARGHRVMVVSPRYLDGVSDEKFANAVDTGRRIKISCFGGQQEVAFFQEYRAGVDWVFVDHLSYHRPGNPYGDVYGAYGDNQFRFTLLCHAACEAPLVLPLGGFTYGDKCLFLANDWHAALVPVLLSAKYRPNGVYKDGRCILVIHNLAHQGVEPETTYPFLGLPSEWYGSVEWVFPTWARTHALDPGKSVNLLKGAVVTVDRIVTVSQGYSWEITTPEGGYGLHELLNSRKSVLNGITNGIDVGDWDPASDQHIQFHYSVNDLSGKVKCKMALQEEFGLDVRPDCPLIGFIGRLDMQKGTDLIMMAMPELMKEDIQFVMLGSGDAGTEQWMRTAESIYRDKFRGWVGFNVAISHRITAGCDILLMPSRFEPCGLNQLYAMRYGTVPVVHATGGLKDTVENFNPYANERSGKGTGWAFSPLSKDSMLKALNLAIRTYRDFKPSWEGLMKRGMSKDFTWDNAAAQYEQVFGWAFIDPPYVR

SEQ ID NO: 4839 - DNA, 2409 bp, Hordeum vulgare
  CDS (1)..(2409)
atgtcgtcggcggtcgcgtcccccgcgtccttcctcgcgctcgcgtccgcctcgcccgggagatcatcacggaggagggcgagggtgggcgcgtcgccaacccgcgctggggccggcaggctgcaatggcggccgtcgccgctgcagcgcacggctcgcgacggagcggtggccgcgcgcgccgccgggatcgacgacgccgcgcccggtaggcagccccgcgctcgccgctatggcgccgccaccaaggtcgcggatcccgtcaagacgctcgatcgcgacgccgcggaaggtggtgggccgtccccgccggcaccgaggcaggacgccgcccgtctgccgagtaagaacggcacgctgatcaacggtgagaacaaacctaccggcggcggtggcgcgactaaagacagcgggctgcccacacccgcacgcgcgccccatctgtcaatccagaacagagtaccggtgaacggtgaaaacaaacataaggtcgcctcgccgccgaccagcatagtggatgtcgcgtctccgggttccgcagctaacatttccatcagtaacaaggtgccgccgtccgttgtcccagccaagaagacgccgccgtcgtccgttttcccggccaagaagacgctgccgtcgtccggctcaaattttgtgtcctcggcctctgctcccaggctggacactgtcagcgatgtggaacttgcacagaagaaggatgcgctgattgtcaaagaagctccaaaaccaaaggctctttcggcccctgcagcccccgctgtacaagaagacctttgggatttcaagaaatacattggtttcgaggagcccgtggaggccaaggatgatggctcggctgttgcagatgatgcgggttcctttgaacatcaccagaatcatgattccggacctttggcaggggagaacgtcatgaacgtggtcgtcgttgctgctgaatgttctccctggtgcaaaacaggtggtcttggagatgttgcgggtgctttgcccaaggctttggctaagagaggacatcgtgttatggttgtggtactaaggtatggggactatgaggaagcctacgatgtcggagtccgaaaatactacaaggctgctggacaggatatggaagtgaattatttccatgcttatatcgatggagtggattttgtgttcattgacgctcctctcttccgacaccgtcagcaagacatttatgggggcagcagacaggaaattatgaagcgcatgattttgttctgcaaggccgctgtcgaggttccttggcacgttccatgcggcggtgtcccttacggggatggaaatctggtcttcattgcaaatgattggcacacggcactcctgcctgtctatctgaaagcatattacagggaccatggtttgatgcaatacagtcgctccgttatggtgatacataacatcgctcaccagggccgtggccctgtagatgaattcccgttcaccgagttgcctgagcactacctggaacacttcagactgtacgaccccgtcggcggtgagcacgccaactacttcgccgccggcctgaagatggcggaccaggttgtcgtcgtgagccccgggtacctgtgggagctgaagacggtggagggcggctgggggcttcacgacatcatacggcagaacgactggaagacccgcggcatcgtgaacggcatcgacaacatggagtggaaccctgaggtggacgtccacctgaagtcggacggctacaccaacttctccctgaagacgctggactccggcaagcggcagtgcaaggaggccctgcagcgcgagctggggctgcaggtccgcggcgacgtgccgctgctcgggttcatcgggcggctggacgggcagaagggcgtggagatcatcgcggacgcgatgccctggatcgtgagccaggacgtgcagctggtgatgctgggcacggggcgccacgacctggagagcatgctgcagcacttcgagcgggagcaccacgacaaggtgcgcgggtgggtggggttctccgtgcgcctggcgcaccggatcacggcgggcgccgacgcgctcctcatgccctcccggttcgagccgtgcgggctgaaccagctctacgcgatggcctacggcaccatccctgtcgtgcacgccgtcggcggcctgagggataccgtgccgccgttcgaccccttcaaccactccgggctcgggtggacgttcgaccgcgccgaggcgcacaagctgatcgaggcgctcgggcactgcctccgcacctaccgggaccacaaggagagctggaggggcctccaggagcgcggcatgtcgcaggacttcagctgggaacatgccgccaagctctacgaggacgtcctcgtccaggccaagtaccagtggtga

SEQ ID NO: 4840 - protein, 802 aa, Hordeum vulgare
MSSAVASPASFLALASASPGRSSRRRARVGASPTRAGAGRLQWRPSPLQRTARDGAVAARAAGIDDAAPGRQPRARRYGAATKVADPVKTLDRDAAEGGGPSPPAPRQDAARLPSKNGTLINGENKPTGGGGATKDSGLPTPARAPHLSIQNRVPVNGENKHKVASPPTSIVDVASPGSAANISISNKVPPSVVPAKKTPPSSVFPAKKTLPSSGSNFVSSASAPRLDTVSDVELAQKKDALIVKEAPKPKALSAPAAPAVQEDLWDFKKYIGFEEPVEAKDDGSAVADDAGSFEHHQNHDSGPLAGENVMNVVVVAAECSPWCKTGGLGDVAGALPKALAKRGHRVMVVVLRYGDYEEAYDVGVRKYYKAAGQDMEVNYFHAYIDGVDFVFIDAPLFRHRQQDIYGGSRQEIMKRMILFCKAAVEVPWHVPCGGVPYGDGNLVFIANDWHTALLPVYLKAYYRDHGLMQYSRSVMVIHNIAHQGRGPVDEFPFTELPEHYLEHFRLYDPVGGEHANYFAAGLKMADQVVVVSPGYLWELKTVEGGWGLHDIIRQNDWKTRGIVNGIDNMEWNPEVDVHLKSDGYTNFSLKTLDSGKRQCKEALQRELGLQVRGDVPLLGFIGRLDGQKGVEIIADAMPWIVSQDVQLVMLGTGRHDLESMLQHFEREHHDKVRGWVGFSVRLAHRITAGADALLMPSRFEPCGLNQLYAMAYGTIPVVHAVGGLRDTVPPFDPFNHSGLGWTFDRAEAHKLIEALGHCLRTYRDHKESWRGLQERGMSQDFSWEHAAKLYEDVLVQAKYQW

SEQ ID NO: 4841 - DNA, 2115 bp, Setaria italica
  CDS (142)..(1959)
ctccacaccaccaccaagggtttgaagaagaggaagaactaaaccactgcaagccagtgacggatcgacgacgacacgcccaccccgggctccctgctcatccatccgtcagctagctagccctccacgctggtcaccggcatggcggctctggccacttcccagctcgtcaccacccgcgccggcttcggcctcggcgacgcctcctcctccatgttccgccccggcgtccagggcctcaggggctcccgggcctcctccccggcggccacgctcagcgtgcggaccagcgcgcgcgccgcgcccaggcagcagcaccgccgggcgcagcgcggcgccaggttcccctccctcgtcgtctgcgccaccgcgggcatgaacgtcgtcttcgtcggcgccgagatggcgccttggagcaagaccggcggactcggcgacgtcctcggcggcctcccgccggccatggccgcgaatgggcaccgggtcatggtcatctccccccgctacgaccagtacaaggacgcctgggacaccagcgtcgtctccgagatcaaggtgggagacaggtacgagagggtgaggttcttccactgctacaagcgcggagtcgaccgcgtgttcatcgaccacccgtccttcctggagagggtttggggaaagactggtgagaagatctacgggccagacgctggagtggattacaaggacaaccagctgcgtttcagccttctttgccaggcagcacttgaagctcctaggattctgagcctcaacaacaacccttacttctcaggaccgtacggggaggacgtcgtgttcgtctgcaacgactggcacaccggccctctgtcgagctacctcaagagcaactaccagtccaacggcatctacagaaacgccaagaccgctttctgcatccacaacatctcctaccagggccggttcgcattctcggactacccggagctgaacctccctgagagattcagatcatccttcgatttcatcgacggctacgagaagcctgtggagggcaggaagatcaactggatgaaggccgggatcattgaagccgacagggtcctgaccgtgagcccctactacgccgaggagctcatctccggcatcgccaggggctgcgagctcgacaacatcatgcgcctcaccggcatcaccggtatcgtcaacggcatggacgtcagcgagtgggaccccagcaaggacaagtacatcgccaccaagtacgacgtgtcaacggccattgcggccaaggcgctcaacaaggaggcgctgcaggccgcggccgggctcccggtggaccggaagatcccgctggtggcgttcgtcggcaggctggaggagcagaagggccccgacgtcatggctgccgccatcccgcagctcatggaggaggatgtccagatcgtccttctgggcactgggaagaagaagttcgagcgcatgctgatgagcgcggaggagaagtaccccgacaaggtgcgcgccgtggtgaagttcaacgcggcggtggcgcaccacatcatggccggcgccgacctgctcgccgtcaccagccgcttcgagccctgcggcctcatccagctgcaggggatgcgatacggcacgccctgcgtgtgcgcgtccaccggcgggctcgtcgacaccgtcatcgaaggcaagaccggattccacatgggccgcctcagcgtcgactgtaaggtcgtggagccggccgacgtgcagaaggtggcgagcaccctgaagcgcgccatcaaggtcgtcggcacgccggcgtacgaggagatggtcaggaactgcatgatccaggacctctcctggaagggccctgccaagaactgggagaacgttctgctgagcctgggcgtcgccggcagccagccggggatcgaaggcgaggagatcgcgccgctcgccaaggagaacgtggccgctccctgaaggcggccaagatgatccagtgaacacctacatagtatatagttgcttgtggtagtgtattgtagtggccagcggatatatgacctaataagcatgaactatatatatacactatatattgcgagtgaaaaaaaaaaaaaaaaaaaaaaaaaaaaa

SEQ ID NO: 4842 - protein, 605 aa, Setaria italica
MAALATSQLVTTRAGFGLGDASSSMFRPGVQGLRGSRASSPAATLSVRTSARAAPRQQHRRAQRGARFPSLVVCATAGMNVVFVGAEMAPWSKTGGLGDVLGGLPPAMAANGHRVMVISPRYDQYKDAWDTSVVSEIKVGDRYERVRFFHCYKRGVDRVFIDHPSFLERVWGKTGEKIYGPDAGVDYKDNQLRFSLLCQAALEAPRILSLNNNPYFSGPYGEDVVFVCNDWHTGPLSSYLKSNYQSNGIYRNAKTAFCIHNISYQGRFAFSDYPELNLPERFRSSFDFIDGYEKPVEGRKINWMKAGIIEADRVLTVSPYYAEELISGIARGCELDNIMRLTGITGIVNGMDVSEWDPSKDKYIATKYDVSTAIAAKALNKEALQAAAGLPVDRKIPLVAFVGRLEEQKGPDVMAAAIPQLMEEDVQIVLLGTGKKKFERMLMSAEEKYPDKVRAVVKFNAAVAHHIMAGADLLAVTSRFEPCGLIQLQGMRYGTPCVCASTGGLVDTVIEGKTGFHMGRLSVDCKVVEPADVQKVASTLKRAIKVVGTPAYEEMVRNCMIQDLSWKGPAKNWENVLLSLGVAGSQPGIEGEEIAPLAKENVAAP

SEQ ID NO: 4843 - DNA, 2081 bp, Triticum aestivum
  CDS (1)..(1800)
atggcggctctggtcacgtcccagctcgccacctccggcaccgtcttcagcgtcaccgacagattccggcgtccaggttttcagggtgtgaggccccggagcccggcagatgcgccgctcggcatgaggactaccggagcgagcgccgccccgaagcaacaaagccggaaagcgcaccgcgggacccggcggtgcctctccatggtggtgcgcgccacgggcagcgccggcatgaacctcgtgttcgtcggcgccgagatggcgccctggagcaagaccggcggcctcggcgacgtcctcgggggcctccccccagccatggccgccaacggtcaccgggtcatggtcatctccccgcgctacgaccagtacaaggacgcctgggacaccagcgtcgtctccgagatcaaggtcgcggacgagtacgagagggtgaggtacttccactgctacaagcgcggggtggaccgcgtgttcgtcgaccacccgtgcttcctggagaaggcccggggcaagaccaaggagaagatctacgggcccgatgccggcacggactacgaggacaaccagctacgcttcagcctgctctgccaggcagcgcttgaggcacccaggatcctcgacctcaacaacaacccatacttctccggaccctacggggaagacgtggtgttcgtgtgcaacgactggcacacgggccttctggcctgctacctcaagagcaactaccagtccagtggcatctataggacggccttggtagcgttctgcatccacaacatctcgtatcagggccgcttctccttcgacgacttcgcgcagctcaacctgcccgacaggttcaagtcgtccttcgacttcatcgacggctacgacaagccggtggaggggcgcaagatcaactggatgaaggccgggatcctgactgtgagcccctactatgctgaggagctaatctctggcgaagccaggggctgcgagctcgacaacatcatgcgcctcactgggatcaccggcatcgtcaacggcatggacgtcagcgagtgggaccccatcaaggacaagttcctcaccgtcaactacgacgtcaccaccgcgttggaggggaaggcgctgaacaaggaggcgctgcaggccgaggtggggctgccggtggaccggaaggtgcccctggtggcgttcatcggcaggctggaggagcagaagggccccgacgtgatgatcgccgccatcccggagatcttgaaggaggaggacgtccagatcgttctcctgggcaccgggaagaagaagtttgagcggctgctcaagagcgtggaggagaagttcccgagcaaggtgagggccgtggtcaggttcaacgcgccgctggctcaccagatgatggccggcgccgacgtcctcgccgtcaccagccgcttcgagccctgcggcctcatccagctccaggggatgcgctacggaacgccgtgcgcgtgcgcgtccaccggcgggcttgtcgacacgatcatggagggcaagaccgggttccacatgggccacctcagcgttgactgcaacgtggtggagccggccgacgtgaagaaggtggtcaccaccctgaagcgcgccgtcaaggtcgtcggcacgccggcgtaccatgagatggtcaagaactgcatgatacaggatctctcctggaaggggcctgccaagaactgggaggacgtgcttctggaactgggggtcgaggggagcgagccgggggtcatcggcgaggagattgcgccgctcgccatggagaacgtcgccgctccctgaagagaggaaagaggtttttggtgcatggagcattcatccatcttcagggttcccgtgtgaggagatagccgcttgttgtagcgaagggccgatatatacatatttatatatagactaataagtacttatgctttgttgtgccgcttgcctctttattacaaacaaaaaaaaggtaagaagttaggggttgtgcttgtgagaggtgtgtacttaatcgtgcttgcattttggtgtggtatattgcaaataaacaaaggatttgttaaaaaaaaaaaaaaaaa

SEQ ID NO: 4844 - protein, 599 aa, Triticum aestivum
MAALVTSQLATSGTVFSVTDRFRRPGFQGVRPRSPADAPLGMRTTGASAAPKQQSRKAHRGTRRCLSMVVRATGSAGMNLVFVGAEMAPWSKTGGLGDVLGGLPPAMAANGHRVMVISPRYDQYKDAWDTSVVSEIKVADEYERVRYFHCYKRGVDRVFVDHPCFLEKARGKTKEKIYGPDAGTDYEDNQLRFSLLCQAALEAPRILDLNNNPYFSGPYGEDVVFVCNDWHTGLLACYLKSNYQSSGIYRTALVAFCIHNISYQGRFSFDDFAQLNLPDRFKSSFDFIDGYDKPVEGRKINWMKAGILTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEILKEEDVQIVLLGTGKKKFERLLKSVEEKFPSKVRAVVRFNAPLAHQMMAGADVLAVTSRFEPCGLIQLQGMRYGTPCACASTGGLVDTIMEGKTGFHMGHLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 4845 - DNA, 1230 bp, Corynebacterium glutamicum
  CDS (1)..(1230)
atgcccccatttcggtatcgctgcgcaactgtttttagatggctaatctttgaaattatgagagtcggaatgatgacaagagagtatccaccagaggtttacggcggcgctggcgtgcacgtcaccgaattgacccgattcatgcgtgagatcgctgaagttgatgttcactgcatgggtgcacctcgcgatatggagggagttttcgtccacggcgtcgatcctgccttggaaagcgcgaaccctgcgattaagacactgtccaccggtttacgcatggcagaagctgcaaacaacgtggatgtcgtgcactcacacacttggtatgcaggtcttggcggccaccttgcagctcgtctccacggcattcctcacgtggctaccgcgcactctttggagccagatcgcccatggaagcgtgagcagcttggcggtggatacgacgtgtcctcctggtctgaaaaaaatgccatggaatacgctgacgcggtcatcgctgtgtcggctcgcatgaaagattccatcctcgctgcgtaccctcgcatcgagccggacaacgtgcgtgttgtcctcaacggcatcgacactgagttgtggcagcctcgcccgactttcgatgacgcggaagattccgtactccgctccctaggcgttgacccacagcggcccatcgtcgcatttgtcggccgcatcacccgccaaaaaggcgtcgagcacctcatcaaggcagcagcgcttttcgacgagtccgtgcagcttgtgctctgtgccggcgcgccagacacccccgaaatcgcagctcgcaccaccgccctggtggaagaactccaggcaaagcgcgaaggcattttctgggttcaggacatgctgggcaaggacaaaatccaagagattctcaccgctgctgacaccttcgtgtgcccatccatttacgagccactgggcatcgtgaacttggaagcaatggcctgcaacaccgcagttgtcgcatccgacgttggaggcatccctgaggttgttgtcgacggcaccaccggcgccctcgttcactacgacgaaaatgatgtcgaaaccttcgagcgcgatatcgccgaagcggtgaataaaatggtcgctgatcgagagaccgcagccaaatttggtctcgcagggcgcgaacgtgctatcaatgatttctcctgggcaacgattgctcagcagaccattgatgtgtacaaatccttgatgtag

SEQ ID NO: 4846 - protein, 409 aa, Corynebacterium glutamicum
MPPFRYRCATVFRWLIFEIMRVGMMTREYPPEVYGGAGVHVTELTRFMREIAEVDVHCMGAPRDMEGVFVHGVDPALESANPAIKTLSTGLRMAEAANNVDVVHSHTWYAGLGGHLAARLHGIPHVATAHSLEPDRPWKREQLGGGYDVSSWSEKNAMEYADAVIAVSARMKDSILAAYPRIEPDNVRVVLNGIDTELWQPRPTFDDAEDSVLRSLGVDPQRPIVAFVGRITRQKGVEHLIKAAALFDESVQLVLCAGAPDTPEIAARTTALVEELQAKREGIFWVQDMLGKDKIQEILTAADTFVCPSIYEPLGIVNLEAMACNTAVVASDVGGIPEVVVDGTTGALVHYDENDVETFERDIAEAVNKMVADRETAAKFGLAGRERAINDFSWATIAQQTIDVYKSLM

SEQ ID NO: 4847 - DNA, 1356 bp, Pyrococcus furiosus
  CDS (1)..(1356)
atgaaggtacttttgcttggctttgaatacttacccataaaggtcggaggactagcagaggcattaacgtatattgcaaaggcacttgcctccctgggaaatgagaccatcgtatttactcccgcccatgggcaatttcacggagaatcgattggaaaggttagggcttttggagaagaagttgaaattagagttcacttagagaaagagggaaacttaagggtttatagaatagggggaggactgcttgactcaacggatgtgtatggccctggttgggatggattgctgaagaagagtgttctctttggaaaagcaagcgttctcctcttaaataaattgctcgagaaagaagagctcccagatgtagttcactttcacgattggcacaccgtttttgctggtgcactaataaagaagtacttcaagatcccagccgtctttacaatacacaggttgaataaggcgaaagttccagcttattacttccatgaggcaaacctttcggagctagccccctacccagatttagacccagagcatactggaggatatgtagccgacatggtaacgacggtaagcagagggtatctcctggatgaatgggggttcttcaggaactttgaaggtaaagttacctatgtattcaacggcatagactgcagcttctggagtgaagacttcctcgatggggatagagagacaagaaaagagaggcttctaaagaagttcgggcttgaaaaagggacgactttcatgtttattggaaggttcgatagagggcagaagggagtagatgttcttttaagggcaattgaaattctatcccagatttacaaagactttagctctcttaggtttataatagttggaaaaggggatccagaattggaaaattgggctagaagcttggctacttcatacaaaaacgttgtagttataacacagatgctgtctagagagtttgtgagggaactatatggttcagtagattttgtggttattccttcgtactttgagccctttggtttagttcaattagaagcaatgtgccttggagcaatacccatagcctcttcagtcggtgggttaagggataccataataagcctcgataaaagtccccacaatgcaactggcttgttagtacccccaggagatccttggacacttgcaaatgctatgataaagatggccgagctaaataagaccaacaaagagctaatagaggagctaagagaaaactgcaagaagagggcaagagaattttcatggaaaaaggcagctgaaagatacattaaagtttacaggggaaatgtggaaaggttctttgacttcatcagcaccggagtttag

SEQ ID NO: 4848 - protein, 451 aa, Pyrococcus furiosus
MKVLLLGFEYLPIKVGGLAEALTYIAKALASLGNETIVFTPAHGQFHGESIGKVRAFGEEVEIRVHLEKEGNLRVYRIGGGLLDSTDVYGPGWDGLLKKSVLFGKASVLLLNKLLEKEELPDVVHFHDWHTVFAGALIKKYFKIPAVFTIHRLNKAKVPAYYFHEANLSELAPYPDLDPEHTGGYVADMVTTVSRGYLLDEWGFFRNFEGKVTYVFNGIDCSFWSEDFLDGDRETRKERLLKKFGLEKGTTFMFIGRFDRGQKGVDVLLRAIEILSQIYKDFSSLRFIIVGKGDPELENWARSLATSYKNVVVITQMLSREFVRELYGSVDFVVIPSYFEPFGLVQLEAMCLGAIPIASSVGGLRDTIISLDKSPHNATGLLVPPGDPWTLANAMIKMAELNKTNKELIEELRENCKKRAREFSWKKAAERYIKVYRGNVERFFDFISTGV

SEQ ID NO: 4849 - DNA, 2112 bp, Oryza sativa
  CDS (61)..(1887)
agaattatttctagagcagaacttctaaccaccatttggcatttttgtaggtgtcactgaatggctagaacaatgggttcaacacctacctactgctcttaccaaacaaatggtgttggcgctttaaagcaatcacctcatatgcaattccaacaatcgtacaactatggagttaggttcctaaagagggataccctttctgtgcggattaacaaacatatggccaaaagaatagcaacaagcactggaatttgcactaagcctaggaggtctcacatgcctatagtatgctctgctggaatgacaataatttttattgcaactgaatgtcacccatggtgcaaaactggaggcctcggtgatgttctagggggactgccccctgctcttgctgcaatgggacatcgtgtcatgacaatagttcctcgttatgatcaatacaaagatgcatgggatacaaatgtccttgtcgaggtcaatattggtgacaggacagaaacagtgcgcttcttccactgctataaaaggggagttgaccgtgtttttgttgatcatcctatgtttcttgagaaggtatggggcaagactggaccaaaattatacggtcctaccactggagatgactaccgggacaaccagttgcggttctgccttttatgcctcgctgctttggaggctccaagggttctcaatctcaacaattctgaatatttctcgggaccatatggtgaaaatgttgtcttcgttgcaaatgactggcacactggagtcctgccatgctatctcaagagcatctatcaggcaaaaggaatgtatgtgaatgctaaggttgctttctgcattcacaatattgcctaccagggtagatttgccagagaagactttgaacttcttaatctaccggacagtttcctgccttcatttgattttattgatgggcattttaaacctgtagtaggtagaaagattaactggatgaaggcagggatcactgaatgtgatctggttatgacggttagtccacattatgtcaaagaactcgcttctggcccagataaaggtgttgaattggatggcatccttcgcacaaagccccttgaaactggaattgtcaatggcatggatgtttatgaatggaatccagcaacagatcagtacatcagcgtgaaatacgatgcaacaacggtaactgaagcaagggcactcaataaggaaatgctacaagctgaagttgggttgcctgtggactcgagcattcctttaatagtttttgttggtcgtcttgaagagcagaaagggtcagacatactaattgcagccattccagagttcgtggaggggaatgtccagataattgttcttggtacagggaagaagaaaatggaggaggaactgatactgctcgaagttaaatatccaaacaccgctagagggttagcaaaatttaatgtccctttagcgcatatgatgtttgctggggctgattttataattgttcctagtaggtttgagccatgtggtctcatccaattgcaagggatgagatatggagtggttcccatctgctcatctactggaggacttgtcgacacggttaaggagggcgtgaccggattccacatgggtttgttcaatgtcgagtgcgaaactgttgatccagtggacgtcacagcggttgcttcaactgtcaaacgggctctgaagcagtacaacacaccggcattccaagaaatggttcagaactgcatggctcaagacctatcttggaagggacctgcaaagaagtgggaggaggttcttcttgggttgggcgttgaggggagccagccaggcatcgagggtgaggaggtggcgccacttgccaaggaaaacgtggccactccctgaaattctccatgacggtgcctagcttgctggcttgtttaggtgacaggcagcctgataggatcccatggacttctgagctcgccaccggcaaagccactatttgtatccctgcaggcttctgccatttctctcgtctacttcacgtgtaatataatcgcagatgttacttagagatgtgggccagatggcatgcatttgcctgttaaaaaaaaaaaaaaaaaaaaa

SEQ ID NO: 4850 - protein, 608 aa, Oryza sativa
MARTMGSTPTYCSYQTNGVGALKQSPHMQFQQSYNYGVRFLKRDTLSVRINKHMAKRIATSTGICTKPRRSHMPIVCSAGMTIIFIATECHPWCKTGGLGDVLGGLPPALAAMGHRVMTIVPRYDQYKDAWDTNVLVEVNIGDRTETVRFFHCYKRGVDRVFVDHPMFLEKVWGKTGPKLYGPTTGDDYRDNQLRFCLLCLAALEAPRVLNLNNSEYFSGPYGENVVFVANDWHTGVLPCYLKSIYQAKGMYVNAKVAFCIHNIAYQGRFAREDFELLNLPDSFLPSFDFIDGHFKPVVGRKINWMKAGITECDLVMTVSPHYVKELASGPDKGVELDGILRTKPLETGIVNGMDVYEWNPATDQYISVKYDATTVTEARALNKEMLQAEVGLPVDSSIPLIVFVGRLEEQKGSDILIAAIPEFVEGNVQIIVLGTGKKKMEEELILLEVKYPNTARGLAKFNVPLAHMMFAGADFIIVPSRFEPCGLIQLQGMRYGVVPICSSTGGLVDTVKEGVTGFHMGLFNVECETVDPVDVTAVASTVKRALKQYNTPAFQEMVQNCMAQDLSWKGPAKKWEEVLLGLGVEGSQPGIEGEEVAPLAKENVATP

SEQ ID NO: 4851 - DNA, 2496 bp, Oryza sativa
  CDS (1)..(2496)
atgatacaaaacatggaaaagaatattctgctcctaaatcaagctcgtcttcaagcaattgaagatgttgacaaaattcttactgaaaaggaagctttgcagaaaaaggttgacactctagagatgaatttgtcaaaagcacttgcaaccaaagggaacataaatacagatatccctggtgatcatttagagaaatttacaaaagaaattttgatagaaagtgctctaagtggaggcaatccagcacatttgtgtgagtctccacttttcatggagctgactgttctaaaagaagagaatatgctacttaaggctgacgcacaatttcttaaagcaaagattgttgagtttgctgaaacagaggaattcctattcaaattggagaaagaaaggtcactgttagacgctacagttagggagctggaagctaggtttctagttgctcaaactgatatctggaaagttgtccctctgcaatatgatgtttggatggagaaagtagaaaatctgcaacacatgcttggatgtttgaaaaatcatgtagagaagtatgctgcattgttggatcagcatgatgatctgcatgacaagattgatgagctagaagcatcactaaaagaagggaaaacatctgagttttctccttatgttgttgaacttctgcaacagaagttgaaagcagcaaaaagccatcaccaagcaggccatcaagaaacaaacactcacattcaagtatatcagcagttaactgaggaatttcaagataacctaggtaaactaatagaagaaagtggcagactggagcattctgcaaatagtatgccatcagaattctggagtcacatcctgctcatgattgatggttggttccttgagcggaaaataccaaatactgatgcacgtatgctgagagaaatggcatggaagagagatgaccgtatctgtgaagcctactttgcttgcaagggtgcaaaagaaagtgatgttatggaaactttcctaaagctatcgttatcaggaaacagtttgcttaacaaaatggttcttcaggttggcggtctggcagatgtagttgctggtcttggcaaggcacttcagactaagggacatttagtagagattgttcttcccaaatacgactgtatgcaacttgaccagattactaatcttaaggttttagatgttgtcatacaatcctattttgatggaaatctattcagcaacaacgtgtggacaggaactgttgaaggtcttccagtctattttattgagccacagcatccttcaaaattcttctggagggcccaatactatggagagcatgacgattttaaacgttattcatactttagccgtgcagcactggaattactttaccaatctgggaagaaaattgatataatccactgccatgactggcaaactgcatttgttgcacctctatattgggatatatatgcaactcgaggcttcagctcagctagaatttgtttcacttgccacaacttcgaataccaaggtacagcacctgctcctgatttatcatattgcggccttgatgttgagcagttggatagaccagacaggatgcaagacaatgcacatggaagaataaatgttgccaagggtggaattgtttattccaatattgtgacaactgtatcaccaacatatgctttagaagtgcgctcagagggtggtcgtggtctccaagatacacttaaaatgcattccaggaaatttgtggggatacttaatggaatcgacacaggaacatggaacccttccacagacagatttcttgctgtgcaatatagtgctactgatcttcaggggaaagcagcaaacaaagcatttctcaggaagcagctagggctgtattctgaggatgcctctcaaccactggtagcctgcattacgaggctagttcctcaaaagggtctacatcttatcaggcatgcaatatacaaaacagctgagttaggaggacagtttgtactcctgggttcaagtccagttccacatattcagagggaatttgagggtgttgcagaccaattccagaagaataacaatattaggttaattctgaaatatgatgaagctttgtctcattgtatttatgcggcatctgacatgtttatcattccatcaatgtttgagccttgtggccttactcagatgatagctatgagatatggttctgtgccaattgttcgacaaactggtggattgtgtgatagtgtttttgattttgatgatgaaactatacctgtggagctgcggaatggctttacatttgctaggactgatgagcaggatctaagcagttgcttggaaagggcattcagctactacagcagaaaacctatggtttggaaacagttagtgcagaaggatatgcagattgatttcagctgggattctccagcttcacagtacgaaaacctttatcagagtgctgttgctcaggcaaggggagcggctcaaacataa

SEQ ID NO: 4852 - protein, 831 aa, Oryza sativa
MIQNMEKNILLLNQARLQAIEDVDKILTEKEALQKKVDTLEMNLSKALATKGNINTDIPGDHLEKFTKEILIESALSGGNPAHLCESPLFMELTVLKEENMLLKADAQFLKAKIVEFAETEEFLFKLEKERSLLDATVRELEARFLVAQTDIWKVVPLQYDVWMEKVENLQHMLGCLKNHVEKYAALLDQHDDLHDKIDELEASLKEGKTSEFSPYVVELLQQKLKAAKSHHQAGHQETNTHIQVYQQLTEEFQDNLGKLIEESGRLEHSANSMPSEFWSHILLMIDGWFLERKIPNTDARMLREMAWKRDDRICEAYFACKGAKESDVMETFLKLSLSGNSLLNKMVLQVGGLADVVAGLGKALQTKGHLVEIVLPKYDCMQLDQITNLKVLDVVIQSYFDGNLFSNNVWTGTVEGLPVYFIEPQHPSKFFWRAQYYGEHDDFKRYSYFSRAALELLYQSGKKIDIIHCHDWQTAFVAPLYWDIYATRGFSSARICFTCHNFEYQGTAPAPDLSYCGLDVEQLDRPDRMQDNAHGRINVAKGGIVYSNIVTTVSPTYALEVRSEGGRGLQDTLKMHSRKFVGILNGIDTGTWNPSTDRFLAVQYSATDLQGKAANKAFLRKQLGLYSEDASQPLVACITRLVPQKGLHLIRHAIYKTAELGGQFVLLGSSPVPHIQREFEGVADQFQKNNNIRLILKYDEALSHCIYAASDMFIIPSMFEPCGLTQMIAMRYGSVPIVRQTGGLCDSVFDFDDETIPVELRNGFTFARTDEQDLSSCLERAFSYYSRKPMVWKQLVQKDMQIDFSWDSPASQYENLYQSAVAQARGAAQT

SEQ ID NO: 4853 - DNA, 1443 bp, Rhizobium loti
  CDS (1)..(1443)
atgcaggttctgtcggtcacgcccgagatttttccgctgatcaagaccggtgggctggccgacgtgaccggcgctctgcccatcgcgctcgctgccaagggcgtaaccatgcgcacgctcattccaggctttcccgtggtgatggctgctttcaagaaaaagaaagccgtctaccaatatccgctgttgcagggcggcaaggcttccgtccacgccgtgcagattgctgggctcgacctgttcgtgctcgacgcgccgcatctgttcgaccgcccgggcggcccctacggcaatgcttcggggcggactgccggacaattgcggcgcttcgcggcgctgagccaggttggtggcgatatcgccggcggcgccatctccggctatcagcctgacatcgtccacgcccatgactggcagtcggcgatgacgctggcctatatgcgctacggcaaggcggtcggcgttccgtcgatgatgaccgtccacaatctcgccttccagggccagttcggcgccggcatcttcggcgaactcggcctgccggctgttgcgatggcgctcgacggcgtcgaatattatggcggcgtcggcttcctaaaggccggtctgcaggccgcctgggcgatcaccacggtcagcccgacctatgcgcaggagatccggtcggcggagttcggcatgggcctcgacggcctgatcaacatgcgcgccagcgatctccatggcatcgtcaacggcatcgacaccgctatctgggatccgcaaacggacaagcatctggtgtcgaactataccgccgcgacgctcgaggcacgggcgcccaacagggccgccgtggaggaacgcttcggcctcgaccgcgacgacagcccgatcgtctgcgtcatcagccggctgacctggcagaagggcatggatattttggctacagtgatcgacggcgtcgtcgcgaccggcgcgcggctcgccatactgggctcgggcgacgccggcctcgaaggcgcgctgcttgcagccgccgcgcgccaccgtggccgcatcggcgtggtcatcggctacgacgaggggctgtcgcacaccatgcagggcggttgcgacgccatcgtcatcccgtcgcgcttcgaaccctgcggactgacgcagctttacggcctgcgctacggctgcgtgccggtggtcgcccgcactggcggcctcgccgacaccatcatcgacgccaacgaagcggcgatggcggccggcgtggcgacagggttccagttcgctcccaacaatggcggcgcgatgctgcacgccattgcccggctggccgacgctcacgcgaatcccgcggctttcgaaaccatccagcgtcagggcatgaagacggatgtgtcgtgggatcgaagcgccgaaaaatatgttggactctatcgcctgctgctttcgaaaagggttgcctga

SEQ ID NO: 4854 - protein, 480 aa, Rhizobium loti
MQVLSVTPEIFPLIKTGGLADVTGALPIALAAKGVTMRTLIPGFPVVMAAFKKKKAVYQYPLLQGGKASVHAVQIAGLDLFVLDAPHLFDRPGGPYGNASGRTAGQLRRFAALSQVGGDIAGGAISGYQPDIVHAHDWQSAMTLAYMRYGKAVGVPSMMTVHNLAFQGQFGAGIFGELGLPAVAMALDGVEYYGGVGFLKAGLQAAWAITTVSPTYAQEIRSAEFGMGLDGLINMRASDLHGIVNGIDTAIWDPQTDKHLVSNYTAATLEARAPNRAAVEERFGLDRDDSPIVCVISRLTWQKGMDILATVIDGVVATGARLAILGSGDAGLEGALLAAAARHRGRIGVVIGYDEGLSHTMQGGCDAIVIPSRFEPCGLTQLYGLRYGCVPVVARTGGLADTIIDANEAAMAAGVATGFQFAPNNGGAMLHAIARLADAHANPAAFETIQRQGMKTDVSWDRSAEKYVGLYRLLLSKRVA

SEQ ID NO: 4855 - DNA, 2100 bp, Pisum sativum
  CDS (6)..(1847)
caaaaatggcaacagtgactgcttcaagtaacatagtatccagaacctctcatgtcaatttaccaactgtttcatgtgagtttaaaacagcaccaatgagacttggttctataaggaaagccaatactcataatggactcagagttttgaactcgttggacgagttattaaataggacgccgattaaaatgaagggagtgcaatcgaggaagaagggtgtccagagaaagaatgttaggcctaaaggtattatagtttgtggcatgaatttgatctttgttggaactgaggttgctccgtggagtaaaactggtggtttaggcgatgttcttggaggtcttccgccagcattatcagctaatgggcacagagttatgaccgtcactccgcgttatgaccaatacaaagatgcatgggatacaaatgtaacaatcgaggtaaaagtaggagatagaacagaaaaagtccgcttcttccattgctttaaacgaggagttgatcgcgtttttgtagatcaccctatatttcttgaaaaggtttgggggaaaactggaacaaaactttatggccctgccgcaggagacgattaccaagacaatcaactacgttttagcatcttttgtcaggcagctctggaagcagcgagagttctaaatcttaagagcaataaatatttctcaggaccatatggtgaagatgtcattttcgttgctaatgattggcacactgcccttatctcatgctacatgaaatccatgtaccaatcaattggcatctttaggaatgccaaagttgttttttgtatccacaacattgcttaccaaggaagatttgcatttaccgactattcacttctcaatctccctgaccaatttaaaagctcctttgacttccttgacgggcatgttaaaccaattgttggaagaaaaatcaattggatgaaagctggaattatagaatctcatcgagttttaactgttagtccatactatgcacaagaactagtgtcaggcccagataaaggagttgagttggacaacattcttcgccgagttggtgttactggaatcgtaaatggcatggatgttcaagagtggaatccatccaccgacaaatatataagtatcaaatacgatgcctcaacagtattggaaggaaaagctcttctgaaagaagaactgcaagcagaagttggattgccggttgacaaaaatgttcctctcattgctttcatcggtaggcttgaagagcaaaaaggttctgatattcttgtagaagccattcctcaatttataaaggagaatgttcaaatagtcgcactaggaacgggaaaaaaagaaatggaaaagcaacttcagcaacttgaaatatcataccctgacaaggccagaggagttgcgaaattcaatgttcccctagctcatatgatgattgcaggagctgattttatcttgattccaagtagatttgagccttgcggtctcattcagttacaagctatgcgctatggaacggtacctattgttgcctcgacgggtggattagtggacacagtcaaagaaggttttactggattccacatgggttccttcaatgtcaaatgtgatgctgtggatcctgttgatgtggatgctataccaaaaactgtcacaaaggcccttggagtctatggaacttcagcttttgcagaaatgatcaagaattgcatggctcaagaactttcatggaagggacctgctaagaagtgggaggaagtgctgctaaatttgggagttcctgacagtgaacctggaattgatggacaagaaattgctccacaggcaaaggaaaatgtggcaactccatgattaaaataatgatgtgatggaagcttcttctagtttccatctcttgaagtttcatggaacttcacccgagtgatggatcgattattagtgcattttttccaaggagtttaaatctgtaattataagtgatcttggacaagtttactattattttgccttaaaatgatagattagcattccttttaaaaaaaaaaaaaaaaaaaaaaaaaaaaaaaaaaaaaaaaaaaaaaaaaaaaaaaaaaaaaaaaaaaaa

SEQ ID NO: 4856 - protein, 613 aa, Pisum sativum
MATVTASSNIVSRTSHVNLPTVSCEFKTAPMRLGSIRKANTHNGLRVLNSLDELLNRTPIKMKGVQSRKKGVQRKNVRPKGIIVCGMNLIFVGTEVAPWSKTGGLGDVLGGLPPALSANGHRVMTVTPRYDQYKDAWDTNVTIEVKVGDRTEKVRFFHCFKRGVDRVFVDHPIFLEKVWGKTGTKLYGPAAGDDYQDNQLRFSIFCQAALEAARVLNLKSNKYFSGPYGEDVIFVANDWHTALISCYMKSMYQSIGIFRNAKVVFCIHNIAYQGRFAFTDYSLLNLPDQFKSSFDFLDGHVKPIVGRKINWMKAGIIESHRVLTVSPYYAQELVSGPDKGVELDNILRRVGVTGIVNGMDVQEWNPSTDKYISIKYDASTVLEGKALLKEELQAEVGLPVDKNVPLIAFIGRLEEQKGSDILVEAIPQFIKENVQIVALGTGKKEMEKQLQQLEISYPDKARGVAKFNVPLAHMMIAGADFILIPSRFEPCGLIQLQAMRYGTVPIVASTGGLVDTVKEGFTGFHMGSFNVKCDAVDPVDVDAIPKTVTKALGVYGTSAFAEMIKNCMAQELSWKGPAKKWEEVLLNLGVPDSEPGIDGQEIAPQAKENVATP

SEQ ID NO: 4857 - DNA, 3386 bp, Triticum aestivum
  CDS (251)..(2995)
gccgtttgcccgacgaatggcaccgtgccacgcccacggccctcctccgcctccgcccccgcctcgcccgcgcgcggagcacgagacacgccacgcgctggcccccggccaccgccaccgccaccagtccaccaccaccagtccaccaccaccactcttcagccccactccactccccgccgctttccggcccgccgcccgcttcaagctcccctcgccccaccagtcgccctgcctctccctattccccatggcgtgctccgcggcggcgggcgtcgaggcgaccgccctcctgtccccgcgctgccccgccccttccccgcccgacggccgctcccgccgccgcctcgccctcgcttcccgcacgcgccaccgcagcctcagggcggccgcgcagcgccctcacaagagcgcaaccggcgccgaccccctttataacaacagggccaatgtgcggagcgacgaggcgtcggtttccgctgaaaaagaacggcaaaggaaatacaacgatggagatggcatatcaaaccttaagctggaagatttggtaggaatgatacagaacaccgagaagaatatacttcttttgaatcaagcccgtcttcaggcaatggaacacgctgataaagttcttaaagaaaaggaagccttgcagagaaagataaacattttagagacgaggttgtcagaaacagatgaacaacataagctttcaagtgaagggaatttcagtgactctccactagcattggagcttggtattctaaaggaagagaacattctactgaaggaggacatagaatttttcaaaacaaagcttatagaggttgccgagatagaggagggtatattcaaattggagaaggagcatgctcttttagatgcttcccttagggagctggagtctaggtttatagccgcccaagcagatacgatgaaacttggtcctagggatgcctggtgggagaaagtagaaaaattggaagacttgcttgagaccacagcaaaccaagtagagcatgctgctgtgatattggaccacaatcatgatctgcaggataggcttgacaatttagaggcatcactgcaagcagcaaatatttcaaagttctcttgttctcttgttgatcttttgcagcaaaaggtcaaattggtagaagaccgcttccaagcatgtaacagcgaaatgcattctcagattgaactgtacgagcattcaatagtggaatttcatgatactcttagcaaactaatagaggaaagtgagaaaagatcactggagaattttacaggaaacatgccttcggaactatggagcaaaatttcccttttaattgatggatggttactggagaagaaaatatcttacaatgacgcaagtatgttgcgagaaatggttcagaaaagggacagtcgtcttcgggaagcatacttgtcatacagaggtaccgaaaacagggaagttatggacaacttacttaagatggcattaccaggaaccagttctggtttgcacatcgctcacatagcagcagagatggctcctgtcgcgaaggttggtggcctggcagatgtgatatctggtcttgggaaggcacttcagaaaaaaggccatctagtagagatcattcttcccaaatacgactgcatgcaggttgaccaagttagcaatctaaaggttttagatgttcttgtgcagtcctactttgaaggaaatatgttcaacaacaaaatttggaccgggactgttgaaggcctacccgtgtactttattgagccacagcatccagcgatgttcttttcgagggctcagtactatggagagcatgatgacttcaaacgtttttcatacttcagccgtgcggcactagaattactttatcaatctgggaagaaagttgatataatccactgccatgactggcaaactgcatttgttgcacctctttattgggatgtatatgcaaatctaggcttcaactcagctagaatttgcttcacctgtcataattttgaataccaaggaactgctccagctcgtgatttagcatggtgtggtcttgatgttgagcacctagacagaccagacaggatgcgggacaattcgcatggcagaataaatgctgttaagggagcagttgtgtattcaaacatcgtgacaactgtctcgccaacatatgcactagaggttcgctcagagggtgggcgtggactccaagatacacttaaagtacattccaggaaatttcttgggatacttaatggaatcgacacagatacatggaacccttgcacagataggtatctcaaggtccagtataatgctaaggatctccagggaaaggcagccaacaaagcagccctcagagagcaactaaacctggcttctgcatatccttcacaaccactggttggttgcattaccaggctggttgctcagaagggtgtacatcttatcaggcatgcaatatacaaaacagctgaattaggaggacagtttgtccttctgggttcaagtccagtaccagaaattcagagggagtttgaaggtattgcagaccattttcagaacaacaacaatatccggctgattttgaagtatgatgatgcgctgtctcattgcatatatgctgcgtctgacatgttcattgttccctctatatttgagccatgtggcctcactcagatgatagccatgagatatggttctgtgccaatcgttcggaaaactggtgggctgaatgacagtgtctttgacttcgatgacgaaacaatacccatggaggtgcggaacggctttacatttgtcaaggccgacgagcagggcctaagcagcgcgatggagagggcgttcaactgctacacgaggaagcccgaggtgtggaaacagcttgtgcagaaagacatgacgatcgatttcagctgggacacctcggcttcgcagtacgaggacatctaccagaaggcggtggctcgagcgagggcagtggcgtgagcacacacacacacggtagttggttccctgatgcctctctcccctgccctgccctcatgatacaaacggcactggacgaaatcgagggatcatggaaacagaatcatatagcaagctccatgctctcggcgcgcatttccggtaagggtgtgacggtgtatcgctggttatatgcgctgtttattgaaggcagaacgcgagctaaaaatggagtagctaccgtgaaccctcaagatcgtagtatgcgcgctgttgttggcataatattggtgtaaattgtagtaggctgtatattttcttgaggggttgcaacggagctgtatgcgtgcagtgcaggctgcagagtcgcacgtatgtactgtattatgcagaaaaaaaaaaaaaaaaaaaa

SEQ ID NO: 4858 - protein, 914 aa, Triticum aestivum
MACSAAAGVEATALLSPRCPAPSPPDGRSRRRLALASRTRHRSLRAAAQRPHKSATGADPLYNNRANVRSDEASVSAEKERQRKYNDGDGISNLKLEDLVGMIQNTEKNILLLNQARLQAMEHADKVLKEKEALQRKINILETRLSETDEQHKLSSEGNFSDSPLALELGILKEENILLKEDIEFFKTKLIEVAEIEEGIFKLEKEHALLDASLRELESRFIAAQADTMKLGPRDAWWEKVEKLEDLLETTANQVEHAAVILDHNHDLQDRLDNLEASLQAANISKFSCSLVDLLQQKVKLVEDRFQACNSEMHSQIELYEHSIVEFHDTLSKLIEESEKRSLENFTGNMPSELWSKISLLIDGWLLEKKISYNDASMLREMVQKRDSRLREAYLSYRGTENREVMDNLLKMALPGTSSGLHIAHIAAEMAPVAKVGGLADVISGLGKALQKKGHLVEIILPKYDCMQVDQVSNLKVLDVLVQSYFEGNMFNNKIWTGTVEGLPVYFIEPQHPAMFFSRAQYYGEHDDFKRFSYFSRAALELLYQSGKKVDIIHCHDWQTAFVAPLYWDVYANLGFNSARICFTCHNFEYQGTAPARDLAWCGLDVEHLDRPDRMRDNSHGRINAVKGAVVYSNIVTTVSPTYALEVRSEGGRGLQDTLKVHSRKFLGILNGIDTDTWNPCTDRYLKVQYNAKDLQGKAANKAALREQLNLASAYPSQPLVGCITRLVAQKGVHLIRHAIYKTAELGGQFVLLGSSPVPEIQREFEGIADHFQNNNNIRLILKYDDALSHCIYAASDMFIVPSIFEPCGLTQMIAMRYGSVPIVRKTGGLNDSVFDFDDETIPMEVRNGFTFVKADEQGLSSAMERAFNCYTRKPEVWKQLVQKDMTIDFSWDTSASQYEDIYQKAVARARAVA

SEQ ID NO: 4859 - DNA, 2919 bp, Oryza sativa
  CDS (165)..(2597)
ggtgccctcctcgccgtcgtcgctcgctgcccatttcatcccccgcacggcacgcgcgggacgaaagcaaagcacgcgcacacactcaaacccgcgcctcctccgctctcgtccgtcgcttcggttcggttccggctcgatcggggaggttcctcggggcgaccatgtcgtcggccgtcgtcgcgtcatccaccacgttcctcgtcgcgctcgcctcttcggcgtcacggggagggcccaggagggggagggtggtgggcgtggccgcgccgccggccctgctttacgacggccgcgccggaaggctagccctacgggcgccgcctccgccccggcctcggcctcggcgtcgggatgcgggcgtggtgcgccgcgcggatgatggggagaacgaggcggcggtggagcgggcgggtgaggacgacgacgaggaggaggagttctcttcgggcgcgtggcagccgccccgctcgcgtcgcggcggcgtcggcaaggtcttgaagcggaggggcaccgtcccgcccgtcggccggtacggctccggcggtgatgcggcgagagtgcgcggggcggccgcgccggcgccggcgccgacacaggacgccgcctcaagtaagaacggagcgcttctcagcggccgcgacgacgacacacctgcctcacggaacggatcggtcgttaccggcgccgacaagcctgccgccgccacgccgccggtgaccataacgaagctcccagcgccggactcccccgtgatccttccatccgtagacaagccgcagccggagttcgtcatcccagacgcgacggcgccggcgccgccaccgcccggttcaaatcccaggtcgtccgctcctctccccaagcctgacaattcggaatttgcagaggataagagcgcaaaagttgttgagagtgctccgaagccaaaggcgactagatcttcccctattcctgcggtagaagaggagacgtgggatttcaagaaatattttgatctgaacgaaccggacgccgcggaggatggcgatgacgatgatgactgggctgattcagatgcgtcagattctgagatcgaccaggatgacgattcgggccctttggctggggagaatgtcatgaacgtgatcgtggtggctgctgaatgttctccctggtgcaaaacaggtgggcttggagatgttgcaggtgctttacccaaagctttggcgaggagaggacatcgtgttatggttgtggtaccaaggtacggtgattacgcggaagcccaggatgtaggaatcaggaaatactacaaggctgctggacaggatctggaagtgaaatatttccatgcatttatcgatggagttgattttgtgttcattgacgctcctctcttccgtcaccgtcaggatgacatctatggggggaacagacaggaaatcatgaagcgcatgattctgttttgtaaggctgctgttgaggttccttggcacgttccatgcggtggtgtgccctatggggatggcaacttggtgttccttgcaaacgattggcacactgcactcctgcctgtttatctgaaggcatattacagagacaatggcatgatgcagtacactcgctctgtccttgtgatacataatatcgcttaccagggccgtggcccagtagatgaattcccctacatggaattgccggagcactacctggatcacttcaagctgtacgaccccgtcggcggcgagcacgccaacatcttcggcgcgggcctgaagatggcggaccgggtggtgaccgtgagccccggctacctctgggagctgaagacgacggagggcggctggggcctccacgacatcatacgggagaacgactggaagatgaacggcatcgtgaacggcatcgactaccgggagtggaacccggaggtggacgtgcacctgcagtccgacggctacgccaactacaccgtggcctcgctggactccagcaagccgcggtgcaaggcggcgctgcagcgcgagctggggctggaggtgcgcgacgacgtgccgctgatcgggttcatcgggcggctcgacgggcagaaaggtgtggacatcatcggcgacgcgatgccgtggatcgccgggcaggacgtgcagctggtgctgctgggctccggccgccgcgacctggaggtgatgctgcagcggttcgaggcgcagcacaacagcaaggtgcgcgggtgggtggggttctcggtgaagatggcgcaccggatcacggcgggcgccgacgtgctggtcatgccgtcgcggttcgagccgtgcggcctcaaccagctctacgccatggcgtacggcaccgtccccgtcgtgcacgccgtcggcgggctgagggacacaatgtcggcgttcgacccgttcgaggacaccggcctcgggtggacgttcgaccgcgccgagccgcacaagctcatcgaggcgctcggccactgcctcgagacgtaccgcaagtacaaggagagctggagggggctccaggtgcgcggcatgtcgcaggacctcagctgggaccacgccgccgagctctacgaggaggtccttgtcaaggccaagtaccaatggtgaagagaccatgtccgcccgcggtctccgcctgcgcgttcggcagctatagctatagcctccctgaagaagcttggcgctgctgtggaggtgcgactcggtggcggtgtggcgccggcgccggcgcttgcaggggaggtgtttgtgctgaccgagctgtgcgttgaggtgcgcaaattagcttccggtttgtgtgtttatggcgaggcatggtggagttgagggagtattaagctttgtttcagatgcatcatgcatgcgtaataggatgttgtatttaataatgtgtttgttatgtccattgatgcgatgttacttcttcatt

SEQ ID NO: 4860 - protein, 810 aa, Oryza sativa
MSSAVVASSTTFLVALASSASRGGPRRGRVVGVAAPPALLYDGRAGRLALRAPPPPRPRPRRRDAGVVRRADDGENEAAVERAGEDDDEEEEFSSGAWQPPRSRRGGVGKVLKRRGTVPPVGRYGSGGDAARVRGAAAPAPAPTQDAASSKNGALLSGRDDDTPASRNGSVVTGADKPAAATPPVTITKLPAPDSPVILPSVDKPQPEFVIPDATAPAPPPPGSNPRSSAPLPKPDNSEFAEDKSAKVVESAPKPKATRSSPIPAVEEETWDFKKYFDLNEPDAAEDGDDDDDWADSDASDSEIDQDDDSGPLAGENVMNVIVVAAECSPWCKTGGLGDVAGALPKALARRGHRVMVVVPRYGDYAEAQDVGIRKYYKAAGQDLEVKYFHAFIDGVDFVFIDAPLFRHRQDDIYGGNRQEIMKRMILFCKAAVEVPWHVPCGGVPYGDGNLVFLANDWHTALLPVYLKAYYRDNGMMQYTRSVLVIHNIAYQGRGPVDEFPYMELPEHYLDHFKLYDPVGGEHANIFGAGLKMADRVVTVSPGYLWELKTTEGGWGLHDIIRENDWKMNGIVNGIDYREWNPEVDVHLQSDGYANYTVASLDSSKPRCKAALQRELGLEVRDDVPLIGFIGRLDGQKGVDIIGDAMPWIAGQDVQLVLLGSGRRDLEVMLQRFEAQHNSKVRGWVGFSVKMAHRITAGADVLVMPSRFEPCGLNQLYAMAYGTVPVVHAVGGLRDTMSAFDPFEDTGLGWTFDRAEPHKLIEALGHCLETYRKYKESWRGLQVRGMSQDLSWDHAAELYEEVLVKAKYQW

SEQ ID NO: 4861 - DNA, 2394 bp, Oryza sativa
  CDS (34)..(2118)
ggaggaggaggagcggcggcggcggcggatcctatgtcgggggcaatcgcttcctcgccggcggctactctcttcctcgctggctcctcctcctcttcgccgcggcgcaggcggagcagggtgagcggggtttggtggcacttgtatggtggcacggggctgcggttgcattgggagcggcggggtttggttcgggacggagccgtcgtgtgctcggcgtcggccgccggtggtgaggatggcgtcgcgaaggcgaagacgaagtcagcggggagctcgaaggcggtcgctgtgcagggcagcacggccaaggctgatcatgttgaggattcagtttcatcacccaaatacgtgaaacctgccgttgcgaagcaaaatggagaggttgtgagcagagctaccaaatctgatgcaccagtgtctaaacccaaagttgacccgtcagttcctgcttccaaggctgaagctgatggtaatgcacaagctgtggaatcgaaggctgcactggacaagaaggaagacgtcggtgttgctgaaccgttggaagctaaggctgatgctggtggagatgcaggtgcagtaagctctgcagatgatagtgagaacaaggaatctggtccattggcagggccaaatgtgatgaatgtcattgtggtggcttctgaatgttctcctttctgtaaaacaggtggtcttggagatgttgtgggtgctttgcctaaggctctggcaagaagaggacatcgtgttatggttgtgataccaagatacggagaatatgcagaagccaaggatctaggtgtccgcaaacgttacagggtagctggacaggattcagaagtgagttattttcatgcttttatcgatggtgttgattttgtgtttctagaggcccctccctttcgacaccggcacaatgatatttatggaggagaaagatttgatgttttgaagcgtatgattttgttctgcaaagctgctgttgaggttccttggtttgctccatgtggtggttccatctacggtgatggcaatttagtcttcattgcaaatgattggcatactgcacttttacccgtatgtttgaaggcatattaccgagataatggcttgatgcagtatactcgctctgttcttgtgatacacaacattgctcatcagggtcgcggccctgtagatgacttcgccacgatggacttgcccgagcactacatcgatcatttcagactgtacgaccccgtcggcggtgagcacagcaacgtgttcgccgctggcctgaagatggctgaccgcgcggtcaccgtcagccatggctatctgtgggagatcaagacaatggacggtggctggggcctccacgagataataaaccacaacgactggaagctgcagggcatcgtgaatggcatcgacatggccgaatggaaccccgaggtggacgagcacctgcagtccgacggctacgccaactacacgttcgagacgctggacaccggcaagaaacagtgcaaggaggcgctgcagcggcagctgggcctgcaggtccgcgacgacgtgccgctgatcgggttcatcgggcggctcgaccaccagaagggcgtggacatcatcggcgacgcgatgccgtggatcgccgggcaggacgtgcaggtggtgatgctgggcacggggcggccggacctggaggagatgctgcggcggttcgagtcggagcacaacgacaaggtgcgcgggtgggtggggttctcggtgcagctggcgcaccggatcacggcgggcgccgacgtcctcctgatgccgtcgcggttcgagccgtgcgggctgaaccagctgtacgccatggcgtacagcaccgtgcccgtggtgcacgccgtgggcgggctccgcgacacggtggcgccgttcgacccgttcgccgacacggggctcgggtggacgttcgaccgcgccgaggcgaaccggatgatcgacgcgctcgggcactgcctcaacacgtaccggaactacaaggagagctggagggggctccaggcgcgcggcatggcgcaggacctcagctgggaccacgccgccgagctctacgaggacgtcctcgtcaaggccaagtaccagtggtgagctggtggtatttttcgcgacgcctctggatcccgccgtggatgggcgcgctttttctctagggcggctctgcgtcggagacgctcagacgcatcgcgcgcgttcgcgcccacacgatgactggcacgctgctgctgagacggcggcacgcgatgccatcatgccaccggacggtaggagcaacggtggaagtgaactgtactactggtgctacactgctactacatgagatctgctcttattggtcacgtactcacgttcacgctgaattaccga

SEQ ID NO: 4862 - protein, 694 aa, Oryza sativa
MSGAIASSPAATLFLAGSSSSSPRRRRSRVSGVWWHLYGGTGLRLHWERRGLVRDGAVVCSASAAGGEDGVAKAKTKSAGSSKAVAVQGSTAKADHVEDSVSSPKYVKPAVAKQNGEVVSRATKSDAPVSKPKVDPSVPASKAEADGNAQAVESKAALDKKEDVGVAEPLEAKADAGGDAGAVSSADDSENKESGPLAGPNVMNVIVVASECSPFCKTGGLGDVVGALPKALARRGHRVMVVIPRYGEYAEAKDLGVRKRYRVAGQDSEVSYFHAFIDGVDFVFLEAPPFRHRHNDIYGGERFDVLKRMILFCKAAVEVPWFAPCGGSIYGDGNLVFIANDWHTALLPVCLKAYYRDNGLMQYTRSVLVIHNIAHQGRGPVDDFATMDLPEHYIDHFRLYDPVGGEHSNVFAAGLKMADRAVTVSHGYLWEIKTMDGGWGLHEIINHNDWKLQGIVNGIDMAEWNPEVDEHLQSDGYANYTFETLDTGKKQCKEALQRQLGLQVRDDVPLIGFIGRLDHQKGVDIIGDAMPWIAGQDVQVVMLGTGRPDLEEMLRRFESEHNDKVRGWVGFSVQLAHRITAGADVLLMPSRFEPCGLNQLYAMAYSTVPVVHAVGGLRDTVAPFDPFADTGLGWTFDRAEANRMIDALGHCLNTYRNYKESWRGLQARGMAQDLSWDHAAELYEDVLVKAKYQW

SEQ ID NO: 4863 - DNA, 2903 bp, Oryza sativa
  CDS (86)..(2335)
ccgcgggaggagggctcgccgattccactacttcactccagtaggtggccaacgcgcggggtgggagcagcagcgacgacctccaatggcggcggcggccgtctcctccctcctcgccccttcgggatcctgctactcccccggatgccacagctgctggggtcccgggcccggaggcgggcggcgcctaccttccccgcgccggcgcccgattaccgccgcggctcgccctacttgggcagtgccgaggaggagcaggttggagtgggggcgtgtggaggctcagaattcgggcgctcgcaccagctgccgagcagcactgcaatggctatcatccacggcaaggtcccatgtgaatgttggttatgggtcgccgctggtgttcccaggtttgaccaaaccggggtcaagcaggtgtctatgcgttgttggaatggtcggcaatgcagggaatcaagttggtgacgatagtgatgatggaatcaaggttaccaatgagaagcttcgtgctgttatccgcaagagcaaagaggtgttggagatccatcggaatctacttgagaagatatcggcatcagaaaggaagaagatcacttcaattatagaggacagttccatttataatgagcaagatccatttggtcaaagagatagttctttttatcatcttgatgaagttccagacgatgatgaatttagctatgacctacagatgtaccttgatagacatccagatcaatctgaagttgttgcaactcaggattatgaggcacaactaagtcaaataagtgaaatgggacagtcagttgctgagggcacaagtgatgatccatctgcttcagcttctgtagatcttatcaatatcatattggtagcggcggagtgtgctccttggtccaaaacaggtgggcttggagatgttgctggagctttgccaaaggctttggctaggagaggtcaccgtgtcatggtagtagtgccaatgtataaaaactacgcagaacctcaacagctaggagagccaaggagataccaggttgcagggcaggatatggaggtaatttattatcatgcatacatagatggtgtggattttgttttcattgacaatcctatcttccaccacgttgagaatgacatttatggcggagaccgaacagacatcttaaaacggatggttttgttgtgcaaagcggctatagaggttccatggtatgttccttgtggtggctactgctacggtgatggaaatcttgtgttccttgcaaatgattggcatactgcactactgcctgtttatttgaaggcatactatcatgacaatggtttcatgatatatgcccgttctgttcttgtcatacacaatatagcacatcagggtcgtggcccattagatgacttcagttatctggatttgccagttgattacatggatcttttcaaactttatgacccatttgggggtgatcacctaaacatatttgcagctggtattaaagctgctgaccgtttgcttactgtaagccatggttatgcatgggagctcaaaacagctgaaggtggttggggtcttcatgggatcatcaatgaaagcgattggaaatttcagggcattgtaaatggcattgatacaactgattggaatcctaggtgtgatatccacctaaaatctgatgggtacaccaattattctctagaaacagttcaggcaggtaaacagcaatgtaaggcagcattgcagaaggaacttggtctcccagttcgtggcgatgttcctgtcattgctttcattggacggctagaccatcaaaaaggtgtagaccttatagcagaagcaatgccatggattgctggccaagatgtacagttaataatgttgggcactggacggcaagacctcgaagatacattgaggaggcttgagagccaacattacgatagagttagggggtgggttggtttttccatcaggttggctcatcgaatgacagcaggggctgatatactattgatgccatcaaggtttgagccatgtggattgaatcagctctatgccatgatgtatgggactgtcccagtagtccatgcggtcggtggtcttcgagacaccgttgagcactacaatccctacgaggagtccggacttggttggacttttgaaaaggcagaggcaaacagactgattgatgctctagggcactgcttgaacacgtacaggaactacaggactagttgggagggactccaaaagagagggatgatgcaagatctaagttgggataatgctgctaagctgtatgaggaagtcctcctagctgccaagtatcaatggtgatcagtccaagaagacctcgacggttgttcagtcattcatgaccgaaatgcctttttctcgtgtcagctgctcagatgcggccaccatctagttccatggcttacatcttcctgtgatttggatgaacagagtttttttgtcagatctgacatcattttcaagaaggcacatgatgaacctacttcccaggtgaatacagcagcggacgatgcctttgttggaaggtggcaaaacacatggaagattcagccgtctgccagcatgcacctctgtcctaaggagaggctccaagccccattgtgcgctctggagaggctccaaaccaccattgttcgcccctgggtaggttgttgagctcggttagatgcttttagtacagtagaatagcagatactagcggatagactagttgatatttcccctatgcaccgagtggttcggttgtaccttatttttttcttggctcttgttgtccagttcttcgatctttagacgattagcgtcccgggatttcccagatgacattgacattgatactagtgggaatttcccctgcaaatttactgtc

SEQ ID NO: 4864 - protein, 749 aa, Oryza sativa
MAAAAVSSLLAPSGSCYSPGCHSCWGPGPGGGRRLPSPRRRPITAAARPTWAVPRRSRLEWGRVEAQNSGARTSCRAALQWLSSTARSHVNVGYGSPLVFPGLTKPGSSRCLCVVGMVGNAGNQVGDDSDDGIKVTNEKLRAVIRKSKEVLEIHRNLLEKISASERKKITSIIEDSSIYNEQDPFGQRDSSFYHLDEVPDDDEFSYDLQMYLDRHPDQSEVVATQDYEAQLSQISEMGQSVAEGTSDDPSASASVDLINIILVAAECAPWSKTGGLGDVAGALPKALARRGHRVMVVVPMYKNYAEPQQLGEPRRYQVAGQDMEVIYYHAYIDGVDFVFIDNPIFHHVENDIYGGDRTDILKRMVLLCKAAIEVPWYVPCGGYCYGDGNLVFLANDWHTALLPVYLKAYYHDNGFMIYARSVLVIHNIAHQGRGPLDDFSYLDLPVDYMDLFKLYDPFGGDHLNIFAAGIKAADRLLTVSHGYAWELKTAEGGWGLHGIINESDWKFQGIVNGIDTTDWNPRCDIHLKSDGYTNYSLETVQAGKQQCKAALQKELGLPVRGDVPVIAFIGRLDHQKGVDLIAEAMPWIAGQDVQLIMLGTGRQDLEDTLRRLESQHYDRVRGWVGFSIRLAHRMTAGADILLMPSRFEPCGLNQLYAMMYGTVPVVHAVGGLRDTVEHYNPYEESGLGWTFEKAEANRLIDALGHCLNTYRNYRTSWEGLQKRGMMQDLSWDNAAKLYEEVLLAAKYQW

SEQ ID NO: 4865 - DNA, 1719 bp, Sulfolobus tokodaii
  CDS (1)..(1719)
atggctgaaatgaaaagaatagaagcaatttggtttccagaagaaataaaaagcgtctggatgataacagtagaattatcaaatgttgctagtgttggtggattggggaatgcagtttataatatggctaagggattagctgagcaaggaataaacgtaactgtaataatgcctagtcatggtcgacacttaaatgaccaatatagatcagcgttgaagctaagagaactttctttaacagcatatggagatagaattggaatggacggaaagaggtatccttacgctttaggttttgaagaagggagattagacggatttaatgtgattttagttaaaggacttgattataatactggagtattaattgataattggaacgtttataataacataatggaaaaatcagcattattagctagaggagttcaagcttattctgtcttttctataccgggcaatataccttcggtaattcatgctcatgattggcatgctgtactagctggagtaatggcaaaacaaacttttgagactaggaaagttgtagttccattagtgtttacaatacacttacttaacaaagttggagctccttggcattacgcttcagaagattgggctggattaagcaattgccctcattatatctggcaagttgtttcccataaattatatactacaagacaagtttgggatgagttgtcacaagggttgatagaaaaatttggagcatgggaagctgatgtagtaactacagtaagtaaaagttatcttacatacgacgtttacaattttataggaaactggatagagaacaaaagttgtgtaacttataacggaaccgattggagtattgatgaagttaaaaattacgcaagaaagattttcaatacagaggacagagttgaggtaaggagaagattatataatatgctcgagaatttaagattaattccagaggattatactactggaaacattttatggaataataggtttaggattgggattaaagatgattggacatacacaagattagatgatggtcctttagtcctatttgctggaagacttgtgtatcagaaaggagttgacttacttataagagcttttagggaggtagttaacaagataccaaatgctagattagtaattttaggtctaccttcaggtgattatggcttactctatgacttagtaaataaggcttctgaaattggtggtaacgttaggatcatcgcgtcttattccatgcccaaggatatttacaaattattttactatgctgcatcagtatttgtagtcccttctagatgggaaccttttggaatagtagctcttgaggctatggctgttggcactccagttgttgcctatgccgttggtggccttagagagtctattatagatttaaggagcgacataaataatggaacaggatttattataggaccagaaaacatctgggaattgtataggggtatacttacatcattagctctatctatgagtagtgagactaaaaataagaattacttatatatggatgaccttattttaaagacagacgatacggatttatggaataaagttagacaaaacggaattagaagagttgaggagaattttagatggagtgctactgcaaaatatttaataaattgttatagtaaagcacagactatggctaaatatagggcttcagcatcgttctaa

SEQ ID NO: 4866 - protein, 572 aa, Sulfolobus tokodaii
MAEMKRIEAIWFPEEIKSVWMITVELSNVASVGGLGNAVYNMAKGLAEQGINVTVIMPSHGRHLNDQYRSALKLRELSLTAYGDRIGMDGKRYPYALGFEEGRLDGFNVILVKGLDYNTGVLIDNWNVYNNIMEKSALLARGVQAYSVFSIPGNIPSVIHAHDWHAVLAGVMAKQTFETRKVVVPLVFTIHLLNKVGAPWHYASEDWAGLSNCPHYIWQVVSHKLYTTRQVWDELSQGLIEKFGAWEADVVTTVSKSYLTYDVYNFIGNWIENKSCVTYNGTDWSIDEVKNYARKIFNTEDRVEVRRRLYNMLENLRLIPEDYTTGNILWNNRFRIGIKDDWTYTRLDDGPLVLFAGRLVYQKGVDLLIRAFREVVNKIPNARLVILGLPSGDYGLLYDLVNKASEIGGNVRIIASYSMPKDIYKLFYYAASVFVVPSRWEPFGIVALEAMAVGTPVVAYAVGGLRESIIDLRSDINNGTGFIIGPENIWELYRGILTSLALSMSSETKNKNYLYMDDLILKTDDTDLWNKVRQNGIRRVEENFRWSATAKYLINCYSKAQTMAKYRASASF

SEQ ID NO: 4867 - DNA, 2270 bp, Perilla frutescens
  CDS (172)..(1986)
cttaggaaagggaccattttcctcccgccacgtgtcgtgtagccactagtatattagtagtccctgtattccccatgatttctgaaaaaatcagttcatcgctgatagcgtaaccgctcacaagctctgctcgactcaaagctcacccctgagatttgagtttgtgtcgttatggcaacagtaacagcttcgcagtttgcggcgtacgtgcatggaggagcaacctccgtggattccaagtcaaatttggggcaaattgggcagagggctcaactcatcactcacaatgggctgagatcagtgaacagagctgatgcgctccaaatgagaaacaacgtgaaagtgagtgctaagcgggtcggtcaagttcccatcaacaaagatcgatgtgaaacttcagggatgaccttgattttcgtgtcggccgagtgcggtccatggagcaaaaccggtggcctcggtgatgttgtgggtggattgccccctgccttggcggcaaatagacacagagtgatgactgtgtctccgcgttatgatcagtacaaagatgcttgggacacttctgtggttgttgagattcaagttggagacaaagtcgaaactgttggattcttccattgctacaagcgtggagttgatcgtgtttttgtcgatcaccctttgttcttggagaaggtctggggtaaaactaaatccaaggtttatggtccttctgctggagtcgattacgaggataatcaactgcggttcagcttgctgtccttggctgctttggaggctcctagggtgttgaatctaaccagcaacaagtatttctccggaccgtatggtgaggatgttgtcttcgttgctaatgactggcacaccgctgtgcttccgtgctacctgaaaaccatttaccaacctaagggaatctacacgaacgctaaggttgtcttgtgcatccacaacattgcatatcagggaagatttgcattctcggacttctataagcttaatctgcctgatcaactcaagagctctttcgatttcatggatgggtatgaaaaaccagtgaagggaaggaaaataaactggatgaaggctggaattatagaatcagacagagttctgactgtgagcccgtactacgccaatgaactcgtttctggtcctgataaaggagttgagttggataacatcctccgtaagtgtaccgtcaccggcatcgtgaatggcatggatactcaagagtggaacccggcgacggataaatacatcgataatcactatgatattaccactgttatggatggtaagccattgttgaaggaagctcttcaagcagaagtgggtttgcctgttgataggaatgttcctcttgttggatttatcggcagacttgaagagcagaaaggatcagacatcctggtggctgcgctgcataaatttattgagatggatgtgcaagtggtcatccttggaacggggaagaaggagttcgagaagcagatcgagcaactcgaggagttgtacccgggtaaagctgtaggagtggcgaagttcaatgtaccgttggcccataagataactgctggtgctgattttatgttggttcctagtagatttgaaccatgcggtctcatccaattacatgccatgagatatggaacaatacccatctgtgcttcaactggtggtctcgtggacaccgtgaaagaaggattcactggattccatatgggagcttttaatgttgagtgtgatgcggttgacccggccgacgtgttgaagatagtgaaaactgttgggagagctctggaagtgtatggcacccctgcattcagagaaatgataaataactgcatgtcactcgatctctcctggaagggacctgcaaagaactgggaaacggtgctgctgagcttgggcgtggccgggagcgaacccggtgttgaaggcgatgaaatcgctccgcttgccaaggaaaacgttgccactccttgaagaatgaagatgatatatctatctagtatctatatggaattgcatggtttaaactatatatatatgccccatgcatggctctctacctacttactactactaacacatcataacccttgcttgccattctccgttctccattctccattctcaactaactaataaacttctcacaccatctattcttcttccataatatctgtaggtgttatgtaacgcccactaatttttataaaatgaagagtctcatgtttggtttccaaaaaaaaaaaaaaaaaaaaaaa

SEQ ID NO: 4868 - protein, 604 aa, Perilla frutescens
MATVTASQFAAYVHGGATSVDSKSNLGQIGQRAQLITHNGLRSVNRADALQMRNNVKVSAKRVGQVPINKDRCETSGMTLIFVSAECGPWSKTGGLGDVVGGLPPALAANRHRVMTVSPRYDQYKDAWDTSVVVEIQVGDKVETVGFFHCYKRGVDRVFVDHPLFLEKVWGKTKSKVYGPSAGVDYEDNQLRFSLLSLAALEAPRVLNLTSNKYFSGPYGEDVVFVANDWHTAVLPCYLKTIYQPKGIYTNAKVVLCIHNIAYQGRFAFSDFYKLNLPDQLKSSFDFMDGYEKPVKGRKINWMKAGIIESDRVLTVSPYYANELVSGPDKGVELDNILRKCTVTGIVNGMDTQEWNPATDKYIDNHYDITTVMDGKPLLKEALQAEVGLPVDRNVPLVGFIGRLEEQKGSDILVAALHKFIEMDVQVVILGTGKKEFEKQIEQLEELYPGKAVGVAKFNVPLAHKITAGADFMLVPSRFEPCGLIQLHAMRYGTIPICASTGGLVDTVKEGFTGFHMGAFNVECDAVDPADVLKIVKTVGRALEVYGTPAFREMINNCMSLDLSWKGPAKNWETVLLSLGVAGSEPGVEGDEIAPLAKENVATP

SEQ ID NO: 4869 - DNA, 1701 bp, Sulfolobus acidocaldarius
  CDS (1)..(1701)
atgaagagatatgaaagcctatggtttgaggacgaactaaagcacgtctggatgatcagtgccgagctagagaaagtagctagtctagggggattgggaccagtagtatataatcttggtaaagaattagttaagcagggtataaaagtaactgtaatcatgccaagccatggtcgtcatcttaatgactattataggtcactccttaaattgaacgaaatatctttagtcgcagaaggagatagaataggtattgatggtaaatcttatcactacaagctagggtttgaacatggaaatttggatggaatgaacgtggttttaattaaaggactggattacaacacgggaaggataattgattcatggaacatttacgataacgccatggagaaatcttcacttctggctagggctgtcgagaagtatgcaaagttctcaatacctaatgacataccgtccataatacacgtacatgattggcactctgtaattgcaggtgtgactgctaaatttacatttgaggctaggagagtaatagttcctctagtatttacagttcacctgttaaacaaggtcagtgcaccttggcattacgcgtcagaagattggagtggactgatgaattatccacattacatttggagaataataaaacatgacttgtacacaactagagaagtgtgggatttcttctcttctggttccatagaaaagtttggttcttatgaggctgatctaataacatcagttagtaaaagctacctaacatatgatatatttaacttcataggaaactggatagagaacaagagttgtatccattataacggtactgattgggaagtagaggagactaaaaagtacgcttacagcaagtttgggactgaggatagggctgaaataagaaaaaggttatttgacgaactagaagtcctaagagtaacccctgaggattacactacaggtaacatactttggaataacagattcaatataggtataaaggatgactggacatatagtagactagaaaacggtcctctaattctatttgcaggaagaatggtttatcagaagggaatagactcattactcatagcatttgatgaagtacttaagaccattaacaatgcccgtctaataatattaggattaccctcctcagactatggattactacaaaatgtggtatctaatatatctagacacggtggtaacattaggataatcctaggcaaaatgagtaaggaactgtacaggctcttctactatagtgcctcagtgtttgtgataccctcaagatgggaaccatttgggctagttgcagtagagtcaatggctgtaggaaccccggtagttgcatactcggtaggcgggctgagagagagtatagtagacatcagggttgaccaagagcagggaacaggactactggtagaaccggaaaatgtctgggaactatcaaaagcgttaatttctgctttatcattgtctatggcttcagaaacaaacaatggagattttctaaaatatactgaagttaagacgaatgatgtgaagttatgggacaaaataaggcaaaattgtgtaaggagagttaatgagaatttcagatggtcagcaagtgctaagcagttacaggagtgctattctaaggctcagaccatggcgaaatatagactgttagcatcattttaa

SEQ ID NO: 4870 - protein, 566 aa, Sulfolobus acidocaldarius
MKRYESLWFEDELKHVWMISAELEKVASLGGLGPVVYNLGKELVKQGIKVTVIMPSHGRHLNDYYRSLLKLNEISLVAEGDRIGIDGKSYHYKLGFEHGNLDGMNVVLIKGLDYNTGRIIDSWNIYDNAMEKSSLLARAVEKYAKFSIPNDIPSIIHVHDWHSVIAGVTAKFTFEARRVIVPLVFTVHLLNKVSAPWHYASEDWSGLMNYPHYIWRIIKHDLYTTREVWDFFSSGSIEKFGSYEADLITSVSKSYLTYDIFNFIGNWIENKSCIHYNGTDWEVEETKKYAYSKFGTEDRAEIRKRLFDELEVLRVTPEDYTTGNILWNNRFNIGIKDDWTYSRLENGPLILFAGRMVYQKGIDSLLIAFDEVLKTINNARLIILGLPSSDYGLLQNVVSNISRHGGNIRIILGKMSKELYRLFYYSASVFVIPSRWEPFGLVAVESMAVGTPVVAYSVGGLRESIVDIRVDQEQGTGLLVEPENVWELSKALISALSLSMASETNNGDFLKYTEVKTNDVKLWDKIRQNCVRRVNENFRWSASAKQLQECYSKAQTMAKYRLLASF

SEQ ID NO: 4871 - DNA, 2793 bp, Triticum aestivum
  CDS (135)..(2531)
gcactccagtccagtccagcccactgccgcgctactccccactcccactgccaccacctccgcctgcgccgcgctctgggcggaccaacccgcgcatcgtatcacgatcacccaccccgatcccggccgccgccatgtcgtcggcggtcgcgtccgccgcgtccttcctcgcgctcgcgtccgcctcccccgggagatcacggaggaggacgagggtgagcgcgtcgccaccccacaccggggctggcaggttgcactggccgccgtcgccgccgcagcgcacggctcgcgacggagcagtggccgcgcgcgccgccgggaagaaggacgcggggatcgacgacgccgcgcccgcgaggcagccccgcgcactccgcggtggcgccgccaccaaggttgcggagcggagggatcccgtcaagacgctcgatcgcgacgccgcggaaggtggcgcgccgtccccgccggcaccgaggcaggaggacgcccgtctgccgagcatgaacggcatgccggtgaacggtgaaaacaaatctaccggcggcggcggcgcgactaaagacagcgggctgcccgcacccgcacgcgcgccccagccgtcgagccagaacagagtaccggtgaatggtgaaaacaaagctaacgtcgcctcgccgccgacgagcatagccgaggtcgcggctccggatcccgcagctaccatttccatcagtgacaaggcgccagagtccgttgtcccagccgagaaggcgccgccgtcgtccggctcaaatttcgtgccctcggcttctgctcccgggtctgacactgtcagcgacgtggaacttgaactgaagaagggtgcggtcattgtcaaagaagctccaaacccaaaggctctttcgccgcctgcagcacccgctgtacaacaagacctttgggacttcaagaaatacattggtttcgaggagcccgtggaggccaaggatgatggccgggctgttgcagatgatgcgggctccttcgaacaccaccagaatcacgattccgggcctttggcaggggagaacgtcatgaacgtggtcgtcgtggctgctgaatgttctccctggtgcaaaacaggtggtcttggagatgttgccggtgctttgcccaaggctttggcgaagagaggacatcgtgttatggttgtggtaccaaggtatggggactatgaggaagcctacgatgtcggagtccgaaaatactacaaggctgctggacaggatatggaagtgaattatttccatgcttatatcgatggagttgattttgtgttcattgacgctcctctcttccgacaccgccaggaagacatttatgggggcagcagacaggaaattatgaagcgcatgattttgttctgcaaggccgctgtcgaggttccatggcacgttccatgcggcggtgtcccttatggggatggaaatctggtgtttattgcaaatgattggcacacggcactcctgcctgtctatctgaaagcatattacagggaccatggtttgatgcagtacactcggtccattatggtgatacataacatcgctcaccagggccgtggcccagtagatgagttcccgttcaccgagttgcctgagcactacctggaacacttcagactgtacgaccccgtgggtggtgaacacgccaactacttcgccgccggcctgaagatggcggaccaggttgtcgtcgtgagcccggggtacctgtgggagctgaagacggtggagggcggctgggggcttcacgacatcatacggcagaacgactggaagacccgcggcatcgtgaacggcatcgacaacatggagtggaaccccgaggtggacgtccacctcaagtcggacggctacaccaacttctccctggggacgctggactccggcaagcggcagtgcaaggaggccctgcagcgggagctgggcctgcaggtccgcggcgacgtgccgctgctcggcttcatcgggcgcctggacgggcagaagggcgtggagatcatcgcggacgcgatgccctggatcgtgagccaggacgtgcagctggtcatgctgggcaccgggcgccacgacctggagggcatgctgcggcacttcgagcgggagcaccacgacaaggtgcgcgggtgggtggggttctccgtgcggctggcgcaccggatcacggccggcgccgacgcgctcctcatgccctcccggttcgagccgtgcggactgaaccagctctacgccatggcctacggcaccgtccccgtcgtgcatgccgtcggcggcctgagggacaccgtgccgccgttcgaccccttcaaccactccgggctcgggtggacgttcgaccgcgcagaggcgcagaagctgatcgaggcgctcgggcactgcctccgcacctaccgggactacaaggagagctggagggggctccaggagcgcggcatgtcgcaggacttcagctgggagcatgccgccaagctctacgaggacgtcctcgtcaaggccaagtaccagtggtgaacgctagctgctagccggtccagccccgcatgcgtgcatgacaggatggaattgcgcattgcgcacgcaggaatgtgccatggagcgccggcatccgcgaagtacagtgacatgaggtgtgtgtggttgagacgctgattccgatctggtccgtagcagagtagagcggaggtagggaagcgctccttgttacaggtatatgggaatgttgttaacttggtattgtaatttgttatgttgtgtgcattattacaaagggcaa

SEQ ID NO: 4872 - protein, 798 aa, Triticum aestivum
MSSAVASAASFLALASASPGRSRRRTRVSASPPHTGAGRLHWPPSPPQRTARDGAVAARAAGKKDAGIDDAAPARQPRALRGGAATKVAERRDPVKTLDRDAAEGGAPSPPAPRQEDARLPSMNGMPVNGENKSTGGGGATKDSGLPAPARAPQPSSQNRVPVNGENKANVASPPTSIAEVAAPDPAATISISDKAPESVVPAEKAPPSSGSNFVPSASAPGSDTVSDVELELKKGAVIVKEAPNPKALSPPAAPAVQQDLWDFKKYIGFEEPVEAKDDGRAVADDAGSFEHHQNHDSGPLAGENVMNVVVVAAECSPWCKTGGLGDVAGALPKALAKRGHRVMVVVPRYGDYEEAYDVGVRKYYKAAGQDMEVNYFHAYIDGVDFVFIDAPLFRHRQEDIYGGSRQEIMKRMILFCKAAVEVPWHVPCGGVPYGDGNLVFIANDWHTALLPVYLKAYYRDHGLMQYTRSIMVIHNIAHQGRGPVDEFPFTELPEHYLEHFRLYDPVGGEHANYFAAGLKMADQVVVVSPGYLWELKTVEGGWGLHDIIRQNDWKTRGIVNGIDNMEWNPEVDVHLKSDGYTNFSLGTLDSGKRQCKEALQRELGLQVRGDVPLLGFIGRLDGQKGVEIIADAMPWIVSQDVQLVMLGTGRHDLEGMLRHFEREHHDKVRGWVGFSVRLAHRITAGADALLMPSRFEPCGLNQLYAMAYGTVPVVHAVGGLRDTVPPFDPFNHSGLGWTFDRAEAQKLIEALGHCLRTYRDYKESWRGLQERGMSQDFSWEHAAKLYEDVLVKAKYQW

SEQ ID NO: 4873 - DNA, 5346 bp, Triticum aestivum
  CDS (29)..(4915)
cggcacgaggtttagtaggttccgggaaatggagatgtctctctggccacggagccccctgtgccctcggagcaggcagccgctcgtcgtcgtccggccggccggccgcggcggcctcacgcagccttttttgatgaatggcagatttactcgaagcaggacccttcgatgcatggtagcaagttcagatcctcctaataggaaatcaagaaggatggtaccacctcaggttaaagtcatttcttctagaggatatacgacaagactcattgttgaaccaagcaacgagaatacagaacacaataatcgggatgaagaaactcttgatacatacaatgcgctattaagtaccgagacagcagaatggacagataatagagaagccgagactgctaaagcggactcgtcgcaaaatgctttaagcagttctataattggggaagtggatgtggcggatgaagatatacttgcggctgatctgacagtgtattcattgagcagtgtaatgaagaaggaagtggatgcagcggacaaagctagagttaaagaagacgcatttgagctggatttgccagcaactacattgagaagtgtgatagtagatgtgatggatcataatgggactgtacaagagacattgagaagtgtgatagtagatgtgatggatcataatgggactgtacaagagacattgagaagtgtgatagtagatgtgatggatgatgcggcggacaaagctagagttgaagaagacgtatttgagctggatttgtcaggaaatatttcaagcagtgcgacgaccgtggaactagatgcggttgacgaagtcgggcctgttcaagacaaatttgaggcgacctcatcaggaaatgtttcaaacagtgcaacggtacgggaagtggatgcaagtgatgaagctgggaatgatcaaggcatatttagagcagatttgtcaggaaatgttttttcaagcagtacaacagtggaagtgggtgcagtggatgaagctgggtctataaaggacaggtttgagacggattcgtcaggaaatgtttcaacaagtgcgccgatgtgggatgcaattgatgaaaccgtggctgatcaagacacatttgaggcggatttgtcgggaaatgcttcaagctgcgcaacatacagagaagtggatgatgtggtggatgaaactagatcagaagaggaaacatttgcaatggatttgtttgcaagtgaatcaggccatgagaaacatatggcagtggattatgtgggtgaagctaccgatgaagaagagacttaccaacagcaatatccagtaccgtcttcattctctatgtgggacaaggctattgctaaaacaggtgtaagtttgaatcctgagctgcgacttgtcagggttgaagaacaaggcaaagtaaattttagtgataaaaaagacctgtcaattgatgatttaccaggacaaaaccaatcgatcattggttcctataaacaagataaatcaattgctgatgttgcgggaccgacccaatcaatttttggttctagtaaacaacaccggtcaattgttgctttccccaaacaaaaccagtcaattgttagtgtcactgagcaaaagcagtccatagttggattccgtagtcaagatctttcggctgttagtctccctaaacaaaacgtaccaattgttggtacgtcgagagagggtcaaacaaagcaagttcctgttgttgatagacaggatgcattgtatgtgaatggactggaagctaaggagggagatcacacatccgagaaaactgatgaggatgcgcttcatgtaaagtttaatgttgacaatgtgttgcggaagcatcaggcagatagaacccaagcagtggaaaagaaaacttggaagaaagttgatgaggaacatctttacatgactgaacatcagaaacgtgctgccgaaggacagatggtagttaacgaggatgagctttctataactgaaattggaatggggagaggtgataaaattcagcatgtgctttctgaggaagagctttcatggtctgaagatgaagtgcagttaattgaggatgatggacaatatgaagttgacgagacctctgtgtccgttaacgttgaacaagatatccaggggtcaccacaggatgttgtggatccgcaagcactaaaggtgatgctgcaagaactcgctgagaaaaattattcgatgaggaacaagctgtttgtttttccagaggtagtgaaagctgattcagttattgatctttatttaaatcgtgacctaacagctttggcgaatgaacccgatgtcgtcatcaaaggagcattcaatggttggaaatggaggcttttcactgaaagattgcacaagagtgaccttggaggggtttggtggtcttgcaaactgtacatacccaaggaggcctacagattagactttgtgttcttcaacggtcgcacggtctatgagaacaatggcaacaatgatttctgtataggaatagaaggcactatgaatgaagatctgtttgaggatttcttggttaaagaaaagcaaagggagcttgagaaacttgccatggaagaagctgaaaggaggacacagactgaagaacagcggcgaagaaaggaagcaagggctgcagatgaagctgtcagggcacaagcgaaggccgagatagagatcaagaagaaaaaattgcaaagtatgttgagtttggccagaacatgtgttgataatttgtggtacatagaggctagcacagatacaagaggagatactatcaggttatattataacagaaactcgaggccacttgcgcatagtactgagatttggatgcatggtggttacaacaattggacagatggactctctattgttgaaagctttgtcaagtgcaatgacaaagacggcgattggtggtatgcagatgttattccacctgaaaaggcacttgtgttggactgggtttttgctgatgggccagctgggaatgcaaggaactatgacaacaatgctcgacaagatttccatgctattcttccgaacaacaatgtaaccgaggaaggcttctgggcgcaagaggagcaaaacatctatacaaggcttctgcaagaaaggagagaaaaggaagaaaccatgaaaagaaaggctgagagaagtgcaaatatcaaagctgagatgaaggcaaaaactatgcgaaggtttctgctttcccagaaacacattgtttataccgaaccgcttgaaatacgtgccggaaccacagtggatgtgctatacaatccctctaacacagtgctaaatggaaagtcggagggttggtttagatgctcctttaacctttggatgcattcaagtggggcattgccaccccagaagatggtgaaatcaggggatgggccgctcttaaaagcaacagttgatgttccaccggatgcctatatgatggactttgttttctccgagtgggaagaagatgggatctatgacaacaggaatgggatggactatcatattcctgtttctgattcaattgaaacagagaattacatgcgtattatccacattgccgttgagatggcccccgttgcaaaggttggaggtcttggggatgttgttacaagtctttcacgtgccattcaagatctaggacatactgtcgaggttattctcccgaagtacgactgtttgaaccaaagcagtgtcaaggatttacatttatatcaaagtttttcttggggtggtacagaaataaaagtatgggttggacgagtcgaagacctgaccgtttacttcctggaacctcaaaatgggatgtttggcgttggatgtgtatatggaaggaatgatgaccgcagatttgggttcttctgtcattctgctctagagtttatcctccagaatgaattttctccacatataatacattgccatgattggtcaagtgctccggtcgcctggctatataaggaacactattcccaatccagaatggcaagcactcgggttgtatttaccatccacaatcttgaatttggagcacattatattggtaaagcaatgacatactgtgataaagccacaactgtttctcctacatattcaagggacgtggcaggccatggcgccattgctcctcatcgtgagaaattctacggcattctcaatggaattgatccagatatctgggatccgtacactgacaattttatcccggtcccttatacttgtgagaatgttgtcgaaggcaagagagctgcaaaaagggccttgcagcagaagtttggattacagcaaactgatgtccctattgtcggaatcatcacccgtctgacagcccagaagggaatccacctcatcaagcacgcaattcaccgaactctcgaaagcaacggacatgtggttttgcttggttcagctccagatcatcgaatacaaggcgatttttgcagattggccgatgctcttcatggtgtttaccatggtagggtgaagcttgttctaacctatgatgagcctctttctcacctgatatacgctggctcggacttcataattgttccttcaatcttcgaaccctgtggcttaacacaacttgttgccatgcgttatggatcgatccctatagttcggaaaactggaggacttcacgacacagtcttcgacgtagacaatgataaggaccgggctcggtctcttggtcttgaaccaaatgggttcagtttcgacggagccgacagcaatggcgtggattatgccctcaacagagcaatcggcgcttggttcgatgcccgtgattggttccactccctgtgtaagagggtcatggagcaagactggtcgtggaaccggcccgcactggactacattgaattgtaccatgccgctcgaaaattctgacacccaactgaaccaatgacaagaacaagcgcattgtgggatcgactagtcatacagggctgtgcagatcgtcttgcttcagttagtgccctcttcagttagttccaagcgcactacagtcgtacatagctgaggatcctcttgcctcctaccagggggaacaaagcagaaatgcatgagtgcattgggaagacttttatgtatattgttaaaaaaatttccttttcttttccttccctgcacctggaaatggttaagcgcatcgccgagataagaaccgcagtgacattctgtgagtagctttgtatattctctcatcttgtgaaaactaatgttcatgttaggctgtctgatcatgtggaagctttgttatatgttacttatggtatacatcaatgatatttacatttgtggaaaaaaaaaaaaaaaaa

SEQ ID NO: 4874 - protein, 1628 aa, Triticum aestivum
MEMSLWPRSPLCPRSRQPLVVVRPAGRGGLTQPFLMNGRFTRSRTLRCMVASSDPPNRKSRRMVPPQVKVISSRGYTTRLIVEPSNENTEHNNRDEETLDTYNALLSTETAEWTDNREAETAKADSSQNALSSSIIGEVDVADEDILAADLTVYSLSSVMKKEVDAADKARVKEDAFELDLPATTLRSVIVDVMDHNGTVQETLRSVIVDVMDHNGTVQETLRSVIVDVMDDAADKARVEEDVFELDLSGNISSSATTVELDAVDEVGPVQDKFEATSSGNVSNSATVREVDASDEAGNDQGIFRADLSGNVFSSSTTVEVGAVDEAGSIKDRFETDSSGNVSTSAPMWDAIDETVADQDTFEADLSGNASSCATYREVDDVVDETRSEEETFAMDLFASESGHEKHMAVDYVGEATDEEETYQQQYPVPSSFSMWDKAIAKTGVSLNPELRLVRVEEQGKVNFSDKKDLSIDDLPGQNQSIIGSYKQDKSIADVAGPTQSIFGSSKQHRSIVAFPKQNQSIVSVTEQKQSIVGFRSQDLSAVSLPKQNVPIVGTSREGQTKQVPVVDRQDALYVNGLEAKEGDHTSEKTDEDALHVKFNVDNVLRKHQADRTQAVEKKTWKKVDEEHLYMTEHQKRAAEGQMVVNEDELSITEIGMGRGDKIQHVLSEEELSWSEDEVQLIEDDGQYEVDETSVSVNVEQDIQGSPQDVVDPQALKVMLQELAEKNYSMRNKLFVFPEVVKADSVIDLYLNRDLTALANEPDVVIKGAFNGWKWRLFTERLHKSDLGGVWWSCKLYIPKEAYRLDFVFFNGRTVYENNGNNDFCIGIEGTMNEDLFEDFLVKEKQRELEKLAMEEAERRTQTEEQRRRKEARAADEAVRAQAKAEIEIKKKKLQSMLSLARTCVDNLWYIEASTDTRGDTIRLYYNRNSRPLAHSTEIWMHGGYNNWTDGLSIVESFVKCNDKDGDWWYADVIPPEKALVLDWVFADGPAGNARNYDNNARQDFHAILPNNNVTEEGFWAQEEQNIYTRLLQERREKEETMKRKAERSANIKAEMKAKTMRRFLLSQKHIVYTEPLEIRAGTTVDVLYNPSNTVLNGKSEGWFRCSFNLWMHSSGALPPQKMVKSGDGPLLKATVDVPPDAYMMDFVFSEWEEDGIYDNRNGMDYHIPVSDSIETENYMRIIHIAVEMAPVAKVGGLGDVVTSLSRAIQDLGHTVEVILPKYDCLNQSSVKDLHLYQSFSWGGTEIKVWVGRVEDLTVYFLEPQNGMFGVGCVYGRNDDRRFGFFCHSALEFILQNEFSPHIIHCHDWSSAPVAWLYKEHYSQSRMASTRVVFTIHNLEFGAHYIGKAMTYCDKATTVSPTYSRDVAGHGAIAPHREKFYGILNGIDPDIWDPYTDNFIPVPYTCENVVEGKRAAKRALQQKFGLQQTDVPIVGIITRLTAQKGIHLIKHAIHRTLESNGHVVLLGSAPDHRIQGDFCRLADALHGVYHGRVKLVLTYDEPLSHLIYAGSDFIIVPSIFEPCGLTQLVAMRYGSIPIVRKTGGLHDTVFDVDNDKDRARSLGLEPNGFSFDGADSNGVDYALNRAIGAWFDARDWFHSLCKRVMEQDWSWNRPALDYIELYHAARKF

SEQ ID NO: 4875 - DNA, 2502 bp, Arabidopsis thaliana
  CDS (1)..(2379)
atggcatcagttgccgagagctcttttcctcttctctgtcaaatcaagactcagcgtcgcatcaattcctctacgctgaggcattcccgtgtttcttaccatgatttgccttctggctcgctgtcttttcgttctcggagctttgttctgggacatcgatgcaagtgtgtgagccgcgtcgaggcttccggctcagacgatgatgagccagaggatgcgcttcaggctaccattgacaagagcaagaaggttcttgctatgcaaaggaaccttcttcaccagattgctgaaaggaggaagctggtctcatctattaaagagagcacacctgacttggatgatgcaaaagcttcttccaaacaagagtctgcttcttctgtgaatgctaatactgatgctactaaaaaagaaattatggatggagatgcaaacggtagtgttagtccaagcacttatggcaagtcatctttaagtaaagaaccagaagctaagactttctctcccagtactgaatccttgaagaaccgcaaacaaagctcggcctctgtgatatcttcttcccctgtaacctctcctcagaaaccatccgatgtagccactaatgggaagccttggtctagcgtagtagcgtctagtgtagatcctccttataaaccttcatctgttatgacctctcctgagaaaacttctgatcctgtaacttctcctggaaagccaagtaaatctcgcgctggtgcattttggtcagatccactaccgtcttatctgactaaagctcctcaaacatcaactatgaagacagagaagtacgtggaaaaaacacctgacgtagctagtagtgaaactaacgaacctggcaaggatgaagagaagccgcctccactggctggagcaaatgtcatgaatgtgatattggtagcagcagagtgtgctccattttcgaaaacaggtggccttggagatgtagctggtgctttaccaaagtctttggctaggcgtggacacagggttatggttgtggttcctcggtatgccgagtatgctgaagccaaagatttaggggtacggaagagatataaggtggccgggcaggatatggaagtaatgtacttccatgcatttatagatggtgtggattttgttttcattgatagccctgaatttcggcatctgagtaataacatttatggtggaaaccgacttgatatcttgaagcggatggttttattttgcaaggctgctgttgaggttccgtggtatgttccttgtggaggtgtgtgttatggtgatggaaatttggcttttatagcaaatgattggcacactgcgttactaccggtgtacctgaaggcctattaccgggatcacggaataatgaaatacacacgatctgttcttgtaattcataacattgctcatcaggggcggggaccggtagatgatttctcctacgtggatttaccgagccattacttggatagcttcaagttatatgacccagtaggaggtgagcacttcaatatttttgcagctggtctaaaagctgcggatagagttctcactgttagccatggatactcctgggaggttaagaccttagaaggaggttggggtctgcataacatcataaatgaaaacgactggaaatttagaggaattgtgaacggtatcgatacacaagaatggaacccagaatttgatacttacttgcactctgatgattataccaactattccttggagaatcttcacattggtaaaccccaatgtaaagctgcattacagaaagagctcggtttgcctgttcggcctgatgttccgctgatcggttttattggaagattggatcaccagaaaggtgttgatttgatagctgaggcggttccatggatgatgagtcaggatgttcagctggttatgttaggcacagggcgaccggatcttgaagaggtcctcagacaaatggagcatcaatatcgagataaagcacggggatgggttggattctcggttaaaacagcacacagaataacagctggtgcagacatattgctgatgccttctagatttgagccgtgtggtctaaaccagctttacgcaatgaactatggaaccattccggtggtccatgccgtgggaggattgagggatacagttcaacaatttgatccctatagtgaaacgggtcttggttggacatttgatagcgcggaagcaggtaagttgattcatgccttaggaaactgtttgttgacatatagagagtataaggagagttgggaagggcttcagagaagaggaatgacacaggatttgagttgggataatgctgcagagaagtacgaagaagttcttgttgctgctaagtatcattggtgagttaaataaaagttaccttttttactgtctataaagaacatgtctttggaattgttaagaagcttagttgtgtagatttggtgataaagctacattggagcttggcaaattctcatgccatgt

SEQ ID NO: 4876 - protein, 792 aa, Arabidopsis thaliana
MASVAESSFPLLCQIKTQRRINSSTLRHSRVSYHDLPSGSLSFRSRSFVLGHRCKCVSRVEASGSDDDEPEDALQATIDKSKKVLAMQRNLLHQIAERRKLVSSIKESTPDLDDAKASSKQESASSVNANTDATKKEIMDGDANGSVSPSTYGKSSLSKEPEAKTFSPSTESLKNRKQSSASVISSSPVTSPQKPSDVATNGKPWSSVVASSVDPPYKPSSVMTSPEKTSDPVTSPGKPSKSRAGAFWSDPLPSYLTKAPQTSTMKTEKYVEKTPDVASSETNEPGKDEEKPPPLAGANVMNVILVAAECAPFSKTGGLGDVAGALPKSLARRGHRVMVVVPRYAEYAEAKDLGVRKRYKVAGQDMEVMYFHAFIDGVDFVFIDSPEFRHLSNNIYGGNRLDILKRMVLFCKAAVEVPWYVPCGGVCYGDGNLAFIANDWHTALLPVYLKAYYRDHGIMKYTRSVLVIHNIAHQGRGPVDDFSYVDLPSHYLDSFKLYDPVGGEHFNIFAAGLKAADRVLTVSHGYSWEVKTLEGGWGLHNIINENDWKFRGIVNGIDTQEWNPEFDTYLHSDDYTNYSLENLHIGKPQCKAALQKELGLPVRPDVPLIGFIGRLDHQKGVDLIAEAVPWMMSQDVQLVMLGTGRPDLEEVLRQMEHQYRDKARGWVGFSVKTAHRITAGADILLMPSRFEPCGLNQLYAMNYGTIPVVHAVGGLRDTVQQFDPYSETGLGWTFDSAEAGKLIHALGNCLLTYREYKESWEGLQRRGMTQDLSWDNAAEKYEEVLVAAKYHW

SEQ ID NO: 4877 - DNA, 2592 bp, Sorghum bicolor
  CDS (59)..(1948)
cctcactttctccgcgccatccacggcacccgcgccctcctgctgctccctctccgcaatggcgacgccctcggccgtgggcgccgcgtgcctcgtcctagcgcgagccgccgccgggcttgggcttgggcccgggcggggcggcgatcgggcgcgcccgcgccggttccagcgcgtggtgcgcaggcggtgcgtcgcggagctgagcagggagggtcccgcgccgacgccgcgcccgctgccacccgcgctgctggcgcccccgctcgtgcccgccttcctcgcgccgccgtccgagcccgagggtgagccggcgtcgacaccgccgcccctgcccgacgccggtctcggcgacctcggtctccaacctgaagggattgctgagggttccatcgatgagacagtagttgtggcaagtgagcaagattctgagatcgtggttggaaaggagcaagctcgagctaaagtaacacaaagcattgtctttgtaactggcgaagcttctccttatgcaaagtctgggggtctaggagatgtttgtggttcattgccagttgctcttgctgctcgtggtcaccgtgtgatggttgtaatgcccagatatttaaatggtacctctgataagaattacgcaaatgcattttacacagaaaagcacattcggattccatgctttggcggtgaacatgaagttacctttttccatgagtacagagattcagttgactgggtgtttgttgatcatccctcatatcacagacctggaaatttatatggagataagtttggtgcttttggtgataatcagttcagatacacgctcctttgctatgctgcatgtgaggctcctttggtccttgaattgggaggatatatttatggacagaattgcatgtttgttgtgaatgattggcatgccagtctagtgccagtccttcttgctgcaaaatatagaccatatggtgtttataaagactcccgcagcattcttgtaatacataatttagcacatcagggtgtagagcctgcaagcacatatcctgaccttgggttgccacctgaatggtatggagctctggagtgggtattccctgaatgggcaaggaggcatgcccttgacaagggtgaggcagttaattttttgaaaggtgcagttgtgacagcagatcgaattgtgactgtcagtaagggttattcatgggaggtcacaactgctgaaggtggacagggtctcaatgagctcttaagctcccgaaagagtgtattaaacggaattgtaaatggaattgacattaatgattggaaccctgcgacggacaaatgtatcccttgtcattattctgttgatgacctctctggaaaagccaaatgtaaaagtgcattgcagaaggagctgggtttacctataaggcctgaagttcctctgattggttttattggaagattggattatcagaaaggcattgatctcattcaacttatcataccacatctcatgcgggacgacgttcaatttgtcatgcttggatctggtgacccagagctcgaagactggatgagatctacagagtcggacttcaaggataaatttcgtggatgggttggatttagtgttccagtttcccaccgaataactgccggctgcgatatattgttaatgccatccagattcgaaccttgtggtctcaatcagctatatgctatgcagtatggcacagttcctgttgtccatgcaactgggggccttagagatactgtggagaacttcaaccctttcggtgagaatggagaacagggtacagggtgggcattcgcacccctaaccacggaaaacatgtttgtggacattgcgaactgcaatttcgacatacaaggagcacaaatcttcctgggaagggctcatgaagaggggcatgtcaaaagacttcacgtgggaccatgccgctgaacaatacgaacaaatcttccagtgggccttcatcgatcgaccctatgtcatgtaaaggggaccacaagtggtgtgtccttaaagatcttcagttcttcatcctacagtggaaggatgagaaaacccctgtacattacatggaaggcggaccggctgttgggtggctccaatgtccaggttagccttacggagcctgctgctttggctggtttgtcccaaaggaccgtgatgcagtgaggaccagttgaacgacagttttgaagaataagaaggggatgctggaagcagtcgtgcaggcagcctcgcagtgatacatatggattatggaacaaactggagtcagtttctgctttgccactcactgtttaccttaagattattaccctgttgttgtcctttgttcgttagggcttataacttaatgactcatagaaaaccattccttgtttttcttgaccacttctgtgcgttctcggccgtttactagagatggccattgctgatggccgtttactatatatcgaaagcgtagctatgatggtatggaggaatcctgtaaagcgcatggtgttggactgttggtgtatgccttgtgtcccagcacgggtttccatgtttcaggtgctttatacttgtcgtgacca

SEQ ID NO: 4878 - protein, 629 aa, Sorghum bicolor
MATPSAVGAACLVLARAAAGLGLGPGRGGDRARPRRFQRVVRRRCVAELSREGPAPTPRPLPPALLAPPLVPAFLAPPSEPEGEPASTPPPLPDAGLGDLGLQPEGIAEGSIDETVVVASEQDSEIVVGKEQARAKVTQSIVFVTGEASPYAKSGGLGDVCGSLPVALAARGHRVMVVMPRYLNGTSDKNYANAFYTEKHIRIPCFGGEHEVTFFHEYRDSVDWVFVDHPSYHRPGNLYGDKFGAFGDNQFRYTLLCYAACEAPLVLELGGYIYGQNCMFVVNDWHASLVPVLLAAKYRPYGVYKDSRSILVIHNLAHQGVEPASTYPDLGLPPEWYGALEWVFPEWARRHALDKGEAVNFLKGAVVTADRIVTVSKGYSWEVTTAEGGQGLNELLSSRKSVLNGIVNGIDINDWNPATDKCIPCHYSVDDLSGKAKCKSALQKELGLPIRPEVPLIGFIGRLDYQKGIDLIQLIIPHLMRDDVQFVMLGSGDPELEDWMRSTESDFKDKFRGWVGFSVPVSHRITAGCDILLMPSRFEPCGLNQLYAMQYGTVPVVHATGGLRDTVENFNPFGENGEQGTGWAFAPLTTENMFVDIANCNFDIQGAQIFLGRAHEEGHVKRLHVGPCR

SEQ ID NO: 4879 - DNA, 1815 bp, Triticum turgidum subsp
  CDS (1)..(1815)
atggcggctctggtcacgtcccagctcgccacctccggcaccgtcctcggcatcaccgacaggttccggcgtgcaggtttccagggcgtgaggccccggaacccggcggatgcggccctcgtcatgaggactatcggagcgagcgccgccccgaagcaaagccggaaagcgcaccgcgggagccggcggtgcctctccatggtggtgcgcgccacgggcagcggcggcatgaacctcgtgttcgtcggcgccgagatggcgccctggagcaagaccggcggcctcggcgacgtcctcggaggcctccccccagccatggccgccaacggtcaccgggtcatggtcatctccccgcgctacgaccagtacaaggacgcctgggacaccagcgtcgtctccgagatcaaggtcgcggacgagtacgagagggtgaggtacttccactgctacaagcgcggggtggaccgcgtgttcgtcgaccacccgtgcttcctggagaaggtccggggcaagaccaaggagaagatctacgggcccgatgccggcaccgactacgaggacaaccagctacgcttcagcctgctctgccaggcagcgctggaagcacccaggatcctggacctcaacaacaacccatacttttctggaccctacggggaggacgtggtgttcgtgtgcaacgactggcacacgggccttctggcctgctacctcaagagcaactaccagtccaatggcatctatatgacggccaaggtggcgttctgcatccacaacatctcgtaccagggccgcttctccttcgacgacttcgcgcagctcaacctgcccgacaggttcaagtcgtccttcgacttcatcgacggctacgacaagccggtggaggggcgcaagatcaactggatgaaggccgggatcctgcaggccgacaaggtgctgacggtgagcccctactacgctgaggagctcatctccggcgaagccaggggctgcgagctcgacaacatcatgcgcctcacgggcatcaccggcatcgtcaacggcatggacgtcagcgagtgggaccccaccaaggacaagttcctcgccgtcaactacgacgtcaccaccgcgttggaggggaaggcgctgaacaaggaggcgctgcaggccgaggtggggctgccggtggaccggaaggtgcccctggtggcgttcatcggcaggctggaggagcagaagggccccgacgtgatgatcgccgccatcccggagatcttgaaggaggaggacgtccagatcgttctcctgggcaccgggaagaagaagtttgagcggctgctcaagagcgtggaggagaagttcccgaacaaggtgagggccgtggtcaggttcaacgcgccgctggctcaccagatgatggctggcgccgacgtgctcgccgtcaccagccgcttcgagccctgtggcctcatccagctccaggggatgcgctacggaacgccgtgcgcgtgcgcgtccaccggcgggctcgtcgacactatcgtggagggcaagaccgggttccacatgggccgcctcagcgtcgactgtaatgtggtggaaccggccgacgtgaagaaggtggtgaccaccctgaagcgcgccgtcaaggtcgtcggcacgccggcgtaccatgggatggtcaagaactgcatgatacaggatctctcctggaagggtcctgccaagaactgggaggacgtgcttttggaactgggtgtcgaggggagcgagccgggggtcatcggcgaagagattgcgccgctcgccatggagaacgtcgccgctccctga

SEQ ID NO: 4880 - protein, 604 aa, Triticum turgidum subsp
MAALVTSQLATSGTVLGITDRFRRAGFQGVRPRNPADAALVMRTIGASAAPKQSRKAHRGSRRCLSMVVRATGSGGMNLVFVGAEMAPWSKTGGLGDVLGGLPPAMAANGHRVMVISPRYDQYKDAWDTSVVSEIKVADEYERVRYFHCYKRGVDRVFVDHPCFLEKVRGKTKEKIYGPDAGTDYEDNQLRFSLLCQAALEAPRILDLNNNPYFSGPYGEDVVFVCNDWHTGLLACYLKSNYQSNGIYMTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDVTTALEGKALNKEALQAEVGLPVDRKVPLVAFIGRLEEQKGPDVMIAAIPEILKEEDVQIVLLGTGKKKFERLLKSVEEKFPNKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHGMVKNCMIQDLSWKGPAKNWEDVLLELGVEGSEPGVIGEEIAPLAMENVAAP

SEQ ID NO: 4881 - DNA, 2575 bp, Manihot esculenta
  CDS (50)..(2305)
gtttgatgaaccccatctcaagctgttggggctgtcgcacttgtgagaaatggcatttataggatcacttccttttattatccaaaccaaagcagaaagttctgtccttctccatgacaaaaacctacagcgatccagattctccgttttcccatgtagatcacaaaactcttttaatttagccgtttcgttatctttgagttttaagcctgtaagagctacaggtaaggaaggcgttagtggtgatgggtcagaggatacacttcaagccaccatcgagaaaagcaagaaagttctcgccttgcaaagggacctacttcagaagattgctgaaagaaggaaattggtttcttctatacaaagtagtgttggtgaccacgacacaaacaaaacttctcatgaacagagggaaaactctttggcaaattcagataatacttcaactagtgatgtgaatatgcaccaacagcaaaatggcccagttcttccgagtagctatgtccattcaactgcagatgaggtatcagaaactgcatcttcagctattaatagaggtcatgctaaagatgataaggaacttgaacaacatgcatctcctagaacagcctttgttaagaattctaccaaacagtttaaagagatggattctgagaaactacagacagatgagataccatcttttctttcaaacaccacagatatttccactataaatgaagaaaatagtgaacattcaaatgaatcaacctcacctatggtcgacatttttgaaagtgattctatgactgaagacatgaagccacctcctttggctggggacaatgtcatgaatgttattttggtagctgcagaatgtgctccatggtccaaaacaggtggccttggtgatgtcgctggatctttaccaaaggctttggctcggcgtggacatcgggttatggttgtggcaccgcgatatggcaactatgttgaacctcaggatactggagtccgaaagaggtataaggtggatggtcaggattttgaagtatcatacttccaagccttcattgatggggttgattttgtattcattgacagtcctatgtttcgccacatagggaatgatatatatggaggaaacagaatggatatattaaagaggatggtattattttgcaaagctgctgttgaggttccttggcatgtcccatgtggtggagtctgctatggggatggaaatttggctttcattgcaaatgattggcatacagcattgttgccagtgtatctgaaggcatattatcgggataatggtttaatgcaatatacaagatctgttcttgtaattcataacatagctcaccagggtcggggtcccagtggagatttctcttacgtgggtctaccagaacattacattgatctcttcaaactgcatgatccgattggtggtgaccacttcaatatctttgcacctggtcttaaggtggcagatcgtgtggttactgttagtcatggatacgcctgggagcttaaaacatctgaaggtggttggggtcttcacaatatcataaatgagaaccactggaaattgcagggcattgttaatgggattgatgccaaagaatggaatccacagtttgatattcaactgacatcagatggttatactaactattccctggaaacacttgatactggcaagcctcagtgcaagacagccttacagaacgagctccggtttgccatccccccagatgtccctgttattgggttcattggaaggttggattatcagaaaggtgtcgatctcatagctgaggcaattccctggatggtgggtcaggatgtgcaactagtaatgttgggtactggcagacaagacttggaagagatgcttagacaatttgaaaaccaacatagagataaagtgaggggatgggttggtttttctgtgaagacagctcacaggataactgctggtgcagatattttgctcatgccatcaagatttgaaccatgtgggctaaaccagttatatgctatgatgtacgggacgattcctgtagtacacgctgtgggtggactaagggacacggtgcaacctttcgatccatttaatgagtcggggcttgggtggacatttgatagcgctgaatcacataaactgatacatgcattaggcaattgcttgctcacttaccgagagtacaagaagagctgggaaggcctgcagagaagagggatgactccaaacctcagctgggaccatgctgctgagaaatatgaggagactcttgttgcagccaagtaccagtggtgagcaatagtgcttttccttaaattttgacttttttttttctgttaaataatgcttccaagaggttgccctctgatgctagtaagggggccaatagatggccatgtatgttctgctatatagctcaatgtgtaatcagcttagagttatgattcaggagttgtaatcctttctggttttatcacacattagcagaggatggtttggatgtgatgagtggtgacccatgttttatccttgtgcttattctgttatctgaaaaaaaaaaaaaaa

SEQ ID NO: 4882 - protein, 751 aa, Manihot esculenta
MAFIGSLPFIIQTKAESSVLLHDKNLQRSRFSVFPCRSQNSFNLAVSLSLSFKPVRATGKEGVSGDGSEDTLQATIEKSKKVLALQRDLLQKIAERRKLVSSIQSSVGDHDTNKTSHEQRENSLANSDNTSTSDVNMHQQQNGPVLPSSYVHSTADEVSETASSAINRGHAKDDKELEQHASPRTAFVKNSTKQFKEMDSEKLQTDEIPSFLSNTTDISTINEENSEHSNESTSPMVDIFESDSMTEDMKPPPLAGDNVMNVILVAAECAPWSKTGGLGDVAGSLPKALARRGHRVMVVAPRYGNYVEPQDTGVRKRYKVDGQDFEVSYFQAFIDGVDFVFIDSPMFRHIGNDIYGGNRMDILKRMVLFCKAAVEVPWHVPCGGVCYGDGNLAFIANDWHTALLPVYLKAYYRDNGLMQYTRSVLVIHNIAHQGRGPSGDFSYVGLPEHYIDLFKLHDPIGGDHFNIFAPGLKVADRVVTVSHGYAWELKTSEGGWGLHNIINENHWKLQGIVNGIDAKEWNPQFDIQLTSDGYTNYSLETLDTGKPQCKTALQNELRFAIPPDVPVIGFIGRLDYQKGVDLIAEAIPWMVGQDVQLVMLGTGRQDLEEMLRQFENQHRDKVRGWVGFSVKTAHRITAGADILLMPSRFEPCGLNQLYAMMYGTIPVVHAVGGLRDTVQPFDPFNESGLGWTFDSAESHKLIHALGNCLLTYREYKKSWEGLQRRGMTPNLSWDHAAEKYEETLVAAKYQW

SEQ ID NO: 4883 - DNA, 2842 bp, Triticum aestivum
  CDS (89)..(2488)
gctgccaccacctccgcctgcgccgcgctctgggcggaggaccaacccgcgcatcgtaccatcgcccgccccgatcccggccgccgccatgtcgtcggcggtcgcgtccgccgcgtccttcctcgcgctcgcctccgcctcccccgggagatcacgcaggcgggcgagggtgagcgcgccgccaccccacgccggggccggcaggctgcactggccgccgtggccgccgcagcgcacggctcgcgacggaggtgtggccgcgcgcgccgccgggaagaaggacgcgagggtcgacgacgacgccgcgtccgcgaggcagccccgcgcacgccgcggtggcgccgccaccaaggtcgcggagcggagggatcccgtcaagacgctcgatcgcgacgccgcggaaggtggcgcgccggcaccgccggcaccgaggcaggacgccgcccgtccaccgagtatgaacggcacgccggtgaacggtgagaacaaatctaccggcggcggcggcgcgaccaaagacagcgggctgcccgcacccgcacgcgcgccccatccgtcgacccagaacagagtaccagtgaacggtgaaaacaaagctaacgtcgcctcgccgccgacgagcatagccgaggtcgtggctccggattccgcagctaccatttccatcagtgacaaggcgccggagtccgttgtcccagccgagaagccgccgccgtcgtccggctcaaatttcgtggtctcggcttctgctcccaggctggacattgacagcgatgttgaacctgaactgaagaagggtgcggtcatcgtcgaagaagctccaaacccaaaggctctttcgccgcctgcagcccccgctgtacaagaagacctttgggacttcaagaaatacattggcttcgaggagcccgtggaggccaaggatgatggctgggctgttgcagatgatgcgggctcctttgaacatcaccagaaccatgattccggacctttggcaggggagaacgtcatgaacgtggtcgtcgtggctgctgaatgttctccctggtgcaaaacaggtggtcttggagatgttgccggtgctttgcccaaggctttggcgaagagaggacatcgtgttatggttgtggtaccaaggtatggggactatgaggaagcctacgatgtcggagtccgaaaatactacaaggctgctggacaggatatggaagtgaattatttccatgcttatatcgatggagttgattttgtgttcattgacgctcctctcttccgacaccgccaggaagacatttatgggggcagcagacaggaaattatgaagcgcatgattttgttctgcaaggccgctgtcgaggttccttggcacgttccatgcggcggtgtcccttatggggatggaaatctggtgtttattgcaaatgattggcacacggcactcctgcctgtctatctgaaagcatattacagggaccatggtttgatgcagtacactcggtccattatggtgatacataacatcgcgcaccagggccgtggcccagtagatgaattcccgttcaccgagttgcctgagcactacctggaacacttcagactgtacgaccccgtgggtggtgagcacgccaactacttcgccgccggcctgaagatggcggaccaggttgtcgtggtgagccccgggtacctgtgggagctcaagacggtggagggcggctgggggcttcacgacatcatacggcagaacgactggaagacccgcggcatcgtcaacggcatcgacaacatggagtggaaccccgaggtggacgtccacctcaagtcggacggctacaccaacttctccctggggacgctggactccggcaagcggcagtgcaaggaggccctgcagcgcgagctgggcctgcaggtccgcgccgacgtgccgctgctcggcttcatcggccgcctggacgggcagaagggcgtggagatcatcgcggacgccatgccctggatcgtgagccaggacgtgcagctggtcatgctgggcaccggccgccacgacctggagagcatgctgcggcacttcgagcgggagcaccacgacaaggtgcgcgggtgggtggggttctccgtgcgcctggcgcaccggatcacggcgggcgccgacgcgctcctcatgccctcccggttcgagccgtgcgggttgaaccagctttacgccatggcctacggcaccgtccccgtcgtgcacgccgtcggcggggtgagggacaccgtgccgccgttcgaccccttcaaccactccggcctcgggtggacgttcgaccgcgccgaggcgcacaagctgatcgaggcgctcgggcactgcctccgcacctaccgggactacaaggagagctggaggggcctccaggagcgcggcatgtcgcaggacttcagctgggagcatgccgccaagctctacgaggacgtcctcctcaaggccaagtaccagtggtgaacgctagctgctagccgctccagccccgcatgcgtgcatgcatgagagggtggaactgcgcattgcgcccgcaggaacgtgccatccttctcgatgggagcgccggcatccgcgaggtgcagtgacatgagaggtgtgtgtggttgagacgctgattccgatctcgatctggtccgtagcagagtagagcggacgtagggaagcgctccttgttgcaggtatatgggaatgttgtcaacttggtattgtagtttgctatgttgtatgcgttattacaatgttgttacttattcttgttaagtcggaggcaaagggcgaaagctagctcacatgaaaaaaaaaaaaaaaaaaaaa

SEQ ID NO: 4884 - protein, 799 aa, Triticum aestivum
MSSAVASAASFLALASASPGRSRRRARVSAPPPHAGAGRLHWPPWPPQRTARDGGVAARAAGKKDARVDDDAASARQPRARRGGAATKVAERRDPVKTLDRDAAEGGAPAPPAPRQDAARPPSMNGTPVNGENKSTGGGGATKDSGLPAPARAPHPSTQNRVPVNGENKANVASPPTSIAEVVAPDSAATISISDKAPESVVPAEKPPPSSGSNFVVSASAPRLDIDSDVEPELKKGAVIVEEAPNPKALSPPAAPAVQEDLWDFKKYIGFEEPVEAKDDGWAVADDAGSFEHHQNHDSGPLAGENVMNVVVVAAECSPWCKTGGLGDVAGALPKALAKRGHRVMVVVPRYGDYEEAYDVGVRKYYKAAGQDMEVNYFHAYIDGVDFVFIDAPLFRHRQEDIYGGSRQEIMKRMILFCKAAVEVPWHVPCGGVPYGDGNLVFIANDWHTALLPVYLKAYYRDHGLMQYTRSIMVIHNIAHQGRGPVDEFPFTELPEHYLEHFRLYDPVGGEHANYFAAGLKMADQVVVVSPGYLWELKTVEGGWGLHDIIRQNDWKTRGIVNGIDNMEWNPEVDVHLKSDGYTNFSLGTLDSGKRQCKEALQRELGLQVRADVPLLGFIGRLDGQKGVEIIADAMPWIVSQDVQLVMLGTGRHDLESMLRHFEREHHDKVRGWVGFSVRLAHRITAGADALLMPSRFEPCGLNQLYAMAYGTVPVVHAVGGVRDTVPPFDPFNHSGLGWTFDRAEAHKLIEALGHCLRTYRDYKESWRGLQERGMSQDFSWEHAAKLYEDVLLKAKYQW

SEQ ID NO: 4885 - DNA, 1818 bp, Triticum monococcum
  CDS (1)..(1818)
atggcggctctggtcacgtcccagctcgccacctccggcgccgtcctcggcatcaccgacaggttccggcgtgcaggttttcagggcgtgaggccccggagcccggcggatgcggcgctcggcatgaggactgtcggagcaagcgcggcaccgaagcaacaaagcaggaaagcgcaccgcgggacccggcggtgcctctcggtggtggtgcgcgccacgggcagcggcggcatgaacctcgtgttcgtcggcgccgagatggcgccctggagcaagaccggcggcctcggcgacgtcctcgggggcctccccccagccatggccgccaacggtcaccgggtcatggtcatctccccgcgctacgaccagtacaaggacgcctgggacaccagcgtcgtctccgagatcaaggtcgccgacgagtacgagcgggtgaggtacttccactgcttcaaacgtggggtggaccgcgtgttcgtcgaccacccgtgcttcctggagaaggtccggggcaagaccaaggagaagatctatgggcccgacgccggcacggactacgaggacaaccagctacgcttcagccttctctgccaggcagcacttgaggtgcccaggatcctcgacctcaacaacaacccatacttttctggaccctacggggaagacgtggtgttcgtgtgcaacgactggcacacgggccttctggcctgctacctcaagagcaactaccagtccaatggcatctataggacggccaaggtggcgttctgcatccacaacatctcgtaccagggccgcttctccttcgacgacttcgcgcagctcaacctgcccgacaggttcaagtcgtccttcgacttcatcgacgggtacgacaagccggtggaggggcgcaagatcaactggatgaaggccgggatcctgcaggccgacaaggtgctgacggtgagcccctactacgcggaggagctcatctccggcgaagccaggggctgcgagctcgacaacatcatgcgcctcacgggcatcaccggcatcgtcaacggcatggatgtcagcgagtgggaccccaccaaggacaatttcctcaccgtcaactacaacgtcaccaccgcgttggaggggaaggtgctgaacaaggaggcgctgcaggccgaggtggggctgccggtggaccggaaggtgccgctggtggcgttcatcggcaggctggaggagcagaagggccccgacgtgatgatcgccgccatcccggagatcgtgaaggaggaggacgtccagatcgttctcctgggcaccgggaagaagaagtttgagcggctgctcaagagcgtggaggagaagttcccaagcaaggtgagggccgtggtcaggttcaacgcgccgctggctcaccagatgatggccggagccgacgtgctcgccgtcaccagccgctttgagccctgcggcctcatccagctccaggggatgcgctacggaacgccgtgcgcatgcgcgtccaccggcgggctcgtcgacaccatcgtggagggcaagaccgggttccacatgggccgcctcagcgtcgactgcaacgtggtggagccggccgacgtgaagaaggtggtgaccaccctgaagcgcgccgtcaaggtcgtcggcacgccggcgtaccatgagatggtcaagaactgcatgatacaggatctctcctggaaggggcctgccaagaactgggagcacgtgcttctggaactgggggtcgaggggagcgagccggggatcgtcggcgaggagatcgcgccgctcgccatggagaacgtcgccgctccctga

SEQ ID NO: 4886 - protein, 605 aa, Triticum monococcum
MAALVTSQLATSGAVLGITDRFRRAGFQGVRPRSPADAALGMRTVGASAAPKQQSRKAHRGTRRCLSVVVRATGSGGMNLVFVGAEMAPWSKTGGLGDVLGGLPPAMAANGHRVMVISPRYDQYKDAWDTSVVSEIKVADEYERVRYFHCFKRGVDRVFVDHPCFLEKVRGKTKEKIYGPDAGTDYEDNQLRFSLLCQAALEVPRILDLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDNFLTVNYNVTTALEGKVLNKEALQAEVGLPVDRKVPLVAFIGRLEEQKGPDVMIAAIPEIVKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEHVLLELGVEGSEPGIVGEEIAPLAMENVAAP

SEQ ID NO: 4887 - DNA, 2081 bp, Triticum aestivum
  CDS (120)..(1919)
tctgcttctacttctacttgagcggagcctgctgcgttcccacggccaccagccactccgcctgctccgcggttccacagcgcctagctcgaaaaggtcgtcattgagaggctgcaccaatgggttccattcctaattattgttcttatcaaacaaacagtgttggttcactgaaactgtcgcctcacatccaattccagcaatcttgtaacaatgaagttatgttcctatccatgcgaaataagacacagctggccaaaagaagagccacaaattatggaactcatcgtaattctagtaggactcctgcacctatcgtatgttcaactggaatgcccataattttcgttgccactgaagtgcacccatggtgcaaaactggaggccttggtgatgtcgtaggaggattgcccccagctctggctgcaatggggcaccgggttatgacgatagctcctcgctatgatcagtacaaggatacatgggatacaaatgttcttgttgaggtaattgttggtgacagaacagaaacagtgcgcttttttcactgctacaaaaggggggttgatcgtgtttttgttgatcatcctatgtttcttgagaaggtatggggcaaaactggatcaaaattgtatgggcctaccactggaacagacttccgagataaccaattacggttctgccttttgtgccttgctgcattggaggctccgagggttcttaatctcaacaattctgaatacttctctggaccatatggagaaaatgttgtcttcgttgcaaatgactggcacactgcagttttgccatgctatttgaagagcatgtataagcaaaatggaatttatgtgaatgccaaggttgctttctgcattcacaatatcgcctatcagggcagatttcccagagtggacttcgaacttcttaatttacctgaaagtttcatgccgtcatttgattttgttgatgggcatgttaagccagtagtagggagaaagattaactggatgaaggcagggatcactgagtgtgatgtggtccttacagttagtccacattatgtcaaagaacttacttctggcccagagaaaggtgttgagttggatggcgtccttcgtgcaaagcctcttgaaactggaattgtaaatggaatggatgttgttgattggaatccagcaacagataagtacatcagtgtcaaatacaatgcaacaacggtggcggaagcaagagctctcaataaagaaatactgcaggctgaagttggattgcctgtggactctagcatacctgttatagttttcattggacgtcttgaagaacagaaagggtcagacatactaattgcagccataccggagtttctcgaggagaatgttcagataattgttctcggcacagggaagaagaaaatggaggaggaactgatgctgctagaagcgaagtacccacagaatgccagaggcatagcaaaattcaatgtcccattggcgcacatgatgtttgccggggctaatttcataattgttccaagtaggttcgagccatgtggcctcatccaattgcaagggatgagatatggagtgattcccatctgttcatccaccggaggactcgttgacacggtgagcgagggtgtcaccggattccacatgggttcgttcaatgtcgagtttgaaaccgtcgatccagcagatgtcgcggcagttgcttcgaatgtcacacgagctctgaaacagtacaaaacaccgtcgttccacgcaatggttcagaattgcatggcgcaggacctatcttggaagggaccggcaaagaagtgggaggaggctcttcttggcctaggagtcgagggaagtcagccgggcatcgagggcgaggagatcgctccacttgcgaaacagaatgtggccactccctgaaatctccaaatattagggagagtgttctaagattcgacaaaataatgaggttgctaaagatgaagctgtattcatctaggctttgccatttctctactactccatgtgtaacatactacctgaatttcaacaagtatgcatccttaaaaaaaaaaaaaaaaa

SEQ ID NO: 4888 - protein, 599 aa, Triticum aestivum
MGSIPNYCSYQTNSVGSLKLSPHIQFQQSCNNEVMFLSMRNKTQLAKRRATNYGTHRNSSRTPAPIVCSTGMPIIFVATEVHPWCKTGGLGDVVGGLPPALAAMGHRVMTIAPRYDQYKDTWDTNVLVEVIVGDRTETVRFFHCYKRGVDRVFVDHPMFLEKVWGKTGSKLYGPTTGTDFRDNQLRFCLLCLAALEAPRVLNLNNSEYFSGPYGENVVFVANDWHTAVLPCYLKSMYKQNGIYVNAKVAFCIHNIAYQGRFPRVDFELLNLPESFMPSFDFVDGHVKPVVGRKINWMKAGITECDVVLTVSPHYVKELTSGPEKGVELDGVLRAKPLETGIVNGMDVVDWNPATDKYISVKYNATTVAEARALNKEILQAEVGLPVDSSIPVIVFIGRLEEQKGSDILIAAIPEFLEENVQIIVLGTGKKKMEEELMLLEAKYPQNARGIAKFNVPLAHMMFAGANFIIVPSRFEPCGLIQLQGMRYGVIPICSSTGGLVDTVSEGVTGFHMGSFNVEFETVDPADVAAVASNVTRALKQYKTPSFHAMVQNCMAQDLSWKGPAKKWEEALLGLGVEGSQPGIEGEEIAPLAKQNVATP

SEQ ID NO: 4889 - DNA, 2591 bp, Triticum aestivum
  CDS (256)..(2199)
ctcccactcttctctccccgcgcacaccgagtcggcaccggctcatcacccatcacctcggcctcggccaccggcaaaccccccgatccgcttttgcaggcagcgcactaaaaccccggggagcgcgccccgcggcagcagcagcaccgcagtgggagagagaggcttcgccccggcccgcaccgagcggggcgatccaccgtccgtgcgtccgcacctcctccgcctcctcccctgtcccgcgcgcccacacccatggcggcgacgggcgtcggcgccgggtgcctcgcccccagcgtccgcctgcgcgccgatccggcgacggcggcccgggcgtccgcctgcgtcgtccgcgcgcggctccggcgcttggcgcggggccgctacgttgccgagctcagcagggagggccccgcggcgcgccccgcgcagcagcagcaactggccccgccgctcgtgccaggcttcctcgcgccgccgccgcccgcgcccgcccagtcgccggccccgacgcagccgcccctgccggacgccggcgtgggggaactcgcgcccgacctcctgctcgaagggattgctgaggattccatcgacagcataattgtggctgcaagtgagcaggattctgagatcatggatgcgaatgagcaacctcaagctaaagttacacgtagcatcgtgtttgtgactggtgaagctgctccttatgcaaagtcaggggggctgggagatgtttgtggttcgttaccaattgctcttgctgctcgtggtcaccgtgtgatggttgtaatgccaagatacttgaatgggtcctctgataaaaactatgcaaaggcattatacactgggaagcacattaagattccatgctttgggggatcacatgaagtgaccttttttcatgagtatagagacaacgtcgattgggtgtttgtcgatcatccgtcatatcatagaccaggaagtttatatggagataattttggtgcttttggtgataatcagttcagatacacactcctttgctatgctgcatgcgaggccccactaatccttgaattgggaggatatatttatggacagaattgcatgtttgttgtgaacgattggcatgccagccttgtgccagtccttcttgctgcaaaatatagaccatacggtgtttacagagattcccgcagcacccttgttatacataatttagcacatcagggtctggagcctgcaagtacatatcctgatctgggattgccacctgaatggtatggagctttagaatgggtatttccagaatgggcaaggaggcatgcccttgacaagggtgaggcagttaactttttgaaaggagcagtcgtgacagcagatcgaattgtgaccgtcagtcagggttattcatgggaggtcacaactgctgaaggtggacagggcctcaatgagctcttaagctcccgaaaaagtgtattgaatggaattgtaaatggaattgacattaatgattggaaccccaccacagacaagtgtctccctcatcattattctgtcgatgacctctctggaaaggccaaatgtaaagctgaattgcagaaggagctgggtttacctgtaagggaggatgttcctctgattggctttattggaagactggattaccagaaaggcattgatctcattaaaatggccattccagagctcatgagggaggacgtgcagtttgtcatgcttggatctggggatccaatttttgaaggctggatgagatctaccgagtcgagttacaaggataaattccgtggatgggttggatttagtgttccagtttcccacagaataactgcaggttgcgatatattgttaatgccatccaggtttgaaccttgtggtcttaatcagctatatgctatgcaatatggtacagttcctgtagttcatggaactgggggcctccgagacacagtcgagaccttcaacccttttggtgcaaaaggagaggagggtacagggtgggcgttctcaccgctaaccgtggacaagatgttgtgggcattgcgaaccgcgatgtcgacattcagggagcacaagccgtcctgggaggggctcatgaagcgaggcatgacgaaagaccatacgtgggaccatgccgccgagcagtacgagcagatcttcgaatgggccttcgtggaccaaccctacgtcatgtagacggggactggggaggtcgaagcgcgggtctccttgagctctgaagacatgttcctcatccttccgcggcccggaaggatacccctgtacattgcgttgtcctgctacagtagagtcgcaatgcgcctgcttgcttggtccgccggttcgagagtagatgacggctgtgctgctgcggcggtgacagcttcgggtggatgacagttacagttttggggaataaggaagggatgtgctgcaggatggttaacagcaaagcaccactcagatggcagcctctctgtccgtgttacagctgaaatcagaaaccaactggtgactctttagccttagcgattgtgaagtttgttgcattctgtgtatgttgtcttgtccttagctgacaaatatta

SEQ ID NO: 4890 - protein, 647 aa, Triticum aestivum
MAATGVGAGCLAPSVRLRADPATAARASACVVRARLRRLARGRYVAELSREGPAARPAQQQQLAPPLVPGFLAPPPPAPAQSPAPTQPPLPDAGVGELAPDLLLEGIAEDSIDSIIVAASEQDSEIMDANEQPQAKVTRSIVFVTGEAAPYAKSGGLGDVCGSLPIALAARGHRVMVVMPRYLNGSSDKNYAKALYTGKHIKIPCFGGSHEVTFFHEYRDNVDWVFVDHPSYHRPGSLYGDNFGAFGDNQFRYTLLCYAACEAPLILELGGYIYGQNCMFVVNDWHASLVPVLLAAKYRPYGVYRDSRSTLVIHNLAHQGLEPASTYPDLGLPPEWYGALEWVFPEWARRHALDKGEAVNFLKGAVVTADRIVTVSQGYSWEVTTAEGGQGLNELLSSRKSVLNGIVNGIDINDWNPTTDKCLPHHYSVDDLSGKAKCKAELQKELGLPVREDVPLIGFIGRLDYQKGIDLIKMAIPELMREDVQFVMLGSGDPIFEGWMRSTESSYKDKFRGWVGFSVPVSHRITAGCDILLMPSRFEPCGLNQLYAMQYGTVPVVHGTGGLRDTVETFNPFGAKGEEGTGWAFSPLTVDKMLWALRTAMSTFREHKPSWEGLMKRGMTKDHTWDHAAEQYEQIFEWAFVDQPYVM

SEQ ID NO: 4891 - DNA, 1872 bp, Oryza sativa
  CDS (1)..(1872)
atggcgacggcggcggggatggggatcggggcggcgtgcctggtggcgccgcaggtgaggccggggaggaggttgcggctccagcgggtgcggaggcggtgcgtggcggagctgagcagggacggtgggtcggcgcagcgcccgctggcaccggcgccgctggtgaagcagccggtcctgccgaccttcctcgtgccgacgtcgacgccacccgcgcccacgcagtcgccggcgccggcgccgaccccgccgccgttgccggactccggcgtgggggagatcgagcccgatctagaaggtctcacagaagattccatcgacaaaacaatttttgtggctagtgagcaggagtctgagatcatggatgtgaaggagcaagctcaagctaaagtaacacgcagcgttgtctttgtaaccggtgaagcttctccttatgcaaagtcaggtggactaggagatgtttgtggttcactgccaattgctcttgctcttcgtggtcatcgtgtgatggttgtaatgccgagatacatgaacggggccttgaacaaaaattttgcaaacgcattttacactgagaagcacattaagattccatgctttggcggagaacatgaagttactttttttcacgagtatagggattctgttgattgggtgtttgttgatcatccctcatatcatagacctggaaatttgtatggagataattttggtgcttttggcgataatcagttcagatacacactcctgtgctatgcggcgtgtgaagccccattaattcttgaactgggaggatatatctatggacagaaatgcatgtttgttgtgaatgattggcatgccagtcttgtgccagtccttcttgctgcaaaatatagaccatatggtgtttacagggatgcccgcagtgttcttgtcatacataatctagcacatcagggtgtggagcctgccagtacatatcctgacctgggattgccacctgaatggtatggagcattagaatgggtgtttccagagtgggcaaggcggcatgcccttgacaagggtgaggcagtcaattttttaaaaggcgcagttgtgacagcagatcgaattgtgactgtcagccaggggtattcatgggaggtcacaactgctgaaggtgggcaaggcctcaatgagctcttaagctcccggaagagtgtattgaatggaattgtaaatggaattgacattaatgattggaacccatccacagacaagtttctcccttatcattattctgttgatgacctgtccggaaaggccaagtgtaaagctgaattgcagaaggagctgggtttacctataaggcccgatgtgcctctgattggctttattggaagattggactatcaaaaaggcattgatctaattaaacttgccattccagatctcatgcgggacaatattcaattcgtcatgcttggatctggtgacccaggttttgaaggatggatgagatccacagaatcagggtacagggataaatttcgtggatgggttggatttagtgttccagtttcccaccgaataactgcaggttgcgatatattgttgatgccatccagattcgaaccttgtggcctcaatcagctatatgctatgcaatatggtacagtgcctgttgttcatggaactggaggcctcagagatacagtggagaattttaacccgtttgctgagaaaggagagcagggtacagggtgggcattctcgccactaaccattgaaaaaggcattgcggatggcaatttcgacatacagggaacacaagtcctcttgggagggtctaatgaagcgaggcatgtcaagcgactttacatgggaccatgccgcctcacagtatga

SEQ ID NO: 4892 - protein, 623 aa, Oryza sativa
MATAAGMGIGAACLVAPQVRPGRRLRLQRVRRRCVAELSRDGGSAQRPLAPAPLVKQPVLPTFLVPTSTPPAPTQSPAPAPTPPPLPDSGVGEIEPDLEGLTEDSIDKTIFVASEQESEIMDVKEQAQAKVTRSVVFVTGEASPYAKSGGLGDVCGSLPIALALRGHRVMVVMPRYMNGALNKNFANAFYTEKHIKIPCFGGEHEVTFFHEYRDSVDWVFVDHPSYHRPGNLYGDNFGAFGDNQFRYTLLCYAACEAPLILELGGYIYGQKCMFVVNDWHASLVPVLLAAKYRPYGVYRDARSVLVIHNLAHQGVEPASTYPDLGLPPEWYGALEWVFPEWARRHALDKGEAVNFLKGAVVTADRIVTVSQGYSWEVTTAEGGQGLNELLSSRKSVLNGIVNGIDINDWNPSTDKFLPYHYSVDDLSGKAKCKAELQKELGLPIRPDVPLIGFIGRLDYQKGIDLIKLAIPDLMRDNIQFVMLGSGDPGFEGWMRSTESGYRDKFRGWVGFSVPVSHRITAGCDILLMPSRFEPCGLNQLYAMQYGTVPVVHGTGGLRDTVENFNPFAEKGEQGTGWAFSPLTIEKGIADGNFDIQGTQVLLGGSNEARHVKRLYMGPCRLTV

SEQ ID NO: 4893 - DNA, 2028 bp, Triticum aestivum
  CDS (30)..(1754)
gctgcaggtagccacaccctgcgcgcgccatggcggctctggtcacgtcccagctcgccacctccggcaccgtcctcggcatcaccgacaggttccggcgtgcaggtttccagggcgtgaggccccggagcccggcggatgcggctctcggcatgaggaccgtcggagctagcgccgccccaacgcaaagccggaaagcgcaccgcgggacccggcggtgcctctccatggtggtgcgcgccaccggcagcggcggcatgaacctcgtgttcgtcggcgccgagatggcgccctggagcaagaccggcggcctcggcgacgtcctcgggggcctccccccagccatggccgccaacggccaccgggtcatggtcatctccccgcgctacgaccagtacaaggacgcctgggacaccagcgtcgtctccgagatcaaggtcgttgacaagtacgagagggtgaggtacttccactgctacaagcgcggggtggaccgcgtgttcgtcgaccacccgtgcttcctggagaaggtccggggcaagaccaaggagaagatctacgggcccgacgccggcacggactacgaggacaaccagcagcgcttcagccttctctgccaggcggcgctggaagtgccgaggatcctgaacctcgacaataacccctacttttctgggccctacggggaggacgtggtgttcgtgtgcaatgactggcacacgggccttctggcctgctacctcaagagcaactaccagtccaatggcatctacagggccgcaaaggtggcattctgcatccacaacatctcgtaccagggccgcttctccttcgacgacttcgcgcagctcaacctgcccgacaggttcaagtcgtccttcgacttcatcgacggctacgacaagccggtggaggggcgcaagatcaactggatgaaggccgggatcctgcaggccgacaaggtgctgacggtgagcccctactacgcggaggagctcatctctggcgaagccaggggctgcgagctcgacaacatcatgcgcctcactgggatcaccggcatcgtcaacggcatggatgttagcgagtgggaccccaccaaggacaagttcctcgccgtcaactacgacatcaccaccgcgttggaggggaaggcgctgaacaaggaggcgctgcaggccgaggtggggctgccggtggaccggaaggtgcccctggtggcgttcatcggcaggctggaggagcagaagggccccgacgtgatgatcgccgccatcccggagatcctgaaggaggaggacgtccagatcgttcttctgggcaccgggaagaagaagttcgagcggctactcaagagcattgaggagaaattcccgagcaaggtgagggccgtggtcaggttcaacgcgccgctggctcaccagatgatggccggcgccgacgtgctcgccgtcaccagccgcttcgagccctgcggcctcatccagctccaggggatgcgctacggaacgccgtgcgcgtgcgcgtccaccggcgggcttgtcgacacgatcgtggagggcaagaccgggttccacatgggccggctcagtgtcgattgcaacgtggtggagccggccgacgtgaagaaggtggtgaccaccctgaagcgcgccgtcaaggtcgtcggcacgccggcataccatgagatggtcaagaactgcatgatacaggatctctcctggaaggggccagcctggaaggtaagtcgatgaccgccaagatcaatgcgacacaaccaggaaatgacagatgaccgccaagatcaacgcacacaacaaatgacgcaaggggagcgatcatggctgaaacagcttcactattttccttgctagtacagtactacttgctcagtttgctgttaaactgtgagtctgtgacgcactaaacttatttaataagttgtgcagcagcaacttatttaatgtaagtcatgcaaagagccagcttctaaatacttcctaaaatacaaaaaaaaaaaaaaaaaaa

SEQ ID NO: 4894 - protein, 574 aa, Triticum aestivum
MAALVTSQLATSGTVLGITDRFRRAGFQGVRPRSPADAALGMRTVGASAAPTQSRKAHRGTRRCLSMVVRATGSGGMNLVFVGAEMAPWSKTGGLGDVLGGLPPAMAANGHRVMVISPRYDQYKDAWDTSVVSEIKVVDKYERVRYFHCYKRGVDRVFVDHPCFLEKVRGKTKEKIYGPDAGTDYEDNQQRFSLLCQAALEVPRILNLDNNPYFSGPYGEDVVFVCNDWHTGLLACYLKSNYQSNGIYRAAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAWKVSR

SEQ ID NO: 4895 - DNA, 3901 bp, Vigna unguiculata
  CDS (161)..(3604)
ggcacgagaattgaattaaattgaacaccaccgccacacgcactacaacgtcgtttttgttttattcagttgaaacttgaaaccttcatattcatcatcaatcaaatgctcagataacaaaacgaaacgtcgtttaaagcaaagttagtaactaactacgatggagatgtcgttgcagctaaactacaaaacgccgttttgtttcaagctcactccattttctgttttaacaccttcttcatggcacaaagcaagtattcgagtttcttgcgttaatgctagtgcagatttttctaggaagagacaacagaagaagagttcaattgcgaagccaaagggttctaatccaaagggttttgttccaaaatcatctattggatcaagcagtaagaaaaatcctagagtcagtaagaagggagattctttagctccagttgttagtgaggttttggaggatgataataaacaaacacttgatgttattattgatgatgatgaagatgaattttcggtggaggaaaattgtggtgtggatgataaaattaataaaattgctcgagagttcggggaatcgtccttgatagatgagacattcgatgttgaaaacattcctataattgatgatgttcaattatatgaggagggaaattcttacgttggagatgatgggaatgttaaagattcagagggaaggagattatactatgctgaaattgatggaaatcttagaggtacatatactgatactaatggggaaatagctgggaatatcgttgaggaaacaagtgctgctatcgatgatgttaaaattaacgaggaagcttctcggatgttgaagttgaagttggaagaaaatttgcgaaaacaggaaatagagaggattgcggaggaaaattttttacgaggggcaaagttgtttgtatatcctcctgtggttaaacctgatgaagatatagaggtgtttcttaacaagaacctttcgacactaagtgatgaacctgatattttgattttgggggcgtttaatgattgggagtggaaatcttttaccattagattgaataaaacacatcttaaagatgattggtggagttgccaattgtatgtgccaagagaagcctataaaatagactttgtgttctttaatggacaaagtgtttatgacaataatgaccaaaaagacttttgtataccagttgttggtggaatggatgcattggtgttcgaagattttttgctcgaggagaagcgtaaagaattagaaaaacttgctaaggagcaggctgaaagggaaagacaggctgaagagcaaaggcgaatagatgcagacaaagctgtaaagggagaggacaggttgcaggcaaggatggaggttgaaaaaatgcaagatacgttgctgcagttgatgaaaaatgctgtaacctctattgataatgtttggtatattgagcctagtgagtttaacagcaatgactcagtcagattatattataatggaaactcgggtcctcttcaacatgctaaggaagtatgggttcatggcggtcacaacaattggaaggatggattaacaattgttgaaaggcttgtcaaatcaggtttgaaaggtggtgcttggtggtatgctgatgttgttgtacctgaccaagctcttgtcctggattgggtctttgctgatggtccacctcaaaatgcagttgtgtatgataacaaccgtatgcaagatttccatgctattgtccctatggctacacccgacgcacagtattgggttgaggaagagcagctaatatacagaaaacttcaggaggagaggaagttgaaagaggaagttatacgggcgaaggctgaaaaaacagcacaaatgaaagccgaaacaaaggaaaaaactttgaaaaagtttttactatctcaaaagcatatcgtctacactgagccgcttgatattcaagcagggagtacagtgacggtgttttataacccctcaaacacaaatctgaatggaagacctgaggtttggtttagaggctcatttaatcgttggtctcatcgtaatggtccattgccacctcagagaatgttgcctgctgagagtggcacacatgtcaaagcctctgttaaagttccattggatgcatacatgatggactttgtattctctgagagtgaaaatggtggagtttttgataacaaatttggaatggattaccacatacctgtttttggaggtattgtgaaggaacctcctatgcatattgttcatattgctgttgagatggccccaattgcaaaggttggaggccttggtgatgttgttactagtctttcccgagctgttcaagatttaaatcataatgtggatatcattcttccaaaatatgactgcttgaaccttagcaatgtaaaggacttgcaatttcacaaaagctatttctggagtgggactgaaataaaagtatggcacggaaaggtcgagggcctctcggtctactttttggagcctcagaatggattattttgggtgggctgtgtatatggtcgtgcaaatgatgcagagagatttggttttttttgccatgccgctcttgaatttctactccaaaatggaagtcatcctgatatcatccactgccatgactggtcgagtgctccagttgcatggctatttaaagaacagtatacacattatggtcttagtaaggctcgagttgtcttcacaattcataaccttgaatttggtgccaatctcattggaaaagctatggcatacgctgacaaggctacaactgtctcccccacttattcaagggagattgctgggaatcatgcagttgctactcatcttcacaagtttcatggtataataaatggaatcgacccagatatatgggacccatttaatgataactccattcctgtaccatacacagcagaaaatgttgttgaaggaaaaagagcgtccaaggaagccttacaacaaaagcttggtttgaaaaaagctgatcttcctttggtgggagttattactcgattgactcatcaaaaagggatccatctcatcaaacatgccatatggcgtaccctagaacgcggtggacaggtcgtattacttggttcggctcctgatcaccgtatacaaaatgattttgtgaatttggccaatcaattgcattccagtcataatgatcgggcaagactttgccttgcatatgatgaacctctttcccacatgatatatgctggtgctgatttcattcttgttccttcaatctttgagccatgtggactcactcaactcacagcaatgagatacggttcaataccaattgttcgaaaaactgggggactttatgatacggtgtttgacgttgataatgataaggatagagcacaagtgcaaggtcttgagccaaatggattcagttttgatggggctgatgcgggaggtgttgattatgctcttaatagggcaatatctgcttggtatgatggccgtgagtggtttaacacattatgcaagacagtaatggagcaagattggtcttggaaccgccctgctctcgactatttggagctttaccatgcagcatgcaagttggaatgagagtttagtgagcgggaagccatgcaaattaaggttcatcgccgttgtacagctttagtctaaagcaaaattagtgcacatagttaatcctagtgaaaagataatagcaaagtgacatcatttgtagacaccagcttcttgttcatttttttgttggcacacaataatgtaggtaaatattacatagttttagtatagatgctgagagtttgtcctcttaaataaatgaacatgaacttgtgaataaaaaaaaaaaaaaaaaaaaaaaaaaaaaaaaaaaaaaaaaaaaaaaaaaaa

SEQ ID NO: 4896 - protein, 1147 aa, Vigna unguiculata
MEMSLQLNYKTPFCFKLTPFSVLTPSSWHKASIRVSCVNASADFSRKRQQKKSSIAKPKGSNPKGFVPKSSIGSSSKKNPRVSKKGDSLAPVVSEVLEDDNKQTLDVIIDDDEDEFSVEENCGVDDKINKIAREFGESSLIDETFDVENIPIIDDVQLYEEGNSYVGDDGNVKDSEGRRLYYAEIDGNLRGTYTDTNGEIAGNIVEETSAAIDDVKINEEASRMLKLKLEENLRKQEIERIAEENFLRGAKLFVYPPVVKPDEDIEVFLNKNLSTLSDEPDILILGAFNDWEWKSFTIRLNKTHLKDDWWSCQLYVPREAYKIDFVFFNGQSVYDNNDQKDFCIPVVGGMDALVFEDFLLEEKRKELEKLAKEQAERERQAEEQRRIDADKAVKGEDRLQARMEVEKMQDTLLQLMKNAVTSIDNVWYIEPSEFNSNDSVRLYYNGNSGPLQHAKEVWVHGGHNNWKDGLTIVERLVKSGLKGGAWWYADVVVPDQALVLDWVFADGPPQNAVVYDNNRMQDFHAIVPMATPDAQYWVEEEQLIYRKLQEERKLKEEVIRAKAEKTAQMKAETKEKTLKKFLLSQKHIVYTEPLDIQAGSTVTVFYNPSNTNLNGRPEVWFRGSFNRWSHRNGPLPPQRMLPAESGTHVKASVKVPLDAYMMDFVFSESENGGVFDNKFGMDYHIPVFGGIVKEPPMHIVHIAVEMAPIAKVGGLGDVVTSLSRAVQDLNHNVDIILPKYDCLNLSNVKDLQFHKSYFWSGTEIKVWHGKVEGLSVYFLEPQNGLFWVGCVYGRANDAERFGFFCHAALEFLLQNGSHPDIIHCHDWSSAPVAWLFKEQYTHYGLSKARVVFTIHNLEFGANLIGKAMAYADKATTVSPTYSREIAGNHAVATHLHKFHGIINGIDPDIWDPFNDNSIPVPYTAENVVEGKRASKEALQQKLGLKKADLPLVGVITRLTHQKGIHLIKHAIWRTLERGGQVVLLGSAPDHRIQNDFVNLANQLHSSHNDRARLCLAYDEPLSHMIYAGADFILVPSIFEPCGLTQLTAMRYGSIPIVRKTGGLYDTVFDVDNDKDRAQVQGLEPNGFSFDGADAGGVDYALNRAISAWYDGREWFNTLCKTVMEQDWSWNRPALDYLELYHAACKLE

SEQ ID NO: 4897 - DNA, 3519 bp, Vigna unguiculata
  CDS (386)..(3010)
ggcacgagagaaacgatcaattggtcgctaaaatggcttcgaagctaacaacatgttttatttgctggaatctgaatagcaacaacggcttcaactgtaataataacaatactcgcgtaatgcactctccttttcaaccttattgcaaaatgcgacaccgtattcccagttctcgccacaaaagacaatatatcaagaaagcatcacacccttccattgatggagctctcaatcaaaatcaaaactctgatgatgattctctccacaatttcaaccctccaattctactgcctcttaataataattccacaccatcggccttgaacgtaaacggagcagagcggctgaacagttgtctggcagtcaactcgaccatttgttagccatgataaaaaatgcagagaaaaatatccttcttctgaatcaagctagagttcatgcacttgaagaccttgaaaagattcttgccgaaaaggaagccttacaaggagaaattaatgtcttagcgatgagattggccgagtctgatgtgcggattgaagttgcggcccaggaaaagacacgtgttgaactcttggagggtgagttggagaaactgcgtagtgaattggcgcaaaagggcagtattgaaggaagagatgctgaattgcatgaacttcaaaatggagtatttagtgatgcaattacaaacaatctaagtcataatgataagatccattcccttaccgaggagctaaattcaattagagaagaaaatgccactttgaagaatgccatagaatcatttaaagcacagctcaatgatgttgcaaacaatgatgaacgtttagcggtattggaaaaagaacgcttatctttgcgatcagccctaaaagacatggaatcaaaactgtcaatatttccagaagatgtatctgaactgtctacacttagagttgaatgcaaggatttgtctgataaggttgaaaatttgcaattgctgctagacaaagcaaccaaacaagacagccaagctgttacagtgctgcaacaaaaccaggatcttcaaaggaaggttgataaattggaagcatccctcgaagaagctaacatctataagctgtcatctgataaattgcaaaaatctaatgaactaatgcaacaaaagataaaactattggagagccagctacaaaaatcagatgaagatataaactcttacgttcagttgtatcagcagtcagtgaaggaatttcaagatacactcgatcttctgaaaaaagaaagcaagagaagggcgccggatgaaccagtggaagatatgccgtgggaattctggagtcggttgttgcttctaattgatggttgggcacttgaaaagaagatatcagtagatgatgcaaagcttttgagagaaaaggtctggaagagagacaagagtgttagtgatgtatatatggcttacaaagaaaagaccgaacatgaggctatatctgcatttcttgggcttacatcatctgcaacaagtccaggattgtacgtgattcatattgcagcagagatggcaccagtagctaaggttggtggcttgggggatgttatcagtggtctaagtaaagcattgcaaaagaaaggacaccttgttgaaattatacttcccaaatatgactgtatgcaatatgaccgcattggtgacttaagagctttggatgtggtgatagagtcatactttgatggtcaattattcaaaaataaaatctgggttggcactgttgaaggccttcctgtttatttcattgagcctcatcatcctggtaagttcttttggagaggagattattatggcgcgcatgacgacttcagaagattttcatattttagccgtgcagctcttgagtttcttcttcaagctggcaagaagccagatatcatccattgccatgattggcagacagcatttattgctcctctatattgggatgtatatgccccaaaaggattaaattcagctaggatatgttttacatgccacaactttgagtatcaagggactgcaggagcttcagagttggaagcatgtggtcttgatagccaccagctaaacagaccagatagaatgcaggacaactcagcacataacagagtcaattctgtcaagggtgcagttgtttactcaaacattgtaacaacagtgtcccccacttatgctcaagaagtgagaactgcagagggaggtaaaggcctccattcaactctctctacccactccaaaaagttcatcggtattcttaatggtattgacactgatatatggaatcctgccactgatccatttcttcaagtccagtacaatgcaaatgatcttcaagggaaatcagagaataaggaagccttgagaaggaatctaggtctttcttctgcagacgttaggaggccattggttggctgcattacaagattggttccacaaaaaggtgttcatcttatccgacatgcaatatatctaacattggaactgggaggacaatttgttctacttggttcaagtccagtccctcatattcagagagaatttgagggcattgccaaccactttcagaatcacgaccacataaggttgatattgaagtatgatgagtctctctcccatgctatttatgctgcatctgacatgttcatcattccatcaatctttgaaccttgtggcctaacacagatgatatcaatgagatatggtgccatacctattgccagaaaaaccggtggcctaaatgacagtgtttttgacgttgatgatgatacaataccttcacagtttcgaaatggatttacattcttgaatgccgatgagaagggaataaacgatgccttagtacgtgcaattaatctcttcacaaacgatcctaagagttggaagcaacttgttcagaaggacatgaacatagatttcagctgggattcttcagcagcacaatatgaggagctctactcaaagtctgtgactagaggaagggcaacaaaacgtgcttaatttagcaaaaggaggcttttctgtgctatccgttcaattttgtcagtttcctaaacagagatgggagatcagatttaatgctcaatgaggaggatttatctgaacatgcctgtcatgcaaaaacatctcaaattgagaatgaatataaagaataataatatgaatgcaacatggttactgaaactatgctgctagctagattagtttccgtgaagcaaccgttctcatgcattgatggattctatatctaggtgatatttgaacttcactatacctcacaggattgtgtaattatttcccccttttcttcgttatttaattagtttgccaacagtgtataaaggtcacacatgtaaaagcgttacaggctttcatcttagttttctactaaaaagaatgtagaatgtaatcaaatgtcaagcaaaataaaaattgttcactgcctgtaaactttttatcttttatttttgacaaagcttataactttttcctaaaaaaaaaaaaaaaaa

SEQ ID NO: 4898 - protein, 874 aa, Vigna unguiculata
MIKNAEKNILLLNQARVHALEDLEKILAEKEALQGEINVLAMRLAESDVRIEVAAQEKTRVELLEGELEKLRSELAQKGSIEGRDAELHELQNGVFSDAITNNLSHNDKIHSLTEELNSIREENATLKNAIESFKAQLNDVANNDERLAVLEKERLSLRSALKDMESKLSIFPEDVSELSTLRVECKDLSDKVENLQLLLDKATKQDSQAVTVLQQNQDLQRKVDKLEASLEEANIYKLSSDKLQKSNELMQQKIKLLESQLQKSDEDINSYVQLYQQSVKEFQDTLDLLKKESKRRAPDEPVEDMPWEFWSRLLLLIDGWALEKKISVDDAKLLREKVWKRDKSVSDVYMAYKEKTEHEAISAFLGLTSSATSPGLYVIHIAAEMAPVAKVGGLGDVISGLSKALQKKGHLVEIILPKYDCMQYDRIGDLRALDVVIESYFDGQLFKNKIWVGTVEGLPVYFIEPHHPGKFFWRGDYYGAHDDFRRFSYFSRAALEFLLQAGKKPDIIHCHDWQTAFIAPLYWDVYAPKGLNSARICFTCHNFEYQGTAGASELEACGLDSHQLNRPDRMQDNSAHNRVNSVKGAVVYSNIVTTVSPTYAQEVRTAEGGKGLHSTLSTHSKKFIGILNGIDTDIWNPATDPFLQVQYNANDLQGKSENKEALRRNLGLSSADVRRPLVGCITRLVPQKGVHLIRHAIYLTLELGGQFVLLGSSPVPHIQREFEGIANHFQNHDHIRLILKYDESLSHAIYAASDMFIIPSIFEPCGLTQMISMRYGAIPIARKTGGLNDSVFDVDDDTIPSQFRNGFTFLNADEKGINDALVRAINLFTNDPKSWKQLVQKDMNIDFSWDSSAAQYEELYSKSVTRGRATKRA

SEQ ID NO: 4899 - DNA, 2221 bp, Phaseolus vulgaris
  CDS (30)..(1850)
ctcacaactcctccgtcaccggtataagcatggcaacggtatcgatggcatcgtgcgtggcgtcaaaaggcgcgtggagtacagagacaaaagtgaaatcttcgggtcagatgagcctgaaccgtcatgaattgaaatacgatgggttgagatctctgaacaaggtactcgtgcgaagcacgcatgcgagcaaaatgggaagctctttggctgcgaagagtagcaaaagtgggcgtgagaaggttttggagaagatcgagtgcgggatgaacttgatctttgttggggctgaggttgcaccttggagtaaaactgggggcctcggtgatgttctcggaggacttccatcagctttggccgaacatggacaccgtgttatgacagtgtcaccgcgttacgaccaatacaaggatgcatgggacactaatgttaccgtggaggtcaaagttgctgatagaatagaaactgtccgtttttttcactgctacaagcaaggtgttgatcgtgtttttgtagaccacccatgtttccttgagaaggtgtggggcaagaccggttcaaaactctacggccctagtgctggagtggattatgaagataaccaacttagatacagcttgttatgccaggctgcccttgaggcaccaagggttttgaacttaaacagcaacaaatatttctcgggaccatatggtgaagatgtgatctttgttgccaatgattggcacactgctcttcttccgtgctacttgaaatcaatgtaccagaccaggggggtttatagaaacacaaaggttgcattttgtattcataacatatcctaccagggtaggcatccctttgaagacttccctcttctcaatttacctaatgaatacaggagcgcttttgactttactgatgggcatcttaagcctgtgaggggaaggaaaattaactggatgaaagctgcaatattagaatcggacctagtgctcactgtaagtccatattatgccaaggaacttgtttccggagaggatagaggtgtagaattggacaacataattcgcaaaactggcgttgccggtatcgtgaatggcatggatattcgggagtggagtccaaaaactgataaattcatagatatacacttcgatacaacaagtgtcaaggaagcaaaattcctgctgaaagaggcccttcaggcagaggttggcttacctgtaaacagggatatccctctgataggcttcattggtaggcttgaagagcagaaaggttcagatattcttgtggaagccatcccaaagttcattgaccagaatgttcagatcataattcttggaactggcaaaaagagcatggagaagcagattgagcaactagaggaaatttatccggagaaggccagaggcatagcaaaattcgatggtcccttggctcacaagataattgctggatctgacttcataatgatcccaagtagatttgaaccctgtggtctagttcagttgcattctatgccatatggaacggtgccaatagtttcttccactggtggactcgttgataccgttcaagaagggtttactggattccacatgggtgcatttaacgtagactgtgaagctattgatcctgctgatgtggaaaagatagcaactaccgtaaggagagcccttggaacatatggtaccgtagccatggaaaagattatccagaactgcatggcccaagacttttcatggaagggaccagccaaacaatgggaaaaagtgctgtttagcctagacgttggtcgcagtgaagctggaattgaaggtgatgagattgctcctcttgcaaaggaaaatgtggccactccttgagcatcagcattaagatcctctttctgaatatgatcatggacgagggattataaacgaagcatcttcacataatttgatcaaccatttcgaaggggcggaacttcaatttcaagcaaactatcaaactaacataaaggtttttcataagcaaggtcttgtcataaaggaaatttgaagtacttgagttttataagtttaaattcagcataaggtgaataaatgtcaatgcatgcttccaaatcttaggaaggagcatgtcatctttttttattttctgaccttattggctttggtctcaccgttctttatgtacattacaaattaaataagcactatgtttccaagtaaaaaaaaaaaaaaaaaaaaaaaaa

SEQ ID NO: 4900 - protein, 606 aa, Phaseolus vulgaris
MATVSMASCVASKGAWSTETKVKSSGQMSLNRHELKYDGLRSLNKVLVRSTHASKMGSSLAAKSSKSGREKVLEKIECGMNLIFVGAEVAPWSKTGGLGDVLGGLPSALAEHGHRVMTVSPRYDQYKDAWDTNVTVEVKVADRIETVRFFHCYKQGVDRVFVDHPCFLEKVWGKTGSKLYGPSAGVDYEDNQLRYSLLCQAALEAPRVLNLNSNKYFSGPYGEDVIFVANDWHTALLPCYLKSMYQTRGVYRNTKVAFCIHNISYQGRHPFEDFPLLNLPNEYRSAFDFTDGHLKPVRGRKINWMKAAILESDLVLTVSPYYAKELVSGEDRGVELDNIIRKTGVAGIVNGMDIREWSPKTDKFIDIHFDTTSVKEAKFLLKEALQAEVGLPVNRDIPLIGFIGRLEEQKGSDILVEAIPKFIDQNVQIIILGTGKKSMEKQIEQLEEIYPEKARGIAKFDGPLAHKIIAGSDFIMIPSRFEPCGLVQLHSMPYGTVPIVSSTGGLVDTVQEGFTGFHMGAFNVDCEAIDPADVEKIATTVRRALGTYGTVAMEKIIQNCMAQDFSWKGPAKQWEKVLFSLDVGRSEAGIEGDEIAPLAKENVATP

SEQ ID NO: 4901 - DNA, 2107 bp, Astragalus membranaceus
  CDS (96)..(1919)
gttttttggttaacggcactcctcactctctagtagccatttccgttcagcttccttccatcggcgattgttgctccttactgctctctcacagaatggcaacggtgacggggtcttatgtggtgtcgagaagcgcgtgcttcaattcccagggaagaacagaagccaaagtgaattcacctcagaagataaatctcaatagccaagcattcacttacgttggcttgagatctctcaacaagctgcacgtgcaaaccgcacgtgcaaccaaaacatcttcgtcttccttgaaggctactaacaaagatttggtgaaaatagtgtgtgggaatgggatgaacttggtgtttgtgggagctgaggtgggaccatggagtaaaactggaggacttggtgatgttcttggaggacttccaccagctttggctggaaatgggcaccgtgttatgactgtgtcaccgcgttacgatcaatacaaggatgcatgggacactggtgtgtctgtggagatcaaagttggagatagattcgaaactgtccgattctttcactgctacaaacgaggagttgatcgtgtttttgtagatcacccacttttccttgagaaggtgtggggaaagaccgaatctaaactctatggccctaaaactggtgtggattataaagataaccaacttagattcagcttgttgtgccaggctgcacttgaggcaccaagggttttgaacttaaacagcaacaaacatttctcaggaccatatggcgaagatgtagttttcgttgccaatgattggcatactgctcttcttccatgctatctgaaatccttgtacaagtccaagggaatttacaaaagcgcaaaggtagcattttgtattcataacatagcgtatcagggaaggcatgccttttcagacctctcccttctcaatttaccaaatgaattcagaagctctttcgactttattgatgggtatgataagcctgtgaagggaaggaaaattaactggatgaaggctggagtgttagaatctgaccgagtcttcactgtaagtccatattatgccaaggagcttgtttctggagaggatagaggtgtggaattggacaatataattcgttcgattggtatcactggtattgtaaatggcatggataatcgagagtggagtccacaaactgatagatacatagatgtacactacgatgcatcaactgtcaccgaagcaaaagctatactgaaagaagcccttcaagcagaggttgggttgcctgttgacaggaatatccctgtgatagggttcattggcaggctagaagagcagaaaggttcagatattcttgttgaatctatcccaaagttcattgaccagaatgttcagataatagttcttggaactggcaaaaagatcatggagaaacaaattgaacagctggaggtaacctatcctggcaaggctataggagtagcaaaattcaacagtcccttggctcacaagattattgctggagctgactttatagtgatcccaagtagatttgagccatgtggtttagttcagttgcatgccatgccatacggaacggtgcctatagtttcctcaactggtggacttgttgacaccgtaaaagaaggttataccggattccatgtaggagcattcagcgtcgagtgtgaagctgttgatcctgctgatgtggagaagttagcaactacagtcaacagagcccttaaaacctatggtacccaagccttgaaagagatgatcctgaattgcatggcccaagacttttcttggaagggaccggcgaaacaatgggagcaggcgctgttgagcttagaggtcgctggcagcgaacctggaattgatggagaggaggtcgctcctcttgcaaaggaaaatgttgccactccttgaacatccccatggatttcctgatttcagaaggattttgtagccacaaattggtaatatgaccaacgagttctaacgatgggattgtgtggttacaagggaataaagttgaaggtctttctcaagcaatgtatatatttatttatatataactaaaactaacataacgtttattataaaaaaaaaaaaaa

SEQ ID NO: 4902 - protein, 607 aa, Astragalus membranaceus
MATVTGSYVVSRSACFNSQGRTEAKVNSPQKINLNSQAFTYVGLRSLNKLHVQTARATKTSSSSLKATNKDLVKIVCGNGMNLVFVGAEVGPWSKTGGLGDVLGGLPPALAGNGHRVMTVSPRYDQYKDAWDTGVSVEIKVGDRFETVRFFHCYKRGVDRVFVDHPLFLEKVWGKTESKLYGPKTGVDYKDNQLRFSLLCQAALEAPRVLNLNSNKHFSGPYGEDVVFVANDWHTALLPCYLKSLYKSKGIYKSAKVAFCIHNIAYQGRHAFSDLSLLNLPNEFRSSFDFIDGYDKPVKGRKINWMKAGVLESDRVFTVSPYYAKELVSGEDRGVELDNIIRSIGITGIVNGMDNREWSPQTDRYIDVHYDASTVTEAKAILKEALQAEVGLPVDRNIPVIGFIGRLEEQKGSDILVESIPKFIDQNVQIIVLGTGKKIMEKQIEQLEVTYPGKAIGVAKFNSPLAHKIIAGADFIVIPSRFEPCGLVQLHAMPYGTVPIVSSTGGLVDTVKEGYTGFHVGAFSVECEAVDPADVEKLATTVNRALKTYGTQALKEMILNCMAQDFSWKGPAKQWEQALLSLEVAGSEPGIDGEEVAPLAKENVATP

SEQ ID NO: 4903 - DNA, 1389 bp, Bradyrhizobium japonicum
  CDS (1)..(1389)
atggacgacttcgtccgcgtcggcggacttggagccgtttccgctgccctgcccagagcccttcgccccttcgccgatatccggatcatgttgcccggctatcgcgacatcatcgagcaactcacgcatattcagatcgttggccgctgcccgtcgtttgcggatctgccggcctgctcgctcggccgggccgcgaccaaggacggcctgccggtctatgtgctgttatgctcgcaactctacgaccggcccggcaatccctatggcgacgagtccggacgcgactggccggacaacgacatccgcttcgcacgctttgcctcggcagccgctgagctggccatgggcaagctggacaagaattgggcagcagacctgatccatgccaacgactggcaggcctcgctcgtgcccgcctatctcgcctggcgcggcgccaagctgccgtcgatcctgaccattcacaacctcgcctatcagggcctcttcccgaaggactcgctgcggcggatcggcgcaccggaaagcgccttccacatcgacggcctcgaattctacgaccaggtctccttcctcaaggctggcctcgtctacgcctcgcatctcaccaccgtcagcggcacctatgcgcgcgagatcaccacggccgagttcggctgcggcctggagggtctgctccggctgcgctcggacgccgccgagctcaccggcatcctcaacggcatcgacgagagctgggacccgcgctcctgcgcccagctcgcccagcaattcggcgccggcgactgggtcggcaagaaggccaatgcggactacgtgcgcaagcagttcgggctggcggtgtcgcgcggcccgatgttcggcatcgtcgcgcggctcgtgcaccagaagggcatcgatctcgtgctgtccgcggccgacgagatcatcgatgccggcggccagatcgtggtcaccggctccggcgagccggcgctcgagcaggcgctgatcgacgcacatcgccgccgccccgatgcgatcggcgttgcgatcggcttcaacgacgcccaggcgcggcgcatcttcgccggcagcgacttcaccctgatgccgtcgcgcttcgagccgtgcggcctcagccagatgtacgcccagcgcttcggctcgctgccgatcgggcaccagaccggcggcttggccgagaccatcaccgacggcgagaccggcttcctgttctcgagaccctcgcacgaatccttcctcggcggcgtccgccgggccttcgaagccttcatggcgcaggaccagctcgactccatgcgccgcagcgccatgggacggtcgttctcctggagcatctcggccgacagctatagcgcgctgtaccggaagctggcagcggtgtga

SEQ ID NO: 4904 - protein, 462 aa, Bradyrhizobium japonicum
MDDFVRVGGLGAVSAALPRALRPFADIRIMLPGYRDIIEQLTHIQIVGRCPSFADLPACSLGRAATKDGLPVYVLLCSQLYDRPGNPYGDESGRDWPDNDIRFARFASAAAELAMGKLDKNWAADLIHANDWQASLVPAYLAWRGAKLPSILTIHNLAYQGLFPKDSLRRIGAPESAFHIDGLEFYDQVSFLKAGLVYASHLTTVSGTYAREITTAEFGCGLEGLLRLRSDAAELTGILNGIDESWDPRSCAQLAQQFGAGDWVGKKANADYVRKQFGLAVSRGPMFGIVARLVHQKGIDLVLSAADEIIDAGGQIVVTGSGEPALEQALIDAHRRRPDAIGVAIGFNDAQARRIFAGSDFTLMPSRFEPCGLSQMYAQRFGSLPIGHQTGGLAETITDGETGFLFSRPSHESFLGGVRRAFEAFMAQDQLDSMRRSAMGRSFSWSISADSYSALYRKLAAV

SEQ ID NO: 4905 - DNA, 1530 bp, Agrobacterium tumefaciens
  CDS (1)..(1530)
atgcggattcttgccgttacggccgaaatgtttcccttcgtcaaaaccggcggattggccgatgccacgagcgctttgccgcaggcgctggaacgaaaaggggctgacgttcggacattgctacccctctaccgcgggctcacgccgcttgtccgcggccggaagccggtcctggttgccaatattctggagcagccggtatcagtttattacgttgtttccgatggtcacaagcttctgcttcttgaagcggcaagcctgttcgacagagacggacatccctatggcgtaaaaggcgagccttttgctgacaacgatcttcgctttgcggttctgtccaaagtagcggcggaaatagccctcggcgcgattgacggctggcagccggatgttgtccatgtccatgattggcacgcggctctgacctgcgtctatctcgcggattcgacgccctcggtagcctccgttctaacccttcacaatctcgcatttcagggtcagtatccgctggagagggcgggtatgcttggactaccctcgcacctctgcactgtcgattgccttgaatattacgatgacatgtcatttttgaagggcggtctgacgaccgcgtcggcggtaacgacggttagtccaacttatgcaagagaaatccttacgccggaaatggggatgggaatgcatggcgtgctcgccaggcggcgaggggacctgcgcggcatcgtcaacggtgtcgatcacgacgtctggaatccggcaacagatccgtacattctcgcaaatttcacggctgccacggcgacaagacggagcctcaacaaatatgccttgcttcaggcccttggcctagcccctacccagggccctgtcttcggcgtggtcagtcgcctgacctggcaaaagggaatcgatctcctccctcacgtcgtaccccttataatagaaaggaaaggcaggctgatcgttcacggagagggagatacggcactggaagacagcttgcaggcgctggcaaagcgctatccggaactagtctgcgcccatatcggctatgacgaacggctggcgcacatgatccaggccggctcggatttcatcatccagccgtcacggttcgaaccctgcgggctgacgcagctttacgcgctgcgatacggcgcgctgcccatcgtcagccgcacgggcgggctggcggaaaccattatcgacgcgaatgacgcggccattgaagcgggcgtagcaacaggctttcaattcgagccggcgaatgaagacgatctgcgcgccgcgctggagcgtgccattagcgcctataacgaccgggaacttttccgacggcttcagacgcaggccatgcaggccaatttttcctgggacaagagtgccgcacaatatatggcgcttttcgagagccttgtcggcaacagcacgcgcgaaacggatgccgtcgccgacatcagaaccgagacttttgcaaagataagagctgataggcggctggcgggaaccccaggatcaccaacaggttag

SEQ ID NO: 4906 - protein, 509 aa, Agrobacterium tumefaciens
MRILAVTAEMFPFVKTGGLADATSALPQALERKGADVRTLLPLYRGLTPLVRGRKPVLVANILEQPVSVYYVVSDGHKLLLLEAASLFDRDGHPYGVKGEPFADNDLRFAVLSKVAAEIALGAIDGWQPDVVHVHDWHAALTCVYLADSTPSVASVLTLHNLAFQGQYPLERAGMLGLPSHLCTVDCLEYYDDMSFLKGGLTTASAVTTVSPTYAREILTPEMGMGMHGVLARRRGDLRGIVNGVDHDVWNPATDPYILANFTAATATRRSLNKYALLQALGLAPTQGPVFGVVSRLTWQKGIDLLPHVVPLIIERKGRLIVHGEGDTALEDSLQALAKRYPELVCAHIGYDERLAHMIQAGSDFIIQPSRFEPCGLTQLYALRYGALPIVSRTGGLAETIIDANDAAIEAGVATGFQFEPANEDDLRAALERAISAYNDRELFRRLQTQAMQANFSWDKSAAQYMALFESLVGNSTRETDAVADIRTETFAKIRADRRLAGTPGSPTG

SEQ ID NO: 4907 - DNA, 1449 bp, Bradyrhizobium japonicum
  CDS (1)..(1449)
atgacgcctgctcgcgtcctcgcggtcgcctccgaagtctatcccatcgtcaagaccggcggcctcgcggatgtcgccggcgcgctgccgattgcgctgaaggcgcacggcgtcgagatgcgcaccctgatgccgggctatcccgacgtgatgcggctgctctcgggcgcggaggagatccggcgctggccggattatttcggcgggccgggccggctgctcgccggcgcgcatgacgggctcgacctgttcgtgctcgacgtgccgcatctctacgcgcggccgggcaacccatacgtcacgacagagggggtcgactggccggacaacggcgtgcgctttgcggcgctgtcgcgcgtggcggccgacatcggccacggactcgttccggccttcgtgcccgacatcgtgcacgcccatgactggcaggccgggctcgcgcccgcttatctgcactacgacaatcgtccgcggcccggcaccgtgatgacgatccacaacatggcctatcagggcaagttcgctcctgagctgatcggtgcgatcggcctgccgtggagctccttcgacgtcaacggcctcgaatatttcggcggcatcagcttcctgaaggccggcctgcaattcgccgatcgcatcacgacggtgtccccgacctacgcgcgtgagatccagagcgacgaaggcggcatggggctcggcggcctgctgcgcgcgcgcgcgggcgcattgagcgggatcctcaacggcatcgacatcgcggtgtggaatccgcagaccgattcgcacatcgcctatcggttcggcgcggaggaccttacattccgcgctgcgaacaaggcggtgcttcagcaacaattcaatctcgattcctcggacgaagcccccctgctcggcgtcatcagccggctgtcctggcagaaggggctcgatctcctgctcgaggccattccgaccattttgggcgaaggcatgcagctcgcgctgctcggcagcggcgaccgcgatctccaggatcgctatcaggccgccgcccgcgcgaatcccggccggatcggggtcgtaatcggctacgacgagatcctggcgcatctgatccaggccggctcggacgcgctcatcgtgccgtcgcggttcgagccgtgcggcctgacccagctctgcgccctgcgctatggcgccgtgccgatcgtctcgcgcgtcggcggcctcgaggataccatcgtcgatatcggcgaggccggccgcgaggccaccggcttcaagttcggcccggtgacggcggatgccctcgccggcacgctgcgcaaggccaacacggctttccacgacaagctgacctggcggcagctgcaacgaaacggccttgcgaccgacgtctcctggcgcagccgcgccggcgactatgcagcgctgtatcggagcctgatcgaatcgcgccgcgcctag

SEQ ID NO: 4908 - protein, 482 aa, Bradyrhizobium japonicum
MTPARVLAVASEVYPIVKTGGLADVAGALPIALKAHGVEMRTLMPGYPDVMRLLSGAEEIRRWPDYFGGPGRLLAGAHDGLDLFVLDVPHLYARPGNPYVTTEGVDWPDNGVRFAALSRVAADIGHGLVPAFVPDIVHAHDWQAGLAPAYLHYDNRPRPGTVMTIHNMAYQGKFAPELIGAIGLPWSSFDVNGLEYFGGISFLKAGLQFADRITTVSPTYAREIQSDEGGMGLGGLLRARAGALSGILNGIDIAVWNPQTDSHIAYRFGAEDLTFRAANKAVLQQQFNLDSSDEAPLLGVISRLSWQKGLDLLLEAIPTILGEGMQLALLGSGDRDLQDRYQAAARANPGRIGVVIGYDEILAHLIQAGSDALIVPSRFEPCGLTQLCALRYGAVPIVSRVGGLEDTIVDIGEAGREATGFKFGPVTADALAGTLRKANTAFHDKLTWRQLQRNGLATDVSWRSRAGDYAALYRSLIESRRA

SEQ ID NO: 4909 - DNA, 1431 bp, Bacillus cereus
  CDS (1)..(1431)
atgaatattttatttgcagtatcagaatgtgtaccgtttgtgaaatcgggaggattagctgatgtagcgggtgcgctcccaaaagagctaaaaaaattaggagtggacgttcgtattatacttccgaattatagtctcattccgcaaaagttaagagatggatgtacgttacataaagtaattaacgtccctcttgggtggagaaatcaatattgtggaattttaaaaggtgagcaagacggaattacgtattacttaatagataatgaatattattttaagagagattctctgtatggtcattacgatgacggagagcgtttttcttatttctcaaaagcagtgttagagtgtattccgcaccttgattttgaagtggatgttcttcatagccatgattggcatacggctatggttaatttcttacttcgtgaaaagtatcaagataacccgttatatgagcgtattaaaacggtatatacgattcataacttgcagttccaaggtgtatttcctcctgaagtgatctacgacttgttagagcttggtgatgaatattttcatagtgagcagctagagttttatggaaacgtaaactttatgaaaggcggtattattgcttcggatcaaattacagcggtgagcccgacgtataaagaagaaattcaatatgaatttttcggtgagaagttagatggattactgcgaaaatataatgataagcttagcggcattgtaaatggtattgatacgagcgtatataatccagaaacggattcgtatattaaggcccagtatgatgcagagtcattatatgaaaagagtgaaaataaacgcgccttgcagcgttattttggtttgccagaaaaagaggatacaccaattatttcaatggtaacgagattaacgaagcaaaaaggtcttgatttagtacgtactgtattccgcgaaataatggaagaagatgtacaatgtattattttaggttcaggtgattcggaatatgagcaattctttgagtggatggcatatgagtatccggagaaggtaaaagtttatatcggatttaatgaagaattagctcaccaagtgtatgcgggaagcgatttgtttttaatgccatcgctgtttgaaccgtgtggacttggacaacttatcgcattagcatacggtacgattccaattgtaagagaaacaggtgggttaaacgacacggtacattcttatgatgaagaaactggagaaggaaatggtttcagtttcacgaattttaatgcacatgacatgctgcatacgattcatcgtgcaattgaattctatcatgataaaccagtgtgggagcagcttgtaaaacaagcgatgactgaagattatagctgggagcaatcggctcttgcttataaggaattgtataaaagtctcatggaataa

SEQ ID NO: 4910 - protein, 476 aa, Bacillus cereus
MNILFAVSECVPFVKSGGLADVAGALPKELKKLGVDVRIILPNYSLIPQKLRDGCTLHKVINVPLGWRNQYCGILKGEQDGITYYLIDNEYYFKRDSLYGHYDDGERFSYFSKAVLECIPHLDFEVDVLHSHDWHTAMVNFLLREKYQDNPLYERIKTVYTIHNLQFQGVFPPEVIYDLLELGDEYFHSEQLEFYGNVNFMKGGIIASDQITAVSPTYKEEIQYEFFGEKLDGLLRKYNDKLSGIVNGIDTSVYNPETDSYIKAQYDAESLYEKSENKRALQRYFGLPEKEDTPIISMVTRLTKQKGLDLVRTVFREIMEEDVQCIILGSGDSEYEQFFEWMAYEYPEKVKVYIGFNEELAHQVYAGSDLFLMPSLFEPCGLGQLIALAYGTIPIVRETGGLNDTVHSYDEETGEGNGFSFTNFNAHDMLHTIHRAIEFYHDKPVWEQLVKQAMTEDYSWEQSALAYKELYKSLME

SEQ ID NO: 4911 - DNA, 1458 bp, Bacillus stearothermophilus
  CDS (1)..(1458)
atgaaggtcctatttgccgtttccgaatgtgcaccgtttgccaaatcagggggattggctgacgtcgccggcgcactgccgaaagagctgcgccggctcggcattgatgcccgcgtgatgttgccgaaatatgaaacgatcgcccctgaatggaaaaagaaaatgaaaaaagtcgccgagctcatcgtgccggttgggtggcggcgccaatattgcggcgtggaggagcttcggcatgacggagtcatctattactttatcgacaacgaatattattttaagcggccgcagctgtacggccattatgatgatggcgagcggttcgcctatttttgtcgggcggtgctcgaagtgttgccggaaattcagttccagcccgacgtaattcactgccatgactggcatacaggcatggtgccgtttttgcttcgggaacaataccggcatgagctgttttatgtcgacatgcgcaccgtctttacgattcataacttgcagtttcaagggctgtttccgcgcggcattttagaagacttattgaatttggatggtcgctatttcactgtggatcatcttgagttttatggctgcgtcagctttatgaaaggggcgctcgttgcttccgatttgattacaacagtgagcccgacgtataaagaggagattcaaaccgcctattacggcgagcggttagacggtttgctgcgggcgcggcgggatgatctgctcggcattttaaacggcattgacgatgagttttacaatccagaagcggatccgtttttgacggcgacgtatagcgtacatacgcgggaaagaaaacaactcaacaagcgtgccttgcagcggcagttcggcttgccggagtgggacgatgtaccgcttatcgcgatggtcacgagaatgacggcgcaaaaagggcttgatttagtaacatgcgtctttcatgagatgatgagtgaagatatgcagcttgtcgtactcggcacgggcgactggcggtttgaacaatttttctcgcaaatggctgcggcgtatccgggcaaagtcggcgtgtacatcggcttccatgaaccgctcgcccaccaaatttacgccggtgccgatttgtttttaatcccgtcgttatttgaaccgtgcgggctgagccaaatgatcgcgctccggtatggaacgatcccgatcgtccgggaaactgggggattaaacgatacggtgcaatcatacaatgagataacaaaagaaggaaatgggttcagctttaccaattttaacgctcatgacatgctgtatacgatccgccgggcgctgtcattttaccgccaaccatccgtttgggaacagttgacggaacgggcgatgcgcggtgattacagttggcgtcggtcggcaaaccaatataaacaagcctatgaacagctgatcaaaaaggaggagcacacgcttgttcacggataa

SEQ ID NO: 4912 - protein, 485 aa, Bacillus stearothermophilus
MKVLFAVSECAPFAKSGGLADVAGALPKELRRLGIDARVMLPKYETIAPEWKKKMKKVAELIVPVGWRRQYCGVEELRHDGVIYYFIDNEYYFKRPQLYGHYDDGERFAYFCRAVLEVLPEIQFQPDVIHCHDWHTGMVPFLLREQYRHELFYVDMRTVFTIHNLQFQGLFPRGILEDLLNLDGRYFTVDHLEFYGCVSFMKGALVASDLITTVSPTYKEEIQTAYYGERLDGLLRARRDDLLGILNGIDDEFYNPEADPFLTATYSVHTRERKQLNKRALQRQFGLPEWDDVPLIAMVTRMTAQKGLDLVTCVFHEMMSEDMQLVVLGTGDWRFEQFFSQMAAAYPGKVGVYIGFHEPLAHQIYAGADLFLIPSLFEPCGLSQMIALRYGTIPIVRETGGLNDTVQSYNEITKEGNGFSFTNFNAHDMLYTIRRALSFYRQPSVWEQLTERAMRGDYSWRRSANQYKQAYEQLIKKEEHTLVHG

SEQ ID NO: 4913 - DNA, 1533 bp, Bordetella bronchiseptica
  CDS (1)..(1533)
atgacgaccatacgtaccttggtggtggccgcggaggcgtttccgctggccaagacgggcggcctgggcgacgccgtggcgggcatggtgcaggcgctgggccaccggccgggcggtgtggacgtgcagtgcgagttgctgatgcccgcctatcgcggcacgctggacaggctgtaccggccgcgcacggtcgcgcggctgggcggactgcccggcggcccggccagtctggtgcgcggccattgcccgggctcgggattgtcggtgctgctgctgcgcaacgacgcgctgtacgaccggcccggcatttacgtggacgacagcggccagggctacccggacaatgcccgccgctatgcggccctggcccacgcggccgcccggctggcgcagggcctgcccgggctgcggccgccgcacgtggtgcacgcgcacgactggcatgccgcgctcgcgccgctgctcatccacgcggccggactgcactacgtcaagacgctgctcaccattcacaacctggcgttccagggtacgtttccggccgagctggccagcgcgctgggcatcccgctggcgtgccggcacgacgacggcgcgctgtccgatgaccgagtgaatttcctcaaggccggcatccgttatgcgacccgcgtcaccaccgtcagccgcgcctatgcgcgcgagattctcacgccggcgttcggttgcggattgcacggtttgctgcgcgcgcgcggcgccgacctgagcccggtgcccaatggcatcgacaccgcgctgtggaatccggccgccgacccgcatctgggcggcctgcgcttcgacgcgctggatatgcgcaacaaggcctgttgcaaggccgcgctgcaggccgagctgggcctgcagctgcgcgcggacgcgaccgtgctggccatgggcagccgcctgaccggccagaagatggccgacgtggccatcgccgccctgcccgccctgttggaggcgcacgaacacttgcagttcgcgctgatcggccgcggcgagccggacctcgaagcggcgctgcgcgccctggcggcgcgctacccgggccgctgcgcggtccacatcggctacgacgaaccgcttgcgcaccggctgcacgccggcgccgacctgctgctgcacggcagccgcttcgagcctttcggcctgaccccgctgtacgccatgcgctatgggaccctgccggtggcctcgcgggtgggcggcatggtcgataccatccgcgacccgggcccggcgatcgaagagtcctgcgccggccagggcacgggtttcctgttcgatggcagcgagcccgccgacatgcggcaggccgtgacgcgtgcgctgcgcgcgctggccaagccggcggtgcgcgacgccatgcgccgcaatgccatgcaggccgatttcagctggcgcacctcggcgcaggcttatgcggggctgtacgccaatctggccagcgggccgcagcgcggccgggtgcccgcgcccacgctgccgctgctggccaacgcggcctga

SEQ ID NO: 4914 - protein, 510 aa, Bordetella bronchiseptica
MTTIRTLVVAAEAFPLAKTGGLGDAVAGMVQALGHRPGGVDVQCELLMPAYRGTLDRLYRPRTVARLGGLPGGPASLVRGHCPGSGLSVLLLRNDALYDRPGIYVDDSGQGYPDNARRYAALAHAAARLAQGLPGLRPPHVVHAHDWHAALAPLLIHAAGLHYVKTLLTIHNLAFQGTFPAELASALGIPLACRHDDGALSDDRVNFLKAGIRYATRVTTVSRAYAREILTPAFGCGLHGLLRARGADLSPVPNGIDTALWNPAADPHLGGLRFDALDMRNKACCKAALQAELGLQLRADATVLAMGSRLTGQKMADVAIAALPALLEAHEHLQFALIGRGEPDLEAALRALAARYPGRCAVHIGYDEPLAHRLHAGADLLLHGSRFEPFGLTPLYAMRYGTLPVASRVGGMVDTIRDPGPAIEESCAGQGTGFLFDGSEPADMRQAVTRALRALAKPAVRDAMRRNAMQADFSWRTSAQAYAGLYANLASGPQRGRVPAPTLPLLANAA

SEQ ID NO: 4915 - DNA, 1428 bp, Chlamydophila caviae
  CDS (1)..(1428)
atgaaaatcatacaaactgctgtagaatttgctccttttattaaagctggcggattaggtgatgccgtctatggcttatcaaaagcattgtctgaaagccatgatgttgaggtattacttcctttctttcctctaatcaccccctctttttcttctcaagtaattgacgagaaggttttttcttacgaattcctagggagacagcatgcgcattccatttcctattcctatgaaggaatgattctcacaataattaaattggattcacaattagatctgttctcaacatcaacaatctatactgaagatgatacattacgcttcagcgctttctctgctgccgctgccgcctacattggggaattagatcatgtggacattgtacacatgcatgattggcatatggggcttctaagcggccttttaaaagaacctaaccgcccgcattatccaaaaagaatttttacaattcataattttagttatcgaggctattgcagcacacaattacttgggacatcagggatcagcgatttcgggttaagtaattatcaattatatagagatcctcagatgagtgtattactgaaaggagctctatattgttctgattatattaccactgtctcccctacatatgctcaagagattcttaatgattattctgattatgaaatgcacgatgcgatcatggctagacgccatgttttctgtgggatcttaaatggtatagatgaacagatctggaatcctgaaacggatgcttctttggctgtcaattacagcaaagatttacttgatgctcctgatgttttattcacaaagaaagaggaaaataaaaatgctctatatgagaaattagggctgtcctatgaatactctcctttaatgtgcatcatttctcgcattgtagaacaaaaagggcctgaatttatgaaagcagccattctccatgctatggaaaatggctatgctttagtcatagtaggcacgtgttacgatccagaaattcaaagaaaatttacaaatttacaagagtcgttaacgacttctccgaatatccgcattatcttagattataacgatcctctagcccggttagtgtatggggctgcggacatgatctgtattccttctcattttgagccctgtgggctcacacaactcattggaatgcgttatggaacggttcccttagttagatctaccggaggccttgccgatacggttgtaacgggaatcaatgggttcacattctctcagacggataatttcaatgatttccttcacatgctaacgctagcaattaccacttacagacaagagccggacatatggttccaacttgtagaagaaggtatgctgcgatcttcgggtctaacaacaatggcgatacattatttaggagtctataattccttattatga

SEQ ID NO: 4916 - protein, 475 aa, Chlamydophila caviae
MKIIQTAVEFAPFIKAGGLGDAVYGLSKALSESHDVEVLLPFFPLITPSFSSQVIDEKVFSYEFLGRQHAHSISYSYEGMILTIIKLDSQLDLFSTSTIYTEDDTLRFSAFSAAAAAYIGELDHVDIVHMHDWHMGLLSGLLKEPNRPHYPKRIFTIHNFSYRGYCSTQLLGTSGISDFGLSNYQLYRDPQMSVLLKGALYCSDYITTVSPTYAQEILNDYSDYEMHDAIMARRHVFCGILNGIDEQIWNPETDASLAVNYSKDLLDAPDVLFTKKEENKNALYEKLGLSYEYSPLMCIISRIVEQKGPEFMKAAILHAMENGYALVIVGTCYDPEIQRKFTNLQESLTTSPNIRIILDYNDPLARLVYGAADMICIPSHFEPCGLTQLIGMRYGTVPLVRSTGGLADTVVTGINGFTFSQTDNFNDFLHMLTLAITTYRQEPDIWFQLVEEGMLRSSGLTTMAIHYLGVYNSLL

SEQ ID NO: 4917 - DNA, 1467 bp, Chlorobium tepidum
  CDS (1)..(1467)
atggccagaagaaattttaaggttctttatgtctctggcgagagttctccttttgtaagggtcagttctctggccgactacatggcatcattcccccaggcgctcgaagaggagggtttcgaggccagaatcatgatgcccaaatatggtatcatcaacgaccggaagttccgtttgcatgatgtgctcaggctgtcggacattgaagtccctctcaaggacaagaccgacatgctgcacataaaggttaccgccctcccgtcaagcaagattcaaacctatttcctctataacgagaaatatttcaagcgctacgggcttttctccgacatttcgctcggaggagaccacaagggcagcgcggagcgaatcatctttttcagcgtcggcgtcatggagacgctcgtgcgcctgggctggcagcccgacattatccactgccatgactggcacgccggtctggtggcgctgctcgccaagacgcgatacgccaaacacgacttcttcaaaaaggtgaaggttgtgcagaccattcataatgtttaccgccagggcgtttttccgtcgaaggcgttccagaagcatctcgacccggaggtgtgcgacgcgctcgacatggagggcggcgaggtcaacctgctggctaccggcatcaagcacgccgatctggtcaccaccacctcggatcgctacgcccgccagcttctcgatgatccggagctttcgttcggcatggacaaggcgctgaaggcgtgcggcgaccgtttccacggtattctcaacggcatggacactcgccagtggaatccatcctcggacaagctcatcaagaagcgctacagcgccgaacagccggagatgaaactcgaggacaagaaggtgctgctcgaagaggttggtctgccattttccgaagagacgccggttgtcggcgtgatcggaagcttcgatcaataccagggcgcggagatcgtcaaggcaagcctcgcgaagctgcttgagctcgacattcagctcatcgtgttcggttcgggcgacaaggagttcgaccaggcgctcaaggagaccgcggaggaaaacgaggagaagatggccttccggcccgaattcactgatgcgttttaccaccagatgatcgccggacttgacattttgctcatgacctcccgcatcgaggcgtgcggcatgatgcagatgtttgccatgaactacggcaccgtgccggttgcctacgcgggcggcggcattgtcgataccatcgaggaggtctccggcgacaagggtaccggcttcatctttaccgactacacgcccgaggcgctgacggcgaagttgcaggaggcgctggcactgtttgccaacagggagcgctggagcgcgctcatgctcgaatgcatggggcgcgatttttcgtggagcacgtcggcggggcagtatgccgagctctaccgaaatctgcttggctga

SEQ ID NO: 4918 - protein, 488 aa, Chlorobium tepidum
MARRNFKVLYVSGESSPFVRVSSLADYMASFPQALEEEGFEARIMMPKYGIINDRKFRLHDVLRLSDIEVPLKDKTDMLHIKVTALPSSKIQTYFLYNEKYFKRYGLFSDISLGGDHKGSAERIIFFSVGVMETLVRLGWQPDIIHCHDWHAGLVALLAKTRYAKHDFFKKVKVVQTIHNVYRQGVFPSKAFQKHLDPEVCDALDMEGGEVNLLATGIKHADLVTTTSDRYARQLLDDPELSFGMDKALKACGDRFHGILNGMDTRQWNPSSDKLIKKRYSAEQPEMKLEDKKVLLEEVGLPFSEETPVVGVIGSFDQYQGAEIVKASLAKLLELDIQLIVFGSGDKEFDQALKETAEENEEKMAFRPEFTDAFYHQMIAGLDILLMTSRIEACGMMQMFAMNYGTVPVAYAGGGIVDTIEEVSGDKGTGFIFTDYTPEALTAKLQEALALFANRERWSALMLECMGRDFSWSTSAGQYAELYRNLLG

SEQ ID NO: 4919 - DNA, 1449 bp, Clostridium perfringens
  CDS (1)..(1449)
atggaggggtttaaattgataaaagttttatttgcaacatcagaggcaaatccatttataaaaactgggggactaggtgatgtaatgggagcattacctaaggagcttaaaagaaagggaatagatgctagagtaattttgcctaaatatagtgctataaaaggagaacttttagataagcttagttttaaaaaatggtttatggttcctgttggttggagaaatcaatattgtggagtatatcagtgtgaatatgatgaagttatatattatttattagatagtgagttttatttccacagaaatggtttatatggagaaggtgatgatggagagagatttgctttctttgatagagctgttttagaaactttaaaagagattgattggtgtccagatattattcattgtaatgattggcaaacaggaatgataccagtacttcataaattagagtattctaaagatccattttataagaatattaagactgtgacttcaattcataatcttttattccaaggtaatttttcagcagatgttttaccagaactttttggatatgattatgaaccagtgagaaatggaagtttagaattttatggtggaatgagttttatgaagggagctataaattatagcgataggattttaactgtaagtgaaacttatgccaaggaaattaaaactccttactttggagaaaatttagatggcttattaagagaaagaggatatgcactaaaaggaatagtaaatggtatagattatgatgaatttaatcctagtaaggatagtttaatagctaaaaatttctcagtgaaaactatagaagataaagtgttaaataaattagctcttcaaaaggaattagggttacctataaatccagatatacctatgataagtattgtatctaggcttacaaatcaaaagggatgcgacttaatagttaatatagcaaatagattacttcaaagaaatgtgcaattagttatattaggaacaggtgattataattatgaaaatcattttaagggattgcaagagctttatccaactaaggtatctgcaaatataaagtttgataatggattagctcatagaatatatgcatcttcagatattttcttaatgccatcattatttgagccttgtggactaggacaacttatagcattaagatatggagctattccaatagttagagaaacaggtggattaaaggacacaattcattcctataataaatatactggaatagggaatggctttagtttcacaaattataatcataatgatttaatgcatgttattgaattagctttagaaacatatgatgataaagagatttggagatcattaattatacaagctatggattctgataatagttggaataagtcagcagaaaaatataaggaattatatgaagaattaatcaagtag

SEQ ID NO: 4920 - protein, 482 aa, Clostridium perfringens
MEGFKLIKVLFATSEANPFIKTGGLGDVMGALPKELKRKGIDARVILPKYSAIKGELLDKLSFKKWFMVPVGWRNQYCGVYQCEYDEVIYYLLDSEFYFHRNGLYGEGDDGERFAFFDRAVLETLKEIDWCPDIIHCNDWQTGMIPVLHKLEYSKDPFYKNIKTVTSIHNLLFQGNFSADVLPELFGYDYEPVRNGSLEFYGGMSFMKGAINYSDRILTVSETYAKEIKTPYFGENLDGLLRERGYALKGIVNGIDYDEFNPSKDSLIAKNFSVKTIEDKVLNKLALQKELGLPINPDIPMISIVSRLTNQKGCDLIVNIANRLLQRNVQLVILGTGDYNYENHFKGLQELYPTKVSANIKFDNGLAHRIYASSDIFLMPSLFEPCGLGQLIALRYGAIPIVRETGGLKDTIHSYNKYTGIGNGFSFTNYNHNDLMHVIELALETYDDKEIWRSLIIQAMDSDNSWNKSAEKYKELYEELIK

SEQ ID NO: 4921 - DNA, 1335 bp, Deinococcus radiodurans
  CDS (1)..(1335)
atgcgtgtgctgcatctcgcctccgaggtcttccccttttcccgctccggtggcctgggcgacgtgctgggagcgctgcccgctgtgcaggcgcggctgggcgaagacgcagaagtcacggtcctctcgccgtggtacgcctccttgcagggcgagccgcaggaactctggcgcggggaagcctggggcgagcaggcgtggctgggcgaactccgtcaggacggcgtgcgctacctctttctcggcctgaacgagtttcagcgccccggcctctatcaccccgacgacgtagagcgcttctgcgccttcgggcgagcggcgctcccggcactggacgcggtgggcgtgaccccggacgtgctgcacgggcacgactggcaggcgggactggtggtcgcccacgcccggctgcgtggcctgcggaccgccttttcggtccacaacctgcaataccagggccgctggaacctgcacgaagcggcgggctggaccgggctcccggactggaccttcgggcccgatggggtggagtttttcggcgacctcaacctgatgaaagcgggcctgaactttgctgggcacgtcaccaccgtcagccccacctacgcgcaggaaatcaccacgccgcaatacggcgaggggttggaagggctgctggtgcggctgacccacgagggccgactctcgggcatcctcaacgggctcgaccaggaccgctggaacccgcgcaccgaccccgacatcgccgcctacagcgacccggcaggcaaggcaggggccgtgaaggcgctgcggcaggaattcggcctggacgacgccccgattctggcgacggtcagccgcctcgccgaccagaagggcatggacctgctgattacggcgctgcccgaactggtgcgcgactggaacgtggtggtgctcggcggcggcgacccgctgctggaagccgcgctgaccggctgggccaaccacccccgcgtcgccttcgcttcgggcatgaacgagccgttggcgcaccgcatctacgccggcgcccacgcgtttgccatgcccagccgcttcgagccgtgcggcctctcgcagctcatcgccatgcgctacggcaccctgcccatcgtgcgcgaaaccggcggactggccgacaccgtgccgcccgaagtcggtttccgctttgccgacgccaccgcgcccgccttcctgcaagcctgccgcgaggcccaggccgcctttcaggacccggcgcagtggcagacccgcgccacccgcgccatgtcattggatttctcctgggacggtccggcacggcaatacctggaactttaccgggggctgtaa

SEQ ID NO: 4922 - protein, 444 aa, Deinococcus radiodurans
MRVLHLASEVFPFSRSGGLGDVLGALPAVQARLGEDAEVTVLSPWYASLQGEPQELWRGEAWGEQAWLGELRQDGVRYLFLGLNEFQRPGLYHPDDVERFCAFGRAALPALDAVGVTPDVLHGHDWQAGLVVAHARLRGLRTAFSVHNLQYQGRWNLHEAAGWTGLPDWTFGPDGVEFFGDLNLMKAGLNFAGHVTTVSPTYAQEITTPQYGEGLEGLLVRLTHEGRLSGILNGLDQDRWNPRTDPDIAAYSDPAGKAGAVKALRQEFGLDDAPILATVSRLADQKGMDLLITALPELVRDWNVVVLGGGDPLLEAALTGWANHPRVAFASGMNEPLAHRIYAGAHAFAMPSRFEPCGLSQLIAMRYGTLPIVRETGGLADTVPPEVGFRFADATAPAFLQACREAQAAFQDPAQWQTRATRAMSLDFSWDGPARQYLELYRGL

SEQ ID NO: 4923 - DNA, 1386 bp, Fusobacterium nucleatum
  CDS (1)..(1386)
atgaaagttctttttgcaacaggagaagcttttccatttgttaaaacaggggggttaggagatgtgtcttattctctcccaaaaaccttaaaacaaaaggaaaatgttgatattagagttattttacctaagtatagtaaaatttcaaatgaattattaaaagatgctaggcacttaggacataaggaaatttgggttgcacatcataatgaatatgtaggaattgaagaggttgaactggaaggagttatttactattttgtagataatgaaagatattttaaaagacctaatgtttatggtgaatttgatgactgtgaaagatttttatttttctgcaaagcagttgttgaaactatggatatcacaaaatttaaacctgatatcattcattgtaatgattggcaatcagctcttatacctatatatttaaaggaaagaggaatatatgatgtaaaaactatttttactattcataatcttagatttcaaggttttttctttaataatgtaatagaagatttattagaaattgatagggcaaaatatttccaagaagatggtttaaaatattacgatatgatttctttcttaaaaggaggagttgtttattctgattatattacaacagtgagtgatagttatgctgaagaaataaaaactcaagagcttggtgaaggtatacatggattatttcaaaaatatgattataaattatcaggaatagtcaatggaattgataaaatttcatatccattatctaaaaaacctcataaaatattaaaggctgatttacaaaaaaaattaggtttagatgtagaagaggatacacctttaattgttattataactcgtttagatagacaaaagggcctagattatattgttgaaaaatttgatgaaatgatgagtttaggaatacaattcattcttttaggaacaggtgaaaaacgttatgaacatttctttgcttatcaagaatatctccataaaggacaagtatgttcatacattggttttaatcaagaattatctactgaaatctatgcaggagcagatatatttttaatgccttctgtttttgagccttgtggactttctcaaatgatagcaatgagatatggttgtatacctgttgttagagaaacaggaggcttaaaagatactgtaaaaccatataatgagtatacaggtgaaggagatggctttggttttaaacaagctaatgctgatgatatgataaaaactttaaaatatgcaattaaaatgtatcatagacctaatgtatggcaagagattattaagaatgctaagaaaagagataactcttgggataaacctgcaaagagatataaggaattataccaaaggttgatagaaggataa

SEQ ID NO: 4924 - protein, 461 aa, Fusobacterium nucleatum
MKVLFATGEAFPFVKTGGLGDVSYSLPKTLKQKENVDIRVILPKYSKISNELLKDARHLGHKEIWVAHHNEYVGIEEVELEGVIYYFVDNERYFKRPNVYGEFDDCERFLFFCKAVVETMDITKFKPDIIHCNDWQSALIPIYLKERGIYDVKTIFTIHNLRFQGFFFNNVIEDLLEIDRAKYFQEDGLKYYDMISFLKGGVVYSDYITTVSDSYAEEIKTQELGEGIHGLFQKYDYKLSGIVNGIDKISYPLSKKPHKILKADLQKKLGLDVEEDTPLIVIITRLDRQKGLDYIVEKFDEMMSLGIQFILLGTGEKRYEHFFAYQEYLHKGQVCSYIGFNQELSTEIYAGADIFLMPSVFEPCGLSQMIAMRYGCIPVVRETGGLKDTVKPYNEYTGEGDGFGFKQANADDMIKTLKYAIKMYHRPNVWQEIIKNAKKRDNSWDKPAKRYKELYQRLIEG

SEQ ID NO: 4925 - DNA, 1377 bp, Gloeobacter violaceus
  CDS (1)..(1377)
atgaaggtattgtttgcggcggcggagtgtgcccccttagccaaggtgggcggcatggcggacgtggtgggctcgttgcccctggccctggccgagatggggctcgatgtacggatcatcctgccctactacggctttttgggggagctgcccaagtccgagcagccggtctggaccggcggcgccatgttccagcaggtcgaaatttacgaagcgcgcctgcccggcagcgacatccccctctatctggtcggtcacccggcctttgccaacgagcgcatctacggttttgaggacgaagcctggcgcttcacgctcttctcgcgcacggtggccgaatttctctggcggggcggttgggatccgcaggtgctccactgccacgactggcacacgggactgttgcccctctggatgcggtcgatgccggtgatgacggtcttcaccatccacaacctcgcctaccagggaccgcccctgccgtactttcgcgccttcgtggacgtcccctacgacacgggcgcctggaacccgatggtggcggggatcatccacagcgacgcgatcacggcggtctcgcccacctatgcgcgcgaaatttgcacccccgagtacggcgagcgcctggacggcctgctcaggggccagggaaaccgcctgaccggtatcctcaacggcatcaacaccaaggccctcgacccggccaccgacaagcacctgacggtcaactacgacacgaccagtctcgatcggcgcgtcgagaacaaactggccctccagcgcgagttcggcttcgaggtcagtgccgatcgcttgctggtgggtatcgtctcgcggctggtggaccagaagggcttcgatttgctcgcgccgctctgggacaactggatgcacaccagcggcgcccaactggtcgtgctcggcagcggcgacccgttttacgaatttctgtttcgctcggcggcggagcgctacccggaccgcatcaaggcggtgctgagctacaacgtgcccatcgcccagcgcatctacggcggcgcggatctgtttttgatgccctcgcgcttcgagccctgcggcatcggccagatgattgcgctgcgctacggggcggtgcctttggtgcgcaagaccggtggcctcgccgacacggttttcttccacaatccgctcgatgaaaaaggcaacggctttttgttcgaccgctacgacccggccaacctgcttgccatgctctaccgcgccgaggaagcgtttcgctacaaagactactggcgacgactgcaattgcgcggcatggaagcggacctcagttggcgcgcctccgcccatcagtacgcggatctctacaagtcgctgattgctcgcctgggctaa

SEQ ID NO: 4926 - protein, 458 aa, Gloeobacter violaceus
MKVLFAAAECAPLAKVGGMADVVGSLPLALAEMGLDVRIILPYYGFLGELPKSEQPVWTGGAMFQQVEIYEARLPGSDIPLYLVGHPAFANERIYGFEDEAWRFTLFSRTVAEFLWRGGWDPQVLHCHDWHTGLLPLWMRSMPVMTVFTIHNLAYQGPPLPYFRAFVDVPYDTGAWNPMVAGIIHSDAITAVSPTYAREICTPEYGERLDGLLRGQGNRLTGILNGINTKALDPATDKHLTVNYDTTSLDRRVENKLALQREFGFEVSADRLLVGIVSRLVDQKGFDLLAPLWDNWMHTSGAQLVVLGSGDPFYEFLFRSAAERYPDRIKAVLSYNVPIAQRIYGGADLFLMPSRFEPCGIGQMIALRYGAVPLVRKTGGLADTVFFHNPLDEKGNGFLFDRYDPANLLAMLYRAEEAFRYKDYWRRLQLRGMEADLSWRASAHQYADLYKSLIARLG

SEQ ID NO: 4927 - DNA, 1440 bp, Lactobacillus plantarum
  CDS (1)..(1440)
atgactagggtattattcgcggcggcagaagcggcccctttttataagactggtggcttaggcgatgttagtatggcgttaccgcgcgccttgcaagcggaaggaatcgagacgcgtgtagtgattccgtattaccctcaccagatgccgaccgaatatcagcagcagttagtgccagtgacgcattttactgttcaagtgggtgaacatgcgatgtattgcggtattaaaactctgacagtcgcgcacgttcagtattatctaattgataatttagattattttggtcgtgaaggattatatggttattgggatgatggtgcacgctttgccttctttcagatggcggtttgtgaaatgatggagcagatcgattatatccctgatattttacaactcaatgattggcatacggcgtttattcctgtcttgctagctgaaaagtactattggatcgaagcgtatcgtgatattaaaacggtgctgacgattcataacttacagtttcaaggtgtctacgatccgattattttggatagtctctttcgaatcggaactgagacttacaccgaagccggcgtggcgttttacgatcaagtgaactggctgaagggcggtattaactttgcagatgccgttaatacggtgtcaccgacctacgcacaagagattcaaacaccagcttttggggaacgtctcgacggggtgctgcgggccaatcggtacaaactgagtgggattcttaatggcattgatatgcaattatacgatcccgcaaccgacctggcactaacggcgaattattcggctaaggatttgaaacctaagcgtcagaataaacgtgccttacagcgccgattagggttgcctgtcaaaaacatgccggtattggcagtcgtttctcggttaacgaagcaaaagggtatcgacctcttgctggatgcattgaatccattcttgcagcaacaagatgtgcaactcattgttttgggaacgggtgacccagcattggaacgcgcgttacgcacctatcagtcggcgtatccgcaaaaggtggtcgccgcgattcaatttgatacgcagctagctcagcaaatctatgcggccagtgatatctttcttatgccttctgcctttgaaccgtgtggcttgtcgcagatgatggcgatgcattacgggacgttaccgatcgtgcacgcggtcggtgggttgcgggacacggtcattccgtacaatcgctataccggtcagggaaccggctttagctttgacgactaccagccagcggttctacgtaaaattatgattctagccgtgaccttatatcggcagcatccactggtttggcggcagctgcaacaccaagcaatgacttgtgattttggctgggaacattctgcacagcagtaccgtgcgacttatcagaagctaatgcgttag

SEQ ID NO: 4928 - protein, 479 aa, Lactobacillus plantarum
MTRVLFAAAEAAPFYKTGGLGDVSMALPRALQAEGIETRVVIPYYPHQMPTEYQQQLVPVTHFTVQVGEHAMYCGIKTLTVAHVQYYLIDNLDYFGREGLYGYWDDGARFAFFQMAVCEMMEQIDYIPDILQLNDWHTAFIPVLLAEKYYWIEAYRDIKTVLTIHNLQFQGVYDPIILDSLFRIGTETYTEAGVAFYDQVNWLKGGINFADAVNTVSPTYAQEIQTPAFGERLDGVLRANRYKLSGILNGIDMQLYDPATDLALTANYSAKDLKPKRQNKRALQRRLGLPVKNMPVLAVVSRLTKQKGIDLLLDALNPFLQQQDVQLIVLGTGDPALERALRTYQSAYPQKVVAAIQFDTQLAQQIYAASDIFLMPSAFEPCGLSQMMAMHYGTLPIVHAVGGLRDTVIPYNRYTGQGTGFSFDDYQPAVLRKIMILAVTLYRQHPLVWRQLQHQAMTCDFGWEHSAQQYRATYQKLMR

SEQ ID NO: 4929 - DNA, 1488 bp, Nitrosomonas europaea
  CDS (1)..(1488)
atgtcttcatctccttcccgcaaaaatccacgggtgttgtttgtcacttccgaagtatttccgttatgcaaaaccggagggctgggtgatgtcagtgccgcattacctgccgcgctgcgtgaactgaaggcagatgtacgcttactcgtacccggctacccgtcagtactatccgggctcaaatacaaacgtaagctggcagaattcgatctcctgccgcacttccctccaaccacattattttcctcccggttacagatcaatgaatccgtcagtctgcccttatatgtgatccactgcccggaactctatcagcgaccaggcggcatctatctggatgacgacgggcaggactggccggataacgcacaacgcttcggcctgctgtcaaaaatgggtgcactcctcgccagtgatgccagcccgctctcctggataccggatatcatccattgcaatgactggcaaagcgggctcacacctgcttatctccactaccactccgggaagaaagcagccagcctgatgacactgcacaaccttgcttttcagggctgctttccacccgatgaagtagccaggctgggattgccacccgaaagcttcagcgtgcatggcgtcgaatactacggcaatctatcgttcctcaaggcgggaatctactatgcaacccggattactacggtcagccctacttacgcccgggaaatccagcatgagccgctgggattcggtttacagggattactggccgaacgcagcaacgccatcaccggaatcatcaacgggatcgataacaccgtctggaatccggcaaccgatccgcacatcgtaaaaaaatattcaagccgcaacctggcagcaaaaaaaattaacaagctcgctctgcaacgggagatggggctggaagaaaacgaaacgattccgctgtttgccggaatcagccgtctcagttaccagaaaggctacgatattctgttgcaggtcgcacccatgctggcagatctccctgctcaactggtattgctgggaaagggagatcaatctctggaaaaacaactcgttatgcttgcacaaaccaaccctgccagaattgccgtccgcatcgactacgacgaagcgctctcgcatcggatcaatgccagtgcggactgctttctgatgccttcccgctttgaaccgtgcggactgaaccagatgtacagccagcgctacggcactccgcccatcgtccatacaaccggcggactgatcgatacagtgactgatctggcccctgatactccagccggcgaatctgcaagcggattccattttcacgaaatgaccgcagatgcattcatgaatggaatcggacgggcaattgatgcctattacaacaccaggttatggaaaaccctgcagcacaatggcatgcgtaaggatttcagctggcgatccagtgctttggcatacctgtccatttactcgctgttgatgcagcgataa

SEQ ID NO: 4930 - protein, 495 aa, Nitrosomonas europaea
MSSSPSRKNPRVLFVTSEVFPLCKTGGLGDVSAALPAALRELKADVRLLVPGYPSVLSGLKYKRKLAEFDLLPHFPPTTLFSSRLQINESVSLPLYVIHCPELYQRPGGIYLDDDGQDWPDNAQRFGLLSKMGALLASDASPLSWIPDIIHCNDWQSGLTPAYLHYHSGKKAASLMTLHNLAFQGCFPPDEVARLGLPPESFSVHGVEYYGNLSFLKAGIYYATRITTVSPTYAREIQHEPLGFGLQGLLAERSNAITGIINGIDNTVWNPATDPHIVKKYSSRNLAAKKINKLALQREMGLEENETIPLFAGISRLSYQKGYDILLQVAPMLADLPAQLVLLGKGDQSLEKQLVMLAQTNPARIAVRIDYDEALSHRINASADCFLMPSRFEPCGLNQMYSQRYGTPPIVHTTGGLIDTVTDLAPDTPAGESASGFHFHEMTADAFMNGIGRAIDAYYNTRLWKTLQHNGMRKDFSWRSSALAYLSIYSLLMQR

SEQ ID NO: 4931 - DNA, 1434 bp, Oceanobacillus iheyensis
  CDS (1)..(1434)
atgaaaaacattttatttgtcacctcagaatgtacaccatttattaagacaggcggacttgcggatgtatctggatcgttgccacaagctcttcaggaacatggaggaatggaagtaagagtgatgttacctttatatgatgaaattgatcgttcttggaaggatcaatttgaatttgtgtgcgcttttacggtctcattagggtggagagaacaaactgcagagctatatcgttatcgttataatgacgtcacgtattatttcatcggaaacgattattattttactagaaaaggaatatacggctattacgatgatggagaacgatttgtattttttagtcaggctattatagcttctttagaatatatcgattttataccaagtgtattacatgcccatgattggcaaacagggatagctgttgcactagctaaaatctatcaacctattgaagaattgattaccgtttttaccattcataatatatattaccaagggacaatgcctttaacgacatttgatgatttttttcaattaggcagagaacatttagcaggcatggaatggaatcaaatgattaatagtttgaaatcaggcatttttcatgccgataaaataacgacagtaagtccaacctatgcagaagaaatactaacaccttattacggtgccggactggaagagatgctttggaatcggcgagaagacttgataggagtgctaaatgggattgatttaaaagattataatcctgctatagataaatctttaccagttaactaccgttctgcacggtcgaaaaaaatagagaatcgtaagttactctatgaagaaataggtttgaatcttaaagatggagtacctctttatattatggttactagactagtagaacagaaaggaattcatcttgttcaacgaattttagaggaatttttacaagaggatattcaattgattgttcttggaaatggagaacaggaatttgaatactatttcaaagacatcgaataccgttacccagataaaatgattacccacctgcattttaatgaatcattagctaggagattatatgcaagtgccgattttctcctgatgccatcgaagtttgagccatgtgggttatctcaattaattgctttacaatataaaaccgtacctattgtccgtgagacaggaggattaaaagatacgataattgcttttaatgaaattacaggagaaggaaatggctttcgatttgccaattataatgcacatgaacttttacatgtactgaagtactctctggagatttatcaacaaccttcactttggtcagtattaataaagaatgtaaataaaagtaaatttagttggaaggattccgcgtctgcatatgcagacgtatatcaacagctcgatgcttcatctgtatcttataaatag

SEQ ID NO: 4932 - protein, 477 aa, Oceanobacillus iheyensis
MKNILFVTSECTPFIKTGGLADVSGSLPQALQEHGGMEVRVMLPLYDEIDRSWKDQFEFVCAFTVSLGWREQTAELYRYRYNDVTYYFIGNDYYFTRKGIYGYYDDGERFVFFSQAIIASLEYIDFIPSVLHAHDWQTGIAVALAKIYQPIEELITVFTIHNIYYQGTMPLTTFDDFFQLGREHLAGMEWNQMINSLKSGIFHADKITTVSPTYAEEILTPYYGAGLEEMLWNRREDLIGVLNGIDLKDYNPAIDKSLPVNYRSARSKKIENRKLLYEEIGLNLKDGVPLYIMVTRLVEQKGIHLVQRILEEFLQEDIQLIVLGNGEQEFEYYFKDIEYRYPDKMITHLHFNESLARRLYASADFLLMPSKFEPCGLSQLIALQYKTVPIVRETGGLKDTIIAFNEITGEGNGFRFANYNAHELLHVLKYSLEIYQQPSLWSVLIKNVNKSKFSWKDSASAYADVYQQLDASSVSYK

SEQ ID NO: 4933 - DNA, 1443 bp, Pasteurella multocida
  CDS (1)..(1443)
atgaaagtattacatgcttgctcggagttataccccttgttaaaaaccggtgggttggcagatgtgatgggcgcattaccttttgcacaaaaagagattggaattgacgcacgtattgtcttaccggcgtatcctgcaattaaagcgggcattcctgagacgactgttgtcagtgaatttgataattttgcagggcatattgtgttgcgttatggtgaatataaaggtcttggtgtgtatttaattgatgcgcctcatttatatcaacgtgaaggcaatccttaccatgatcaatggtataacgattatgccgacaactataaacgttttgcattattgggctgggtcgcagcggaattagccacgggattagacagttggtggcatgcggatgtggtgcatgcacatgactggcatgccggattagccagtgcttatttgtttaataaaggtcgccctgccaaatctgttttcacgattcataatttagcctatcaaggacaatttgcttatcaccatttagttgaaattggtttacctgctggcatgttccatgtggatggattggaattgcacggtcagatttcttacttaaaagcaggactttattattctgatgcggtgacggcagtgagcccaacttatgcaaaagaaatcaccacgcctgaatttgggtatggcttacaagggctattaaccacattaaattcacaaggaaaattagtcgggattttaaatggtgtggatgatcaaatctggcatccaaatcatgatgcgtacattgagcatcattacaaattaaaagccatgacgggtaaacgtaaaaacaaagaggcattgcaagcttactttaacttaccacaagatccggacgcgttattatttgtgatggtgacacgtttaacagagcaaaagggggtggatctgttaattgacagtgccgaagaaattgtaaaacagggtgggcaattaacgattttaggttcaggatcgccgcatttagaagccggtatcttacatttagcccagcaatatccacaccaaattgcggtgaaaattggctatgatgaagccttatctcatttaatgattgcaggtggtgacgtcattttagtgccaagtcgttttgagccttgtggcttaacacagttatacggtttgaaatatggcaccttaccgttagtcagagccaccggtggtttggcggatacagtggtaaatgcgacagtagaaaacatcaagtcacgattagctacaggatttgtatttgagcaagcaaaccgtgaggcattacgccaagccttagtaaatgcctttgcgttatggcaaaaacagcgcctttggtttacggtgcgtagcgtcgcgatggaacaagattttagctggcaaatttcagcgacgggttatcatgccctatatcaacgtcttttatcgttcaactag

SEQ ID NO: 4934 - protein, 480 aa, Pasteurella multocida
MKVLHACSELYPLLKTGGLADVMGALPFAQKEIGIDARIVLPAYPAIKAGIPETTVVSEFDNFAGHIVLRYGEYKGLGVYLIDAPHLYQREGNPYHDQWYNDYADNYKRFALLGWVAAELATGLDSWWHADVVHAHDWHAGLASAYLFNKGRPAKSVFTIHNLAYQGQFAYHHLVEIGLPAGMFHVDGLELHGQISYLKAGLYYSDAVTAVSPTYAKEITTPEFGYGLQGLLTTLNSQGKLVGILNGVDDQIWHPNHDAYIEHHYKLKAMTGKRKNKEALQAYFNLPQDPDALLFVMVTRLTEQKGVDLLIDSAEEIVKQGGQLTILGSGSPHLEAGILHLAQQYPHQIAVKIGYDEALSHLMIAGGDVILVPSRFEPCGLTQLYGLKYGTLPLVRATGGLADTVVNATVENIKSRLATGFVFEQANREALRQALVNAFALWQKQRLWFTVRSVAMEQDFSWQISATGYHALYQRLLSFN

SEQ ID NO: 4935 - DNA, 1506 bp, Prochlorococcus marinus
  CDS (1)..(1506)
atgcgcgttctttttgctgctgctgaatgcgcaccgatggttaaggtcggtgggatgggagatgttgtagcttctttgccatcagcattggcaaaacttggacatgatgttcgtttgataattcctggctatagcaaactttggggattacttgatatttctaaggatcccatatatacggcccaaacaatgggagcagaattttccgtttacgaaactaagcacccaacttctaatcttcctatttatttagtcggacatcctgtttttgatcctgagaggatttatggaggtgaagatgaagattggcgatttactttttttgcaagtgcgacagcagaatttgcttggaatgtatggaagccacaagtattgcattgccatgattggcacactggaatgatccctgtctggatgcatcaggaccctgaaattagtacagtatttaccatccataatttgaagtatcaaggaccttggcggtggaaattggaacgcatgacatggtgtccgtggtacatgagtggagatcacacaatggcggctgcaatgctttttgcagatcgtgtaaatgcagtttctccaacatattcaagggaaatacgtacttctgaatatggtgaaagtttagaaggtcttttaaattatatttcggggaaactacgaggcatacttaatggaatcgatttagatgaatgggatccagctactgataaggccttgcctgcaaattttagttctggcaagatgtctacccgtaagaaaaataaagaggcccttcagagacaaatggggcttgaagtcaataatgataaatacttgcttgggatggtgggtagactcgttgatcagaaaggtgttgatttacttcttcaggtttctagaagacttttggcatacactgactctcaaatagttgttcttggtacaggagatcaaattctcgaatcagctttatgggagcttgctattgatcaccctggtcgatttgcagttttccttacctatgatgattatctttcgcgtttaatttatgcagggagtgatgctttcttaatgcctagtcgtttcgagccatgtggtattagccagctacttgctatgcgctatggctccataccaattgttagaaatgtaggtggattagttgatactgttattcctcatgatcctattaacaaatcaggaacaggcttttgctttgatagatttgaaccaattgacttttatacagctttggttagatcttgggaggcatttcgtcatagacgtagttggaaggagttacagaaacgagctatgactcagatgtacagttgggagcgctctgctatggaatatgaaactatgtataaagaagttagtggatacaaggaaccttccccagatgctattgaagttgaaaaattttctgtaggtcaagatgcagatccttccttgaaaaatgagaagctttctgtaggtcaagatgaagattcttccttgaaaaatgagaggtttatttaa

SEQ ID NO: 4936 - protein, 501 aa, Prochlorococcus marinus
MRVLFAAAECAPMVKVGGMGDVVASLPSALAKLGHDVRLIIPGYSKLWGLLDISKDPIYTAQTMGAEFSVYETKHPTSNLPIYLVGHPVFDPERIYGGEDEDWRFTFFASATAEFAWNVWKPQVLHCHDWHTGMIPVWMHQDPEISTVFTIHNLKYQGPWRWKLERMTWCPWYMSGDHTMAAAMLFADRVNAVSPTYSREIRTSEYGESLEGLLNYISGKLRGILNGIDLDEWDPATDKALPANFSSGKMSTRKKNKEALQRQMGLEVNNDKYLLGMVGRLVDQKGVDLLLQVSRRLLAYTDSQIVVLGTGDQILESALWELAIDHPGRFAVFLTYDDYLSRLIYAGSDAFLMPSRFEPCGISQLLAMRYGSIPIVRNVGGLVDTVIPHDPINKSGTGFCFDRFEPIDFYTALVRSWEAFRHRRSWKELQKRAMTQMYSWERSAMEYETMYKEVSGYKEPSPDAIEVEKFSVGQDADPSLKNEKLSVGQDEDSSLKNERFI

SEQ ID NO: 4937 - DNA, 1500 bp, Prochlorococcus marinus
  CDS (1)..(1500)
atgcgcgtgctatttgctgctgcggaatgcgcgccgatggtcaaggttggtggaatgggtgatgtggtgggctcattgcccccagctctggccaagcttgatcatgatgtgcgtctgatcatgcctggttacggcaagctctggagcttgctggatatccctactgatccgatttggcggggtcagaccatgggcaacgagttcgccatctatgagacaagtcatcccagcaatggtttgcccctttatctggtagggcatccagtgtttgatcctgaaaggatctacggcggagaagacgaagattggcgttttacgtttttcgcaagcgcgacaacggaatttgcctggaacgtttggaaaccgcaagtgctgcattgccacgactggcataccgggatgattcctgtgtggatgcatcaggaccctgaaatcagcacggtctttaccattcacaacctcaaatatcagggcccctggcgctggaaacttgatcggatgacttggtgcccctggtacatgcaaggggatcacaccatggcggcagccttgctttatgccgatcgggtgaatgccgtctcccccacctatgccagagagatttgtacatctgaatacggggagagccttgatggcttgttgaactacatctctggaaaactgcgtgggatcctcaatggcattgacctgcaggattgggaccctggcaatgacaagtctttgccagccactttcaatgccgatgacctttcaggtcgtgctgtgaacaagcaggcccttcaacagcgcatggggcttgaggtcaatccagacacctatctactggggatggtgagtcggttggtggatcagaaaggggttgatcttctgctgcaggtgacagagcggttgcttgcttacacagattcccagatcgtcgtgctgggcactggtgagcgtggtttggaatccggcctgtggcaattggcaattcagaaccctggccgcttctcggttttcctcacttacgacgatgacctagcacgtttgatctacggcggcagtgacgcatttctgatgccgagtcgcttcgaaccctgtggcattagtcagctgttggccatgcgctacggcagcgtgccggtggtgcgcaaagtgggtggtcttgtcgacacggtgccttcctacgaccctattcatcaaaccggtactggattctgcttcgatcgatttgagcctgttgacttctatacagcattagtgaggtcttgggaggcgttccgtcatcgtgattgctggcgtgagttgcagcaacgtggaatgactcaaaactacagctgggatcgctccgctctcgactatgagcagatgtatcgggatgtctgtggctttaaggagccgtctcctgatgcggcggttgtggagcaattttctctcggccagggttcagatccttcccgtcagaaccaggacagcaatgcgaaaaaaagaaccagacgcaagaagaaggggaatgattaa

SEQ ID NO: 4938 - protein, 499 aa, Prochlorococcus marinus
MRVLFAAAECAPMVKVGGMGDVVGSLPPALAKLDHDVRLIMPGYGKLWSLLDIPTDPIWRGQTMGNEFAIYETSHPSNGLPLYLVGHPVFDPERIYGGEDEDWRFTFFASATTEFAWNVWKPQVLHCHDWHTGMIPVWMHQDPEISTVFTIHNLKYQGPWRWKLDRMTWCPWYMQGDHTMAAALLYADRVNAVSPTYAREICTSEYGESLDGLLNYISGKLRGILNGIDLQDWDPGNDKSLPATFNADDLSGRAVNKQALQQRMGLEVNPDTYLLGMVSRLVDQKGVDLLLQVTERLLAYTDSQIVVLGTGERGLESGLWQLAIQNPGRFSVFLTYDDDLARLIYGGSDAFLMPSRFEPCGISQLLAMRYGSVPVVRKVGGLVDTVPSYDPIHQTGTGFCFDRFEPVDFYTALVRSWEAFRHRDCWRELQQRGMTQNYSWDRSALDYEQMYRDVCGFKEPSPDAAVVEQFSLGQGSDPSRQNQDSNAKKRTRRKKKGND

SEQ ID NO: 4939 - DNA, 1452 bp, Prochlorococcus marinus subsp
  CDS (1)..(1452)
atgagaattcttcttgctgctgctgaatgcgctccaatgatcaaagttggagggatgggagatgtagttggttcattaccaccctcattgataaaacttggtcatgatgtaagagttataattcctggctatagcaaattatggaatctactagaagtatcaagcgaaccagtatttagagcaaatactatgggaaatgatttctctgtgtatgaagcaaaacatccaatacataattacgtaatctacctagttggacatccaacttttgattcgggccacatatatggaggagaagatgaagactggcgatttacattttttgcaagtgctactgctgaattttcctggaattgttggaagccccaagttctacattgccatgattggcacacgggtatgattccagtatggatgcatcaagatcccgaagtaagtacagtttttactatacataatttaaaatatcaaggaccatggagatggaagcttgaaaaaatgacctggtgtccatggtatatgcatggagatcatacgatggctgctgcaatgttatatgcagatagagttaatgcagtttctccaacatatgctgatgagataaaaactcatgagtatggagaaagtcttgagggattattgaattatatttctggtaaattaagaggtatcctcaatgggattgatctaaatgaatgggatcctgataaagataaagtgttacctgcacaattcaatattaaaaatttagaaagtagattagaaaataagattattcttcagaaagaaatgggacttgaggtcaatagtaaaaaatatcttttaggtatggtaagtaggctagtggaccaaaaaggtgttgatttagttttgcaagtttcccgaagattactcgcatatacagattctcaaattgctattttaggtacaggtgatagatctttagaatctggattatggcaattagcattagattatcctggaagattttcagtgtttcttacttatgatgattctttatcaaggcttatatatggaggatctgatgcattcttaatgccaagccgatttgaaccctgcggtatcagtcaattacttgctatgagatatggatcaattccaatagtaagaagagttggaggcttggttgatactgttttgcctcatgatccagaaaataatagtggtacaggtttttgttttgatcgatttgaaccgattgacttttatactgctctagtaagatcttgggaggcatttaggcataaagatagttggaaatcattacagctcagagctatgagtcaagaatttagttggcagagatcggcattagaatatgaatcgatgtataaagatgtatgtgggataaaggcgccatccccggatattgctgaaattgaaaagttttcttatgggcaatctgctgatccttctcttaaaacaatgtga

SEQ ID NO: 4940 - protein, 483 aa, Prochlorococcus marinus subsp
MRILLAAAECAPMIKVGGMGDVVGSLPPSLIKLGHDVRVIIPGYSKLWNLLEVSSEPVFRANTMGNDFSVYEAKHPIHNYVIYLVGHPTFDSGHIYGGEDEDWRFTFFASATAEFSWNCWKPQVLHCHDWHTGMIPVWMHQDPEVSTVFTIHNLKYQGPWRWKLEKMTWCPWYMHGDHTMAAAMLYADRVNAVSPTYADEIKTHEYGESLEGLLNYISGKLRGILNGIDLNEWDPDKDKVLPAQFNIKNLESRLENKIILQKEMGLEVNSKKYLLGMVSRLVDQKGVDLVLQVSRRLLAYTDSQIAILGTGDRSLESGLWQLALDYPGRFSVFLTYDDSLSRLIYGGSDAFLMPSRFEPCGISQLLAMRYGSIPIVRRVGGLVDTVLPHDPENNSGTGFCFDRFEPIDFYTALVRSWEAFRHKDSWKSLQLRAMSQEFSWQRSALEYESMYKDVCGIKAPSPDIAEIEKFSYGQSADPSLKTM

SEQ ID NO: 4941 - DNA, 1560 bp, Pseudomonas putida
  CDS (1)..(1560)
atgatcagtgccgctgtcgagcctcacgtagacgctttcaaaccggataaccgcgagccgctcaccccggatttcgccacgacaggcaaggcacccggcgcccagcgccagcacaacccgaacaagcgcaagattctgttcgtgacctcggaaatcgccgacctggtgaaaaccggtggcctgggtgacgtgtccgctgccctgccccgtgccctggcgcacctgcacgatgtgcgggtcctcatccccggctaccgccaggtgatggaaagcgacaaccctatacatatcgtgggtgaactgggcggccatgcggccctgccgccctgcaagatcgggcgcatggacatggccgacggcctggtcatctatgtgttgatctgcccagaactgtaccagcgcgacggcacaccctatggtgccaacaatggccgcgactggcccgacaaccacatccgcttcgcccgcctgggcctggctgccgccgaaatcgcggccggcgaaggcaagatccactggacgccggaagtggtgcacgcgcatgactggccggccggcctggccccggcctacatgcactggcgtggcctgaatacgcccacgctgttcaccatccacaacctggcgtaccaaggtgtgtacagccgcggctgcagcccggagctggcaatacccgaacatgccatgcagcaagaaggcatggaattctacggcaagctgtcgttcctcaaggccggcctggcctactccagccacatcaccacagtcagcgccacctatgcccgggaaatcaccacccctgaatttggctgcggcctggacggtttcctcgccagcaaggcccagcaaggcctgctcggtggcatccccaacggcatcgacgaaagctgggactcggctaccgacaagcacctgcaacacaacttcagcatcaatgactgggagggcaaagcgcgtaacacccaggaggtgcgcgagctgttcggcctggacgattccgaaggcccgctgttcgccgtggtgtcacggctggtctatcaaaagggcctggacctgaccctgggcgtggccgactacatcgtcgagcaaggcgggcagatcgcgatcatcggccgcggcgagccggaagaggaacaggccatgcgcgagctggcgctgcgccacccaggccgcatcggtgtgcgtatcggcttcaatgaaaccgatgcccggcgcatgttcgccggcagcgatttcctgctgatgccgtcgcgctacgagccgtgcggcctcagccagatgtacgcgcaacgcttcggctcgctgccggtagcacgtaataccggtggcctggccgacaccatcgagtgcggcgtgacgggcttcctgttcaacgagtccaccgtcgagagctaccgcgaggcactcagccgcgccttctatgtttacggcaagaaggacctgctgaacgccatgcgctgcctgtcgatgacccagccgttcaactggtgccaggcggttgaaccctatgcccgcctgtacgaggacctggtcaagcagacacaactgagccattactga

SEQ ID NO: 4942 - protein, 519 aa, Pseudomonas putida
MISAAVEPHVDAFKPDNREPLTPDFATTGKAPGAQRQHNPNKRKILFVTSEIADLVKTGGLGDVSAALPRALAHLHDVRVLIPGYRQVMESDNPIHIVGELGGHAALPPCKIGRMDMADGLVIYVLICPELYQRDGTPYGANNGRDWPDNHIRFARLGLAAAEIAAGEGKIHWTPEVVHAHDWPAGLAPAYMHWRGLNTPTLFTIHNLAYQGVYSRGCSPELAIPEHAMQQEGMEFYGKLSFLKAGLAYSSHITTVSATYAREITTPEFGCGLDGFLASKAQQGLLGGIPNGIDESWDSATDKHLQHNFSINDWEGKARNTQEVRELFGLDDSEGPLFAVVSRLVYQKGLDLTLGVADYIVEQGGQIAIIGRGEPEEEQAMRELALRHPGRIGVRIGFNETDARRMFAGSDFLLMPSRYEPCGLSQMYAQRFGSLPVARNTGGLADTIECGVTGFLFNESTVESYREALSRAFYVYGKKDLLNAMRCLSMTQPFNWCQAVEPYARLYEDLVKQTQLSHY

SEQ ID NO: 4943 - DNA, 1455 bp, Pseudomonas syringae
  CDS (1)..(1455)
atgtctcaggtcaacaggcgcaaagtgctgttcgtgacctccgaactggccgacctggtgaaaaccggcgggctgggcgatgtgtctgccgcactgccacgcgccatgcgccacctgcacgacgttcgtgttctgattcctggttatccgcaagtgatcaacagcggcaacccgatccatatcatcagccagctgggtgggcatgctgcactgccgccctgcaaggttgggcgtatggatatgaaagatggcttggtcatctacgtgctgatctgcccggaactgtacgagcgcgaaggcacgccttacgctgacactaacggccgcgactggtccgacaaccacatccgttttgcccgtctgggcctggccgctgccgagtttgctgctggcgaagtgaaaagccagtggtgccccgagctggttcacgcccacgactggcctgccggtctggcgccggcttacatgcgctggcgcggacagtccacgccgagtattttcacggttcacaacctggcctatcaaggcaccgtgagtactgcgtcgagccgtgaactgggcatcccggatgaggcgatcaccccggaaggcatggaattttacggcaagctgtcgttcatcaaggccggcatggcgttcgcgaaccacatcaccacggtcagcgccacttacgcccgggaaatcaccacacctgaattcggctgcggccttgagggctttttgcagagcaaggccgacaaaggtcagctcagcggcattcccaacggtatcgatgaaagctgggacgccgccactgacgaacacctgatctgtcacttcgcgcccaatgagtggacgcgcaaggaaatcaacgccgattacgtccgcgagctgtttgagctggacgcctccagcgggccgctttacgcggtggtttcgcgcctcgtttaccagaaaggcctggacctgaccatcggcgtggccgagcacatcgtcaacaacggtgggcagattgcaatcatcggccgcggggagcccgaagaagaagatgccatgcgcgaactggcggcacgctttcctggccgtatcggtgtgcgtatcggtttcaacgaaaccgatgcacgacgcatgtttgccggcagtgattttctgctgatgccgtcgcgctatgaaccctgcggcttgagccagatgtacgcccagcgtttcggctcgctgcctgtcgcccgcaacaccggcggcctggcggacaccatcgaggatggcgttaccggctttctgttcaatgaatcaaccgtcgaaagctacaccgaagccctgaaccgcacgtttcaggtcttcgctcacccggaactgctcaatgccatgcgctgccgcgcaatggctgcccccttcaactggcatcaggcagtggagccctacgcagagctttatcgcgacctgttgaagaaaaacgtgagcatgaccagcaactaa

SEQ ID NO: 4944 - protein, 484 aa, Pseudomonas syringae
MSQVNRRKVLFVTSELADLVKTGGLGDVSAALPRAMRHLHDVRVLIPGYPQVINSGNPIHIISQLGGHAALPPCKVGRMDMKDGLVIYVLICPELYEREGTPYADTNGRDWSDNHIRFARLGLAAAEFAAGEVKSQWCPELVHAHDWPAGLAPAYMRWRGQSTPSIFTVHNLAYQGTVSTASSRELGIPDEAITPEGMEFYGKLSFIKAGMAFANHITTVSATYAREITTPEFGCGLEGFLQSKADKGQLSGIPNGIDESWDAATDEHLICHFAPNEWTRKEINADYVRELFELDASSGPLYAVVSRLVYQKGLDLTIGVAEHIVNNGGQIAIIGRGEPEEEDAMRELAARFPGRIGVRIGFNETDARRMFAGSDFLLMPSRYEPCGLSQMYAQRFGSLPVARNTGGLADTIEDGVTGFLFNESTVESYTEALNRTFQVFAHPELLNAMRCRAMAAPFNWHQAVEPYAELYRDLLKKNVSMTSN

SEQ ID NO: 4945 - DNA, 1626 bp, Ralstonia solanacearum
  CDS (1)..(1626)
atgtcgctgaacgtcctctttgtcgcatcggaagcggtgccgctggccaagaccggtggcttgggagacatggtcggggcatgcgccggcgcgctgcagcgcgccggattgcacgtgaccgtgatgctgccggggtaccccgccgcgcaggcgcagctgcgcgatgcccgggtggcctgcgcgcttcccgatctgccgggcgggcccgcgcgcgtgctgctgggcgcgatgcccgataccggcgtgccggtgctgctgctcgacgccccggcgctgttcgatcgcccgggcaacccgtacctcgatgcctgcggcgagccctacgccgacaacgcgctgcgcttcgccgcgttcagccatgcggccgcgcacgtggccggcggcgtgcccgacctgcccgcattcgacatcgtgcaggcgcatgactggcatgccgcgctggtgccgctgctggtcaagcgcgcgggacggccggtcaagacggtcctgaccgtgcacaacctggcgttccagggcaacttcccgccacgtatcgcgcaggacctcggtcttcccccggaggcggtgcgcgaggccggattctttgggcagttcagtttcctgaaggcggggctgatgtgggccgaccgcatcaccaccgtgagccggacctatgcgcgcgagatcctgaccgacgcgttcggctacggcatgcaggacgtgctgcgggcgcgccggcatgacctcgtcgccattctcaacggcatcgacaacgcggtgtggaatccctcgaaagatgcttacctgtcgcggccgtttttcgcgggcaacctgagtggcaagcacgccgccaagctgcagctgcagacgctgctgcgcctgccgaaagacgcgcatgcgccactgctggcgctgggcagccgcctgacgcaccagaagatggcggacgtggcgctgcaggcgctgccgcagatgctggaagcccatcccgacctgcaggtggcggtgctgggctgcggcgagcgccgctatgaaagcgccatggccgccctggccgaacggcatccgcgccggatggcggccgtgatcggctataccgagcgcaacgcgcacatgctgcacgccggcgccgacctgctgctgcacggcagccgtttcgagccgtgcggcctgacaccgctgtatgccatgcgctacggcacggtgccggtggcctcgcgggtgggcgggctggtcgacacgatcgccgatcgcggctcgcccgaggcggcgctgcgcggcgccaccggcttcctgttcgacggcgagacgcccgaggccatggcgggcgcggtggcgcgcgcgctgcgcgtgttcgtccagccgcgcgcatggcgcgtcctgcaatacaacggcatgacgacggacttcggctggtcgcagccggcaagcgagtacctagcgctgtatgccacgctggcaccgcgcgccacgccgatgccgcatctgcagcactggccgatgcgcacgcttgcgcggcccgcgagccccccggacacggcgccggtgggcaaacccgcgcgccggcgccggacgacggcgttgtccaccacggcccgcgcgcacccggtggcgcgcgccgccggccgggaaaagatccgcgcatga

SEQ ID NO: 4946 - protein, 541 aa, Ralstonia solanacearum
MSLNVLFVASEAVPLAKTGGLGDMVGACAGALQRAGLHVTVMLPGYPAAQAQLRDARVACALPDLPGGPARVLLGAMPDTGVPVLLLDAPALFDRPGNPYLDACGEPYADNALRFAAFSHAAAHVAGGVPDLPAFDIVQAHDWHAALVPLLVKRAGRPVKTVLTVHNLAFQGNFPPRIAQDLGLPPEAVREAGFFGQFSFLKAGLMWADRITTVSRTYAREILTDAFGYGMQDVLRARRHDLVAILNGIDNAVWNPSKDAYLSRPFFAGNLSGKHAAKLQLQTLLRLPKDAHAPLLALGSRLTHQKMADVALQALPQMLEAHPDLQVAVLGCGERRYESAMAALAERHPRRMAAVIGYTERNAHMLHAGADLLLHGSRFEPCGLTPLYAMRYGTVPVASRVGGLVDTIADRGSPEAALRGATGFLFDGETPEAMAGAVARALRVFVQPRAWRVLQYNGMTTDFGWSQPASEYLALYATLAPRATPMPHLQHWPMRTLARPASPPDTAPVGKPARRRRTTALSTTARAHPVARAAGREKIRA

SEQ ID NO: 4947 - DNA, 1446 bp, Rhizobium loti
  CDS (1)..(1446)
atgcaggttctgtcggtcacgcccgagatcttcccgctgatcaagaccggcgggcttgccgacgtgaccggtgcgctgcccgtcgcgctggcagccaagggcgtgaccatgcgcacgctcattccaggctttcccgcggtgatggaaggcttcaagaaaaggaaggctgtttaccaatacccgctgctccagggtggcaaggcttcgatccatgctgtccagatcgcagggctcgatcttttcgtgctcgacgcgccgcatctcttcgaccgtcccggcggtccctacggcaatgcttcgggcgccgactggccggacaattggcggcgttttgcggcactgagccaggccggcgccgatatcgccggcggcgccatctcgggctacttgcccgagatcgtccatgcccatgactggcagtcggcgatgacgctggcctatatgcgctacggcaaggcggtcggcacgccgtcgatgatgacggtccacaatctcgccttccagggccagttcggcgcaggcatcttcggcgagctcggcctgccggcggtggcgatggcgcttgacggtgtcgaatattatggcggagtcggcttcctcaaggccggcctgcaggccgcctgggcgatcaccacggtcagcccgacctatgcgcaggaaatccgctcgccggaattcggcatgggcctcgacggcctgatcaacatgcgctccagcgatctctacggcatcgtcaacggcatcgacaccgccatctgggatccggagacggacaagcatctggtatcgaactatacggccaccacgctcaaggcgcgggcgccgaacagggcggccgtggaggaacgcttcggcctcgaccgcgacgacagcccgattgtctgcgtcatcagccggctgacctggcagaagggcatggacatattggcgacggtgatcgacggcatcgtcgcgaccggcgcgcggctggccatattgggctcgggcgacgccggcctcgaaggcgcgctgcttgccgcagccgcacgccaccgtggccgcatcggcgtggtcatcggctatgacgaagggttgtcgcacaccatgcagggcggctgcgacgccatcatcatcccgtcgcgcttcgaaccctgcggattgacgcagctctacggcctccgctacggctgcgtgccggtggtcgcccggaccggcggcctagccgacaccatcatcgacgccaacgaagcggcgatggcggccggcgtggccacagggctccagttcgctcccaacaatggcggcgcgatgctgcacgccatccgccgcctggtcgatgcctacgccgaccccgcggccttcgagaccatccagcgccagggcatgaaggccgatgtgtcatgggacaagagcgcggaaaaatatcttgaactctatcgcctgctgctttcgaaaagggttgcctga

SEQ ID NO: 4948 - protein, 481 aa, Rhizobium loti
MQVLSVTPEIFPLIKTGGLADVTGALPVALAAKGVTMRTLIPGFPAVMEGFKKRKAVYQYPLLQGGKASIHAVQIAGLDLFVLDAPHLFDRPGGPYGNASGADWPDNWRRFAALSQAGADIAGGAISGYLPEIVHAHDWQSAMTLAYMRYGKAVGTPSMMTVHNLAFQGQFGAGIFGELGLPAVAMALDGVEYYGGVGFLKAGLQAAWAITTVSPTYAQEIRSPEFGMGLDGLINMRSSDLYGIVNGIDTAIWDPETDKHLVSNYTATTLKARAPNRAAVEERFGLDRDDSPIVCVISRLTWQKGMDILATVIDGIVATGARLAILGSGDAGLEGALLAAAARHRGRIGVVIGYDEGLSHTMQGGCDAIIIPSRFEPCGLTQLYGLRYGCVPVVARTGGLADTIIDANEAAMAAGVATGLQFAPNNGGAMLHAIRRLVDAYADPAAFETIQRQGMKADVSWDKSAEKYLELYRLLLSKRVA

SEQ ID NO: 4949 - DNA, 1443 bp, Rhizobium tropici
  CDS (1)..(1443)
atgaaggttctctcggtttcgtccgaagtcttccccttgatcaagacagggggtctggccgatgtggtcggcgccctgcctattgcactgaagccctatggcgtcgaaaccaagaccctcatcccaggctatcctgcggtcatgaaagccattcgcgatccggttgttcgtctggagcttccggatcttcttggcgaggccgccaccattctagaagtcgagcacgcgggcatttccttcctcgtgctcgacgcaccggcctattacagccgcaccggcggcccctatgtcgatgcgacgggcaaggactatcccgacaattggcgacgtttcgccgcgctgtcgctggccggcgcggaaattgcagctggtctcctgcccggctggcggccggatctcgtgcacgcacatgattggcagtcggcgctggtgccggtctatatgcgttactatccgacgccggaactgccgagcgttctgaccatccacaacatcgcattccagggccagttcggcgccgatatcttccccggccttcgtctgccggcgcatgctttctcggtggaaggcatcgaatattacggtgatgtcggcttcctgaaaggtgggctgcagacggcgcatgccctgaccaccgtcagcccttcctatgccgaggaaatcctgacgccggaattcggcatgggcctcgaaggcgtcatcgccagcaaggcctacaatctctacggcatcgtcaacggcatcgacgcagatatctggaatccggcgaccgatccgatgatcgcgcaaacctatagcgcggcgacgctgaaggagcgcgccatcaaccgccatcgggtcgtcgagcatttcggcctcgaagaggatgatggtccgatcttctgcgtcgtcagccgcctcacctggcagaagggcatggatattctggcggaggttgcgagcgaggtcgtccacatgggtggcaagctcgcaattctcggcgcaggcgacgcggcgctggagggcgcgctctttgccgcagccggccgtcaccgcggtcgcgtcggcgttgtcggcaggcacaacgagcccatgtcgcatctgatgcaggccggctgcgacgcgattatcatcccctcgcgtttcgaaccctgtggtctcacgcagctttatggcttacgttcaggctgcctgccaatcgttgcgcgaacgggcgggctgaacgatacgattatcgacgccaaccacgccgcgctgcaggcaaaagtcgcgaccggcattcaattttcacccgtcaccgcggaggggctgttgcaggccatgcgccgcgcgatgcacctcttccaggatcgaaaggtctggacgcagatgcaaaagcagggcatgaaatccgacgtatcctggggcaggagcgcagaacgctacgccgctctctactccagtctagtctcgagaggcgcttaa

SEQ ID NO: 4950 - protein, 480 aa, Rhizobium tropici
MKVLSVSSEVFPLIKTGGLADVVGALPIALKPYGVETKTLIPGYPAVMKAIRDPVVRLELPDLLGEAATILEVEHAGISFLVLDAPAYYSRTGGPYVDATGKDYPDNWRRFAALSLAGAEIAAGLLPGWRPDLVHAHDWQSALVPVYMRYYPTPELPSVLTIHNIAFQGQFGADIFPGLRLPAHAFSVEGIEYYGDVGFLKGGLQTAHALTTVSPSYAEEILTPEFGMGLEGVIASKAYNLYGIVNGIDADIWNPATDPMIAQTYSAATLKERAINRHRVVEHFGLEEDDGPIFCVVSRLTWQKGMDILAEVASEVVHMGGKLAILGAGDAALEGALFAAAGRHRGRVGVVGRHNEPMSHLMQAGCDAIIIPSRFEPCGLTQLYGLRSGCLPIVARTGGLNDTIIDANHAALQAKVATGIQFSPVTAEGLLQAMRRAMHLFQDRKVWTQMQKQGMKSDVSWGRSAERYAALYSSLVSRGA

SEQ ID NO: 4951 - DNA, 1524 bp, Rhodopirellula baltica
  CDS (1)..(1524)
atgaatatcgtctacctgacgaccgaagccgttccattcgccaaaaccggtggtctcgccgacgtctgtggcactctgcccaaagtggttgccgctcaagggcatcgctgtgcggtcatcatgcctgccttttcatcgatcgaacgatcgttgcaaccgatcgagacgaccgacatcagcttcgcggttccaatgtcggatcaaaagctgatcggttgccgcctattgaaaagccatctgccgaaagatcccaacgatccagaggactcggccgaggtcccggtttatttcatcgaccaaccgcaatacttccgacgcccctcgctctacggtgacgccaacggagactaccacgacaacgccgaacgattcattttttactgtcgtgccgcgatcatcgcgatgactcgattggggtatccggtcgatttggtgcactgcaacgattggcaatctgctttggtacccgcgctgttgcgagctgcgtcggacaacgtggcaaagacccaaccaattgcgacgatgctgtcgattcacaacatggcctatcaaggcaactttggtttcgatgcgtttccgtggactggtttgagttgggatcacttccgaccggaatcattcgagtactacaaccagctgaacttcctcaaaaccggtgttgtgacctccgatgttgtgtcgacggtcagccccacgtatgccttggaaatccaaacgccagagtacggctgcggactggattcgatcctgcaaggcatcccgcaacctgtcgcgggaatcatcaacggaatcgacacaaacatttggaatcccgaaaccgatccacacctcaaacgcaattacagcgtggtggattgggctgacgcaaagattgacaacaaacttgcgttgcaagccgaggtgggtttgccacaagatcctgacgttccgttgctgggattgattggtcgtttggcggatcaaaaagggtgggacctgatccttcccgttttaaaacaacacctcgccgaagcacgtccaacgcagtgggtcgtactaggcagcggcgatcccaaaatcgaggagcaactacgcgagctgaccgagcaacatcccgaacaactggccgcgtacatcggcttcagcgatgcattggctcatcgcatcgaagcgtcgagcgacatgttcatcatgcccagccactacgaaccctgcgggctcaatcaactctatagccttcggtacggtactccgtgcgttgtgaccaagaccggcggtttagcggacacaatcgtggatgcgactccggagaacgttgcggcaaatctcgccacagggttccatttgaatgacagcagcgccggtgcgcttgaccacgcgatcaaccgggctctgcagcttcgatatcactctcccgaaaaatggaaaaatcttgtcgaattcggtatgtcgcaggattggacgtggaggaaaagtgcagaccaatacattcaactttatgcccgcacaatttccctaaatcgtcgaaggcgatcgggaagctag

SEQ ID NO: 4952 - protein, 507 aa, Rhodopirellula baltica
MNIVYLTTEAVPFAKTGGLADVCGTLPKVVAAQGHRCAVIMPAFSSIERSLQPIETTDISFAVPMSDQKLIGCRLLKSHLPKDPNDPEDSAEVPVYFIDQPQYFRRPSLYGDANGDYHDNAERFIFYCRAAIIAMTRLGYPVDLVHCNDWQSALVPALLRAASDNVAKTQPIATMLSIHNMAYQGNFGFDAFPWTGLSWDHFRPESFEYYNQLNFLKTGVVTSDVVSTVSPTYALEIQTPEYGCGLDSILQGIPQPVAGIINGIDTNIWNPETDPHLKRNYSVVDWADAKIDNKLALQAEVGLPQDPDVPLLGLIGRLADQKGWDLILPVLKQHLAEARPTQWVVLGSGDPKIEEQLRELTEQHPEQLAAYIGFSDALAHRIEASSDMFIMPSHYEPCGLNQLYSLRYGTPCVVTKTGGLADTIVDATPENVAANLATGFHLNDSSAGALDHAINRALQLRYHSPEKWKNLVEFGMSQDWTWRKSADQYIQLYARTISLNRRRRSGS

SEQ ID NO: 4953 - DNA, 1434 bp, Rhodobacter sphaeroides
  CDS (1)..(1434)
atggagacggcgcgcggacgggtgttgtcggtggcttccgaatgcgtgccgctgctgaagaccggggggctcgccgatgtggtgggcgcgcttccgggggcgctggcggcggaaggctgggagatgcgggtgctgatgccctgctaccggccgctgaaatggcggctcgaggagatggaggaggtcttcgccgaagaggatctcttcggggggccggggcgggtgatggcgggcgaggtggccgggcggaagatgctgctccttgatgcgccgcatctctacgaccgagggcggccctatgcgggtccggacggcgactggggcgacaatgcgcagcggtttgcggcgctttcctggatcggcgcgggatcgcgcgcgaggggctcggggacgggctggcggccggatgtggttcatgcccacgactggcaggcgggcttcacgccggcctatatgaactattggggcagcggcggagcgagttcggtgctgacggtgcacaacatcgccttccagggctgggcgccggcgagccttctgtcggcgctgcgcctgccgccgcagaagttccatccggccgcgctcgaatattacggcgggctctcgtcgctgaaggcggggctggtctcggccgatcatatcaccaccgtctcgcccacctatgcctgcgagctgatgcggcccgagttcggcatgggcctgcagggcgtgattgcccagcgggctgggcaggtgaccggcatcctgaacggggtcgacaccgacatctggtcgcccgaggtcgaggagcggccctatgacgccgagagcctgaaggccaaggcggagaaccgcgccgtgctgtcgggcgccttcaaactgtcggtgccggggccgcttgcgatcctcgtgagccgcctgacctatcagaagggcatcgacctcatccccgaggtgctgccggacttcatcgccgcgggcgggggccttgcagttctgggcacgggtgacgcgccgctcgaggcggcgatgcgcgagctcgaggtgcgctttccgggtcgggtcggggtgcggatcggctatgacgaagggctgtcgcatctgatgttcgcgggcggcgatgcggttttggtgccctcgcggttcgagccctgcgggctcacgcagatgtacgggctgcgctacggggccattccggtggtggccctgacagggggccttgccgacacgatcatcaacgccaatccggccgccatggccgcgggctgtgcgaccggcctcaccttccatccgaccgagccgcccgccttcgccgaggcgctgaggcggctgatccatctttatgccgatcccgcggcctgggagacggtgcaacggaatgcgatgcgccatccggtgggctgggagacctcggccgcggcctatgcggcgctctaccgggagctcgtcgcgtga

SEQ ID NO: 4954 - protein, 477 aa, Rhodobacter sphaeroides
METARGRVLSVASECVPLLKTGGLADVVGALPGALAAEGWEMRVLMPCYRPLKWRLEEMEEVFAEEDLFGGPGRVMAGEVAGRKMLLLDAPHLYDRGRPYAGPDGDWGDNAQRFAALSWIGAGSRARGSGTGWRPDVVHAHDWQAGFTPAYMNYWGSGGASSVLTVHNIAFQGWAPASLLSALRLPPQKFHPAALEYYGGLSSLKAGLVSADHITTVSPTYACELMRPEFGMGLQGVIAQRAGQVTGILNGVDTDIWSPEVEERPYDAESLKAKAENRAVLSGAFKLSVPGPLAILVSRLTYQKGIDLIPEVLPDFIAAGGGLAVLGTGDAPLEAAMRELEVRFPGRVGVRIGYDEGLSHLMFAGGDAVLVPSRFEPCGLTQMYGLRYGAIPVVALTGGLADTIINANPAAMAAGCATGLTFHPTEPPAFAEALRRLIHLYADPAAWETVQRNAMRHPVGWETSAAAYAALYRELVA

SEQ ID NO: 4955 - DNA, 1434 bp, Salmonella typhimurium
  CDS (1)..(1434)
atgcaggttttacatgtatgttcagagatgttccccctgctgaagactggggggctggcggatgtgataggcgcgttgcctgcggcacaaattgcggatggtgttgatgttcgcgttctgcttccagggtttcccgatatccgtcgggggatacccgacgcgcatgtggtgagccgccgcgatactttcgcaggtaagatatcgctgctgttcgggcattataacggcgtgggcatttatctgatcgacgcgccgcatctgtacgagcgtccaggcagtccctatcacgatacgaatttatatgcctataccgataacgtgctgcgctttgccctgttagggtgggtcggctgtgaaatggcctgcggacttgatccattctggcgccccgacgtggtgcacgcccatgactggcacgccgggctggcgcccgcctatctggcggcgcgcgggcggccggcgaaatcggtctttaccgtacacaacctggcctatcaaggcatgttttatgcaaagcatatggatgacatcgaactgccgtggtcattctttaatatgcatgggctggagttcaacggacaactctcctttttgaaggccggtttgtactatgccgaccatataacggcggtgagcccgacctatgcgcgtgaaattactgaaccgcagtttgcttatggtatggaaggcctgctgcgtcagcgtcatctggaagggcgcttgtccggcatactgaacggcgtggatgagaagatctggaacccggaatccgatctgctgctggcgtcgcgctacacgcgcgataccctggaagagaaggcggaaaacaaacgtcagctacaaattgcgatggggttgaaggttaacgacaaagtgccgctgttcgccgtggtaagccgtctgaccaaccagaaaggtctggatctggtgctggaggcgttaccggggctgctggagcagggcgggcagttggcgctactcggcgcgggcgatccggtgcttcaggaagggttcctcgcggcggcggcggaacacccagggcaggttggcgtacagatcggctatcacgaagctttctcgcatcgcattatgggcggcgcggacgttattctggtgcccagtcgtttcgaaccgtgcggcttaacgcagttatatggcttaaagtatggcacgctgcctctggtgcggcgtaccggggggttggccgatacggtctccgacagttcgctggaaaatctggcggacggtatcgccagcggttttgtctttgaagacagtaatgcctggtcgttgctacgcgcgattcggcgtgcttttgtgttgtggtcacggccttcgctttggcggtttgtacaacggcaggcgatggcgatggattttagctggcaagttgccgcgaaatcataccgcgagctgtactatcgcttgaaatag

SEQ ID NO: 4956 - protein, 477 aa, Salmonella typhimurium
MQVLHVCSEMFPLLKTGGLADVIGALPAAQIADGVDVRVLLPGFPDIRRGIPDAHVVSRRDTFAGKISLLFGHYNGVGIYLIDAPHLYERPGSPYHDTNLYAYTDNVLRFALLGWVGCEMACGLDPFWRPDVVHAHDWHAGLAPAYLAARGRPAKSVFTVHNLAYQGMFYAKHMDDIELPWSFFNMHGLEFNGQLSFLKAGLYYADHITAVSPTYAREITEPQFAYGMEGLLRQRHLEGRLSGILNGVDEKIWNPESDLLLASRYTRDTLEEKAENKRQLQIAMGLKVNDKVPLFAVVSRLTNQKGLDLVLEALPGLLEQGGQLALLGAGDPVLQEGFLAAAAEHPGQVGVQIGYHEAFSHRIMGGADVILVPSRFEPCGLTQLYGLKYGTLPLVRRTGGLADTVSDSSLENLADGIASGFVFEDSNAWSLLRAIRRAFVLWSRPSLWRFVQRQAMAMDFSWQVAAKSYRELYYRLK

SEQ ID NO: 4957 - DNA, 1431 bp, Streptococcus mutans
  CDS (1)..(1431)
atgaaaatcttatttgtagcagcggaaggggctccttttgcaaagacaggcggtctgggcgatgttattggtgccttgcccaaatcccttgtgaaaaataataatgaagtcagtgttatccttccttattatgatgttgttgatgctaaatttggtgaccaaatagaagatctgttctactttttcaccaatgtcggctggcgtcgtgaatatgttggtatcaaacatatcttcagagatggcgttgacttttactttattgacaataagcattatttttatcgtggtcaaatctatggtgaatttgatgatggtgaacgctttgcttacttccaattagctgctttagaagctatggaaaaaattcaatttattccggatattcttcatgtccatgattatcacaccgccatgattccttacttgctaaaggaaaaatatcattggattaatgcttatcatgggattaagacagtatttaccattcataatatcgagtttcaaggtcaattcaatccttctatgttaggagagctttttggagttggtgatgagcgttatcgtgatgggacgctgcggtggaatgattgcctcaactggatgaaggcagcggtgctctatgcagatcgtgtcaccactgtttcaccatcttatgctaaagaaattatgactcctgaatttggtaaaggactggatcaaattatgcggatggaatcaggtaagttaagtggtgttgtcaatggtattgacacggacttatttgatccggaaacagatccacatctggcagtgcatttttcaaaagatgatctgtcaggtaaagctaaaaataaagcagccttgcaggagcgtgttggtttaccagtacgtgaggatgttcctttggttggtattgtctctcgtctgacagatcagaagggttttcagttggttgttgatcaacttaatacaatgatgcaactggatttacagattgttttactaggaacaggctatgctgattttgaaaatgcttttgcttggttcggtcatgcttatccagacaaaatgtcagccaatatcacttttgatttagaattagctcagcaaatttatgctgccagcgatattttcttaatgccgagtgcatttgagccttgtggcttgtcacaaatgatggctatgcgttatggtaccttaccgcttgtacatgaagtaggcggacttcgggatactgttattccttataatgagtttgaaaagacaggaacaggttttggtttccaagacttctcaggttattggctgaccaaaacgcttgaagctgcgctagatgtctattataatagaaaagaagactggaaaattctccaaaaaaatgcgatgacaactgacttctcttgggatacagccagtcaatcttatgaacatctatataaagaactagcttag

SEQ ID NO: 4958 - protein, 476 aa, Streptococcus mutans
MKILFVAAEGAPFAKTGGLGDVIGALPKSLVKNNNEVSVILPYYDVVDAKFGDQIEDLFYFFTNVGWRREYVGIKHIFRDGVDFYFIDNKHYFYRGQIYGEFDDGERFAYFQLAALEAMEKIQFIPDILHVHDYHTAMIPYLLKEKYHWINAYHGIKTVFTIHNIEFQGQFNPSMLGELFGVGDERYRDGTLRWNDCLNWMKAAVLYADRVTTVSPSYAKEIMTPEFGKGLDQIMRMESGKLSGVVNGIDTDLFDPETDPHLAVHFSKDDLSGKAKNKAALQERVGLPVREDVPLVGIVSRLTDQKGFQLVVDQLNTMMQLDLQIVLLGTGYADFENAFAWFGHAYPDKMSANITFDLELAQQIYAASDIFLMPSAFEPCGLSQMMAMRYGTLPLVHEVGGLRDTVIPYNEFEKTGTGFGFQDFSGYWLTKTLEAALDVYYNRKEDWKILQKNAMTTDFSWDTASQSYEHLYKELA

SEQ ID NO: 4959 - DNA, 1425 bp, Synechococcus elongatus
  CDS (1)..(1425)
atgcgaattctatttgttgctgctgaggcggcaccactggcgaaagtgggaggcatgggagatgtggttggctctctgcccaaggtgttacgccgcatgggacatgatgtgcgcatttttatgccctattatggcttcttgcccgataaggtggagattcccaaggaccccatctggattggccatgccatgtttcagacattccatgtctatgaaaccgtgttgccggggtcggatgttcccctttacctttttggccatccctgctttaatccccgccgcatctactacggtgaggatgaggactggcggttcaccttttttgccaatggggcagcagaatttgcttggaactactggaaaccccaaattatccattgccacgattggcacacgggcatgatccccgtctggatgcatcaggatcccgacattaccaccgtgtttacgatccataacttggcctatcaaggaccttggcggtggcgcctagagcaaattacttggtgtccgtggtacatgcagggccataatacaatggcggcagcgttgcagtatgccgatcgcgtcaataccgtttcgcccacctacgccgaacagattaaaacccctgaatatggcgaaaaattggagggattgctatcgtttattagtggcaaactctctggcattctcaatggtattgatactgagctttttgatcccagtagcgatcgcgcccttgcccaaaactacaccgcagataccctagagcggcgtagggccaacaaaattgctctccaggaagaattaggactcgaggtgaactccggcgctttcttggtggggatggtcagccgcctggtggagcaaaaggggctggatctattgattcaaattttagatcgctttcttgcctataccgatagtcagtttgtcctcttagggacgggcgatcgctactacgaaacccagatgtggcaaattgcctcacggtttccggggcgctgtagtgtgcagttgctctacagtgatgtcctgtcgcgccgcatctatggcggtgccgacgccttcattatgccgagtcgctttgaaccctgtggcatttcccagatgattgcgctgcgctatggttgtgtgccgattgtccgccgcaccggtggccttgtggataccgtctcccaccacaaccctgagcagcaaaccggaacgggctactgctttgaccgctatgagccccttgacttttacacctgtctagtgcgggcatgggaagggtatcgctacaaacgggagtggcatgccctccagcagcggggtatgcgcgaggactttagctggacaaaatcggcactcgcctacaatgctctttataattccatctatggcttgccgccggaaaccatgcccaatcctagtccaacgctggtaccggcagtgacctag

SEQ ID NO: 4960 - protein, 474 aa, Synechococcus elongatus
MRILFVAAEAAPLAKVGGMGDVVGSLPKVLRRMGHDVRIFMPYYGFLPDKVEIPKDPIWIGHAMFQTFHVYETVLPGSDVPLYLFGHPCFNPRRIYYGEDEDWRFTFFANGAAEFAWNYWKPQIIHCHDWHTGMIPVWMHQDPDITTVFTIHNLAYQGPWRWRLEQITWCPWYMQGHNTMAAALQYADRVNTVSPTYAEQIKTPEYGEKLEGLLSFISGKLSGILNGIDTELFDPSSDRALAQNYTADTLERRRANKIALQEELGLEVNSGAFLVGMVSRLVEQKGLDLLIQILDRFLAYTDSQFVLLGTGDRYYETQMWQIASRFPGRCSVQLLYSDVLSRRIYGGADAFIMPSRFEPCGISQMIALRYGCVPIVRRTGGLVDTVSHHNPEQQTGTGYCFDRYEPLDFYTCLVRAWEGYRYKREWHALQQRGMREDFSWTKSALAYNALYNSIYGLPPETMPNPSPTLVPAVT

SEQ ID NO: 4961 - DNA, 1398 bp, Synechococcus sp
  CDS (1)..(1398)
atgcggattctgttcgtggctgccgaatgtgctcccttcgccaaagtgggaggcatgggagatgtggttggttccctgcccaaagtgctgaaagcttctgcccatgatgtcggaatcttcatgcggtactacggctttctgaccagtaagctcgatattcccgctgaaccgatctggtggggctacgcgatgtttaatcacttcgcggtttacgaaacgcagctgcccggttcagatgtgccgctctacttaatggggcatccagcttttgatccgcatcgcatctactcaggagaagacgaagactggcgcttcacgttttttgccaatggggctgctgaattttcttggaactactggaaaccacaagtcattcactgccacgattggcacactgggatgattccggtttggatgcaccagtccccggatatctcgactgtcttcaccattcataacttggcctaccaagggccgtggcgctggaagctcgagaaaatcacctggtgcccttggtacatgcagggcgacagcaccatggcggcggccttgctctatgccgatcgcgtcaacacggtatcgcccacctatgcccagcagattcaaacaccgacctacggtgaaaagctggagggtcttctctcatttatcagtggcaagctaagcggcatccttaacgggattgatgttgatagctacaaccctgcaacggatacgcggattgtggccaactacgatcgcgacactcttatagctcgactgaacaataggctggcgctccaaaaggagatggggcttgaggtcaatcccgatcgcttcctgattggctttgtggctcgtctagtcgagcagaagggcattgacttgctgctgcaaattcttgatcgctttctgtcttacagcgatgcccaatttgttgtcttaggaacgggcgagcgctactacgaaacccagctctgggagttggcgacccgctatccgggccggatgtccacttatctgatgtacgacgaggggctgtcgcgacgcatttatgccggtagcgacgccttcttggtgccctctcgttttgaaccttgcggtatcacgcaaatgctggcactgcgctacggcagtgtgccgattgtgcgccgtacgggggggttggtcgatacggtcttccaccacgatccgcgtcatgccgagggcaatggctattgcttcgatcgctacgagccgctggacctctatacctgtctggtgcgggcttgggagagttaccagtaccagccccaatggcaaaagctacagcaacggggtatggccgttgatctgagctggaaacaatcggcgatcgcctacgaacagctctacgctgaagcgattgggctaccgatcgatgtcttacaggaggcctag

SEQ ID NO: 4962 - protein, 465 aa, Synechococcus sp
MRILFVAAECAPFAKVGGMGDVVGSLPKVLKASAHDVGIFMRYYGFLTSKLDIPAEPIWWGYAMFNHFAVYETQLPGSDVPLYLMGHPAFDPHRIYSGEDEDWRFTFFANGAAEFSWNYWKPQVIHCHDWHTGMIPVWMHQSPDISTVFTIHNLAYQGPWRWKLEKITWCPWYMQGDSTMAAALLYADRVNTVSPTYAQQIQTPTYGEKLEGLLSFISGKLSGILNGIDVDSYNPATDTRIVANYDRDTLIARLNNRLALQKEMGLEVNPDRFLIGFVARLVEQKGIDLLLQILDRFLSYSDAQFVVLGTGERYYETQLWELATRYPGRMSTYLMYDEGLSRRIYAGSDAFLVPSRFEPCGITQMLALRYGSVPIVRRTGGLVDTVFHHDPRHAEGNGYCFDRYEPLDLYTCLVRAWESYQYQPQWQKLQQRGMAVDLSWKQSAIAYEQLYAEAIGLPIDVLQEA

SEQ ID NO: 4963 - DNA, 1542 bp, Synechococcus sp
  CDS (1)..(1542)
atgcgcatcctcttcgctgccgcggaatgcgccccgatgatcaaggtcggtggcatgggggatgtggtgggatcgctgcctccggctctggccaagcttggccacgacgtgcggctgatcatgccgggctactccaagctctggaccaagctgacgatctcggacgaacccatctggcgcgcccagacgatgggtacggaattcgcggtttacgagacgaagcatccaggcaatgggatgaccatctacctggtgggacatccggtgttcgatcccgagcggatctatggcggtgaagatgaggactggcgcttcaccttctttgccagtgccgccgctgaattcgcctggaatgtctggaagccgaatgttcttcactgccacgactggcacaccggcatgattccggtctggatgcaccaggacccggagatcagcacggtcttcaccatccacaacctcaagtaccagggcccctggcgttggaagctggatcgcatcacctggtgcccctggtacatgcagggagatcacaccatggcggcggcacttctgtacgccgaccgggtcaacgccgtctcccccacctacgccgaggaaatccgtacggcggagtacggcgaaaagctggatggtttgctcaatttcgtctccggcaagctgcgcggcatcctcaatggcattgacctcgaggcctggaacccccagaccgatggggctctgccggccaccttcagcgccgacgacctctccggtaaagcggtctgcaagcgggtgttgcaggagcgcatgggtcttgaggtgcgtgacgacgcctttgtcctcggcatggtcagccgactcgtcgatcagaagggcgtcgatctgcttctgcaggtggcggaccgtttgctcgcctacaccgacacgcagatcgtggtgctcggcaccggtgaccgtggcctggaatccggcctgtggcagctggcctcccgccatgccggccgttgcgccgtcttcctcacctacgacgacgacctctcccgactgatctatgccggcagtgacgccttcctgatgcccagtcgcttcgagccctgcggcatcagccagctgtacgccatgcgttacggctccgttcctgtggtgcgcaaggtgggcggcctggtggacaccgttcctccccacagtccagctgatgccagcgggaccggcttctgcttcgatcgttttgagccggtcgacttctacaccgcattggtgcgtgcctgggaggcctaccgccatcgcgacagctggcaggagttgcagaagcgcggcatgcagcaggactacagctgggaccgttcggccatcgattacgacgtcatgtaccgcgatgtctgcggtctgaaggaacccacccctgatgccgcgatggtggaacagttctcccagggacaggctgcggatccctcccgcccagaggatgatgcgatcaatgctgctcccgaggcggtcaccgcgccgtccggccccagccgcaacccccttaatcgtctcttcggccgcagggccgactga

SEQ ID NO: 4964 - protein, 513 aa, Synechococcus sp
MRILFAAAECAPMIKVGGMGDVVGSLPPALAKLGHDVRLIMPGYSKLWTKLTISDEPIWRAQTMGTEFAVYETKHPGNGMTIYLVGHPVFDPERIYGGEDEDWRFTFFASAAAEFAWNVWKPNVLHCHDWHTGMIPVWMHQDPEISTVFTIHNLKYQGPWRWKLDRITWCPWYMQGDHTMAAALLYADRVNAVSPTYAEEIRTAEYGEKLDGLLNFVSGKLRGILNGIDLEAWNPQTDGALPATFSADDLSGKAVCKRVLQERMGLEVRDDAFVLGMVSRLVDQKGVDLLLQVADRLLAYTDTQIVVLGTGDRGLESGLWQLASRHAGRCAVFLTYDDDLSRLIYAGSDAFLMPSRFEPCGISQLYAMRYGSVPVVRKVGGLVDTVPPHSPADASGTGFCFDRFEPVDFYTALVRAWEAYRHRDSWQELQKRGMQQDYSWDRSAIDYDVMYRDVCGLKEPTPDAAMVEQFSQGQAADPSRPEDDAINAAPEAVTAPSGPSRNPLNRLFGRRAD

SEQ ID NO: 4965 - DNA, 1317 bp, Thermus caldophilus
  CDS (1)..(1317)
atgatacgcgtgctccacctggcccccgaggcctaccccctggccaaggtgggagggcttgccgacgtggtgggggccctccccaaggccctgaggcctttgggggtggaggcccatgtcctcctcccctggcacggggggctagaggccaggcgggtgggggaggtggccttcgccttcttcgggcgggaggagagggcccccttgggggagcgggtggagggtggggtgcggtttctcctcctcggggtggaggggtttgggcgggagcgggtctacggctaccccgacgacgccgagcgctacctccgcttcgccctggcggccaaggaggtggcgagggggtacgacctggtccacgcccacgactggacggcggccctcctcgccctctacgcccccacggtctacaccatccacaacctggcccaccagggcctcgtggacccggggctcttcttttcctggaccgggcttccctggagcctcttccacatggaggccctggagttctacggccgggtgaacctgatgaagggggggatcgtcttcgcccgccgggtcaccacggtgcgcccctcttacgccgaggagatccagacccccgagttcggcatgggcctggacggggtcttgaggaggcacgccgggaagcttaggggcatcttgaacggcctggacacggaggtctttgaccccggcaaagacccctacctccccgccccctacacccgggaggacccctcggggaaggcccgggccaaggaggtcttccgggagaggacggggcttaggccccccgtcctcgcttacgtgggccgcctggattaccagaagggcctggacctcgtcttaaaggccctcccccgcctcctggagatgggctttcgcctctacgtccagggcgtgggggacggggggcttcaggaggcgttcctccgggcggaggaggaaaaccccgaaggggtacgcttcctccccgcctacgacgaggccatggcccgcctggcctacgccggggcggaggcggtcttggtcccgagccgctttgagccctgcggcctggtgcagatgatcgcgagccgctacggcacccctcccgtggcccgggcggtgggggggctcaaggacaccgtggaggacgggagggccggggtcctttttgagacctaccaccccgaggggcttctttacggcgtgctccgcctcttccgcctgggggcggaggagatgggccttagggccatggagaaggacttctcctgggaggggccggcgcgggcctaccgggaggtgtaccgggaggccttgggctag

SEQ ID NO: 4966 - protein, 438 aa, Thermus caldophilus
MIRVLHLAPEAYPLAKVGGLADVVGALPKALRPLGVEAHVLLPWHGGLEARRVGEVAFAFFGREERAPLGERVEGGVRFLLLGVEGFGRERVYGYPDDAERYLRFALAAKEVARGYDLVHAHDWTAALLALYAPTVYTIHNLAHQGLVDPGLFFSWTGLPWSLFHMEALEFYGRVNLMKGGIVFARRVTTVRPSYAEEIQTPEFGMGLDGVLRRHAGKLRGILNGLDTEVFDPGKDPYLPAPYTREDPSGKARAKEVFRERTGLRPPVLAYVGRLDYQKGLDLVLKALPRLLEMGFRLYVQGVGDGGLQEAFLRAEEENPEGVRFLPAYDEAMARLAYAGAEAVLVPSRFEPCGLVQMIASRYGTPPVARAVGGLKDTVEDGRAGVLFETYHPEGLLYGVLRLFRLGAEEMGLRAMEKDFSWEGPARAYREVYREALG

SEQ ID NO: 4967 - DNA, 1458 bp, Vibrio parahaemolyticus
  CDS (1)..(1458)
atggctactaacaacttatccattctgtttgtagcttctgaggttgaaggtcttattaaaagtggtggcttggcagatgttgccaaggcactgccggaagcccttcaaaacctacagcaagatgtaagaattacgattcctgcgtacaccagtatcgaaagattagcggacgcagaagttgtgctagaaacaaatctaacgtcatggccgcatacaaagtatcgagttctattgcttacgttaggaaacaatcctgtctatctgattgattgtgatccgtacttcaatcggccatcaatgtatgcagagaacaaccaagcgtataccgataatggtgaacgttttgcatttttcagcgctgcatgcctcgacatgttgccgaaactggcgtttcaacctgatatcatccatgcaaatgattggcacacagggctggttccgtttttgcttaagcacaggtatggcaatgatcccttttttgctcatacaaaaagcgtcatttcaattcataatgcggtctttaaaggcgtatttagttacgacgacgtacagtgtttgcctgagtttcactgccgaaacgttcccgatgcggcggtgagtgcaacgcatattactatgctcaaagctggcgtaatgaatgccgataagataaatgcagtcagcccaacgtacgctgaagagctaaagacagaacttggcagtcatggaatggcatgggagtttcagcaacgagcaggggatctagtcggaattttaaatggttgcgattacagtgcttggaatccggaaactgatatttatttgccaatgaactatagtgccgacaaacaaagtatggttctaggtaaaaacacttgtaagcgcgcattacagcagaggctaaaccttgctgaaaaagacgtagccatgtttggtatggtttgtcgtttgactcagcaaaaaggcgtgcattacttgctgccggctttggcggattttttgaagcatgatgttcaagtcgttgttgttgggacgggtgatcccgttttggctgcacaattggaagaggttgcggcgcaattctccgacaagtttgtgtttgttgaggcgtatgacaatgaactcgcgcatttagttgaagctggttcggatttcttcttaatgccttctgaattcgaaccatgtggcttaaatcagatctacagcatggcttatggcaccttgcctatcgtgagaggggtaggtggcttaaaagacagtgtgaatgattacgacgtagacccttgcgacgctactggatttgtattttatgaaccgacgtctcaagcgctgctacttactatgctgcgagcgttgctgttgtatgcgcaaaacctgacggaagtgcaaagagtacaactgcatgcaatgcaaaaagatttctgctggcggaaggccgcagaatcgtatttgcaactctatcgttcagcgttaaattga

SEQ ID NO: 4968 - protein, 485 aa, Vibrio parahaemolyticus
MATNNLSILFVASEVEGLIKSGGLADVAKALPEALQNLQQDVRITIPAYTSIERLADAEVVLETNLTSWPHTKYRVLLLTLGNNPVYLIDCDPYFNRPSMYAENNQAYTDNGERFAFFSAACLDMLPKLAFQPDIIHANDWHTGLVPFLLKHRYGNDPFFAHTKSVISIHNAVFKGVFSYDDVQCLPEFHCRNVPDAAVSATHITMLKAGVMNADKINAVSPTYAEELKTELGSHGMAWEFQQRAGDLVGILNGCDYSAWNPETDIYLPMNYSADKQSMVLGKNTCKRALQQRLNLAEKDVAMFGMVCRLTQQKGVHYLLPALADFLKHDVQVVVVGTGDPVLAAQLEEVAAQFSDKFVFVEAYDNELAHLVEAGSDFFLMPSEFEPCGLNQIYSMAYGTLPIVRGVGGLKDSVNDYDVDPCDATGFVFYEPTSQALLLTMLRALLLYAQNLTEVQRVQLHAMQKDFCWRKAAESYLQLYRSALN

SEQ ID NO: 4969 - DNA, 1458 bp, Vibrio vulnificus
  CDS (1)..(1458)
atggctactaaccctttgtcgattctgtttgtagcatctgaagtagaaggtttgatcaaaagtggtggcttggcggatgttgccaaggcactgcctgaagctttagtaaaccttcagcatgatgcgagaattgccattccggcttataccgcaattcctaatgtgtgtgatgatgaagtcatcctcgatacacatctagaaacctggccacatactcattatcaagtcaaaaaacgtttcttaggtgacaaccctgtctacttaattgcgtgtgggcattattttgaccgtccgtcgatgtacgctgagaataatcaggcgtataccgataacggtgagcgctttgctttttttagtgctgcttgtttggatatgttaccaaaaattggtttccagcctgacatcgtgcatgccaatgattggcatacaggcttagtgccatttttgcttaagcaccgttacggtcaagatccgttttttgcacaaacaaagagtattttatctatccataatgcggtctttaaaggtgtctttcactatgatgagatgcagtgtttacctgaatttcattgccgaaatgtacccgatgccgctgtcagctctacgcatatgacgatgctgaaagcaggggttatgaatgctgataaaatcaacgcagtgagcccaacttatgcagaggagctgaaaactgaacttggcagtcacggaatggcttgggagtttcagcaacgcgcgggtgatctcgtcgggattctaaacggctgcgattattctgcatggcatccagatactgacagctatttacccatcaactacaaagcaactaagcagagtatggtgagagggaaaaatggctgtaaacgtgcgcttcaagagcaagtcggcctacctgtaaaggacgtcgctatgtttggtatggtgtgtcgcttgacgcatcagaaaggggtgcattacctattgccagtattaactgagttcctgaagttggatgttcagttggttttggttgggaccggtgatccgttgcttgctgcgcaattacgtgatgttgcagcacagtttggtgaaaagtttgtctttgttgaagcttataacaatcaactcgcacacttagttgaggctgcatccgatttctttttaatgccttcagaatttgaaccttgtggcttaaaccaaatctatagcatggcgtatggctccttgccgatcgtgagaggcgttgggggtctcaaagacagtgtatgcgattatgatgtgaaccctgagactgcgacaggatttgtgttctatgaacctacagcacaagcgttgttgattaccatgcaaagagcgttgttgctgtatgcacagaacctaacagagcttcgacgagttcagctatacgcgatggaacgagatttttgctggaacaaggcagcagagcaatatgtggagttgtatcgttctgcgctgaaatag

SEQ ID NO: 4970 - protein, 485 aa, Vibrio vulnificus
MATNPLSILFVASEVEGLIKSGGLADVAKALPEALVNLQHDARIAIPAYTAIPNVCDDEVILDTHLETWPHTHYQVKKRFLGDNPVYLIACGHYFDRPSMYAENNQAYTDNGERFAFFSAACLDMLPKIGFQPDIVHANDWHTGLVPFLLKHRYGQDPFFAQTKSILSIHNAVFKGVFHYDEMQCLPEFHCRNVPDAAVSSTHMTMLKAGVMNADKINAVSPTYAEELKTELGSHGMAWEFQQRAGDLVGILNGCDYSAWHPDTDSYLPINYKATKQSMVRGKNGCKRALQEQVGLPVKDVAMFGMVCRLTHQKGVHYLLPVLTEFLKLDVQLVLVGTGDPLLAAQLRDVAAQFGEKFVFVEAYNNQLAHLVEAASDFFLMPSEFEPCGLNQIYSMAYGSLPIVRGVGGLKDSVCDYDVNPETATGFVFYEPTAQALLITMQRALLLYAQNLTELRRVQLYAMERDFCWNKAAEQYVELYRSALK

SEQ ID NO: 4971 - DNA, 1425 bp, Xanthomonas axonopodis
  CDS (1)..(1425)
atgttcgtggtgtcggaaatggcggacttcatcaaggctggcgggttgggcgacgtggcggccgcgctgccgcgcgcgctgcgccaccgctacgacgtccgcgtgctgattcccggctaccgtgccgtgctcgagcgcgcaggcaaggtggagatcgttggtcgcgtgttggcgcatgccgcgctgccggcctgcgacatcggccgcatcgtgcaatcggacgggctgccgatctacatcctgttgtccaaggaactgttcgagcgcgacggctcgccctatgtgagcaccagcggttcggagttcgaagacaacgcgattcgctttgccaccttgtcgcatgccgccgcgcagatcgcggccggccatgccggcctgggctggaagccgcgcctgctgcatctgaacgactggccgtgcgcgctggcggccggctatgtgcgctggtccggcggcaccacgccgtgcctgctgaccatccataacctggcctaccagggcctggtgccgtattcgatggccgccgcgctgggcatccccgccgagcgggtggccgagttggagttctacgggcagatgtcgttcctgcgcggtggcatcgtcaacgccgaccacgtcaacacggtcagcgtcagctacgccaagcagatcaccggcccggcacagggctgcggcctggaccggctgttggccgggcgcgccgccaagggcgcgctcaccggcatcgtcaacggcatcgacgccagctgggacccgcgcaccgaccaatacctggattcgcacttcagcgtgaaccaatggcagggccgccaggccaacgcagcgcaggtacgcaaggcattcgggctgcgcgagagcgctggcccactgtttgcggtggtctcgcggttggtgcatcagaagggcctggacctgatctgcgaggtggccccgcaaatcgtggccgctggcggccagatcgcggtgatcggcggcggcgagccggagatcgaacagcaggtggccgagctgaccaggcgctatcccggccaggtgggcgccttcatcggcttcgaggaaggcctggcccggcggatgttcgccggtgccgacttcctgctgatgccctcgcgcttcgagccctgcggcctgagccagatgtatgcgcagcgcttcggctgcctgccgatcgcccacgcgaccggcgggctgatcgataccgtggacgacggcgtgaccggcttcctgttccagcacgccagcgtcgaagccctgcgccgctgcctggagcgcgccttccgcaccttccgcctgcccagcctgttgtctgcgatgcggcgcgcagccatgctgcgtcccagcggttgggacgtggcaggcaagaaatacctctcgctctacgaacacaccgctgccaccgcgcccgcgctcgcgacggtgccatga

SEQ ID NO: 4972 - protein, 474 aa, Xanthomonas axonopodis
MFVVSEMADFIKAGGLGDVAAALPRALRHRYDVRVLIPGYRAVLERAGKVEIVGRVLAHAALPACDIGRIVQSDGLPIYILLSKELFERDGSPYVSTSGSEFEDNAIRFATLSHAAAQIAAGHAGLGWKPRLLHLNDWPCALAAGYVRWSGGTTPCLLTIHNLAYQGLVPYSMAAALGIPAERVAELEFYGQMSFLRGGIVNADHVNTVSVSYAKQITGPAQGCGLDRLLAGRAAKGALTGIVNGIDASWDPRTDQYLDSHFSVNQWQGRQANAAQVRKAFGLRESAGPLFAVVSRLVHQKGLDLICEVAPQIVAAGGQIAVIGGGEPEIEQQVAELTRRYPGQVGAFIGFEEGLARRMFAGADFLLMPSRFEPCGLSQMYAQRFGCLPIAHATGGLIDTVDDGVTGFLFQHASVEALRRCLERAFRTFRLPSLLSAMRRAAMLRPSGWDVAGKKYLSLYEHTAATAPALATVP

SEQ ID NO: 4973 - DNA, 1425 bp, Xanthomonas campestris
  CDS (1)..(1425)
atgttcgtggtgtcggagatggcggacttcatcaaggccggcggcctgggtgatgtggcggcggcactgccgcgcgcattgcgccatcgctacgacgtgcgcgtgttgatccccggctaccgcgcggtgctggcgcgcgcgggcaaggtggagatcgtgggtcgtgtgctggcgcatgccgcgctgccggcctgcgacatcggccgcatcgtgcaatcggacggcctgccgatctacatcctgctgtccaaggaactgttcgaacgcgatggctcgccgtatgtgagcaccagcggttcggagttcgaagacaacgcaatccgctttgccaccttgtcgcacgctgccgcgcagatcgccgccggccgtgccgggctgggctggcggccgcgcctgctgcatctcaacgactggccgtgtgccctggctgccgcctacgtgcgctggtccggcggcaccacgccgtgcctgctgaccatccataacctggcctaccagggcctggtgccgtattcgatggccgccgcactgggcatcccggccgagcgcgtctcggagctggagttctacgggcagatgtcgttcctgcgcggtggcatcgtgcatgccgaccacgtcaacacggtgagcgtcagctacgcgcagcagatcaccggcccggcgcagggctgcgggctggaccgcctgctggccggccgcgccgccaagggcgcgctgagcggcatcgtcaacggcatcgacgccagctgggacccgcgcaccgacgaatacctggacagccatttcagcgtgaaccactggcagggccgccaggccaacgccgcgcaggtgcgcaaggccttcggtctgcgtgagagcaccggcccgctgttcgcggtggtgtcgcgcctggtgcaccagaagggcctggacctgatttgcgaggtcgccccgcagatcgtggccgctggcggccagatcgcggtgatcggcggcggtgagccggagatcgaacaacaggtggccgagctgacccggcgctatcccggccaggtcggtgcgttcatcggttttgaggaaggcctggcgcggcgcatgttcgccggcgccgacttcctgctgatgccctcgcgcttcgagccgtgcggcctgagccagatgtacgcgcagcgcttcggctgcctgccgatcgcgcatgccaccggcgggctgatcgacaccgtggacgatggtgtcaccgggttcctgttccagcaggccagcgccgaagcgctgcggcgctgcctggagcgcgccttccgcaccttccgcctgcccagcctgctgtcggcgatgcgccgcgccgcgatgctgcggcccagcggctgggatgtggcgggcaagaaatacatctcgctatacgagcgcaccgctgcaaccgcacccgctgttgcgacggtgtcatga

SEQ ID NO: 4974 - protein, 474 aa, Xanthomonas campestris
MFVVSEMADFIKAGGLGDVAAALPRALRHRYDVRVLIPGYRAVLARAGKVEIVGRVLAHAALPACDIGRIVQSDGLPIYILLSKELFERDGSPYVSTSGSEFEDNAIRFATLSHAAAQIAAGRAGLGWRPRLLHLNDWPCALAAAYVRWSGGTTPCLLTIHNLAYQGLVPYSMAAALGIPAERVSELEFYGQMSFLRGGIVHADHVNTVSVSYAQQITGPAQGCGLDRLLAGRAAKGALSGIVNGIDASWDPRTDEYLDSHFSVNHWQGRQANAAQVRKAFGLRESTGPLFAVVSRLVHQKGLDLICEVAPQIVAAGGQIAVIGGGEPEIEQQVAELTRRYPGQVGAFIGFEEGLARRMFAGADFLLMPSRFEPCGLSQMYAQRFGCLPIAHATGGLIDTVDDGVTGFLFQQASAEALRRCLERAFRTFRLPSLLSAMRRAAMLRPSGWDVAGKKYISLYERTAATAPAVATVS

SEQ ID NO: 4975 - DNA, 2345 bp, Antirrhinum majus
  CDS (10)..(1836)
caggttcctatggctacagtaacagcttcacagttggtgtcacatgtccatggtggagcaacgtcttcaccggatactaaaacaaacttggcccaggttggcctcaggaaccagcaattcactcacaatgggttgagatcaataaacatggttgataagcttcaaatgaggaacaatgcgaaacaatccaggagcttggtaaagaaaactgataatggtagccctttgggaaaaattatttgtggaacagggatgaacttggttttcgtgttagctgaggttggtccgtggagcaaaaccggtggcctcggtgacgttgttggaggattgcctcccgcaatggcaggaaatggacacagagttatgacagtatcaccacgttacgatcagtacaaagacgcttgggacactagtgttgttgttgagataaaagttggagacagcattgagactgtcagatttttccactgctataaacgtggggtggatcgtgtttttgttgatcatcctatattcctcgaaaaggtctggggcaaaactaaatcaaagatttatggccctaatgctggaactgattatcaggacaatcaacttcgattcagcttattgtgccaagctgctttggaagcgcccagggtcctgaatctaaccagcagcaaatatttctctggaccatatggcgaggatgttgtatttgtcgctaatgactggcacactgctttgcttccgtgctacctgaaaagtatgtaccaatctaaaggaatgtaccttcatgctaaggttgccttctgcatccacaacattgcatatcagggaagatttgggtcctcagacttttgtcttctcaatctccccgatcagttcaaaagttcttttgacttcttcgatgggtacgagaaacccgtgaagggaaggaaaattaactggatgaaggctggaatcttagaatcagatagggtcgtaactgtgagtccttactatgccatggaacttgtttctggggctgagaaaggtgttgaactggataatgtcattgctaagacaagcataactgggattgtgaatggtatggatacccaagagtggaatccagcaactgataagcacatcgatactaactacgatatcaccactgtcatggatgctaagcctctgttgaaagaagctcttcaagcagcagtcggattgcctgtggacaagaacattcctgtcattggatttattggcagactcgaagagcagaaaggctcggatatccttgttgctgccatttctaagtttgtcgggttggatgttcaaataataatcctcggaactggcaagaagaagtttgagcagcagattcaggagctggaggtgttgtatcctgataaagcaagaggagtggccaagtttaacgttcccttggctcacatgatcactgctggagctgattttatgctggtcccaagtagattcgaaccttgtggtctcatccaattacacgccatgcgatatggaacgatacccatctgtgcctcaactggtggtcttgtcgacactgtgacagaaggatttactgggttccatatgggagctttcaatgttgaatgtgccaccgtggacccagccgatgtgcaaaagatagccacaactgttgagagagctcttgctgcttatggtagcgttgcctataaagaaatgattcagaactgcatggcacaagatctctcctggaagggacctgcaaagaactgggaaaagatgctgcttagcttgggcgtttcagggagtgaacctggtgttgacggcgaggaaattgctccacttgccaaggaaaatgtcgccactccttagaggctgatcaatatatagactgttgaacataaagtatgactgactgcaatatatagatctgttgaacataaagtatgactgactgactatatgacctgaaatgcttatgatcttataggaataattgcatagtgaagcagtttgtttagatgggtaatggttagattatgggatggtaatgcgtgtgggtgctctataatatatgaggcgaaggaggtcttatatgatagtcagtagcaattgacagatggggtttattttaagaacgtgccactgtgtggtcaagccaagcaccatataaacgtaattaaataaagttgatggcgctagtaggtggtgttgtttatgcttattctggtaattggtatcggtataaagtaggtttgaattgttgaaacgtgcctcgatgtgattcttgtcctggatatgcattcggattctttatataaaagttatagtattaaatgcaaaaaaaaaaaaaaaaaaaaaaaaaaaaaaaaaaaaaaaaa

SEQ ID NO: 4976 - protein, 608 aa, Antirrhinum majus
MATVTASQLVSHVHGGATSSPDTKTNLAQVGLRNQQFTHNGLRSINMVDKLQMRNNAKQSRSLVKKTDNGSPLGKIICGTGMNLVFVLAEVGPWSKTGGLGDVVGGLPPAMAGNGHRVMTVSPRYDQYKDAWDTSVVVEIKVGDSIETVRFFHCYKRGVDRVFVDHPIFLEKVWGKTKSKIYGPNAGTDYQDNQLRFSLLCQAALEAPRVLNLTSSKYFSGPYGEDVVFVANDWHTALLPCYLKSMYQSKGMYLHAKVAFCIHNIAYQGRFGSSDFCLLNLPDQFKSSFDFFDGYEKPVKGRKINWMKAGILESDRVVTVSPYYAMELVSGAEKGVELDNVIAKTSITGIVNGMDTQEWNPATDKHIDTNYDITTVMDAKPLLKEALQAAVGLPVDKNIPVIGFIGRLEEQKGSDILVAAISKFVGLDVQIIILGTGKKKFEQQIQELEVLYPDKARGVAKFNVPLAHMITAGADFMLVPSRFEPCGLIQLHAMRYGTIPICASTGGLVDTVTEGFTGFHMGAFNVECATVDPADVQKIATTVERALAAYGSVAYKEMIQNCMAQDLSWKGPAKNWEKMLLSLGVSGSEPGVDGEEIAPLAKENVATP

SEQ ID NO: 4977 - DNA, 2211 bp, Ipomoea batatas
  CDS (93)..(1919)
cgtgcttccacactcttgcagtagctgctataaccgccgttgctcagccgcggagtttccggtgaagcgggtgtggtgtgagactgtgagtgatggcaactataactgcctcacactttgtttctcatgtctgtgggggtgccacttctggagaatcaaaagtggggttgggtcaattagccctgaggagtcaagctgtgactcacaatgggttgagacctgtgaacaagattgacatgttacaattgagaaccagtgccaagaagcccagcaaaaatggaagggaaaatgagggtggaatggcagcaggaactattgtgtgtaaacaacaagggatgaacttggtctttgtgggatgtgaggtgggtccctggtgcaaaactggtggacttggagatgttcttggaggattgccaccagccttggcagcgcgcgggcatagagttatgacagtgtgtccccgttatgatcagtacaaagatgcttgggatacctgtgtggttgttgagctacaagttggagacagaattgaacctgttcgtttcttccattcatacaaacgcggagttgatcgcgtttttgtggatcatcctatgttcctggagaaggtttggggaaaaactggatctatgctctatggccccaaggctgggaaagattacaaggacaaccagttgcggttcagtttgttgtgccaagcagcacttgaggcaccgagagttttgaatcttaactccagcaactacttcagtggaccttatggtgaggatgttgttttcgttgccaatgattggcacactgctctccttccatgctatctgaaaaccatgtaccagtcgagaggaatctacatgaacgccaaggttgctttctgcattcacaacattgcctaccaaggcagattcgccttttcagacttttctcttctgaatctgcctgacgagtacaagggttcttttgattttattgatgggtatgacaagccagtgaaggggagaaagataaactggatgaaagctggaatacgtgaagcagacagggtttttactgtgagcccaaactacgccaaggagcttgtttcttgcgtttcgaagggtgtggaattggacaaccacatccgagactgcggcatcactggtatttgtaatggaatggatacccaagagtggaaccctgcaactgacaagtaccttgctgttaaatatgatatcacaactgttatgcaagcgaagcccttgttgaaggaagctcttcaagcggcagttggtttgccagttgacaggaatattccactgattggttttatcggcagacttgaagagcagaaaggctcagacattctttatgctgcgatttctaagttcatttcaatggatgttcagatattgattctcggaactgggaagaagaaatttgagcagcagattgagcagctcgaagtgatgtatccggacaaagctagaggagtggcaaagttcaacgttcctttggctcacatgattactgctggcgctgattttatgttgatcccgagcagatttgagccgtgtggtctcattcagttgcatgctatgcgatatggaacaccgtgcatctgtgcctcaactggcggactcgttgacactgtgaaagaaggttatacagggttccacatgggggctttcaacgtcgactgtgaaactgttgacccagaggacgtgctgaaggtgataaccactgttggtagagcacttgcgatgtacggaacccttgcattcactgaaatgatcaagaactgcatgtcacaagagctctcgtggaagggacctgccaagaattgggaaacagtgctgttgagcttaggagttgctgggagcgagcccggggttgaaggagacgaaattgcaccacttgcaaaggaaaacgtcgccactccatgaaaactatggtttcataagctggcatatgaaactaataaagttttatatatatgttgaaagagcagaggcgatttggtgctcttgagcattatgaggtgatgaaagagccaatgggggactctttctttattgttttttggtatgcccaggtggtagtaaatacagagtttaaactaactagtttggtgctttaagacattgggaacttgcagcacttcagcaggctaaatgtataatataaataaacaatggcctcttgtggttttgtgctttgaaaaaaaaaaaaaaaaaa

SEQ ID NO: 4978 - protein, 608 aa, Ipomoea batatas
MATITASHFVSHVCGGATSGESKVGLGQLALRSQAVTHNGLRPVNKIDMLQLRTSAKKPSKNGRENEGGMAAGTIVCKQQGMNLVFVGCEVGPWCKTGGLGDVLGGLPPALAARGHRVMTVCPRYDQYKDAWDTCVVVELQVGDRIEPVRFFHSYKRGVDRVFVDHPMFLEKVWGKTGSMLYGPKAGKDYKDNQLRFSLLCQAALEAPRVLNLNSSNYFSGPYGEDVVFVANDWHTALLPCYLKTMYQSRGIYMNAKVAFCIHNIAYQGRFAFSDFSLLNLPDEYKGSFDFIDGYDKPVKGRKINWMKAGIREADRVFTVSPNYAKELVSCVSKGVELDNHIRDCGITGICNGMDTQEWNPATDKYLAVKYDITTVMQAKPLLKEALQAAVGLPVDRNIPLIGFIGRLEEQKGSDILYAAISKFISMDVQILILGTGKKKFEQQIEQLEVMYPDKARGVAKFNVPLAHMITAGADFMLIPSRFEPCGLIQLHAMRYGTPCICASTGGLVDTVKEGYTGFHMGAFNVDCETVDPEDVLKVITTVGRALAMYGTLAFTEMIKNCMSQELSWKGPAKNWETVLLSLGVAGSEPGVEGDEIAPLAKENVATP

SEQ ID NO: 4979 - DNA, 2988 bp, Pisum sativum
  CDS (140)..(2398)
caaaaagccccaacctttgattcatacaaacaccactttcttcaattggtccaacccaatttgacaacatcactcaattcttgctttttcactcaatttcaccatctgggtcttcctcatttttgaatcaaatttcttgatgatgctatcactaggttctgatgcaactgtgttaccttttcatgctaagaatctcaaatttactccaaagttaagtactttgaatggtgatttagcatttagtaagggtttgggtgttggtagattgaactgtggaagtgttagattgaatcataagcagcatgtaagagctgttggtaagagttttggtgcagatgagaatggagatgggtcagaggatgatgttgttaatgctacaattgaaaagagcaaaaaggttcttgctttgcaaagggaacttattcaacagattgctgaaagaaagaaactagtttcttctatagatagtgacagcattcctggattggaaggaaacggtgtttcttatgaaagcagtgaaaaatctctgtcaagggactcaaatccacagaaaggttcttccagcagcggcagtgctgttgaaaccaaacggtggcactgttttcagcaactatgtcgttctaaagaaacggagacatgggccgtttcatctgttggcattaatcaaggttttgatgaaattgaaaagaaaaatgacgctgtaaaggcgtcatctaagctacacttcaatgaacaaattaaaaacaagctgtacgagagacctgatacgaaagacatttcaagtagcatcagaacttctagtctaaagtttgaaaatttcgaaggtgcgaatgaaccaagttcaaaggaggttgctaatgaagctgaaaattttgagagcggcggtgaaaagccaccaccgttggctgggaccaatgttatgaacattatattggtttctgcagaatgcgctccttggtcgaaaacaggcgggcttggagatgttgctggatcactcccaaaggctttggctcggcgtggacatagagttatgattgttgcacctcattatggtaattatgctgaagcacacgatataggagtacggaagagatacaaagtagctggtcaggacatggaagtgacgtatttccatacttatattgatggtgtcgatattgtttttattgacagtccaatatttcgcaatctagagagtaatatatatggcggaaaccgattggatattctaaggcgcatggtgttgttttgcaaggcggcggttgaggttccttggcatgttccgtgtggtggaatttgctatggagatggaaatctggtcttcatagcaaatgattggcatactgcattgctgccggtgtatctgaaagcatattatcgcgatcatggtttgatgaactatacacgatcagttctcgtgattcataacatagctcaccagggtcggggcccggtcgaggatttcaacaccgtggatttatctggaaactacttagaccttttcaaaatgtacgaccctgttggaggtgagcacttcaacatctttgcagccggtttaaaaaccgccgacaggattgtcaccgtcagtcacggttacgcatgggagcttaaaacttcagaaggtggttggggtttgcataacatcataaatgaaagtgactggaaatttcggggaattgtgaacggtgtcgacacaaaagattggaaccctcaattcgacgcttacttgacatcagacggctacactaactacaacctgaaaaccctacaaaccggcaagcgtcaatgtaaggcagctttgcaaagggagctcggtttgcctgtccgtgaggatgttccgataatttccttcatcggaaggctcgatcaccagaaaggtgttgatcttatagccgaagcgattccttggatgatgagccacgatgttcaactagtcatgttgggaaccggaagagctgatttagaacaaatgctcaaagaattcgaagcccaacactgcgacaaaatccgaagttgggttggtttttcggttaagatggctcataggataacagcaggttcagatatattactcatgccgtcaagattcgagccgtgtggactgaatcaactctatgcgatgagttacggaacagttcctgttgtacacggggtgggcggactcagagacacggtgcagccttttaatccgttcgacgaatcgggtgtcggttggacatttgatcgcgccgaagctaacaagttaatggcggcattatggaattgcttattgacttataaggattataagaagagctgggaagggattcaagaaagagggatgtcacaggatcttagctgggacaatgctgctcaacaatatgaagaggttcttgttgctgccaaataccaatggtgatttcttgacatgcactccatctttgtagtttgatcaaaacgaagggctttcatgctgaatttgtttcacaagagcatatacacggtgttgcagctgtggagacagttcgatctagaacgagaaattttctcttactagatcgaacggtttacagagctgttgcaccgtgtagtttggaggaacatttgctatgtgaactaaggaatgtgtaattcaattggtacataatgtttttggcacatacaatgtaaaatgaagtgtattgactgaaaataaaaaaaaaaaaaaaaggaattccgcaaagcaaaggctttaaccgtttgtcatcatgatacaagaggtatgaatcctgagttgctttacgaagctctcaaagtcagtcctggaactgtttctgtttgccatttcattggcaataaggctgctgcttgggtgcctaattattctgttgaccgtccttgtgtcatctagatgctaacttcatgttcaaactggatttgtgttcaaataataaatgtatgtaaggacaagtatcatattttatgtatcctaaataaaacaagttagaactaaaaaaaaaaaaaaaaaaa

SEQ ID NO: 4980 - protein, 752 aa, Pisum sativum
MMLSLGSDATVLPFHAKNLKFTPKLSTLNGDLAFSKGLGVGRLNCGSVRLNHKQHVRAVGKSFGADENGDGSEDDVVNATIEKSKKVLALQRELIQQIAERKKLVSSIDSDSIPGLEGNGVSYESSEKSLSRDSNPQKGSSSSGSAVETKRWHCFQQLCRSKETETWAVSSVGINQGFDEIEKKNDAVKASSKLHFNEQIKNKLYERPDTKDISSSIRTSSLKFENFEGANEPSSKEVANEAENFESGGEKPPPLAGTNVMNIILVSAECAPWSKTGGLGDVAGSLPKALARRGHRVMIVAPHYGNYAEAHDIGVRKRYKVAGQDMEVTYFHTYIDGVDIVFIDSPIFRNLESNIYGGNRLDILRRMVLFCKAAVEVPWHVPCGGICYGDGNLVFIANDWHTALLPVYLKAYYRDHGLMNYTRSVLVIHNIAHQGRGPVEDFNTVDLSGNYLDLFKMYDPVGGEHFNIFAAGLKTADRIVTVSHGYAWELKTSEGGWGLHNIINESDWKFRGIVNGVDTKDWNPQFDAYLTSDGYTNYNLKTLQTGKRQCKAALQRELGLPVREDVPIISFIGRLDHQKGVDLIAEAIPWMMSHDVQLVMLGTGRADLEQMLKEFEAQHCDKIRSWVGFSVKMAHRITAGSDILLMPSRFEPCGLNQLYAMSYGTVPVVHGVGGLRDTVQPFNPFDESGVGWTFDRAEANKLMAALWNCLLTYKDYKKSWEGIQERGMSQDLSWDNAAQQYEEVLVAAKYQW

SEQ ID NO: 4981 - DNA, 2329 bp, Arabidopsis thaliana
  CDS (67)..(2025)
aacaaccagacgaaatcaaacataaatctgtaacagtcgaagaaactctcactctttaattgatcaatggcgtctcttcaaatcagtggctccgttaaattcgagccgttcgttggattcaaccggatccgccatttccgtccgatcgccagtctcggatttcctcgttttcgacggagattcagtatcggacggtcattgttgcttcgtcgttcttcttccttctccggtgactctcgtgagtctgatgaagagagatttatcacagacgcagagagagatggttctggctccgttcttggctttcagctcactcctcctggtgatcaacaaacagttagcactagcacaggagaaattacacatcatgaagagaagaaagaggctattgatcaaattgtaatggctgactttggcgtacctggaaatagagctgttgaagaaggagctgcagaggttgggattccgagtggaaaagctgaagttgtcaataaccttgttttcgttacatccgaggcggctccttactcgaaaacaggaggattaggagatgtttgtggttctttgccaatagctttagctggtcgtgggcatcgtgttatggtcatttctcctcggtacttaaatggaactgctgcagacaagaactatgcccgggctaaggatttggggatacgtgtaacagtaaattgctttggtggttctcaagaagtttccttctatcatgagtatagagatggtgttgattgggtttttgttgatcacaaatcctaccatagacctggtaatccctacggagatagtaaaggagcctttggtgacaatcagtttcggttcacgttactttgccatgctgcatgtgaagcccctctcgtgctgcctcttggagggttcacttatggagagaaatcactcttccttgtcaatgactggcatgccggccttgttcccatacttttggccgcaaagtatcgcccatatggagtttataaggatgcaagaagcattctcattatccataacctcgctcatcagggggtggagccagcagctacatacaccaacttgggattgccttcggaatggtatggagcagtcgggtgggtatttccaacgtgggcaagaactcatgcccttgacaccggtgaagcggttaatgttctcaagggtgctattgtgacctctgaccgtatcattactgtgagccagggctatgcatgggaaatcactactgttgaaggtggttatggtcttcaagatttgctttctagtcggaaaagtgttataaatgggatcacaaatggaattaatgttgatgaatggaatccatccacggatgaacacattcctttccattactctgctgatgatgtctccgagaagatcaaatgcaagatggcactacaaaaggaattgggtctccccattaggcctgaatgtcctatgattggttttataggaagacttgattaccagaagggcattgatctgatccaaaccgctggtcctgatctcatggtggatgacattcaattcgtcatgcttggttcgggtgacccaaaatatgaaagctggatgagaagtatggaggaaacatacagagacaaattccgtggttgggttgggttcaatgtccccatctctcatcgaatcacagccggctgtgacattcttctcatgccgtcgagattcgagccctgtggtttaaatcagctatacgcaatgagatacggaaccattccagttgttcatggcactggaggactcagagatacggttgagaatttcaacccttatgcagaaggtggagctggtactggtacagggtgggtcttcactcccttgtcgaaagatagcatggtctcggccttgaggttggctgcagcaacgtacagagagtataaacagtcatgggaaggattgatgagaagaggaatgacccgaaactactcttgggaaaacgctgccgttcagtatgagcaagtttttcagtgggttttcatggaccctccctatgtcagctagaccaaacataaactgaaccaaaccgagttggaccggatcagaccagacctgaccaatcagatggagagtgtggaacctccttttccggctatcgaaaatctatggttttcaacgtttccacattaaaccgtgtatctatctatgtctattatcttaaactcgtatggtgtttgttttggggaggtatagaattttagttatgaggttataatatgtttttctttcggttatgacatgtgtgtcttactcttttcctaattatctgaatctgaactagatttctttcgaaaaaaaaaaaaaaaag

SEQ ID NO: 4982 - protein, 652 aa, Arabidopsis thaliana
MASLQISGSVKFEPFVGFNRIRHFRPIASLGFPRFRRRFSIGRSLLLRRSSSFSGDSRESDEERFITDAERDGSGSVLGFQLTPPGDQQTVSTSTGEITHHEEKKEAIDQIVMADFGVPGNRAVEEGAAEVGIPSGKAEVVNNLVFVTSEAAPYSKTGGLGDVCGSLPIALAGRGHRVMVISPRYLNGTAADKNYARAKDLGIRVTVNCFGGSQEVSFYHEYRDGVDWVFVDHKSYHRPGNPYGDSKGAFGDNQFRFTLLCHAACEAPLVLPLGGFTYGEKSLFLVNDWHAGLVPILLAAKYRPYGVYKDARSILIIHNLAHQGVEPAATYTNLGLPSEWYGAVGWVFPTWARTHALDTGEAVNVLKGAIVTSDRIITVSQGYAWEITTVEGGYGLQDLLSSRKSVINGITNGINVDEWNPSTDEHIPFHYSADDVSEKIKCKMALQKELGLPIRPECPMIGFIGRLDYQKGIDLIQTAGPDLMVDDIQFVMLGSGDPKYESWMRSMEETYRDKFRGWVGFNVPISHRITAGCDILLMPSRFEPCGLNQLYAMRYGTIPVVHGTGGLRDTVENFNPYAEGGAGTGTGWVFTPLSKDSMVSALRLAAATYREYKQSWEGLMRRGMTRNYSWENAAVQYEQVFQWVFMDPPYVS

SEQ ID NO: 4983 - DNA, 4127 bp, Solanum tuberosum
  CDS (143)..(3835)
gaattcgcggccgcagatagtgtgttgatgaaggagaagagagatatttcacatgggatgttctatttgattctgtggtgaacaagagttttacaaagaacattcctttttcttttttccttggttcttgtgtgggtcagccatggatgttccatttccactgcatagatcattgagttgcacaagtgtctccaatgcaataacccacctcaagatcaaacctattcttgggtttgtctctcatggaaccacaagtctatcagtacaatcttcttcatggaggaaggatggaatggttactggggtttcattttccatttgtgcaaatttctcgggaagaagacggagaaaagtttcaactcctaggagtcaaggctcttcacctaaggggtttgtgccaaggaagccctcagggatgagcacgcaaagaaaggttcagaagagcaatggtgataaagaaagtaaaagtacttcaacatctaaagaatctgaaatttccaaccagaagacggttgaagcaagagttgaaactagtgacgatgacactaaaggagtggtgagggaccacaagtttctggaggatgaggatgaaatcaatggttctactaaatcaataagtatgtcacctgttcgtgtatcatctcaatttgttgaaagtgaagaaactggtggtgatgacaaggatgctgtaaagttaaacaaatcaaagagatcggaagagagtggttttataattgattctgtaataagagaacaaagtggatctcagggggaaactaatgccagtagcaagggaagccatgctgtgggtacaaaactttatgagatattgcaggtggatgttgagccacaacaattgaaagaaaataatgctgggaatgttgaatacaaaggacctgtagcaagtaagctattggaaattactaaggctagtgatgtggaacacactgaaagcaatgagattgatgacttagacactaatagtttctttaaatcagatttaattgaagaggatgagccattagctgcaggaacagtggagactggagattcttctctaaacttaagattggagatggaagcaaatctacgtaggcaggctatagaaaggcttgccgaggaaaatttattgcaagggatcagattattttgttttccagaggttgtaaaacctgatgaagatgtcgagatatttcttaacagaggtctttccactttgaagaatgagtctgatgtcttgattatgggagcttttaatgagtggcgctataggtcttttactacaaggctaactgagactcatctcaatggagattggtggtcttgcaagatccatgttcccaaggaagcatacagggctgattttgtgttttttaatggacaagatgtctatgacaacaatgatggaaatgacttcagtataactgtgaaaggtggtatgcaaatcattgactttgaaaatttcttgcttgaggagaaatggagagaacaggagaaacttgctaaagaacaagctgaaagagaaagactagcagaagaacaaagacgaatagaagcagagaaagctgaaattgaagctgacagagcacaagcaaaggaagaggctgcaaagaaaaagaaagtattgcgagaattgatggtaaaagccacgaagactcgtgatatcacctggtacatagagccaagtgaatttaaatgcgaggacaaggtcaggttatactataacaaaagttcaggtcctctctcccatgctaaggacttgtggatccacggaggatataataattggaaggatggtttgtctattgtcaaaaagcttgttaaatctgagagaatagatggtgattggtggtatacagaggttgttattcctgatcaggcacttttcttggattgggtttttgctgatggtccacccaagcatgccattgcttatgataacaatcaccgccaagacttccatgccattgtccccaaccacattccggaggaattatattgggttgaggaagaacatcagatctttaagacacttcaggaggagagaaggcttagagaagcggctatgcgtgctaaggttgaaaaaacagcacttctgaaaactgaaacaaaggaaagaactatgaaatcatttttactgtctcagaagcatgtagtatatactgaacctcttgatatccaagctggaagcagcgtcacagtttactataatcccgccaatacagtacttaatggtaaacctgaaatttggttcagatgttcatttaatcgctggactcaccgcctgggtccattgccacctcagaaaatgtcgcctgctgaaaatggcacccatgtcagagcaactgtgaaggttccattggatgcatatatgatggattttgtattttccgagagagaagatggtgggatttttgacaataagagcggaatggactatcacatacctgtgtttggaggagtcgctaaagaacctccaatgcatattgtccatattgctgtcgaaatggcaccaattgcaaaggtgggaggccttggtgatgttgttactagtctttcccgtgctgttcaagatttaaaccataatgtggatattatcttacctaagtatgactgtttgaagatgaataatgtgaaggactttcggtttcacaaaaactacttttggggtgggactgaaataaaagtatggtttggaaaggtggaaggtctctcggtctattttttggagcctcaaaacgggttattttcgaaagggtgcgtctatggttgtagcaacgatggtgaacgatttggtttcttctgtcacgcggctttggagtttcttctgcaaggtggatttagtccggatatcattcattgccatgattggtctagtgctcctgttgcttggctctttaaggaacaatatacacactatggtctaagcaaatctcgtatagtcttcacgatacataatcttgaatttggggcagatctcattgggagagcaatgactaacgcagacaaagctacaacagtttcaccaacttactcacaggaggtgtctggaaaccctgtaattgcgcctcaccttcacaagttccatggtatagtgaatgggattgacccagatatttgggatcctttaaacgataagttcattccgattccgtacacttcagaaaacgttgttgagggcaaaacagcagccaaggaagctttgcagcgaaaacttggactgaaacaggctgaccttcctttggtaggaattatcacccgcttaactcaccagaaaggaatccacctcattaaacatgctatttggcgcaccttggaacggaacggacaggtagtcttgcttggttctgctcctgatcctagggtacaaaacaattttgttaatttggcaaatcaattgcactccaaatataatgaccgcgcacgactctgtctaacatatgacgagccactttctcacctgatatatgctggtgctgattttattctagttccttcaatatttgagccatgtggactaacacaacttaccgctatgagatatggttcaattccagtcgtgcgtaaaactggaggactttatgatactgtatttgatgttgaccatgacaaagagagagcacaacagtgtggtcttgaaccaaatggattcagctttgatggagcagatgctggcggagttgattatgctctgaatagagctctctctgcttggtacgatggtcgggattggttcaactctttatgcaagcaggtcatggaacaagattggtcttggaaccgacctgctcttgattatttggagctttaccatgctgctagaaagttagaatagttagtttgtgagatgctagcagaaaaattcacgagatctgcaatctgtacaggttcagtgtttgggtctggacagctttatcatttcctatatcaaagtataaatcaagtctacactgaggatcaatagcagacagtcctcaagttcatttcattttttggggcaaacatatgaaagagcttagcctcttaataatgtcggcctattgatgattatttgttttgggaagaaatgagaaatcaaaggatgcaaaataaaaaaaaaaaaaaaaaaaaaaactcgtgccgaattc

SEQ ID NO: 4984 - protein, 1230 aa, Solanum tuberosum
MDVPFPLHRSLSCTSVSNAITHLKIKPILGFVSHGTTSLSVQSSSWRKDGMVTGVSFSICANFSGRRRRKVSTPRSQGSSPKGFVPRKPSGMSTQRKVQKSNGDKESKSTSTSKESEISNQKTVEARVETSDDDTKGVVRDHKFLEDEDEINGSTKSISMSPVRVSSQFVESEETGGDDKDAVKLNKSKRSEESGFIIDSVIREQSGSQGETNASSKGSHAVGTKLYEILQVDVEPQQLKENNAGNVEYKGPVASKLLEITKASDVEHTESNEIDDLDTNSFFKSDLIEEDEPLAAGTVETGDSSLNLRLEMEANLRRQAIERLAEENLLQGIRLFCFPEVVKPDEDVEIFLNRGLSTLKNESDVLIMGAFNEWRYRSFTTRLTETHLNGDWWSCKIHVPKEAYRADFVFFNGQDVYDNNDGNDFSITVKGGMQIIDFENFLLEEKWREQEKLAKEQAERERLAEEQRRIEAEKAEIEADRAQAKEEAAKKKKVLRELMVKATKTRDITWYIEPSEFKCEDKVRLYYNKSSGPLSHAKDLWIHGGYNNWKDGLSIVKKLVKSERIDGDWWYTEVVIPDQALFLDWVFADGPPKHAIAYDNNHRQDFHAIVPNHIPEELYWVEEEHQIFKTLQEERRLREAAMRAKVEKTALLKTETKERTMKSFLLSQKHVVYTEPLDIQAGSSVTVYYNPANTVLNGKPEIWFRCSFNRWTHRLGPLPPQKMSPAENGTHVRATVKVPLDAYMMDFVFSEREDGGIFDNKSGMDYHIPVFGGVAKEPPMHIVHIAVEMAPIAKVGGLGDVVTSLSRAVQDLNHNVDIILPKYDCLKMNNVKDFRFHKNYFWGGTEIKVWFGKVEGLSVYFLEPQNGLFSKGCVYGCSNDGERFGFFCHAALEFLLQGGFSPDIIHCHDWSSAPVAWLFKEQYTHYGLSKSRIVFTIHNLEFGADLIGRAMTNADKATTVSPTYSQEVSGNPVIAPHLHKFHGIVNGIDPDIWDPLNDKFIPIPYTSENVVEGKTAAKEALQRKLGLKQADLPLVGIITRLTHQKGIHLIKHAIWRTLERNGQVVLLGSAPDPRVQNNFVNLANQLHSKYNDRARLCLTYDEPLSHLIYAGADFILVPSIFEPCGLTQLTAMRYGSIPVVRKTGGLYDTVFDVDHDKERAQQCGLEPNGFSFDGADAGGVDYALNRALSAWYDGRDWFNSLCKQVMEQDWSWNRPALDYLELYHAARKLE

SEQ ID NO: 4985 - DNA, 25 bp, artificial sequence
  primer
atgcaggttttacatgtatgttcag

SEQ ID NO: 4986 - DNA, 26 bp, artificial sequence
  primer
ttatttcaagcgatagtaaagctcac

SEQ ID NO: 4987 - DNA, 2420 bp, Saccharomyces cerevisiae
  CDS (739)..(2115)
atatacgatgtcttagtgaaatagagccaaaaaaaaaaaagaaaattattacaaaaaaccgaaacccaaatgataaataataatagtaacaaataataataatggaaatcaaaaaagtcgtatcaaatattaagcgaaggatggaaggtacctcttgttctaggtgccacgatgcagaaaaaaagatcaggaaaaacgaatgggaaaaagagaaaaagctggaaacgggattctcttttttctatgctgcttttgctttgcactattggatagtgtctgtagtatctaaactgattgcctatctcttctgtgctggcatcttattcgatgtatatagttcttaatatctagtgaaaaatttttgacaaatttctcgagacctgaatcttcgacacgcaagaaaaaattgaaaaattaacgtggaccctgggaagcgatgagctagagaaggtaaatacagggtcgtacgacgcagaagcatcccaaaattgttgcaacaagtatggaatgtcacattagagatttcccaatcttacatgactctttattgctgttttgtagatagccttccatgtaaaatgcatttgccgtcacattctgtgtgcggttgctgggtgctgtaaacaagctaaagaaatttcgctatcgaacttaaagaacaacgcagtacactagttgggagtgaaaacagtatcatagagtgtgtatgggagagagaaagagttagatactagtagtatggaaggtgaacagtctccgcaaggtgaaaagtctctgcaaaggaagcaatttgtcagacctccgctggatctgtggcaggatctcaaggacggtgtgcgctacgtgatcttcgattgtagggccaatcttatcgttatgccccttttgattttgttcgaaagcatgctgtgcaagattatcattaagaaggtagcttacacagagatcgattacaaggcgtacatggagcagatcgagatgattcagctcgatggcatgctggactactctcaggtgagtggtggaacgggcccgctggtgtatccagcaggccacgtcttgatctacaagatgatgtactggctaacagagggaatggaccacgttgagcgcgggcaagtgtttttcagatacttgtatctccttacactggcgttacaaatggcgtgttactaccttttacatctaccaccgtggtgtgtggtcttggcgtgcctctctaaaagattgcactctatttacgtgctacggttattcaatgattgcttcactactttgtttatggtcgtcacggttttgggggctatcgtggccagcaggtgccatcagcgccccaaattaaagaagtcccttgcgctggtgatctccgcaacatacagtatggctgtgagcattaagatgaatgcgctgttgtatttccctgcaatgatgatttctctattcatccttaatgacgcgaacgtaatccttactttgttggatctcgttgcgatgattgcatggcaagtcgcagttgcagtgcccttcctgcgcagctttccgcaacagtacctgcattgcgcttttaatttcggcaggaagtttatgtaccaatggagtatcaattggcaaatgatggatgaagaggctttcaatgataagaggttccacttggcccttttaatcagccacctgatagcgctcaccacactgttcgtcacaagataccctcgcatcctgcccgatttatggtcttccctgtgccatccgctgaggaaaaatgcagtgctcaatgccaatcccgccaagactattccattcgttctaatcgcatccaacttcatcggcgtcctattttcaaggtccctccactaccagtttctatcctggtatcactggactttgcctatactgatcttttggtcgggaatgcccttcttcgttggtcccatttggtacgtcttgcacgagtggtgctggaattcctatccaccaaactcacaagcaagcacgctattgttggcattgaatactgttctgttgcttctattggccttgacgcagctatctggttcggtcgccctcgccaaaagccatcttcgtaccaccagctctatggaaaaaaagctcaactgaaacagatgtataaatatcatataatcgtattgttttaaatcatttctttataccatctatatagtactactagtatttaatggtgccgttattacccgcgcttgattttcctttttttttttgatcaaaaggatggaacaggctgaaagtaaaccaaaaggatcaaagtgcaagcaaaggtgccacagaaaagtttatcaaaaaaccatacctagctgtgagagttttagactctgttttggtgactgcatatctattcataaatcgacacgaacttttcgtgcaggatacataataaaaatagc

SEQ ID NO: 4988 - protein, 458 aa, Saccharomyces cerevisiae
MEGEQSPQGEKSLQRKQFVRPPLDLWQDLKDGVRYVIFDCRANLIVMPLLILFESMLCKIIIKKVAYTEIDYKAYMEQIEMIQLDGMLDYSQVSGGTGPLVYPAGHVLIYKMMYWLTEGMDHVERGQVFFRYLYLLTLALQMACYYLLHLPPWCVVLACLSKRLHSIYVLRLFNDCFTTLFMVVTVLGAIVASRCHQRPKLKKSLALVISATYSMAVSIKMNALLYFPAMMISLFILNDANVILTLLDLVAMIAWQVAVAVPFLRSFPQQYLHCAFNFGRKFMYQWSINWQMMDEEAFNDKRFHLALLISHLIALTTLFVTRYPRILPDLWSSLCHPLRKNAVLNANPAKTIPFVLIASNFIGVLFSRSLHYQFLSWYHWTLPILIFWSGMPFFVGPIWYVLHEWCWNSYPPNSQASTLLLALNTVLLLLLALTQLSGSVALAKSHLRTTSSMEKKLN

SEQ ID NO: 4989 - DNA, 1345 bp, Arabidopsis thaliana (mouse-ear cress)
  CDS (29)..(1345)
agacgctgatgcgatttgctctgttttcatggcgggcgcctcatcaccggcgagtttgagagcttctcgtagccgtcggctggggaaggagacgaatcgatccgatctattcaaaaaacctgcagttccattcgcattcgcgctaattcttgctgatgcaatcctagtcgcacttattatcgcctatgttccatacacgaagatcgattgggatgcttacatgtcacaggttagtgggtttctcgggggagagagagactatgggaacttgaaaggcgatacagggccattggtttatccagcaggtttcctctatgtttactctgcagtgcagaacttaactggaggggaagtctaccctgctcagattctttttggtgttctctacattgtcaatctggggatcgtcttgatcatctacgtgaagactgatgtggtgccatggtgggcattaagtctactatgtttatccaagaggatacattcaatctttgttctccgtctctttaatgattgttttgccatgactctcctacatgcatcaatggctctctttctctatcgtaaatggcatctagggatgcttgttttcagtggagctgtttctgtaaagatgaatgtacttttgtatgctccaactttgttacttctgctacttaaggccatgaatatcattggagtggtgtctgctttggctggtgcagctcttgttcagatactcgtgggactgccgtttctgataacatatccggtttcatacatagcaaacgcctttgatcttggacgtgttttcattcatttctggtctgttaacttcaaatttgttccagaacgagtttttgtgtccaaagaatttgcagtatgcttgctcattgctcacctttttctccttgtggcgttcgcaaattataagtggtgcaagcatgaaggcgggattataggcttcatgcgttctaggcatttcttcttgacacttccgtcttcactctcgttcagtgatgtatcagcctcacggattattacgaaagaacatgtcgtcacggccatgtttgttgggaatttcatcggcattgtatttgctcgctctctgcactaccagttctactcatggtacttctattcgctaccttatctactatggagaacaccgtttcccacttggctgcgcttgatcatgttcctcggcattgagctctgttggaatgtttatccatcaacaccgtcctcctcgggtttgctattgtgtctacacttgatcattctggtgggtctctggttagctccttcagtcgatccttatcagctcaaagaacaccctaaatcccaaatacacaaaaaagcataa

SEQ ID NO: 4990 - protein, 438 aa, Arabidopsis thaliana (mouse-ear cress)
MAGASSPASLRASRSRRLGKETNRSDLFKKPAVPFAFALILADAILVALIIAYVPYTKIDWDAYMSQVSGFLGGERDYGNLKGDTGPLVYPAGFLYVYSAVQNLTGGEVYPAQILFGVLYIVNLGIVLIIYVKTDVVPWWALSLLCLSKRIHSIFVLRLFNDCFAMTLLHASMALFLYRKWHLGMLVFSGAVSVKMNVLLYAPTLLLLLLKAMNIIGVVSALAGAALVQILVGLPFLITYPVSYIANAFDLGRVFIHFWSVNFKFVPERVFVSKEFAVCLLIAHLFLLVAFANYKWCKHEGGIIGFMRSRHFFLTLPSSLSFSDVSASRIITKEHVVTAMFVGNFIGIVFARSLHYQFYSWYFYSLPYLLWRTPFPTWLRLIMFLGIELCWNVYPSTPSSSGLLLCLHLIILVGLWLAPSVDPYQLKEHPKSQIHKKA

SEQ ID NO: 4991 - DNA, 1533 bp, Drosophila melanogaster
  CDS (1)..(1533)
atggcgccgccaaaggccgccagccaccgtccggcggtgcggcgcaagaagtcgggcaccctggtggactccatcctggacaagtacctcaacgtgcgcttcttcaagtatctgctcctggagccggccgctctgcccatagttggcctcttcgtgctcctggcggagctggtcatcaacgtggtggtcatccagcgggtgccctacacagagatcgactgggtggcttacatgcaggagtgcgagggcttcctgaacggcaccaccaactatagtctgttgcgcggcgacacaggacctcttgtgtatccagccgccttcgtgtacatctactcggctctctactacgtcacgtcccacggaacgaacgttcgcctggcgcagtacatcttcgccgggatctacctgctccagctggccctggtgctgaggctgtactcgaagagcagaaaggtgccgccttatgtgctagtgctcagtgccttcacgtcgtatcggatccactcgatatacgtgctgcgactgttcaacgatcccgtggcagtgctgctcctctatgccgcactcaatttgttcctggacaggaggtggaccctgggtagcaccttcttcagcttggcggtgggcgttaagatgaacatcctgctgtttgcgcctgcgctcttgctgttctacttggccaacctggggcttctgcggacgatcctgcagctggctgtctgcggagtgatacaactgctgctgggcgctcctttcctgctcacccatcctgtggagtatctgcggggcagctttgatttgggacgcatcttcgagcacaagtggacggtcaactatcggtttctgagcagagatgtgttcgagaaccgcaccttccacgtttcgcttttgggcctgcatctgctgctcctgctggccttcgccaagcccatctggacctttttccagagctacgtgcgcctgcgccgcattgaggatcagctgcagccgcaaataacccagcagaacctccagctgaaggcgcagaaaagaccaaagaaagtggaaaaggacaaggacaaggaccagaagaagtttacaaccgagcagcaatccttcctgaaggccttcgagaagagcctgcagaaggcgtctggaggaaaggccactccggcgcccgcacaggcggaaccggaacgctatggcatccacttcgatcgctgcacccagctggccctgctgccgttcttcctgtgcaacctggtgggcgtggcctgctctcgatccttgcactatcagttctacgtctggtacttccactcgctaccctatttggcctggtcgacgccgtactcgctgggcgtgcgctgcctgatcctcggactgattgagtactgctggaacacctatcccagtacgaatttctccagcgctgccctccacttcacccacatcatactgctcgctggggtggccaagcagcttatccagaccatgcggattaataatgcggccaagagggagcagcaggagcaacagaaaaagctgcagtaa

SEQ ID NO: 4992 - protein, 510 aa, Drosophila melanogaster
MAPPKAASHRPAVRRKKSGTLVDSILDKYLNVRFFKYLLLEPAALPIVGLFVLLAELVINVVVIQRVPYTEIDWVAYMQECEGFLNGTTNYSLLRGDTGPLVYPAAFVYIYSALYYVTSHGTNVRLAQYIFAGIYLLQLALVLRLYSKSRKVPPYVLVLSAFTSYRIHSIYVLRLFNDPVAVLLLYAALNLFLDRRWTLGSTFFSLAVGVKMNILLFAPALLLFYLANLGLLRTILQLAVCGVIQLLLGAPFLLTHPVEYLRGSFDLGRIFEHKWTVNYRFLSRDVFENRTFHVSLLGLHLLLLLAFAKPIWTFFQSYVRLRRIEDQLQPQITQQNLQLKAQKRPKKVEKDKDKDQKKFTTEQQSFLKAFEKSLQKASGGKATPAPAQAEPERYGIHFDRCTQLALLPFFLCNLVGVACSRSLHYQFYVWYFHSLPYLAWSTPYSLGVRCLILGLIEYCWNTYPSTNFSSAALHFTHIILLAGVAKQLIQTMRINNAAKREQQEQQKKLQ

SEQ ID NO: 4993 - DNA, 1221 bp, Schizosaccharomyces pombe
  CDS (1)..(1221)
atgtcttcagttgagacaagaaattcttttaatccttttcgggtattatttgatcttggttcctatggctggttacatccttcaaggctccttctgttggaaattccttttgtctttgctattatttccaaagttccctacacggagatagactggattgcttacatggagcaggtgaattcatttctattaggagaaagagattataaatctcttgtcggatgtacaggccctctggtctaccctggagggcacgtatttttgtacacccttttgtactaccttactgatggagggaccaacattgtaagggcgcaatacatttttgcctttgtatactggattacaacggctattgtagggtatttgtttaaaattgtccgcgctcctttttatatatatgttttgcttatactttcaaaacgtctacacagtatatttatcttacgtttatttaacgatggattcaacagtttattctcttccctttttattttgtcttcatgcaaaaaaaagtgggttagagcttcaattctactaagtgtcgcttgttctgtcaagatgtcctccttgctttatgtcccagcttatttagttcttttgctccaaatcttggggcccaaaaagacctggatgcatatttttgttattataattgtacaaattttattttctattcccttccttgcctatttttggtcgtattggactcaagcctttgattttggcagagcattcgattataagtggacagtaaactggagattcattccacgcagcatttttgagtctacatcattttccacatcaatactttttcttcatgttgctttgctagttgcatttacctgcaaacactggaataaactgagcagagcaacaccatttgcaatggtaaactccatgctgaccttgaagcctttaccaaaactccaactcgcaactcctaattttatctttactgcattagcaacatccaatttgattggtatattatgtgcaagatccctgcattatcaattttatgcatggtttgcttggtattcaccatatctatgctatcaagctagttttcctgctccgatagtaattggcttatggatgttacaagaatacgcatggaatgtttttcctagtactaaactatcttcattaatcgctgtatgcgtgccgcttattactattttgaagctatacacatccgactacagaaaaccctga

SEQ ID NO: 4994 - protein, 406 aa, Schizosaccharomyces pombe
MSSVETRNSFNPFRVLFDLGSYGWLHPSRLLLLEIPFVFAIISKVPYTEIDWIAYMEQVNSFLLGERDYKSLVGCTGPLVYPGGHVFLYTLLYYLTDGGTNIVRAQYIFAFVYWITTAIVGYLFKIVRAPFYIYVLLILSKRLHSIFILRLFNDGFNSLFSSLFILSSCKKKWVRASILLSVACSVKMSSLLYVPAYLVLLLQILGPKKTWMHIFVIIIVQILFSIPFLAYFWSYWTQAFDFGRAFDYKWTVNWRFIPRSIFESTSFSTSILFLHVALLVAFTCKHWNKLSRATPFAMVNSMLTLKPLPKLQLATPNFIFTALATSNLIGILCARSLHYQFYAWFAWYSPYLCYQASFPAPIVIGLWMLQEYAWNVFPSTKLSSLIAVCVPLITILKLYTSDYRKP

SEQ ID NO: 4995 - DNA, 1446 bp, Debaryomyces hansenii
  CDS (1)..(1446)
atgacagaacagagtataaaagacggccaacggccagagttacctccttttacgttgaggaatgtgctaaatgatatttacaatgggatattggctttattcactgatccattctgtaccaggatcatttgtcctgttgtcattgtattgacatcattactatctaaagctataatatataaggttccttatacagaaattgatttcaggacttacatccaacaaattcaaataattaacgatggggaacttgattattcgttagtgcaaggagatacgggccaaattgtatacccagctggatttgttcaaatatatcaagtgctcaactggttaaccgatgaaggtactgatattcacgcaggccaaacagcctttggttatttgttggctttgactaactttttggttataattgcctatacaatgactcctgattttcaaccatggccagtgtattgtttgcttttgagcaaaagattgttttccatatacgtgcttcgattattcaatgactgttttactactgtttgtatggttagtgttacaattttgttacaacaggcagcatattggtataagaagggcggatcttcaattagttttctattgaccatggttgcagctgatttatacagtattgcaatttctataaagatgaatgcattattgtattttcctggatttatcatagttgcatatttcttatgcggtgaaaacttattgaagtttggtacagtattattggttattccaattgttcaggtccttatgggttggaagttcttgttaccattttttaatgatgaagaagcttcatacattagatggaactacatcaaccaagcatttaactttaacagaaagttcttatataaatggactgtcaattggagatttgtttccgaggaattcttcttatcagatgttttcagtaatgggttattaattgctaatgcttcagtcttaattttcttcatatttacaagatatatctcgcctaggattacatgcaaaccagtatctcgtctcataaaggatgctatggtaggacctttcagtagcacaattaataaaaacaatttgttgatagatccaaaatgtggtccaaagcttgttatgttaatattaggatctaccaatataataggcattttgtttgcaaggtctttgcactatcaatttctttcgtggtactgctggcaattacctttcatgctatatatgactgggtggagtttactagtttgtattcctctttgggtagtacatgaatggtgctggaacgtatttccatcgacacccatgagttcaggcttgttggtaagcattctagctattgtattatttggtgtgtggtacaatacgaatgaatggttccccaaactagcagacaacgaggctgctactatcgatgagtccggtgagtccaagaaggataaatag

SEQ ID NO: 4996 - protein, 481 aa, Debaryomyces hansenii
MTEQSIKDGQRPELPPFTLRNVLNDIYNGILALFTDPFCTRIICPVVIVLTSLLSKAIIYKVPYTEIDFRTYIQQIQIINDGELDYSLVQGDTGQIVYPAGFVQIYQVLNWLTDEGTDIHAGQTAFGYLLALTNFLVIIAYTMTPDFQPWPVYCLLLSKRLFSIYVLRLFNDCFTTVCMVSVTILLQQAAYWYKKGGSSISFLLTMVAADLYSIAISIKMNALLYFPGFIIVAYFLCGENLLKFGTVLLVIPIVQVLMGWKFLLPFFNDEEASYIRWNYINQAFNFNRKFLYKWTVNWRFVSEEFFLSDVFSNGLLIANASVLIFFIFTRYISPRITCKPVSRLIKDAMVGPFSSTINKNNLLIDPKCGPKLVMLILGSTNIIGILFARSLHYQFLSWYCWQLPFMLYMTGWSLLVCIPLWVVHEWCWNVFPSTPMSSGLLVSILAIVLFGVWYNTNEWFPKLADNEAATIDESGESKKDK

SEQ ID NO: 4997 - DNA, 1617 bp, Yarrowia lipolytica
  CDS (1)..(1617)
atgatcctcatcaaaaataaagtggcgctgaagctgctacagctagccaatgaccgcaaatactccatgacagtatgtggtgtgcttcttgctctggaagcagtctttctcgtggccatcatccacaaggtcccatacaccgagatcgattggaaggcctacatggagcaggctgctctgatcctggggggtgagtacgactacagtaaaattgttggtggaactggtcccatggtctaccccggaggccacgctcgaatcttcactgctctttacgacgtgacctctggtggtgagaatattcgcctggcccagtacatctacgctgctgtatacctgggcacccagttctttgcattcaccgtctatctgctcgccgacgctccaccttacctgttccctcttctctgtctgtctaaacgactgcattctatctatgttcttcgacttttcaacgacgtctttggtaccttcgccatgaccttttgtgtcttcaccctgcagaaccagatgtggctgctttccggtctttggatgtccctggcaattggaatcaagatgaatttcatgctctatcttcctgccttcctgcttattactctccaaggtatgagcagaaacggccttcttgttgtcttcgccctttccatcgtcggaattcaggtcttcctggcactgcctttctgcaatccctcccctgatcacatctggtcctacctggctggtgcttttgacctttctcgagcattcatgtggaaatggactgtcaactggcggtttgttggacagaaggtcttcgagaaccgaaagttccatggcatcctgttgtggacgcacctcacagcactcatcggtttcgcctgcacgatctggaatgctccttccggctaccagaacccgtttgagatgttcttcacaaacccccctcctgccccacgaggtctcaccgctgcccagcgagcagagtgggaccgaatcagacaggaagcctctggcaacgaggtccagtttgatgtccagcagaagcgatccaagcgtgaacagaagcgaatgcaggagcaggaggaggagatcaaaaagcagcaactggctcagcaggaaggacgagagaagcctcccctgttctactctcgaacccagttctccactctggttacccaagagtacgtcttcgtcaccatggctacctgtaacctaatcggtgtgctcttcgctcgatctctccactatcagttttactcatggttctactggactatgcctttcctcctgtaccgagctacatacgccatttcgcctttgtctcctatgcagtctaccctgcgatatgagggccgtctcagcaagacagagatcagaatattcttcaccgacatcatcggctttgtcttcatttttggcacctgggcgcttcaggagtatgcctggaacgtgtatcccagcactttctggtcatctataatcgcagttagttgcatcgccatcactatcatcggtgtctatgtttctgagtgccgatacccctcagccaacaacactgaagcccccacttccaatgagctgcagaaatacttggccaaggttgagaaggagaacgaggccagggccaagaactag

SEQ ID NO: 4998 - protein, 538 aa, Yarrowia lipolytica
MILIKNKVALKLLQLANDRKYSMTVCGVLLALEAVFLVAIIHKVPYTEIDWKAYMEQAALILGGEYDYSKIVGGTGPMVYPGGHARIFTALYDVTSGGENIRLAQYIYAAVYLGTQFFAFTVYLLADAPPYLFPLLCLSKRLHSIYVLRLFNDVFGTFAMTFCVFTLQNQMWLLSGLWMSLAIGIKMNFMLYLPAFLLITLQGMSRNGLLVVFALSIVGIQVFLALPFCNPSPDHIWSYLAGAFDLSRAFMWKWTVNWRFVGQKVFENRKFHGILLWTHLTALIGFACTIWNAPSGYQNPFEMFFTNPPPAPRGLTAAQRAEWDRIRQEASGNEVQFDVQQKRSKREQKRMQEQEEEIKKQQLAQQEGREKPPLFYSRTQFSTLVTQEYVFVTMATCNLIGVLFARSLHYQFYSWFYWTMPFLLYRATYAISPLSPMQSTLRYEGRLSKTEIRIFFTDIIGFVFIFGTWALQEYAWNVYPSTFWSSIIAVSCIAITIIGVYVSECRYPSANNTEAPTSNELQKYLAKVEKENEARAKN

SEQ ID NO: 4999 - DNA, 1389 bp, Kluyveromyces lactis
  CDS (1)..(1389)
atggtggaagaaggcgctaataaaactgtaggggctcccactgtaggagacgatcaacaaccgaaggaatttgtacgtccgccatttacgccatttcaagatattttagatgcattcaattatcttatgtggaatcccgaggccaatgctattgcaatgcctgtcttgatacttttagaatccattgcaatgaagttcattcaaaataaagtgtcttatacagagattgattatactgcatatatggaacaaatatggatgattcaaaacggagaaagagattattctcaaataaaaggcggaactggaccattggtatatccagcaggtcatgtattcatatacaagatatttgagtgggtaagtgatggattagagaatataagcgaagctcaagatttattcagatatctttatgtgataactttgatgatacaattcatgtgttttgggttgttgaatatacctcctgggtatgcgatatttgccatactttccaaaagattacactcggtttacgtgctaagacttttcaacgactgttttacgaccttgtttatgtctttggctgtgttggtaatgatactttgtgcgaagtataagattagaggatttctggtacttatcggcagtagtttttactcaatggcagtaagcatcaaaatgaacgcattgctatatctcccaggtgtgttgttaacaatatacctattagagcgttgtaatactttcaaaatcgtactaaacttagcggtgatggttatttggcaggtaataatagccattccattttggaaagagtatccttgggaatatttgcaaagcgcgttcaatttcagcaggcaattcatgtacaaatggtcagtgaactggcaaatggtagacgaggaagtattcttggacccacttttccataggtctctattaatatctcatgtcattgttttagtcgtgtttttgttttacaagctgataccaacgaacatgaatacaccggcaggtttactgaagattggcaaagctaaccttttacatccttttaccgatgctgtattcagtgcgatgagagtaaacgcagaacaaattgcatacattttacttgttaccaattacattggagtactatttgctcgatcattacactaccaattcctatcttggtaccattggacgttaccagtactattgaattgggccaatgttccgtatccgctatgtgtgctatggtacctaacacatgagtggtgctggaacagctatccgccaaacgctactgcatccacactgctacacgcgtgtaacacatcactgttattggctgtattcttaagaggacccgcaaactcgaaaagtggtgataacgaaacaacacacgagaaagctgagtag

SEQ ID NO: 5000 - protein, 462 aa, Kluyveromyces lactis
MVEEGANKTVGAPTVGDDQQPKEFVRPPFTPFQDILDAFNYLMWNPEANAIAMPVLILLESIAMKFIQNKVSYTEIDYTAYMEQIWMIQNGERDYSQIKGGTGPLVYPAGHVFIYKIFEWVSDGLENISEAQDLFRYLYVITLMIQFMCFGLLNIPPGYAIFAILSKRLHSVYVLRLFNDCFTTLFMSLAVLVMILCAKYKIRGFLVLIGSSFYSMAVSIKMNALLYLPGVLLTIYLLERCNTFKIVLNLAVMVIWQVIIAIPFWKEYPWEYLQSAFNFSRQFMYKWSVNWQMVDEEVFLDPLFHRSLLISHVIVLVVFLFYKLIPTNMNTPAGLLKIGKANLLHPFTDAVFSAMRVNAEQIAYILLVTNYIGVLFARSLHYQFLSWYHWTLPVLLNWANVPYPLCVLWYLTHEWCWNSYPPNATASTLLHACNTSLLLAVFLRGPANSKSGDNETTHEKAE

SEQ ID NO: 5001 - DNA, 1395 bp, Pichia pastoris
  CDS (1)..(1395)
atgcctccgatagagccagctgaaaggccaaagcttacgctgaaaaatgttatcggtgatctagtggctcttattcaaaacgttttatttaacccagattttagtgtcttcgttgcacctcttttatggttagctgattccattgttatcaaggtgatcattggcactgtttcctacacagatattgatttttcttcatatatgcaacaaatctttaaaattcgacaaggagaattagattatagcaacatatttggtgacaccggtccattggtttacccagccggccatgttcatgcttactcagtactttcgtggtacagtgatggtggagaagacgtcagtttcgttcaacaagcatttggttggttatacctaggttgcttgttactatccatcagctcctactttttctctggcttagggaaaatacctccggtttattttgttttgttggtagcgtccaagagactgcattcaatatttgtattgagactcttcaatgactgtttaacaacatttttgatgttggcaactataatcatccttcaacaagcaagtagctggaggaaagatggcacaactattccattatctgtccctgatgctgcagatacgtacagtttagccatctctgtaaagatgaatgcgctgctatacctcccagcattcctactactcatatatctcatttgtgacgaaaatttgattaaagccttggcacctgttctagttttgatattggtgcaagtaggagtcggttattcgttcattttaccgttgcactatgatgatcaggcaaatgaaattcgttctgcctactttagacaggcttttgactttagtcgccaatttctttataagtggacggttaattggcgctttttgagccaagaaactttcaacaatgtccattttcaccagctcctgtttgctctccatattattacgttagtcttgttcatcctcaagttcctctctcctaaaaacattggaaaaccgcttggtagatttgtgttggacattttcaaattttggaagccaaccttatctccaaccaatattatcaacgacccagaaagaagcccagattttgtttacaccgtcatggctactaccaacttaataggggtgctttttgcaagatctttacactaccagttcctaagctggtatgcgttctctttgccatatctcctttacaaggctcgtctgaactttatagcatctattattgtttatgccgctcacgagtattgctggttggttttcccagctacagaacaaagttccgcgttgttggtatctatcttactacttatcctgattctcatttttaccaacgaacagttatttccttctcaatcggtccctgcagaaaaaaagaatacataa

SEQ ID NO: 5002 - protein, 464 aa, Pichia pastoris
MPPIEPAERPKLTLKNVIGDLVALIQNVLFNPDFSVFVAPLLWLADSIVIKVIIGTVSYTDIDFSSYMQQIFKIRQGELDYSNIFGDTGPLVYPAGHVHAYSVLSWYSDGGEDVSFVQQAFGWLYLGCLLLSISSYFFSGLGKIPPVYFVLLVASKRLHSIFVLRLFNDCLTTFLMLATIIILQQASSWRKDGTTIPLSVPDAADTYSLAISVKMNALLYLPAFLLLIYLICDENLIKALAPVLVLILVQVGVGYSFILPLHYDDQANEIRSAYFRQAFDFSRQFLYKWTVNWRFLSQETFNNVHFHQLLFALHIITLVLFILKFLSPKNIGKPLGRFVLDIFKFWKPTLSPTNIINDPERSPDFVYTVMATTNLIGVLFARSLHYQFLSWYAFSLPYLLYKARLNFIASIIVYAAHEYCWLVFPATEQSSALLVSILLLILILIFTNEQLFPSQSVPAEKKNT

SEQ ID NO: 5003 - DNA, 1329 bp, Candida glabrata
  CDS (1)..(1329)
atgcagacagtgagatcggaagataaccctcctaaaaaggaagagttcaagaggccaccaattgacttactacaggacttgaaagacggtattaaccatgttgtgtataatccactaggtaataaaatagtcatgccactaatgtttttactagaatcagtattgttgaagtatgttattgctgctataccatacactgaaattgattataaggcatacatggaacaagtggaaatgatctatgaggaaggtaattataactacctagaaattactggtgggacaggacctctggtttatcctgcaggccatgttttgattttccgagtgttaaattactttactgaaggaatgaatcatatagaggtaggacaaaagatttttaggtatctgtacttgatcaccctattaatgcagtatacttgttactatcaattacgtttacctccatggtgtgtcgtacttgcctctttatcgaaaaggttacattctatttacgttttaaggctgttcaatgattgttttactactttctttatggtattgtttgttctgctctacactcttagaagcaacaatagtactaaaatgtcgatggttatatcaacttttggatctttggtttacagtatggctatctcagttaaaatgaatgcgttattatatttacctgggtatttggtttcaacgtatctgataaatgaaggcaaactaataaactgtttgatttcggcatcggtgatcctattctggcaagttatcgtttctttgaggttcttacgttcatatccagttgaatacttggcaggtgctttcgattttagcagacaatttatgtttaaatggagtgttaattggcaatttctagatgaagatgcctttcaagatcgagttttccataccacattattgggctcccaatttgtagcagttgttgcgatgacgctctgtctttatccacgcttacctttagatgcttggaaatctctgaaagcgcctttcacgcaagttgtgattgcagatctgcggttcattgtaccttttttactaatgacttctaatttcattggggtgttgttttcgagatccctacattaccagtttttgtcctggtatcattggactctaccgtgcttgatctactggtcaaagttgcctatgcctttagggttcatatggtacatctgtcatgagtactgttggaactcgtatcctccaaacgaaaaagcaagcatcctcctattcacactaaatgcatctctgctgtgtcttctggcaatcaattgtatgagaccagttatagtaaacatcaagagaaagcaacaatga

SEQ ID NO: 5004 - protein, 442 aa, Candida glabrata
MQTVRSEDNPPKKEEFKRPPIDLLQDLKDGINHVVYNPLGNKIVMPLMFLLESVLLKYVIAAIPYTEIDYKAYMEQVEMIYEEGNYNYLEITGGTGPLVYPAGHVLIFRVLNYFTEGMNHIEVGQKIFRYLYLITLLMQYTCYYQLRLPPWCVVLASLSKRLHSIYVLRLFNDCFTTFFMVLFVLLYTLRSNNSTKMSMVISTFGSLVYSMAISVKMNALLYLPGYLVSTYLINEGKLINCLISASVILFWQVIVSLRFLRSYPVEYLAGAFDFSRQFMFKWSVNWQFLDEDAFQDRVFHTTLLGSQFVAVVAMTLCLYPRLPLDAWKSLKAPFTQVVIADLRFIVPFLLMTSNFIGVLFSRSLHYQFLSWYHWTLPCLIYWSKLPMPLGFIWYICHEYCWNSYPPNEKASILLFTLNASLLCLLAINCMRPVIVNIKRKQQ

SEQ ID NO: 5005 - DNA, 1299 bp, Ashbya gossypii
  CDS (1)..(1299)
atgagcgcagcagttccgaccacacgggcgggaactcccccaaccctacagtgtggatggcggagtgcatgtggaaagctgctggacatcgccaattatgtcatcttcagcccggaggcgtctgccgtggtcatgccggtgctcgtggcgtgggaatgtgtgctgttgaagctgattgtgaagcacgtgccctacacggagattgactacttggcatacatggagcagatatggcagatcaacaatggtgaacgcgactattcaaagatcgagggcggcacggggccgctggtgtacccggcgggacatgtactgatccatcgcctgcttgagcgcgccacagatggcctgcagaatgtcgcgcgcggacaggatattttcacgtggctctacttgctgacactcgtcctgcagttcggcgtctaccgcatgctgcgactgcccccgtggtgcattgtgctcgcgtgtctgtccaagcgtctgcactctgtctacgtcctgcggctgttcaacgacggctggacgaccctcatggtggtggtcgcagtctttctgcttctgctagccgcacgccaccccaggctctgcctgccggccgcgctcgtctacagcgctgctgtcagcatcaaaatgaatgcgctgctatacctgcccggcgtcctggtcgcactctttctactcacacgcggccacctgcttgcgctcgcgctctgtggcgccgtggccgtcgcatggcaggtcctggtcgccgcagacttcctctccactcaccccgccgagtactttgccaccgccttcgacttccgccggcaattcatgtaccgctggagcgtcaactggcagctcgtcggcgagcaagtcttttcacaccccaccttccaccgctgcctgctgctctcccacatcgccatcctgatgctcttcttcttcacgcgctatgccgagccgcgccagccaaactggttccgcactgctgcagctgccctgcgtcacccggccaccgccgtcctagccgccagcccgccccgggcccacgtcgcctacgtcctcctcgtctcgaacttcatcggcgtgctcttcgctcgctccctgcactaccagttcctggcctggtaccattggaccctacccgccttgcttcactgggctcgcatgccctgcctgctcgcgctgctatggtacgtcctgcacgagctctgctgggatacctacccgccctcctccgttgctagtgccacgctgtacgctctcaactccgccctacttctccttctgtacatcaacggcccgcctgcctag

SEQ ID NO: 5006 - protein, 432 aa, Ashbya gossypii
MSAAVPTTRAGTPPTLQCGWRSACGKLLDIANYVIFSPEASAVVMPVLVAWECVLLKLIVKHVPYTEIDYLAYMEQIWQINNGERDYSKIEGGTGPLVYPAGHVLIHRLLERATDGLQNVARGQDIFTWLYLLTLVLQFGVYRMLRLPPWCIVLACLSKRLHSVYVLRLFNDGWTTLMVVVAVFLLLLAARHPRLCLPAALVYSAAVSIKMNALLYLPGVLVALFLLTRGHLLALALCGAVAVAWQVLVAADFLSTHPAEYFATAFDFRRQFMYRWSVNWQLVGEQVFSHPTFHRCLLLSHIAILMLFFFTRYAEPRQPNWFRTAAAALRHPATAVLAASPPRAHVAYVLLVSNFIGVLFARSLHYQFLAWYHWTLPALLHWARMPCLLALLWYVLHELCWDTYPPSSVASATLYALNSALLLLLYINGPPA

SEQ ID NO: 5007 - DNA, 1662 bp, Anopheles gambiae str
  CDS (1)..(1662)
atgcgtattccgggcagtgagacagtgagaccagaccaaagaagagaaaaaaaccaaaacaaatccagcaaccagctctggagaggagcgatggggaaaattccagccaatcaaccgaaatcggtgccgccggtgccgcggaaggaaccgcaaactctgctcgccaagatacgcaaagagtacgtaagcttaacgtttgccaaatcgctcatcttcgacccggcccggttgccgctgatctcgatcctaattttggccgctgagttggtgctgaacgtgttcgtggtgcaaaatgtgcgctacaccgaaatcgactggaaggcgtacatgcaggagtgtgaagggtttctcaacggcaccaccgactattcgcagctacgaggtgataccggcccgctcgtctatcctgccgggtttgtctacatctacagcgcgctgtacttcctaacatcacacggcaccaacattcgcttggcccagtatgtcttcgttggcatctatctggttcagctgatgctcgtactccggctgtactgtaagagctgcaaagtccctccatacgtgatggtcattaccattttcacctcctaccggattcactccatctacgtgctgcggttgttcaacgatccgattgcgatcctgttcctctacgccgccctgaatgcgttcattgacggtcgatggacgctcggcagcgtaatgctcagcttgggcgtatcggtaaagatgaacatccttctgtttgctccggccattctgctgctgtacattaccaatctgggatggctgaaaacggcccttcagctgacggtctgtggagtgatacagctgatcctgggtgctccgttccttcttacccatccgtggcagtaccttaagggtagcttcgatttggggcgcgtgttcgagcacaagtggacagtaaactatcgcttcctcgagccggaagtgttcgaaagtaaggtgtttcatctggcactgctcggactgcatctcacgctgctgctcgtgtttgcatcgccctgctacaagtacttccaaaattactgccgcctgcgccacctggagatgatgctgatgccacagatagaggcacaaaatcgggccgaaaaggaaaaggtgaaaaagggcaagcaatcgaaagccaaagcattgccggctgctaaaggagacaacggggaggaaaagctaacgcaggatcaggaaaagtttttgaaatcgtttgaaaagggcattaaaaagatgtccggtaagcagcagcagcagcagaatgtcgccccggtggaaacggaatcaccggcagcagcgaacccagcggccaacaaattttccatccacttcgatcgatccacccaactcgcgctgctccccattttcctgtccaactttatcggcatcgtttgtgcgcgtagcttgcactaccaattttacgtgtggtacttccacagcttgccctacctcacttggtacacggagtatacgaacagtttgaagtttttgcttcttctgctgctggaattctgctggaacacgtacccgagcacggtactgagcagcgtggtcctgcacgcctgccacgtgtgcctgctggttggcattggaaggaaattgttccgtcggattccggatcttgctcagctgaacaataagacagagtaa

SEQ ID NO: 5008 - protein, 553 aa, Anopheles gambiae str
MRIPGSETVRPDQRREKNQNKSSNQLWRGAMGKIPANQPKSVPPVPRKEPQTLLAKIRKEYVSLTFAKSLIFDPARLPLISILILAAELVLNVFVVQNVRYTEIDWKAYMQECEGFLNGTTDYSQLRGDTGPLVYPAGFVYIYSALYFLTSHGTNIRLAQYVFVGIYLVQLMLVLRLYCKSCKVPPYVMVITIFTSYRIHSIYVLRLFNDPIAILFLYAALNAFIDGRWTLGSVMLSLGVSVKMNILLFAPAILLLYITNLGWLKTALQLTVCGVIQLILGAPFLLTHPWQYLKGSFDLGRVFEHKWTVNYRFLEPEVFESKVFHLALLGLHLTLLLVFASPCYKYFQNYCRLRHLEMMLMPQIEAQNRAEKEKVKKGKQSKAKALPAAKGDNGEEKLTQDQEKFLKSFEKGIKKMSGKQQQQQNVAPVETESPAAANPAANKFSIHFDRSTQLALLPIFLSNFIGIVCARSLHYQFYVWYFHSLPYLTWYTEYTNSLKFLLLLLLEFCWNTYPSTVLSSVVLHACHVCLLVGIGRKLFRRIPDLAQLNNKTE

SEQ ID NO: 5009 - DNA, 1446 bp, Mus musculus
  CDS (7)..(1323)
gtcaagatggctgctgggctgcggaaacgcggccagccggcttctgtcggccagccggcaggaatctggaaacaatggctacagcgtgcctggcaagaacgctacctactgctgcgggaaccgcgctacacattgctggtggcctcctgcctctgcatagcagaggtgggcatcaccttctgggtcattcacagggtggcatacacagagattgactggaaggcctacatggcccaggtggagggtttcatcaatggcacatatgactacacacagctgcagggtgacaccggacctcttgtctacccagctgggtttttgtacatctttacggggctattctatgctactgaccggggcactgatatccctatggcccagaacatctttgctgtactctaccttgtcaccttggtgcttgttttcttgatataccaccagacctccaaggtacctcccttcgtctttttcttcatgtgttgtgcctcttaccgtgtccattccatctttgtactgcggctcttcaatgacccagtagctatggccttgctcttcctgagcatcaaccttttcctggcacagtgctggagctggggctgctgctgtttcagcctggctgtctcggtgaagatgaatgtgctgctcttcgccccgggattgctattccttcttcttactcagtttggcttccgtggtgccctccccaagctggccatctgtgctgctcttcaggtggtgctgggattgcccttcctgctggagaaccccattggctacctatcccgctcctttgaccttggtcgtcagtttcttttccaatggacagtaaactggcgcttcctgcctgaaaccatcttcctgcatcgtgccttccatctagccctgttggctgcccaccttagcctcctcttgctgtttgccctctgtaggtggcacagaacaggggaaagtattctggcactgctgaaggatccttccaaaaggaaagttccaccccaagccctcacacctaaccagattgtttccatcctcttcacctccaacttcattggcatctgctttagccactcgctccactaccagttttatgtctggtatttccacacactgccctacctcctgtgggccatgcctgcacgctggctcacacacctgctcaggttgctggtgctgggactcattgagctctcctggaatacgtacccatccacgtccttcagctctgccgccctccacctgtgccacgctgtcgtcctgctgcagctctggctgtcccccgagtccttccctaagagcattcagccaagcaggaaaactcactgaaacccaccccttccttctaggacgtgctcagcatcatgggtggaacggactctgtgttcttagaataaaccttgccaagtccaaaaaaaaaaaaaaaaaaaaaaaaaaaaaaaaaaaaaaaaa

SEQ ID NO: 5010 - protein, 438 aa, Mus musculus
MAAGLRKRGQPASVGQPAGIWKQWLQRAWQERYLLLREPRYTLLVASCLCIAEVGITFWVIHRVAYTEIDWKAYMAQVEGFINGTYDYTQLQGDTGPLVYPAGFLYIFTGLFYATDRGTDIPMAQNIFAVLYLVTLVLVFLIYHQTSKVPPFVFFFMCCASYRVHSIFVLRLFNDPVAMALLFLSINLFLAQCWSWGCCCFSLAVSVKMNVLLFAPGLLFLLLTQFGFRGALPKLAICAALQVVLGLPFLLENPIGYLSRSFDLGRQFLFQWTVNWRFLPETIFLHRAFHLALLAAHLSLLLLFALCRWHRTGESILALLKDPSKRKVPPQALTPNQIVSILFTSNFIGICFSHSLHYQFYVWYFHTLPYLLWAMPARWLTHLLRLLVLGLIELSWNTYPSTSFSSAALHLCHAVVLLQLWLSPESFPKSIQPSRKTH

SEQ ID NO: 5011 - DNA, 1164 bp, Oryza sativa
  CDS (1)..(1164)
atggctggacaaatgtcatctgtggctagaattgctatatttttggacaaaagagtagtagactataatttaactaacttatatggaggacaaaaaatttggaaaataaaactcatcgcacgcagaacagacaacgacggcgttggcgcgagaaccacgaggcgccgagctgggcctgcatccggatgggccttcgggccggaggcccatgaggttctcgggttgggccggatgagctcctcctcctcgtcgtcgtcgtcttcgtctcgagttcttggttggttggatctacctcgagctgcccggagcttggctgtggaggcggccatggcgcgggtgggcaagcacggcgagtcgtcgccgccgtccgaccgtaggccgctccacttcgcggcgttcctgctgctcgccgacgcggcgctcgtcgccctcatcgtcgtcttcgtcccgtataccaagatcgactgggacgcgtacatggctcagaaggtggacgcgtttgtggaaggggagagggattacaccaagatcgagggcgacacggggccgctcgtctacccggccggcttcctctacgtttactccgccatcaagcttctcaccgccggccaagtcttccccgcgcagagggttcactccatctttgtgctccgccttttcaacgattgtttcgctatgacgtttctccatgctgccatggttttgattatgtatcacaagtggtaccttggtctagtaattttcaggtctgtaaattttaaatttgtccctgagaagttctttgtatcaaaagagctagctgttgcattgttggttcttcacctcactactcttttggtctttgcacactacaagtggcttaaattcaaagatgccacatcaattggacagttaatttttgccaagcccaaactgtcaactcttaacaaagaacatattgtaacggtcatgtttgttggaaatttcattggcatcgtgtgcgcacgatcattacactaccaattttattcctgggtcattttatttcttgctgtggagctctgctggaatatctatccttccactgcctattcgtcactgctgttgctattcattcacatctccatcttgtttggcttatggagctcacctgcagagtacccctatgccaatggaaagaaatga

SEQ ID NO: 5012 - protein, 387 aa, Oryza sativa
MAGQMSSVARIAIFLDKRVVDYNLTNLYGGQKIWKIKLIARRTDNDGVGARTTRRRAGPASGWAFGPEAHEVLGLGRMSSSSSSSSSSSRVLGWLDLPRAARSLAVEAAMARVGKHGESSPPSDRRPLHFAAFLLLADAALVALIVVFVPYTKIDWDAYMAQKVDAFVEGERDYTKIEGDTGPLVYPAGFLYVYSAIKLLTAGQVFPAQRVHSIFVLRLFNDCFAMTFLHAAMVLIMYHKWYLGLVIFRSVNFKFVPEKFFVSKELAVALLVLHLTTLLVFAHYKWLKFKDATSIGQLIFAKPKLSTLNKEHIVTVMFVGNFIGIVCARSLHYQFYSWVILFLAVELCWNIYPSTAYSSLLLLFIHISILFGLWSSPAEYPYANGKK

SEQ ID NO: 5013 - DNA, 1329 bp, Neurospora crassa
  CDS (1)..(1329)
atggccgctccgtcaagtaggccagaatcaaacccgcccctctacaagcaagcccttgatttcgccctagatgtcgccaacggtcgccatgctctgtcgaagctcatcccgcccgccctcttcctggtcgatgcgctcctctgcggcctgatcatctggaaagtgccttacaccgaaatcgactgggcggcctatatggagcaagtctcccaaatcctctcgggcgagcgcgactacaccaaggtccgcggcggcaccggtccgctcgtttacccggctgcgcacgtctacatctacaccggactataccacttgacggatgaggggaggaacatcttgcttgcgcaacagctgtttgcgggtctttatatggttacgttggcggttgttatggggtgttactggcaggccaaggcaccaccatatctattcccgctcctgactctctcgaaacggctacacagcatcttcgtcctgcgctgcttcaacgactgcttcgccgtcctgttcctctggcttgccatcttcttctttcagcggcgcaactggcaagccggcgcattactctacaccctcggcctcggcgtcaaaatgacgctactactctccttaccagccgtaggcattgtcctcttcctcggcagtggcagttttgtcaccactctgcagctcgtagcaacaatgggtctggtccagatcctcatcggcgtccccttcctggcacactaccccacggaatacctctcccgggccttcgagctctcccggcaattcttctttaaatggaccgtcaactggcgcttcgtcggcgaggaaatatttctcagcaaggggttcgcgctcacactgctcgctttgcacgttctcgttttgggaatcttcatcaccacccgttggatcaaacctgcgcgcaagtctcttgttcagctaatctctcctgtcctcttggcgggcaaaccgcctctgactgtccccgagcaccgcgctgcggcgcgggatgtgacgccgaggtacatcatgaccacgatcctgtctgccaatgctgtgggcctcctctttgctaggtccctccactaccagttctatgcctatgtcgcatggtcgactccattcctcctctggcgcgcggggttgcaccctgtcttggtgtacctgctatgggcggtgcatgagtgggcgtggaacgtgttccccagcacgccggcgagctcggcggtggtggtgggcgtattaggcgttacggtcgcaggagtgtggtttggcgcacgggaggagtgggagcccgggatgaagtcgtcatcgaagaaggaggaggcggcgatgcggtga

SEQ ID NO: 5014 - protein, 442 aa, Neurospora crassa
MAAPSSRPESNPPLYKQALDFALDVANGRHALSKLIPPALFLVDALLCGLIIWKVPYTEIDWAAYMEQVSQILSGERDYTKVRGGTGPLVYPAAHVYIYTGLYHLTDEGRNILLAQQLFAGLYMVTLAVVMGCYWQAKAPPYLFPLLTLSKRLHSIFVLRCFNDCFAVLFLWLAIFFFQRRNWQAGALLYTLGLGVKMTLLLSLPAVGIVLFLGSGSFVTTLQLVATMGLVQILIGVPFLAHYPTEYLSRAFELSRQFFFKWTVNWRFVGEEIFLSKGFALTLLALHVLVLGIFITTRWIKPARKSLVQLISPVLLAGKPPLTVPEHRAAARDVTPRYIMTTILSANAVGLLFARSLHYQFYAYVAWSTPFLLWRAGLHPVLVYLLWAVHEWAWNVFPSTPASSAVVVGVLGVTVAGVWFGAREEWEPGMKSSSKKEEAAMR

SEQ ID NO: 5015 - DNA, 1923 bp, Caenorhabditis elegans
  CDS (1)..(1923)
atgcgagagttaatctctcggctagtggttggcctattttcggtcaatgatacgggatttagagcagttgcggcgctgctgatgattgccgaagccgttttatcacatttagtcattttaaaagttaattacaccgaaatcgactggagcacgtatatgcaacaagtcgagtgctacgtgaacaaggggatcctcaactacacgcaaatcggcggtgacacgggtccctgcgtctacccggccggccatctcttcgtcttccgcttgctccactttttcacgagctccggccgcaatatccgcgcggctcagcacattttccaaggattctacatgtttaatctatttatggtctttcgaatccttcacaagactatgcggatcccgccgatcgtgctgcttctcgtgtcgatcaccggctatcggatacactcgattttcgtgttgcggctcttcaacgatcctctagctatgatgctcttctacgtggcaatggatcggtttttggagcaaaaatggcttgtcggatgtgttttttatagcctggcagtatcgattaaaatgaacgtgttgcttttcgcgccggcgctgttcttcacacttttgctcaacaatagttatatggcgacgttgggatatttgacagtttgcgggctaatccaactgtacgtcggtggcccattcctcctctacgactggaaatcgtatctgcaacaatccttcgatttgggccgagttttcatgttcaaatggactgtcaactggcgattcttgcccgaagaggtacccccccccgctgggtttttcctcgacaagcgattccacgcggcacttttggttgggcatttgacgtttttggcggttttcgcgtcgtacatgtggtttagacgcctaaacggtctccgcacctcggtctacctacgtcttttcgaaggcatcaccaccaccacaggcgccgtcgagacctactacgccttctgtacctcaaatctgatcggaatcgccttctcccgatcccttcactaccagttctacagttggtacttccatcagataccgttccttctcttctgcgactatccccacgtggcaagtgtctccacgattccgtggcgtcaatttctgtggaaagtaccgttgctcgccgccgtcgagctcagctggaacgtctatccatcgacgtggtggagttctgcgttgctccacgtttgccacgtcatcattttctggcatctaatcgtgacgagacccgcgcgacctggcgattcagtgtccagggagacgctccgaaggcttgagcagcggcagaaaatgcttgagcaagagctccgagagcatggacaagttgtgccgaaattcaaatttccagcgtttttggaagagcagcaggaagagcaagtggatgttcggaagaggatgaagcagccgattggggagaagaggacgaaaaagcagttggatgcggaatttgagacgtatttcgaggagcagatggacggatttcgggaggagcacacgatttattacacccacgatggaaaaccgcaagtttctgggcttgcaccactggataagccggaaaaaatgaagatgcacgagaaagttgcagcattatatacgcaggcgctgaagctacaagctcaattaaatcccaatgaaactccaacaacatggaaatcattcaaatttcccaaaaatgccgacaaaaacctgctggaaagctatctgaagcttcacggagcaggagcacaacaagactctgaagaatctgaaatttcctcagccgaagaagaagcttcagacgacgagaatagcggtgaggaagagcccaatacggagaaaattgagcaaaattcgtgtaaagctgaagcctcggagcaagagagcaatggaggtgtgaggcggcgaattttggtcgattaa

SEQ ID NO: 5016 - protein, 640 aa, Caenorhabditis elegans
MRELISRLVVGLFSVNDTGFRAVAALLMIAEAVLSHLVILKVNYTEIDWSTYMQQVECYVNKGILNYTQIGGDTGPCVYPAGHLFVFRLLHFFTSSGRNIRAAQHIFQGFYMFNLFMVFRILHKTMRIPPIVLLLVSITGYRIHSIFVLRLFNDPLAMMLFYVAMDRFLEQKWLVGCVFYSLAVSIKMNVLLFAPALFFTLLLNNSYMATLGYLTVCGLIQLYVGGPFLLYDWKSYLQQSFDLGRVFMFKWTVNWRFLPEEVPPPAGFFLDKRFHAALLVGHLTFLAVFASYMWFRRLNGLRTSVYLRLFEGITTTTGAVETYYAFCTSNLIGIAFSRSLHYQFYSWYFHQIPFLLFCDYPHVASVSTIPWRQFLWKVPLLAAVELSWNVYPSTWWSSALLHVCHVIIFWHLIVTRPARPGDSVSRETLRRLEQRQKMLEQELREHGQVVPKFKFPAFLEEQQEEQVDVRKRMKQPIGEKRTKKQLDAEFETYFEEQMDGFREEHTIYYTHDGKPQVSGLAPLDKPEKMKMHEKVAALYTQALKLQAQLNPNETPTTWKSFKFPKNADKNLLESYLKLHGAGAQQDSEESEISSAEEEASDDENSGEEEPNTEKIEQNSCKAEASEQESNGGVRRRILVD

SEQ ID NO: 5017 - DNA, 1507 bp, Homo sapiens
  CDS (7)..(1323)
gttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5018 - protein, 438 aa, Homo sapiens
MAAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 5019 - DNA, 1455 bp, Drosophila melanogaster
  CDS (1)..(1455)
atggcgccgccaaaggccgccagccaccgtccggcggtgcggcgcaagaagtcgggcaccctggtggactccatcctggacaagtacctcaacgtgcgcttcttcaagtatctgctcctggagccggccgctctgcccatagttggcctcttcgtgctcctggcggagctggtcatcaacgtggtagtcatccagcgggtgccctacacagagatcgactgggtggcttacatgcaggagtgcgaaggcttcctgaacggcaccaccaactacagtctgttgcgcggcgacacaggacctcttgtgtatccagccgccttcgtgtacatctactcggctctctactacgtcacgtcccacggaacgaacgttcgcctggcgcagtacatcttcgccgggatctacctgctccagctggccctggtgctgaggctgtactcgaagagcagaaaggtgccgccgtatgtgctagtgctcagtgccttcacgtcgtatcggatccactcgatatacgtgctgcgactgttcaacgatcccgtggcagtgctgctcctctatgccgcactcaatttgttcctggacaggaggtggactctgggtagcaccttcttcagcttggcggtgggcgttaagatgaacatcctgctgtttgcgcctgcgctcttgctgttctatttggccaacctgggacttctgcggacgatcctgcagctggctgtctgcggagtgatacaactgctgctgggcgctcctttcctgctcacccatcctgtggagtatctgcggggcagctttgatttgggacgcatcttcgagcacaagtggacggtcaactatcggtttctgagcagagatgtgttcgagaaccgcaccttccacgtttcgcttttgggcctgcatctgctgctcctgctggccttcgccaagcccacttggacctttttccagagctacgtgcgcctgcgccgcattgaggatcagctgcagccgcaaatagcccagcagaacctcgagctgaaggcgcagaaaagaccaaagaaggtggaaaaggacaaggacaaggaccagaagaagtttacaaccgagcagcaatccttcctgaaggccttcgaaaagagcctgcagaaggcgtccggcggcaaggccactccggcgcccgcacaggcggaaccggaacgctatggcatccacttcgatcgctgcacccagctggccctgctgccgttcttcctgtgcaacctggtgggcgtggcctgctcccgatccttgcactatcagttctacgtctggtacttccactcgctaccctatttggcctggtcgacgccgtactcgttgggcgtgcgctgcctgatcctcggactgattgagtactgctggaacacctatcccagtacgaacttctccagcgctgcccttcacttcacccacatcataccgccatatcagttgtaa

SEQ ID NO: 5020 - protein, 484 aa, Drosophila melanogaster
MAPPKAASHRPAVRRKKSGTLVDSILDKYLNVRFFKYLLLEPAALPIVGLFVLLAELVINVVVIQRVPYTEIDWVAYMQECEGFLNGTTNYSLLRGDTGPLVYPAAFVYIYSALYYVTSHGTNVRLAQYIFAGIYLLQLALVLRLYSKSRKVPPYVLVLSAFTSYRIHSIYVLRLFNDPVAVLLLYAALNLFLDRRWTLGSTFFSLAVGVKMNILLFAPALLLFYLANLGLLRTILQLAVCGVIQLLLGAPFLLTHPVEYLRGSFDLGRIFEHKWTVNYRFLSRDVFENRTFHVSLLGLHLLLLLAFAKPTWTFFQSYVRLRRIEDQLQPQIAQQNLELKAQKRPKKVEKDKDKDQKKFTTEQQSFLKAFEKSLQKASGGKATPAPAQAEPERYGIHFDRCTQLALLPFFLCNLVGVACSRSLHYQFYVWYFHSLPYLAWSTPYSLGVRCLILGLIEYCWNTYPSTNFSSAALHFTHIIPPYQL

SEQ ID NO: 5021 - DNA, 1581 bp, Drosophila virilis
  CDS (1)..(1581)
atggcaccgccaagaaccaacaaccggcctgtgacccgacgcaaaaagcccagcaacctgttgcttttgcttaaagagaaatatgtcaattggaactttattaaatacctggcattcgagccggctgcgctgcccattgtttcggtgctgattgttttggccgaggcagttatcaacgtgcttgtcattcaacgtgtgccctacacggagattgattggaaggcctacatgcaggaatgtgaaggctttctgaatggcacaaccaattattcgctgctacgaggtgacaccggtccgttggtatacccggctgcatttgtttacatttactcgggactgtactatttaaccggccagggtacgaatgtgcgtctggcacaatacatattcgcctgcatctacttgctccaaatgtgcctcgtattgcgcctttatacgaagagccgcaaggtgccgccctatgtgctggtgcttagcgccttcacatcctaccgcatccactcgatctatgtgctccgactgttcaatgatcctgtggccattctactactatatgccgcgctaaatctgttcctggatcagcgttggacgctgggaagtatttgctatagccttgctgttggtgtcaagatgaacattttactgtttgctcccgcgttgttgctgttctatttggctaatctgggcgtgctcaggactctggtacagctcaccatttgcgcagtgctacagctgtttattggcgcgccctttctgcgtacccatcctatggaatatctgcgcggcagcttcgacctgggtcgcatctttgagcataagtggactgtcaactatagattcctgagcaaggaactcttcgagcagcgtgagttccacttggtcctgctggcgctgcatctgctgctgctcttatgctttgcaaagcctacctggacgttcttcagaagctacctgagactacgcgaggtgcagcaacagatagtgccacaaatactacacaaaaatcgcgagcagcagaaccaagcaaagattcaggcgaagaagtccaagcaattggtagagcagcagcaggaggaggaggacgagcaactgagtgccgagcaaaaatccttcctcaaggcattcgagaggagtctgcagcaaagcacgggtcagaaatctttagagccacatttgaaccaaaagcaagaacaatacgacatttattttgagccatgcacacagctggcgctgctacccttcttcctgtgcaacttcatcggtgtcgcctgcgcccggtcgctgcattatcagttctacatttggtacttccactctctcccgtatttggtatggtccacgccgtattcgcttggcgtgcgctatttaattctgggaattatcgagtactgctggaacacctatcccagcacaatggagtccagcatagcccttcacttgtgtcatctaattctgcttgtgggtgtggcacgccacgtttaccgcatcctgaggctcaacgctacggtaaagcaacagcagcggcaggaacaatctactttacaaaatggtcaaccaaagacgtccaaaaaatcgcaatga

SEQ ID NO: 5022 - protein, 526 aa, Drosophila virilis
MAPPRTNNRPVTRRKKPSNLLLLLKEKYVNWNFIKYLAFEPAALPIVSVLIVLAEAVINVLVIQRVPYTEIDWKAYMQECEGFLNGTTNYSLLRGDTGPLVYPAAFVYIYSGLYYLTGQGTNVRLAQYIFACIYLLQMCLVLRLYTKSRKVPPYVLVLSAFTSYRIHSIYVLRLFNDPVAILLLYAALNLFLDQRWTLGSICYSLAVGVKMNILLFAPALLLFYLANLGVLRTLVQLTICAVLQLFIGAPFLRTHPMEYLRGSFDLGRIFEHKWTVNYRFLSKELFEQREFHLVLLALHLLLLLCFAKPTWTFFRSYLRLREVQQQIVPQILHKNREQQNQAKIQAKKSKQLVEQQQEEEDEQLSAEQKSFLKAFERSLQQSTGQKSLEPHLNQKQEQYDIYFEPCTQLALLPFFLCNFIGVACARSLHYQFYIWYFHSLPYLVWSTPYSLGVRYLILGIIEYCWNTYPSTMESSIALHLCHLILLVGVARHVYRILRLNATVKQQQRQEQSTLQNGQPKTSKKSQ

SEQ ID NO: 5023 - DNA, 23 bp, artificial sequence
  primer
atggaaggtgaacagtctccgca

SEQ ID NO: 5024 - DNA, 25 bp, artificial sequence
  primer
tcagttgagctttttttccatagag

SEQ ID NO: 5025 - DNA, 1008 bp, Saccharomyces cerevisiae
  CDS (1)..(1008)
atgttgaggttatctttactgagatcaacagctactttgccagtgaaatgccaacgtcgtgggctaatattacctgcggcggcaatgtacaccttaggctcattaatatttggtaaggaagcaaggttggcggatgccatggaacgtggtgagttacataacaagaacgttgattatgcgaaagaagctgaagagcgtaccgagttacgtattagggccctggctaatactcggccaatggaacctcggtacaacggccatgttccccttcatcggtacgagaaattgctgctgtttgcaatttccggttggaattcatttttccatcctgaagatggttataatattgtacaattgggtgaggcaactgcattgccggtcttcttggagaatttgaagcaaacaatgttaagtgattcctctgggaggcgcattttgaaggaacaacccaatatcacaacagagattttgcatatggacaaactagctaaattgccacataacacgtttgggtatgtatattaccaatggttgaaaagagaaaacgtttctccggacactagagcacctgtcaaatttatcgacgatcctatgcatgcatatatctttaagaggtatagacaatgccacgatttctatcacgctataaccaacatgcctattatcattgagggggagatcaccataaaggctcttgaaggtgccaacctgggcgtcccaatggccattctcggtggtatccttgcacctttacgtttgaaaaaggtgcaaagaaaaagattatataatatatatctcccttgggctgtcagaacaggtttaagctgcaagccattgatcaacgtgtattgggaggaaatgctggagaaggatgttactgctttgaggaaagagctaaagataacactccctccggatctaaggacaatgaggaaggagcgtgcagcccttaggaaggagattgacgcaaaatacaactcacagaaacgagccacgactccagcatga

SEQ ID NO: 5026 - protein, 335 aa, Saccharomyces cerevisiae
MLRLSLLRSTATLPVKCQRRGLILPAAAMYTLGSLIFGKEARLADAMERGELHNKNVDYAKEAEERTELRIRALANTRPMEPRYNGHVPLHRYEKLLLFAISGWNSFFHPEDGYNIVQLGEATALPVFLENLKQTMLSDSSGRRILKEQPNITTEILHMDKLAKLPHNTFGYVYYQWLKRENVSPDTRAPVKFIDDPMHAYIFKRYRQCHDFYHAITNMPIIIEGEITIKALEGANLGVPMAILGGILAPLRLKKVQRKRLYNIYLPWAVRTGLSCKPLINVYWEEMLEKDVTALRKELKITLPPDLRTMRKERAALRKEIDAKYNSQKRATTPA

SEQ ID NO: 5027 - DNA, 699 bp, Nostoc sp. PCC 7120
  CDS (1)..(699)
atgcaaacgataaatactcacccagttcagccgttaaaacttgactcggaagtgcaacggcagatgaatttccagtttttgacggcgatgaaagcttttttcacgttactaacaacagaagacaacatagatgcggtggatgaacttagtagcatcttaattcacagccgggcctttgaattggcggcggaaagtatgcagactgatcctgaggtagcgcatttgatcaaagagcgatattatgcgccagtccacgacgtagagcagctattgcaatatccggctgattctttgggttatctctatgcctcgactctcaaagaatctggctttgaacgcatagatcctgaaattattgtcaattcagatacagcttacattgagcatcgctggcagcaaacccatgatatttggcatcttgttacgggattcagcgccagtggtattgacgaaataggattacaagccttttatctagcacaatttcgtctacccttagccagtatgctaattgccaatgccttgatgagtgccactttactcgctccagaagacttaccgcaacttctccagactattgaacgaggttggacaatgggtttgcaagccaaaccgttattcgcacaaaagtgggaagaagcttgggaaaaacctttatcccagtggcgggatgaattaaatattcaagcttttagttag

SEQ ID NO: 5028 - protein, 232 aa, Nostoc sp. PCC 7120
MQTINTHPVQPLKLDSEVQRQMNFQFLTAMKAFFTLLTTEDNIDAVDELSSILIHSRAFELAAESMQTDPEVAHLIKERYYAPVHDVEQLLQYPADSLGYLYASTLKESGFERIDPEIIVNSDTAYIEHRWQQTHDIWHLVTGFSASGIDEIGLQAFYLAQFRLPLASMLIANALMSATLLAPEDLPQLLQTIERGWTMGLQAKPLFAQKWEEAWEKPLSQWRDELNIQAFS

SEQ ID NO: 5029 - DNA, 663 bp, Nostoc sp. PCC 7120
  CDS (1)..(663)
atgcaatctccagagaaaatagatccaacatgggaagatagcgtcattgatagctttattagctttgtcagatcatacgatggcgatttcacctgcatttacaaactggctgataccgtaagtgatgagtacagtttgcaaaagataattgactttctctctagcacccctcagggaaaacaagctttccaaaaacgtccacaattaggtgtggtggatttaccaaaactccatcaattgccaactgacactttgggatatgtctatgctgaccagatgctgcaaaataatttgcagcctttacagtcccacgaaatagacaatgattatcaatttttcaaaacgcatattaccgagacacacgacctctggcatatagttactggagccgataccagcattttgggagaaatccaattagaagctttttatgtgtcgcaattgtacgctagtcgtttttggttggcattactagcaaaaaacttgctcaaagccgtaatttacgatatagagctttccacgccatacatggatgcgatctccacaggctgggtaatggcaaagcaagccaagcctttgtttggtctggaatggaatctattgtgggaaaagcctctagcagatgtgcgtacttctttaaatattattctccctgtaaattaa

SEQ ID NO: 5030 - protein, 220 aa, Nostoc sp. PCC 7120
MQSPEKIDPTWEDSVIDSFISFVRSYDGDFTCIYKLADTVSDEYSLQKIIDFLSSTPQGKQAFQKRPQLGVVDLPKLHQLPTDTLGYVYADQMLQNNLQPLQSHEIDNDYQFFKTHITETHDLWHIVTGADTSILGEIQLEAFYVSQLYASRFWLALLAKNLLKAVIYDIELSTPYMDAISTGWVMAKQAKPLFGLEWNLLWEKPLADVRTSLNIILPVN

SEQ ID NO: 5031 - DNA, 681 bp, Arabidopsis thaliana (mouse-ear cress)
  CDS (1)..(681)
atgattattgaaagagctcgagttccgttgagccgatggcaacaagcggccgtggcgatgggatctgctctcggtgcgttggttgatcctcgtagagcggatctaatcgctgctctcggcgaaactaccggtaaaccagcttttgaaatggttcttgagagaatgaagaagagcgaagaaggaagagctatattattggagcgtcctcgagttgtgtcagagcaagtaggtcatgcttgggatctaccagaaaacacatttggagctgcatatgctaaattcatgggatctagaaacttctctcccgatgatcgtccgcccgtaagattcatggagacggatgaattggcttacgtagcgacacgggcacgcgaagttcacgacttatggcacactctgtttggccttcctacgaatcttatcggcgagtcgtctttgaaagttatcgagtttgagcaaatgtatcttccgatgtgtatgctctctgtgattggaggtactgtgaggttcaacgagaagcaaagatcaatgttcttgaagcattaccttccttgggctgttcgtgctggaagacaatgcactgacctcatgtgtgtgtactatgagcgtcactttagtgaagacttggagcaagttcgtagaaaatggggaatcatccctgctcctcaacatcctaaatag

SEQ ID NO: 5032 - protein, 226 aa, Arabidopsis thaliana (mouse-ear cress)
MIIERARVPLSRWQQAAVAMGSALGALVDPRRADLIAALGETTGKPAFEMVLERMKKSEEGRAILLERPRVVSEQVGHAWDLPENTFGAAYAKFMGSRNFSPDDRPPVRFMETDELAYVATRAREVHDLWHTLFGLPTNLIGESSLKVIEFEQMYLPMCMLSVIGGTVRFNEKQRSMFLKHYLPWAVRAGRQCTDLMCVYYERHFSEDLEQVRRKWGIIPAPQHPK

SEQ ID NO: 5033 - DNA, 792 bp, Caenorhabditis elegans
  CDS (1)..(792)
atgtctgctcaaaagctatacgcatcgcatgttcccttggcaccgctgtctcggatgcttctcgggattggatcagcagtaacagcgatctcggatccaaaaagaggagatatggtggcagcgatgggcgaaactactgcaattggaccagttttagaaaatattcgaaaaagaatggaatctgatgttgttggaaagcgacttcttctcgaaaaaccaagaatttcaaatggaacaattgatagaaagtggctaagacagttaccggatggaacattaggaaaattgtattcaaactttctcgatcgtttgaacacatctccagatgctcggcccactgtcaagtatatcgataatttggagcatctttatgttatgcaaaggtatcgcgaaacacacgacttcacccacatcgcattggagcagaaaacgaacatgctcggcgaggtaacagtcaaatatttcgaaggaattcaatatgggcttccaatgtgtgtcactggtggaatatttggaggtgccaggcttttaacaaaaaatcgccaagaacttgtcgaccggaacctcccttgggttgtggagcaggccacgaatgcacgattcttcatggctttcgactgggaaaatcactttgaaaagcagctcagcgaggtgcagaaggagctaaatataacgccattatctgagcttctggacctcccggaaatggaaccggatgtccctgatattctcttcagtaaaggacatccgggattttggagagtcctccaggcggttgatatgatgatttaa

SEQ ID NO: 5034 - protein, 263 aa, Caenorhabditis elegans
MSAQKLYASHVPLAPLSRMLLGIGSAVTAISDPKRGDMVAAMGETTAIGPVLENIRKRMESDVVGKRLLLEKPRISNGTIDRKWLRQLPDGTLGKLYSNFLDRLNTSPDARPTVKYIDNLEHLYVMQRYRETHDFTHIALEQKTNMLGEVTVKYFEGIQYGLPMCVTGGIFGGARLLTKNRQELVDRNLPWVVEQATNARFFMAFDWENHFEKQLSEVQKELNITPLSELLDLPEMEPDVPDILFSKGHPGFWRVLQAVDMMI

SEQ ID NO: 5035 - DNA, 819 bp, Schizosaccharomyces pombe
  CDS (1)..(819)
atgttttatcttaatgctcatcttgaaattaataaggtcgtagacgttgtaatgtcactttcaaagaagtttttaaagccttcagttgcttccaaccaacttcgtttgctttttacagcagctgagaggaaggttaattatccaggacatgttcctttatcaccgctgcaacgtatttttttggttgcaggatcagcaatcatgggattgaaggcaccatggagaggcggagatatgatatctgtcctaggagatgcatctggtcaaccattcttccttcatcgattactgaataaaatgctcgttgataaaacaggtcgtgaaattttgaaagataaacctagaatgacatcgaagtctttaaacttaccatttttgcggacccttccgccaaataccctaggtaaaatttatgttgactggatagacaaagagcatgttggacccgatactcgaagccctacccgttttgtagatgacccagaggaggcatatgttatgcaaagatatcgtgaatctcacgatttttaccatgctatatgtaacatgcctacaaacattgaaggagaattagctattaaatggctggaatttgttaacatgggtttaccagttggagctctctctgctttatttggtcctctacgcttaaattgtgaacaggcttcaaggtttcgtcgggtatacattccatggtcgattcgtaatggtttgaatgcaaaaacattgatcaatgtctattgggaaaaggaactgacgaacgacattgaggacgtccgtagacgaatacgaattgaggctgctcctccgctggtttag

SEQ ID NO: 5036 - protein, 272 aa, Schizosaccharomyces pombe
MFYLNAHLEINKVVDVVMSLSKKFLKPSVASNQLRLLFTAAERKVNYPGHVPLSPLQRIFLVAGSAIMGLKAPWRGGDMISVLGDASGQPFFLHRLLNKMLVDKTGREILKDKPRMTSKSLNLPFLRTLPPNTLGKIYVDWIDKEHVGPDTRSPTRFVDDPEEAYVMQRYRESHDFYHAICNMPTNIEGELAIKWLEFVNMGLPVGALSALFGPLRLNCEQASRFRRVYIPWSIRNGLNAKTLINVYWEKELTNDIEDVRRRIRIEAAPPLV

SEQ ID NO: 5037 - DNA, 972 bp, Debaryomyces hansenii CBS767
  CDS (1)..(972)
atgcatatattgcaagcatgtaaagggatggagcatcgctctatttcatcgcttattgtaaaccaaaaaagacaatttttacttacagcaacagctactctagtggggtcaatgataatgaacgaaaataatcgtttagcaaataagatggagaagggacaattacattacaaagatgccaatgccatatttaacaaggcattagaagctcaggaaagtaaatacttttcaagaagtaaactgaattatcccgggcatgtaccattatttaccttcgaaaaattattgatgattgctggctcctcgcttggtgcatatttacatcctgaaagaaatgaatttatagtcgctctaggtgaatctacggcaataacacccgttttaaccaagttacaaacgcaaatgttgtcagacccagttggccgacaaatattaagagaaagaccgagaatcacatccacgtcattagatctagataagctcagagagctaccagataatacaattggtaagacgtatgtcaattggttggatagggaaggtgttagtcctgatacaagagttcctgtaaaatatatcgatgacgaagaattagcatacatttatcaaagatacagagaatgtcatgatttttaccattctataacaggattaccgataataatagaaggggagattgcagttaaaatattagaatttatgaatattggaatccctatgtctggattaggggctttgtttgctcctttgagattaaaacctagtcaaaaagaacgcttgtataatatttattatccttggggattcaagagtggtcttaattcaaaacctttgattaatgtgtactgggaaaatattttagaggaagatataaacgagtttagacataaaatgggaattgaacaacctccagacttgagaaatttaaggaaaaagtacttcgaagaattaaaaaagaaaaagaaggtctaa

SEQ ID NO: 5038 - protein, 323 aa, Debaryomyces hansenii CBS767
MHILQACKGMEHRSISSLIVNQKRQFLLTATATLVGSMIMNENNRLANKMEKGQLHYKDANAIFNKALEAQESKYFSRSKLNYPGHVPLFTFEKLLMIAGSSLGAYLHPERNEFIVALGESTAITPVLTKLQTQMLSDPVGRQILRERPRITSTSLDLDKLRELPDNTIGKTYVNWLDREGVSPDTRVPVKYIDDEELAYIYQRYRECHDFYHSITGLPIIIEGEIAVKILEFMNIGIPMSGLGALFAPLRLKPSQKERLYNIYYPWGFKSGLNSKPLINVYWENILEEDINEFRHKMGIEQPPDLRNLRKKYFEELKKKKKV

SEQ ID NO: 5039 - DNA, 789 bp, Yarrowia lipolytica CLIB99
  CDS (1)..(789)
atgttccgaacggtgcccaaaaccacactattggcgccaattcagcgccgaacgctcttaaacggcaactaccccaaggcataccccgaacacgtgcctctcacgtgtctgggacgagccgtgcttgctgtaggcagtgggttcggcacctttttcgactctcgacgaggcgatctggttgccactcttggagaagcaaccgcccagccttacttcatctacaagctgcgagagcagatgctcaaagacccgaccggtcgacgtctgctgcgcgaacagccccgaatgaccagcaagagtctggatctcgacaaactgcgaaacatgaaggtcggaagcattggacgaacatacgtggagtggctggacaaggagggggtctcacctgatacccgagctcaggtgcgatacattgacgatcccgagtgcgcttatgtcatgcagcgataccgtgagtcccatgacttctaccatgccctgacgggtttgcctatcatcatggagggtgagctggctctcaaggcgttcgaatgggccaatacaggtctgcccatgagtggtctgggcatggtcctcactcctcttaagttcaagcccaagcagcgcaagcggtactttgacgtctaccttccctgggctctctacaatggcttccgatccaaacctgtcattaatgtgtattgggaagaggttctggagaaggacgccgaggagctgagacgagatcttggaatcgaacagcctccggatctccgacagatgaagaaggatatggccaagaagaagtga

SEQ ID NO: 5040 - protein, 262 aa, Yarrowia lipolytica CLIB99
MFRTVPKTTLLAPIQRRTLLNGNYPKAYPEHVPLTCLGRAVLAVGSGFGTFFDSRRGDLVATLGEATAQPYFIYKLREQMLKDPTGRRLLREQPRMTSKSLDLDKLRNMKVGSIGRTYVEWLDKEGVSPDTRAQVRYIDDPECAYVMQRYRESHDFYHALTGLPIIMEGELALKAFEWANTGLPMSGLGMVLTPLKFKPKQRKRYFDVYLPWALYNGFRSKPVINVYWEEVLEKDAEELRRDLGIEQPPDLRQMKKDMAKKK

SEQ ID NO: 5041 - DNA, 999 bp, Kluyveromyces lactis NRRL Y
  CDS (1)..(999)
atgtttactgtaagtaagaaatccttacaagcaagtcgtaacgctttcagtccattgaataatagcaagagaacaatcgtatttactgcaatagcagcttttggagacctattgattgggaaagatgttagactagcagatgctatggagaaagggaatctgcataataaaaatggagagtatgagcataagatggaacaaaggactcaagaaaggttaaatgcattacgaaacacaagaccgatagaacctaattatgagggtcatgttccactttggtggtatgagcgaatgatgctcttcggtatcagtggtttaaaatcttatttccacccggagaacggtgagaacatcgttcaattaggagaagctactgctctaccttgctttcttgaaagtttaaaacggacaatgttgttagataagactggtagaaggattctacaagacagaccaaacatcacatcggaaagccttgacatggaacgattgtcaaagatggataaaaattcagttggctatacgtactacaaatggttgatgaaagagggggtctctccagacacaagggcaccagttacttatatcgatgatcctgtccatgctttcatatttaagagatatagacaatgccatgacttttatcatgcaataaatgacctaccaatcataatcgaaggtgagattgcagttaaagcatttgaggcatcaaacattggtgtcccaatggctgcacttggtgctctattagcaccattgagattaaagaaagtgcaaaaggaaagactttactccatctacctcccatgggcagtcaaagcagggctgaattgcaaacctctcatcaatgtctattgggaagaaatcttggataaggacatagacgaactaagaagagaattaaacgtcacaccacctccagatttgagaaaaattagaaaggaaagagcgaaacaaagaaaacagttcaagcttaagtatgagacctacgagaaatga

SEQ ID NO: 5042 - protein, 332 aa, Kluyveromyces lactis NRRL Y
MFTVSKKSLQASRNAFSPLNNSKRTIVFTAIAAFGDLLIGKDVRLADAMEKGNLHNKNGEYEHKMEQRTQERLNALRNTRPIEPNYEGHVPLWWYERMMLFGISGLKSYFHPENGENIVQLGEATALPCFLESLKRTMLLDKTGRRILQDRPNITSESLDMERLSKMDKNSVGYTYYKWLMKEGVSPDTRAPVTYIDDPVHAFIFKRYRQCHDFYHAINDLPIIIEGEIAVKAFEASNIGVPMAALGALLAPLRLKKVQKERLYSIYLPWAVKAGLNCKPLINVYWEEILDKDIDELRRELNVTPPPDLRKIRKERAKQRKQFKLKYETYEK

SEQ ID NO: 5043 - DNA, 993 bp, Candida glabrata CBS138
  CDS (1)..(993)
atgttacaatcaactaaggttacgaagtcggtgctgacaaatgtgttaagagtggagcaaagacgtggatttttattaagtggtgctgctgtagctctgggtagcacatacatctttggaagagatgctaagctagctgatgctatggatcgtggtgagttgcataacaagaacgaagattatgcgaaattaagggcagagcgtactgagcaacgtattaaggccttgagcaacaacagacctatggagccacgatatgaagggcatgtgcctctgtaccttcatgaaaagatgctactttttgctatttctggtattagggcctttttccacccagagaacggtattaacattgtccagttaggtgaggcaactgcattcccaatattcttggaaaatctaaagcaaacgatgcttgccgatgaaactggaaggcgcatccttagggatcagccaaacgtccgaactgatattttagatatggataagctatcaaagttaccaaagaacacttttggttacactttttataaatggctagagaaggaaaaggtctcgcctgatactagagcaccagtcacatatattgacgacccaatccatgcttttgtgttcaagagatataggcaatgtcacgatttttaccatgccttgaatgatttgccaattatcattgagggggaaattattgtaaaggcattagaatctgcaaacatgggtatcccaatggctactttaggttggatgttggctccactaagattgaaaaaagcacaaagagacagattatatggaacttatttaccttgggcgatcaaaacaggtttgacttgcaagccacttattaatgtctattgggaagagcttcttgaaaaggatgtggaagaattgagacaagaacttggtatcaagatgccacctgatctaagagctatgagagctaagcgtaaagcaatgataaagcgtctcaatgagaaatatcaaaaaaactag

SEQ ID NO: 5044 - protein, 330 aa, Candida glabrata CBS138
MLQSTKVTKSVLTNVLRVEQRRGFLLSGAAVALGSTYIFGRDAKLADAMDRGELHNKNEDYAKLRAERTEQRIKALSNNRPMEPRYEGHVPLYLHEKMLLFAISGIRAFFHPENGINIVQLGEATAFPIFLENLKQTMLADETGRRILRDQPNVRTDILDMDKLSKLPKNTFGYTFYKWLEKEKVSPDTRAPVTYIDDPIHAFVFKRYRQCHDFYHALNDLPIIIEGEIIVKALESANMGIPMATLGWMLAPLRLKKAQRDRLYGTYLPWAIKTGLTCKPLINVYWEELLEKDVEELRQELGIKMPPDLRAMRAKRKAMIKRLNEKYQKN

SEQ ID NO: 5045 - DNA, 972 bp, Ashbya gossypii
  CDS (1)..(972)
atgttacgaggaaaggcgacggtagcagctgctcagcccaggcggacttttgtcctagccggtatgctttccttggggcagcttgtgatcggaagggaggcgcggcttgcggatgccatggccagaggagacctgcacaacaagaatgaggactaccaggcaaagcagctgcaggagctggaggcgcggttgcagggcctgcggaacacgcggccgtcggcgccgcggtacgagggccacgtgccgctgtggtggcacgagaaggcgctgctgttcggtatctcgggcctgcggtcgttctttcaccccgagaacgggatgaacatcgtgcagctgggcgaggctgcggcgatcccgtgcttcttggagtccctgcggcgcaccatgctgtcggacgctaccgggcggcgcatcctgagggagcagccgaacattagcgagccagacctggacatggacaagctcgcgcagctgcccacgaacacgctgggtcacacgttctaccgctggctgcgcaaggagggcgtgacgccggacacgcgcgcgccggtaacctacattgacgaccccgtgcacgcctacatcttcaagcgctatcgccaatgccatgacttctaccacgcgatcaccgggctgccgatcatcatcgagggcgagattgctgtcaaggcgctggaagcggctaatatcggcgttcccatggccgcgctaggcgccctgctggcgccgttgcgcctgcgggcggcgcaacgcgagcgcttgcgcaacatctaccttccctgggccattgaaacgggcctgagcgctaagccgcttatcaacgtgtactgggaggagctgctggagcacgatgtggaccagctgcgcgcagagctgggcatccgcgtgccgccagatctccgcctcattagacaggagcagctccagcgccgcagaagcttcaagatgaagtacgagtcctttgaaaattga

SEQ ID NO: 5046 - protein, 323 aa, Ashbya gossypii
MLRGKATVAAAQPRRTFVLAGMLSLGQLVIGREARLADAMARGDLHNKNEDYQAKQLQELEARLQGLRNTRPSAPRYEGHVPLWWHEKALLFGISGLRSFFHPENGMNIVQLGEAAAIPCFLESLRRTMLSDATGRRILREQPNISEPDLDMDKLAQLPTNTLGHTFYRWLRKEGVTPDTRAPVTYIDDPVHAYIFKRYRQCHDFYHAITGLPIIIEGEIAVKALEAANIGVPMAALGALLAPLRLRAAQRERLRNIYLPWAIETGLSAKPLINVYWEELLEHDVDQLRAELGIRVPPDLRLIRQEQLQRRRSFKMKYESFEN

SEQ ID NO: 5047 - DNA, 1068 bp, Plasmodium yoelii yoelii
  CDS (1)..(1068): n means a or g or c or t/u, r means g or a
atgagcaactttgcaaaaatattccaatcaaattggatagatctaaataagttgggaaagcttgaaatatttttaaaaacaatattaggaatttataaagcaccaaataggacacatttattagcacatgcagcagatatatcatctttttatgcagttaaaaatatttatgaatatatgaaaaatgatgatgaaggaaaagagatattaaaaaataaaccattattaataagacaagatatccaatttaatgaattaaaaaaattgcctaaaaatactttgggttataaatatatggaatttttagaaacatataaacttcatgcacatgatagagaagtagctcatttttttgataatattaattattcatatatattaacaagatatagacaaatacatgatataggccatgtagtttataatttaaatatatcaattgaatcagaagctgcattaaagatgattgaattaatacatacaaaattgcctataacattactagctattttagtagcaccttttatgtcacctttatatcggtttcaatacatatttaaagataaaattcctccaaattttcttaatcccaattttgattatacatataragatgattataattatatagatgaattatcattaaaacaatatgtatataatttaacagaatattttcatattgataaaataaataataatttattttttcaaaaattatataaatattattttgacaatttaaataattctaatcatattcgaggtactattatttatggatataataatgaaaataataatgatataatttttgatgatataaataatgaatatatttttttaaagaatccggaaaaaaattattttctttttaaatataaacctagacaaacattattaaatcaattatatccttgggcatatatggctggaatggctgcaaaaaaacctcttcattctattcatattgaaaattggctagacaaagatattgatatttttagaaaaacatataacataattccccttcctgaccacttgaatttaatgtctggtattaactaa

SEQ ID NO: 5048 - protein, 355 aa, Plasmodium yoelii yoelii
  Xaa in position 204 is unknown
MSNFAKIFQSNWIDLNKLGKLEIFLKTILGIYKAPNRTHLLAHAADISSFYAVKNIYEYMKNDDEGKEILKNKPLLIRQDIQFNELKKLPKNTLGYKYMEFLETYKLHAHDREVAHFFDNINYSYILTRYRQIHDIGHVVYNLNISIESEAALKMIELIHTKLPITLLAILVAPFMSPLYRFQYIFKDKIPPNFLNPNFDYTYXDDYNYIDELSLKQYVYNLTEYFHIDKINNNLFFQKLYKYYFDNLNNSNHIRGTIIYGYNNENNNDIIFDDINNEYIFLKNPEKNYFLFKYKPRQTLLNQLYPWAYMAGMAAKKPLHSIHIENWLDKDIDIFRKTYNIIPLPDHLNLMSGIN

SEQ ID NO: 5049 - DNA, 1044 bp, Neurospora crassa
  CDS (1)..(1044)
atggaagtgacggccctcagacgatccgcggctctagtagctcgcgccagcagccagaatgcaatccggcctgccgtatgcgccgccatcagcagcacatcaccaacaccaccgacccagatccagacacagcaaacaagacaattctcggcccttaaccgcccaccaccaaactaccctggccatgtccctctcacccgcctcgagcgcttcggcctcttcgtcggctcaggcctcatctccctcgccgaccccctgcgcggcgacctaatagcctccttcgccgaagccaccgcaacgccctacttcatctaccgcctgcgcgacgccatgctgtcccaccccacgggacgtcgcatcctgcgccaacgaccgcgcatcacctcccaatctctcaacatcccttacctgcgttccctgccgcccaacaccgtcggacgaacctacattgactggctcgaccgcgaaggggtatctcccgatacgcgctcggcggtgcggtacatcgacgacgaggagtgcgcatacgtgatgcagcggtaccgcgagtgccacgatttctaccacgctttgacgggcttgccgatcgtccgggagggcgaggtggcgctgaaggcgtttgagtttgcgaataccctgttgccgatgacggggttcagcgttttcgcggcgttcacgatgaagaagagcgagcagaagcggtttaggaagatttacttcccctgggcagttaagaatggactgcgggccaaggaggtgattaacgtcttttgggaggaggagttggagcgggatgtaaatgatttgaggagggagttgggcgtggaaccgccgccggatctgagggagatcaggaagcgggagagggaagagaagaggaggagaaaggagatggaacggatgctgagcgggcgcgggacagaggacgtcatccagaaggcggagaaggaagctgaagtggtggcggaacgggtgaaggagatgaggaatgaggtggttgagaaggttggcgaggttgtcgggtcttcggctatgagaggatag

SEQ ID NO: 5050 - protein, 347 aa, Neurospora crassa
MEVTALRRSAALVARASSQNAIRPAVCAAISSTSPTPPTQIQTQQTRQFSALNRPPPNYPGHVPLTRLERFGLFVGSGLISLADPLRGDLIASFAEATATPYFIYRLRDAMLSHPTGRRILRQRPRITSQSLNIPYLRSLPPNTVGRTYIDWLDREGVSPDTRSAVRYIDDEECAYVMQRYRECHDFYHALTGLPIVREGEVALKAFEFANTLLPMTGFSVFAAFTMKKSEQKRFRKIYFPWAVKNGLRAKEVINVFWEEELERDVNDLRRELGVEPPPDLREIRKREREEKRRRKEMERMLSGRGTEDVIQKAEKEAEVVAERVKEMRNEVVEKVGEVVGSSAMRG

SEQ ID NO: 5051 - DNA, 684 bp, Oryza sativa
  CDS (1)..(684)
atgcagggggcgcgtgttaatctgaaggggtggcaacaggctgctgttgcattcggttctgcatttggggccttgcttgaccctagaagagctgatctgatagctgctcttggggagactactgggaagccagcatttcagcgtgtgcttcagcggatgaggaacagtgctgaaggcagggatgttctcctggagcgtcctcgagttatatccacacaagtttctcatgcctgggacatgcctcagaacacatttggtgcagcatatgctcagttcatgggatcaaggaacttctcaccggatgaccgcccacctgtccgtttcatggatacagatgagcttgcgtatgttgcgacccgcgcccgtgaagtccatgacttttggcatgtgctgttcggccttcctacgaacctgattggagagactgcccttaaggtcattgagtttgaacagatgttccttccaatgtgcatgctttcagtcgttgggggctctgcgaggttcaatgagaaacaaaggacactgttttttcagcattatttcccatgggcttcaaaagcaggtcttaagtgcacagatcttatgtctgtgtactatgagaagcattttcatgaagatttggatgaagtgaggaggaactggggaattataccatgccctgatcccaaaaggagcagtgtttag

SEQ ID NO: 5052 - protein, 227 aa, Oryza sativa
MQGARVNLKGWQQAAVAFGSAFGALLDPRRADLIAALGETTGKPAFQRVLQRMRNSAEGRDVLLERPRVISTQVSHAWDMPQNTFGAAYAQFMGSRNFSPDDRPPVRFMDTDELAYVATRAREVHDFWHVLFGLPTNLIGETALKVIEFEQMFLPMCMLSVVGGSARFNEKQRTLFFQHYFPWASKAGLKCTDLMSVYYEKHFHEDLDEVRRNWGIIPCPDPKRSSV

SEQ ID NO: 5053 - DNA, 801 bp, Mus musculus
  CDS (1)..(801)
atggcgaccctgctgctgcttcgctccctgcgcctccaccgcagtcttcggccccgtacgcggccagctgtagatgtacccctcagggccgggagccatggcgcccgcctgctgtacccggaccacatcccaaccaccccgctgcaaaagatgctgctggctgcgggcgcggcgggaatggctctctacaacccctatcgccacgacatggttgcagttctaggggagaccacaggatgccacaccctgaaattcctcagggaccagatgaagaaggatccagagggtgcccagattctacaagagcgtcccaggatctccctgtctaccctcgacctgagcaagcttcagagcctgcctgaaggctcactgggccgtgagtatcttcgcttcctggatgtgaataaggtctctccagacacacgagcacctacacgctttgtggacgatgaagagctagcctatgtgatccagaggtaccgtgaagtgcacgacatgctccacaccctgctgggcatgcccaccaacatgctcggagaggttgtggtaaagtggtttgaggctgtgcagaccggcctaccaatgtgcatcctgggagcactcttcggacccatccgcctccgtactcagagcctccaagtgctgttctcggagctgatcccttgggcgattcagaacgggcgcagggccccatgtgtcctcaacatctactatgagcagcgttgggagcagcccctgacagccctgcgggaggagctgggcatcagtcctcccccaaaacatatccagggcctggcctag

SEQ ID NO: 5054 - protein, 266 aa, Mus musculus
MATLLLLRSLRLHRSLRPRTRPAVDVPLRAGSHGARLLYPDHIPTTPLQKMLLAAGAAGMALYNPYRHDMVAVLGETTGCHTLKFLRDQMKKDPEGAQILQERPRISLSTLDLSKLQSLPEGSLGREYLRFLDVNKVSPDTRAPTRFVDDEELAYVIQRYREVHDMLHTLLGMPTNMLGEVVVKWFEAVQTGLPMCILGALFGPIRLRTQSLQVLFSELIPWAIQNGRRAPCVLNIYYEQRWEQPLTALREELGISPPPKHIQGLA

SEQ ID NO: 5055 - DNA, 1068 bp, Plasmodium falciparum
  CDS (1)..(1068)
atgtacaattttgtaaaaatatttcaatctaattttattgatataaataaattgagcaaatttgaaatatttttaaagacaatatttcgaatttatagttctcctggaagaacacatttattagctcatgctgctgatatatcagctaaatatgcagtgaggaaaatatatgaatatatgagaactgacgaagaagggattaggatattaaaagaaaagcctttattaatacgtcaagatatatgttttaatgaattaaagaagttaccaaaaaatacattaggttataaatatatggaatttttagaaacttataaattacatgcacatgatagagaagtttcacattttataaaagatataaacgaatcttatatattaacaagatatagacaaattcatgatatagctcatgtagtatataatttaaatatatcaatagaagcagaagcagcattaaaattaatcgaattaatacaaacaaaattacctataacattacttgcaattttaatagcaccatttatgacacctttatataggttccaatatatatttgagcataatattccttctaattttttatgtcctaattttgattatacatataatgatgattataattatattgatgaaatgtctttaaaacaatatgaatattatttaactgattattttcatgtagaaaaaagagaaagccaatccttttattacaaattatataaatattatttcgataatttaaataattcttcacatgttagaggttctattatatacggatatcaaaataagaattataatgatatacattatgacaaattaaataatgaatatttatacttaaaaaataatattaaaaattattttcatttccaatataaaccaagaaaactactattaacaaatttatatccatgggcttataaaactgcaatacaaacaaacaaaccattacattcaatatatgtagaaaaatggtttgataaagatattgatctgtttagaaagaaatataacataactcctctaccatccaacttaaacttgatggccggcattaattaa

SEQ ID NO: 5056 - protein, 355 aa, Plasmodium falciparum
MYNFVKIFQSNFIDINKLSKFEIFLKTIFRIYSSPGRTHLLAHAADISAKYAVRKIYEYMRTDEEGIRILKEKPLLIRQDICFNELKKLPKNTLGYKYMEFLETYKLHAHDREVSHFIKDINESYILTRYRQIHDIAHVVYNLNISIEAEAALKLIELIQTKLPITLLAILIAPFMTPLYRFQYIFEHNIPSNFLCPNFDYTYNDDYNYIDEMSLKQYEYYLTDYFHVEKRESQSFYYKLYKYYFDNLNNSSHVRGSIIYGYQNKNYNDIHYDKLNNEYLYLKNNIKNYFHFQYKPRKLLLTNLYPWAYKTAIQTNKPLHSIYVEKWFDKDIDLFRKKYNITPLPSNLNLMAGIN

SEQ ID NO: 5057 - DNA, 827 bp, Drosophila melanogaster
  CDS (21)..(827)
ttctttgtcttaaaagtaaaatgatgcaacgctgtttgcgtctccaaaagccgctggccctacgacgaggccttcgcttggcccaggctaatagccaagcggtggccacagaagcacccgaggcggaacctctggatgccttcgagcgtcagtacctcaaggagcgaatcgagatatcgcccttccagcggctgttcctgggggcaggatcctccattgccgcgctcttgaatccaagacgtcatgacatgatcgcctgtttgggtgagacgactggagaggatgctctatggacaattttggacaccatgcaagccagcgaggagggtcagcgcatcatggctgataagccccgcatccacaccagcaccattgacttcaagtatctggaaactttgccaccggatacctttggagccgcttacgtaaagtttctgaaagataatcaagtcacgccggacagtcgcatggccgtgcggtttttggaggacccgaagttggcctacttgatgacgcgatatcgcgaatgccacgacctaatccacacggtgctggacatgcccaccaatatgctgggcgaggtggctgtcaagtgggtggaggctctgaacacgggcctgcccatgtgctacggtggtgcggtattcggagcagttcgcctacgtcccaagcagcggcgtgcgtacttgaagcattacttgccgtgggccctggagaacggcaagcggaccaagcccttgatgcccgtctactgggagaagcgctgggagcagaacatccacgagctgcgctccgaattgggcattactgtgctgaataaagcttga

SEQ ID NO: 5058 - protein, 268 aa, Drosophila melanogaster
MMQRCLRLQKPLALRRGLRLAQANSQAVATEAPEAEPLDAFERQYLKERIEISPFQRLFLGAGSSIAALLNPRRHDMIACLGETTGEDALWTILDTMQASEEGQRIMADKPRIHTSTIDFKYLETLPPDTFGAAYVKFLKDNQVTPDSRMAVRFLEDPKLAYLMTRYRECHDLIHTVLDMPTNMLGEVAVKWVEALNTGLPMCYGGAVFGAVRLRPKQRRAYLKHYLPWALENGKRTKPLMPVYWEKRWEQNIHELRSELGITVLNKA

SEQ ID NO: 5059 - DNA, 1271 bp, Homo sapiens
  CDS (22)..(819)
cctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggtcaaaaaaaaaaaaaaaaaaaaaaaaaaa

SEQ ID NO: 5060 - protein, 265 aa, Homo sapiens
MATLLRPVLRRLCGLPGLQRPAAEMPLRARSDGAGPLYSHHLPTSPLQKALLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRALREELGITAPPMHVQGLA

SEQ ID NO: 5061 - DNA, 26 bp, artificial sequence
  primer
atgttgaggttatctttactgagatc

SEQ ID NO: 5062 - DNA, 22 bp, artificial sequence
  primer
tcatgctggagtcgtggctcgt

SEQ ID NO: 5063 - DNA, 1390 bp, Saccharomyces cerevisiae; identical to SEQ ID NO: 531
  CDS (303)..(1118)

SEQ ID NO: 5064 - protein, 271 aa, Saccharomyces cerevisiae; identical to SEQ ID NO: 532

SEQ ID NO: 5065 - DNA, 714 bp, Deinococcus radiodurans; identical to SEQ ID NO: 533
  CDS (1)..(714)

SEQ ID NO: 5066 - protein, 237 aa, Deinococcus radiodurans; identical to SEQ ID NO: 534

SEQ ID NO: 5067 - DNA, 1350 bp, Nostoc sp. PCC 7120; identical to SEQ ID NO: 535
  CDS (1)..(1350)

SEQ ID NO: 5068 - protein, 449 aa, Nostoc sp. PCC 7120; identical to SEQ ID NO: 536

SEQ ID NO: 5069 - DNA, 636 bp, Listeria monocytogenes; identical to SEQ ID NO: 537
  CDS (1)..(636)

SEQ ID NO: 5070 - protein, 211 aa, Listeria monocytogenes; identical to SEQ ID NO: 538

SEQ ID NO: 5071 - DNA, 636 bp, Listeria innocua; identical to SEQ ID NO: 539
  CDS (1)..(636)

SEQ ID NO: 5072 - protein, 211 aa, Listeria innocua; identical to SEQ ID NO: 540

SEQ ID NO: 5073 - DNA, 654 bp, Brucella melitensis; identical to SEQ ID NO: 541
  CDS (1)..(654)

SEQ ID NO: 5074 - protein, 217 aa, Brucella melitensis; identical to SEQ ID NO: 542

SEQ ID NO: 5075 - DNA, 813 bp, Nostoc sp. PCC 7120; identical to SEQ ID NO: 543
  CDS (1)..(813)

SEQ ID NO: 5076 - protein, 270 aa, Nostoc sp. PCC 7120; identical to SEQ ID NO: 544

SEQ ID NO: 5077 - DNA, 615 bp, Deinococcus radiodurans; identical to SEQ ID NO: 545
  CDS (1)..(615)

SEQ ID NO: 5078 - protein, 204 aa, Deinococcus radiodurans; identical to SEQ ID NO: 546

SEQ ID NO: 5079 - DNA, 714 bp, Caulobacter crescentus; identical to SEQ ID NO: 547
  CDS (1)..(714)

SEQ ID NO: 5080 - protein, 237 aa, Caulobacter crescentus; identical to SEQ ID NO: 548

SEQ ID NO: 5081 - DNA, 756 bp, Treponema pallidum subsp. pallidum (syphilis spirochete); identical to SEQ ID NO: 549
  CDS (1)..(756)

SEQ ID NO: 5082 - protein, 251 aa, Treponema pallidum subsp. pallidum (syphilis spirochete); identical to SEQ ID NO: 550

SEQ ID NO: 5083 - DNA, 645 bp, Xylella fastidiosa; identical to SEQ ID NO: 551
  CDS (1)..(645)

SEQ ID NO: 5084 - protein, 214 aa, Xylella fastidiosa; identical to SEQ ID NO: 552

SEQ ID NO: 5085 - DNA, 2034 bp, Arabidopsis thaliana (mouse-ear cress); identical to SEQ ID NO: 553
  CDS (1)..(2034)

SEQ ID NO: 5086 - protein, 677 aa, Arabidopsis thaliana (mouse-ear cress); identical to SEQ ID NO: 554

SEQ ID NO: 5087 - DNA, 582 bp, Bacillus subtilis; identical to SEQ ID NO: 555
  CDS (1)..(582)

SEQ ID NO: 5088 - protein, 193 aa, Bacillus subtilis; identical to SEQ ID NO: 556

SEQ ID NO: 5089 - DNA, 606 bp, Thermotoga maritima; identical to SEQ ID NO: 557
  CDS (1)..(606)

SEQ ID NO: 5090 - protein, 201 aa, Thermotoga maritima; identical to SEQ ID NO: 558

SEQ ID NO: 5091 - DNA, 660 bp, Clostridium acetobutylicum; identical to SEQ ID NO: 559
  CDS (1)..(660)

SEQ ID NO: 5092 - protein, 219 aa, Clostridium acetobutylicum; identical to SEQ ID NO: 560

SEQ ID NO: 5093 - DNA, 744 bp, Saccharomyces cerevisiae; identical to SEQ ID NO: 561
  CDS (1)..(744)

SEQ ID NO: 5094 - protein, 247 aa, Saccharomyces cerevisiae; identical to SEQ ID NO: 562

SEQ ID NO: 5095 - DNA, 1050 bp, Synechocystis sp; identical to SEQ ID NO: 563
  CDS (1)..(1050)

SEQ ID NO: 5096 - protein, 349 aa, Synechocystis sp; identical to SEQ ID NO: 564

SEQ ID NO: 5097 - DNA, 875 bp, Arabidopsis thaliana (mouse-ear cress); identical to SEQ ID NO: 565
  CDS (30)..(722)

SEQ ID NO: 5098 - protein, 230 aa, Arabidopsis thaliana (mouse-ear cress); identical to SEQ ID NO: 566

SEQ ID NO: 5099 - DNA, 741 bp, Debaryomyces hansenii; identical to SEQ ID NO: 567
  CDS (1)..(741)

SEQ ID NO: 5100 - protein, 246 aa, Debaryomyces hansenii; identical to SEQ ID NO: 568

SEQ ID NO: 5101 - DNA, 741 bp, Yarrowia lipolytica; identical to SEQ ID NO: 569
  CDS (1)..(741)

SEQ ID NO: 5102 - protein, 246 aa, Yarrowia lipolytica; identical to SEQ ID NO: 570

SEQ ID NO: 5103 - DNA, 816 bp, Kluyveromyces lactis; identical to SEQ ID NO: 571
  CDS (1)..(816)

SEQ ID NO: 5104 - protein, 271 aa, Kluyveromyces lactis; identical to SEQ ID NO: 572

SEQ ID NO: 5105 - DNA, 687 bp, Kluyveromyces lactis; identical to SEQ ID NO: 573
  CDS (1)..(687)

SEQ ID NO: 5106 - protein, 228 aa, Kluyveromyces lactis; identical to SEQ ID NO: 574

SEQ ID NO: 5107 - DNA, 651 bp, Erwinia carotovora subsp; identical to SEQ ID NO: 575
  CDS (1)..(651)

SEQ ID NO: 5108 - protein, 216 aa, Erwinia carotovora subsp; identical to SEQ ID NO: 576

SEQ ID NO: 5109 - DNA, 840 bp, Candida glabrata; identical to SEQ ID NO: 577
  CDS (1)..(840)

SEQ ID NO: 5110 - protein, 279 aa, Candida glabrata; identical to SEQ ID NO: 578

SEQ ID NO: 5111 - DNA, 744 bp, Candida glabrata; identical to SEQ ID NO: 579
  CDS (1)..(744)

SEQ ID NO: 5112 - protein, 247 aa, Candida glabrata; identical to SEQ ID NO: 580

SEQ ID NO: 5113 - DNA, 621 bp, Bartonella quintana; identical to SEQ ID NO: 581
  CDS (1)..(621)

SEQ ID NO: 5114 - protein, 206 aa, Bartonella quintana; identical to SEQ ID NO: 582

SEQ ID NO: 5115 - DNA, 648 bp, Parachlamydia sp; identical to SEQ ID NO: 583
  CDS (1)..(648)

SEQ ID NO: 5116 - protein, 215 aa, Parachlamydia sp; identical to SEQ ID NO: 584

SEQ ID NO: 5117 - DNA, 636 bp, Listeria monocytogenes; identical to SEQ ID NO: 585
  CDS (1)..(636)

SEQ ID NO: 5118 - protein, 211 aa, Listeria monocytogenes; identical to SEQ ID NO: 586

SEQ ID NO: 5119 - DNA, 633 bp, Thermus thermophilus; identical to SEQ ID NO: 587
  CDS (1)..(633)

SEQ ID NO: 5120 - protein, 210 aa, Thermus thermophilus; identical to SEQ ID NO: 588

SEQ ID NO: 5121 - DNA, 654 bp, Mycobacterium paratuberculosis; identical to SEQ ID NO: 589
  CDS (1)..(654)

SEQ ID NO: 5122 - protein, 217 aa, Mycobacterium paratuberculosis; identical to SEQ ID NO: 590

SEQ ID NO: 5123 - DNA, 1134 bp, Mycobacterium paratuberculosis; identical to SEQ ID NO: 591
  CDS (1)..(1134)

SEQ ID NO: 5124 - protein, 377 aa, Mycobacterium paratuberculosis; identical to SEQ ID NO: 592

SEQ ID NO: 5125 - DNA, 627 bp, Lactobacillus johnsonii; identical to SEQ ID NO: 593
  CDS (1)..(627)

SEQ ID NO: 5126 - protein, 208 aa, Lactobacillus johnsonii; identical to SEQ ID NO: 594

SEQ ID NO: 5127 - DNA, 807 bp, Ashbya gossypii; identical to SEQ ID NO: 595
  CDS (1)..(807)

SEQ ID NO: 5128 - protein, 268 aa, Ashbya gossypii; identical to SEQ ID NO: 596

SEQ ID NO: 5129 - DNA, 687 bp, Mycobacterium tuberculosis; identical to SEQ ID NO: 597
  CDS (1)..(687)

SEQ ID NO: 5130 - protein, 228 aa, Mycobacterium tuberculosis; identical to SEQ ID NO: 598

SEQ ID NO: 5131 - DNA, 618 bp, Photorhabdus luminescens; identical to SEQ ID NO: 599
  CDS (1)..(618)

SEQ ID NO: 5132 - protein, 205 aa, Photorhabdus luminescens; identical to SEQ ID NO: 600

SEQ ID NO: 5133 - DNA, 588 bp, Anopheles gambiae str; identical to SEQ ID NO: 601
  CDS (1)..(588)

SEQ ID NO: 5134 - protein, 195 aa, Anopheles gambiae str; identical to SEQ ID NO: 602

SEQ ID NO: 5135 - DNA, 3762 bp, Neurospora crassa; identical to SEQ ID NO: 603
  CDS (1)..(3762)

SEQ ID NO: 5136 - protein, 1253 aa, Neurospora crassa; identical to SEQ ID NO: 604

SEQ ID NO: 5137 - DNA, 567 bp, Synechococcus sp; identical to SEQ ID NO: 605
  CDS (1)..(567)

SEQ ID NO: 5138 - protein, 188 aa, Synechococcus sp; identical to SEQ ID NO: 606

SEQ ID NO: 5139 - DNA, 612 bp, Rhodopirellula baltica; identical to SEQ ID NO: 607
  CDS (1)..(612)

SEQ ID NO: 5140 - protein, 203 aa, Rhodopirellula baltica; identical to SEQ ID NO: 608

SEQ ID NO: 5141 - DNA, 1329 bp, Prochlorococcus marinus subsp; identical to SEQ ID NO: 609
  CDS (1)..(1329)

SEQ ID NO: 5142 - protein, 442 aa, Prochlorococcus marinus subsp; identical to SEQ ID NO: 610

SEQ ID NO: 5143 - DNA, 1332 bp, Prochlorococcus marinus; identical to SEQ ID NO: 611
  CDS (1)..(1332)

SEQ ID NO: 5144 - protein, 443 aa, Prochlorococcus marinus; identical to SEQ ID NO: 612

SEQ ID NO: 5145 - DNA, 591 bp, Prochlorococcus marinus; identical to SEQ ID NO: 613
  CDS (1)..(591)

SEQ ID NO: 5146 - protein, 196 aa, Prochlorococcus marinus; identical to SEQ ID NO: 614

SEQ ID NO: 5147 - DNA, 618 bp, Streptomyces avermitilis; identical to SEQ ID NO: 615
  CDS (1)..(618)

SEQ ID NO: 5148 - protein, 205 aa, Streptomyces avermitilis; identical to SEQ ID NO: 616

SEQ ID NO: 5149 - DNA, 600 bp, Streptomyces avermitilis; identical to SEQ ID NO: 617
  CDS (1)..(600)

SEQ ID NO: 5150 - protein, 199 aa, Streptomyces avermitilis; identical to SEQ ID NO: 618

SEQ ID NO: 5151 - DNA, 612 bp, Streptomyces avermitilis; identical to SEQ ID NO: 619
  CDS (1)..(612)

SEQ ID NO: 5152 - protein, 203 aa, Streptomyces avermitilis; identical to SEQ ID NO: 620

SEQ ID NO: 5153 - DNA, 645 bp, Enterococcus faecalis; identical to SEQ ID NO: 621
  CDS (1)..(645)

SEQ ID NO: 5154 - protein, 214 aa, Enterococcus faecalis; identical to SEQ ID NO: 622

SEQ ID NO: 5155 - DNA, 666 bp, Lactobacillus plantarum; identical to SEQ ID NO: 623
  CDS (1)..(666)

SEQ ID NO: 5156 - protein, 221 aa, Lactobacillus plantarum; identical to SEQ ID NO: 624

SEQ ID NO: 5157 - DNA, 642 bp, Clostridium tetani; identical to SEQ ID NO: 625
  CDS (1)..(642)

SEQ ID NO: 5158 - protein, 213 aa, Clostridium tetani; identical to SEQ ID NO: 626

SEQ ID NO: 5159 - DNA, 600 bp, Bradyrhizobium japonicum; identical to SEQ ID NO: 627
  CDS (1)..(600)

SEQ ID NO: 5160 - protein, 199 aa, Bradyrhizobium japonicum; identical to SEQ ID NO: 628

SEQ ID NO: 5161 - DNA, 1407 bp, Synechococcus elongatus; identical to SEQ ID NO: 629
  CDS (1)..(1407)

SEQ ID NO: 5162 - protein, 468 aa, Synechococcus elongatus; identical to SEQ ID NO: 630

SEQ ID NO: 5163 - DNA, 582 bp, Oceanobacillus iheyensis; identical to SEQ ID NO: 631
  CDS (1)..(582)

SEQ ID NO: 5164 - protein, 193 aa, Oceanobacillus iheyensis; identical to SEQ ID NO: 632

SEQ ID NO: 5165 - DNA, 648 bp, Bifidobacterium longum; identical to SEQ ID NO: 633
  CDS (1)..(648)

SEQ ID NO: 5166 - protein, 215 aa, Bifidobacterium longum; identical to SEQ ID NO: 634

SEQ ID NO: 5167 - DNA, 1005 bp, Arabidopsis thaliana; identical to SEQ ID NO: 635
  CDS (1)..(1005)

SEQ ID NO: 5168 - protein, 334 aa, Arabidopsis thaliana; identical to SEQ ID NO: 636

SEQ ID NO: 5169 - DNA, 645 bp, Xanthomonas campestris; identical to SEQ ID NO: 637
  CDS (1)..(645)

SEQ ID NO: 5170 - protein, 214 aa, Xanthomonas campestris; identical to SEQ ID NO: 638

SEQ ID NO: 5171 - DNA, 645 bp, Xanthomonas axonopodis; identical to SEQ ID NO: 639
  CDS (1)..(645)

SEQ ID NO: 5172 - protein, 214 aa, Xanthomonas axonopodis; identical to SEQ ID NO: 640

SEQ ID NO: 5173 - DNA, 621 bp, Thermoanaerobacter tengcongensis; identical to SEQ ID NO: 641
  CDS (1)..(621)

SEQ ID NO: 5174 - protein, 206 aa, Thermoanaerobacter tengcongensis; identical to SEQ ID NO: 642

SEQ ID NO: 5175 - DNA, 582 bp, Rhizobium loti; identical to SEQ ID NO: 643
  CDS (1)..(582)

SEQ ID NO: 5176 - protein, 193 aa, Rhizobium loti; identical to SEQ ID NO: 644

SEQ ID NO: 5177 - DNA, 651 bp, Pasteurella multocida; identical to SEQ ID NO: 645
  CDS (1)..(651)

SEQ ID NO: 5178 - protein, 216 aa, Pasteurella multocida; identical to SEQ ID NO: 646

SEQ ID NO: 5179 - DNA, 597 bp, Streptomyces coelicolor; identical to SEQ ID NO: 647
  CDS (1)..(597)

SEQ ID NO: 5180 - protein, 198 aa, Streptomyces coelicolor; identical to SEQ ID NO: 648

SEQ ID NO: 5181 - DNA, 600 bp, Streptomyces coelicolor; identical to SEQ ID NO: 649
  CDS (1)..(600)

SEQ ID NO: 5182 - protein, 199 aa, Streptomyces coelicolor; identical to SEQ ID NO: 650

SEQ ID NO: 5183 - DNA, 660 bp, Gloeobacter violaceus; identical to SEQ ID NO: 651
  CDS (1)..(660)

SEQ ID NO: 5184 - protein, 219 aa, Gloeobacter violaceus; identical to SEQ ID NO: 652

SEQ ID NO: 5185 - DNA, 621 bp, Bartonella henselae; identical to SEQ ID NO: 653
  CDS (1)..(621)

SEQ ID NO: 5186 - protein, 206 aa, Bartonella henselae; identical to SEQ ID NO: 654

SEQ ID NO: 5187 - DNA, 681 bp, Parachlamydia sp; identical to SEQ ID NO: 655
  CDS (1)..(681)

SEQ ID NO: 5188 - protein, 226 aa, Parachlamydia sp; identical to SEQ ID NO: 656

SEQ ID NO: 5189 - DNA, 636 bp, Rhizobium meliloti; identical to SEQ ID NO: 657
  CDS (1)..(636)

SEQ ID NO: 5190 - protein, 211 aa, Rhizobium meliloti; identical to SEQ ID NO: 658

SEQ ID NO: 5191 - DNA, 648 bp, Escherichia coli O6; identical to SEQ ID NO: 659
  CDS (1)..(648)

SEQ ID NO: 5192 - protein, 215 aa, Escherichia coli O6; identical to SEQ ID NO: 660

SEQ ID NO: 5193 - DNA, 648 bp, Photorhabdus luminescens; identical to SEQ ID NO: 661
  CDS (1)..(648)

SEQ ID NO: 5194 - protein, 215 aa, Photorhabdus luminescens; identical to SEQ ID NO: 662

SEQ ID NO: 5195 - DNA, 648 bp, Salmonella typhimurium; identical to SEQ ID NO: 663
  CDS (1)..(648)

SEQ ID NO: 5196 - protein, 215 aa, Salmonella typhimurium; identical to SEQ ID NO: 664

SEQ ID NO: 5197 - DNA, 22 bp, artificial sequence
  primer
atgccttcgctaacccccagat

SEQ ID NO: 5198 - DNA, 23 bp, artificial sequence
  primer
ttacacatcgccatgctgggatt

SEQ ID NO: 5199 - DNA, 3844 bp, Saccharomyces cerevisiae; identical to SEQ ID NO: 667
  CDS (1218)..(3269)

SEQ ID NO: 5200 - protein, 683 aa, Saccharomyces cerevisiae; identical to SEQ ID NO: 668

SEQ ID NO: 5201 - DNA, 1713 bp, Glycine max; identical to SEQ ID NO: 669
  CDS (1)..(1713)

SEQ ID NO: 5202 - protein, 570 aa, Glycine max; identical to SEQ ID NO: 670

SEQ ID NO: 5203 - DNA, 1644 bp, Glycine max; identical to SEQ ID NO: 671
  CDS (1)..(1644)

SEQ ID NO: 5204 - protein, 547 aa, Glycine max; identical to SEQ ID NO: 672

SEQ ID NO: 5205 - DNA, 1641 bp, Glycine max; identical to SEQ ID NO: 673
  CDS (1)..(1641)

SEQ ID NO: 5206 - protein, 546 aa, Glycine max; identical to SEQ ID NO: 674

SEQ ID NO: 5207 - DNA, 1668 bp, Zea mays; identical to SEQ ID NO: 675
  CDS (1)..(1668): n means a or g or c or t/u, s means g or c

SEQ ID NO: 5208 - protein, 555 aa, Zea mays; identical to SEQ ID NO: 676

SEQ ID NO: 5209 - DNA, 1659 bp, Brassica napus; identical to SEQ ID NO: 677
  CDS (1)..(1659)

SEQ ID NO: 5210 - protein, 552 aa, Brassica napus; identical to SEQ ID NO: 678

SEQ ID NO: 5211 - DNA, 1689 bp, Glycine max; identical to SEQ ID NO: 679
  CDS (1)..(1689)

SEQ ID NO: 5212 - protein, 562 aa, Glycine max; identical to SEQ ID NO: 680

SEQ ID NO: 5213 - DNA, 3359 bp, Methanothrix soehngenii; identical to SEQ ID NO: 681
  CDS (310)..(2328)

SEQ ID NO: 5214 - protein, 672 aa, Methanothrix soehngenii [sequence omitted]

SEQ ID NO: 5215 - DNA, 3802 bp, Alcaligenes eutrophus; identical to SEQ ID NO: 683
  CDS (722)..(2704)

SEQ ID NO: 5216 - protein, 660 aa, Alcaligenes eutrophus [sequence omitted]

SEQ ID NO: 5217 - DNA, 1845 bp, Phanerochaete chrysosporium; identical to SEQ ID NO: 685
  CDS (1)..(1845)

SEQ ID NO: 5218 - protein, 614 aa, Phanerochaete chrysosporium; identical to SEQ ID NO: 686

SEQ ID NO: 5219 - DNA, 1938 bp, Pseudomonas aeruginosa; identical to SEQ ID NO: 687
  CDS (1)..(1938)

SEQ ID NO: 5220 - protein, 645 aa, Pseudomonas aeruginosa [sequence omitted]

SEQ ID NO: 5221 - DNA, 1668 bp, Pseudomonas aeruginosa; identical to SEQ ID NO: 689
  CDS (1)..(1668)

SEQ ID NO: 5222 - protein, 555 aa, Pseudomonas aeruginosa; identical to SEQ ID NO: 690

SEQ ID NO: 5223 - DNA, 1947 bp, Bacillus halodurans; identical to SEQ ID NO: 691
  CDS (1)..(1947)

SEQ ID NO: 5224 - protein, 648 aa, Bacillus halodurans; identical to SEQ ID NO: 692

SEQ ID NO: 5225 - DNA, 1707 bp, Staphylococcus aureus; identical to SEQ ID NO: 693
  CDS (1)..(1707)

SEQ ID NO: 5226 - protein, 568 aa, Staphylococcus aureus; identical to SEQ ID NO: 694

SEQ ID NO: 5227 - DNA, 1887 bp, Salmonella enterica subsp. enterica serovar Typhi; identical to SEQ ID NO: 695
  CDS (1)..(1887)

SEQ ID NO: 5228 - protein, 628 aa, Salmonella enterica subsp. enterica serovar Typhi; identical to SEQ ID NO: 696

SEQ ID NO: 5229 - DNA, 1575 bp, Nostoc sp. PCC 7120; identical to SEQ ID NO: 697
  CDS (1)..(1575)

SEQ ID NO: 5230 - protein, 524 aa, Nostoc sp. PCC 7120; identical to SEQ ID NO: 698

SEQ ID NO: 5231 - DNA, 1992 bp, Brucella melitensis; identical to SEQ ID NO: 699
  CDS (1)..(1992)

SEQ ID NO: 5232 - protein, 663 aa, Brucella melitensis; identical to SEQ ID NO: 700

SEQ ID NO: 5233 - DNA, 1707 bp, Brucella melitensis; identical to SEQ ID NO: 701
  CDS (1)..(1707)

SEQ ID NO: 5234 - protein, 568 aa, Brucella melitensis; identical to SEQ ID NO: 702

SEQ ID NO: 5235 - DNA, 1959 bp, Yersinia pestis; identical to SEQ ID NO: 703
  CDS (1)..(1959)

SEQ ID NO: 5236 - protein, 652 aa, Yersinia pestis; identical to SEQ ID NO: 704

SEQ ID NO: 5237 - DNA, 1716 bp, Bacillus halodurans; identical to SEQ ID NO: 705
  CDS (1)..(1716)

SEQ ID NO: 5238 - protein, 571 aa, Bacillus halodurans; identical to SEQ ID NO: 706

SEQ ID NO: 5239 - DNA, 2004 bp, Halobacterium sp. NRC-1; identical to SEQ ID NO: 707
  CDS (1)..(2004)

SEQ ID NO: 5240 - protein, 667 aa, Halobacterium sp. NRC-1; identical to SEQ ID NO: 708

SEQ ID NO: 5241 - DNA, 1944 bp, Caulobacter crescentus; identical to SEQ ID NO: 709
  CDS (1)..(1944)

SEQ ID NO: 5242 - protein, 647 aa, Caulobacter crescentus [sequence omitted]

SEQ ID NO: 5243 - DNA, 1716 bp, Sulfolobus solfataricus; identical to SEQ ID NO: 711
  CDS (1)..(1716)

SEQ ID NO: 5244 - protein, 571 aa, Sulfolobus solfataricus; identical to SEQ ID NO: 712

SEQ ID NO: 5245 - DNA, 2001 bp, Sulfolobus solfataricus; identical to SEQ ID NO: 713
  CDS (1)..(2001)

SEQ ID NO: 5246 - protein, 666 aa, Sulfolobus solfataricus; identical to SEQ ID NO: 714

SEQ ID NO: 5247 - DNA, 1959 bp, Escherichia coli; identical to SEQ ID NO: 715
  CDS (1)..(1959)

SEQ ID NO: 5248 - protein, 652 aa, Escherichia coli; identical to SEQ ID NO: 716

SEQ ID NO: 5249 - DNA, 1533 bp, Aquifex aeolicus; identical to SEQ ID NO: 717
  CDS (1)..(1533)

SEQ ID NO: 5250 - protein, 510 aa, Aquifex aeolicus; identical to SEQ ID NO: 718

SEQ ID NO: 5251 - DNA, 1950 bp, Deinococcus radiodurans; identical to SEQ ID NO: 719
  CDS (1)..(1950)

SEQ ID NO: 5252 - protein, 649 aa, Deinococcus radiodurans [sequence omitted]

SEQ ID NO: 5253 - DNA, 1929 bp, Deinococcus radiodurans; identical to SEQ ID NO: 721
  CDS (1)..(1929)

SEQ ID NO: 5254 - protein, 642 aa, Deinococcus radiodurans; identical to SEQ ID NO: 722

SEQ ID NO: 5255 - DNA, 1899 bp, Vibrio cholerae; identical to SEQ ID NO: 723
  CDS (1)..(1899)

SEQ ID NO: 5256 - protein, 632 aa, Vibrio cholerae; identical to SEQ ID NO: 724

SEQ ID NO: 5257 - DNA, 1956 bp, Pseudomonas aeruginosa; identical to SEQ ID NO: 725
  CDS (1)..(1956)

SEQ ID NO: 5258 - protein, 651 aa, Pseudomonas aeruginosa [sequence omitted]

SEQ ID NO: 5259 - DNA, 1497 bp, Sulfolobus solfataricus; identical to SEQ ID NO: 727
  CDS (1)..(1497)

SEQ ID NO: 5260 - protein, 498 aa, Sulfolobus solfataricus; identical to SEQ ID NO: 728

SEQ ID NO: 5261 - DNA, 1869 bp, Sulfolobus solfataricus; identical to SEQ ID NO: 729
  CDS (1)..(1869)

SEQ ID NO: 5262 - protein, 622 aa, Sulfolobus solfataricus; identical to SEQ ID NO: 730

SEQ ID NO: 5263 - DNA, 1989 bp, Helicobacter pylori; identical to SEQ ID NO: 731
  CDS (1)..(1989)

SEQ ID NO: 5264 - protein, 662 aa, Helicobacter pylori [sequence omitted]

SEQ ID NO: 5265 - DNA, 1989 bp, Archaeoglobus fulgidus; identical to SEQ ID NO: 733
  CDS (1)..(1989)

SEQ ID NO: 5266 - protein, 662 aa, Archaeoglobus fulgidus; identical to SEQ ID NO: 734

SEQ ID NO: 5267 - DNA, 1932 bp, Archaeoglobus fulgidus; identical to SEQ ID NO: 735
  CDS (1)..(1932)

SEQ ID NO: 5268 - protein, 643 aa, Archaeoglobus fulgidus; identical to SEQ ID NO: 736

SEQ ID NO: 5269 - DNA, 1542 bp, Aeropyrum pernix; identical to SEQ ID NO: 737
  CDS (1)..(1542)

SEQ ID NO: 5270 - protein, 513 aa, Aeropyrum pernix; identical to SEQ ID NO: 738

SEQ ID NO: 5271 - DNA, 1944 bp, Xylella fastidiosa; identical to SEQ ID NO: 739
  CDS (1)..(1944)

SEQ ID NO: 5272 - protein, 647 aa, Xylella fastidiosa [sequence omitted]

SEQ ID NO: 5273 - DNA, 1827 bp, Sulfolobus solfataricus; identical to SEQ ID NO: 741
  CDS (1)..(1827)

SEQ ID NO: 5274 - protein, 608 aa, Sulfolobus solfataricus; identical to SEQ ID NO: 742

SEQ ID NO: 5275 - DNA, 1959 bp, Sulfolobus solfataricus; identical to SEQ ID NO: 743
  CDS (1)..(1959)

SEQ ID NO: 5276 - protein, 652 aa, Sulfolobus solfataricus; identical to SEQ ID NO: 744

SEQ ID NO: 5277 - DNA, 2046 bp, Archaeoglobus fulgidus; identical to SEQ ID NO: 745
  CDS (1)..(2046)

SEQ ID NO: 5278 - protein, 681 aa, Archaeoglobus fulgidus; identical to SEQ ID NO: 746

SEQ ID NO: 5279 - DNA, 1761 bp, Archaeoglobus fulgidus; identical to SEQ ID NO: 747
  CDS (1)..(1761)

SEQ ID NO: 5280 - protein, 586 aa, Archaeoglobus fulgidus; identical to SEQ ID NO: 748

SEQ ID NO: 5281 - DNA, 1983 bp, Aeropyrum pernix; identical to SEQ ID NO: 749
  CDS (1)..(1983)

SEQ ID NO: 5282 - protein, 660 aa, Aeropyrum pernix; identical to SEQ ID NO: 750

SEQ ID NO: 5283 - DNA, 1677 bp, Methanobacterium thermoautotrophicum; identical to SEQ ID NO: 751
  CDS (1)..(1677)

SEQ ID NO: 5284 - protein, 558 aa, Methanobacterium thermoautotrophicum; identical to SEQ ID NO: 752

SEQ ID NO: 5285 - DNA, 1929 bp, Archaeoglobus fulgidus; identical to SEQ ID NO: 753
  CDS (1)..(1929)

SEQ ID NO: 5286 - protein, 642 aa, Archaeoglobus fulgidus; identical to SEQ ID NO: 754

SEQ ID NO: 5287 - DNA, 1974 bp, Campylobacter jejuni; identical to SEQ ID NO: 755
  CDS (1)..(1974)

SEQ ID NO: 5288 - protein, 657 aa, Campylobacter jejuni [sequence omitted]

SEQ ID NO: 5289 - DNA, 1956 bp, Pseudomonas aeruginosa; identical to SEQ ID NO: 757
  CDS (1)..(1956)

SEQ ID NO: 5290 - protein, 651 aa, Pseudomonas aeruginosa; identical to SEQ ID NO: 758

SEQ ID NO: 5291 - DNA, 1887 bp, Pseudomonas aeruginosa; identical to SEQ ID NO: 759
  CDS (1)..(1887)

SEQ ID NO: 5292 - protein, 628 aa, Pseudomonas aeruginosa [sequence omitted]

SEQ ID NO: 5293 - DNA, 1971 bp, Halobacterium sp. NRC-1; identical to SEQ ID NO: 761
  CDS (1)..(1971)

SEQ ID NO: 5294 - protein, 656 aa, Halobacterium sp. NRC-1; identical to SEQ ID NO: 762

SEQ ID NO: 5295 - DNA, 1719 bp, Bacillus subtilis; identical to SEQ ID NO: 763
  CDS (1)..(1719)

SEQ ID NO: 5296 - protein, 572 aa, Bacillus subtilis; identical to SEQ ID NO: 764

SEQ ID NO: 5297 - DNA, 2019 bp, Phycomyces blakesleeanus; identical to SEQ ID NO: 765
  CDS (1)..(2019)

SEQ ID NO: 5298 - protein, 672 aa, Phycomyces blakesleeanus [sequence omitted]

SEQ ID NO: 5299 - DNA, 2674 bp, Drosophila melanogaster; identical to SEQ ID NO: 767
  CDS (419)..(2164)

SEQ ID NO: 5300 - protein, 581 aa, Drosophila melanogaster; identical to SEQ ID NO: 768

SEQ ID NO: 5301 - DNA, 1962 bp, Synechocystis sp; identical to SEQ ID NO: 769
  CDS (1)..(1962)

SEQ ID NO: 5302 - protein, 653 aa, Synechocystis sp [sequence omitted]

SEQ ID NO: 5303 - DNA, 2013 bp, Emericella nidulans, Aspergillus nidulans; identical to SEQ ID NO: 771
  CDS (1)..(2013)

SEQ ID NO: 5304 - protein, 670 aa, Emericella nidulans, Aspergillus nidulans [sequence omitted]

SEQ ID NO: 5305 - DNA, 1881 bp, Neurospora crassa; identical to SEQ ID NO: 773
  CDS (1)..(1881)

SEQ ID NO: 5306 - protein, 626 aa, Neurospora crassa [sequence omitted]

SEQ ID NO: 5307 - DNA, 1971 bp, Rhodobacter capsulatus; identical to SEQ ID NO: 775
  CDS (1)..(1971)

SEQ ID NO: 5308 - protein, 656 aa, Rhodobacter capsulatus [sequence omitted]

SEQ ID NO: 5309 - DNA, 2043 bp, Caenorhabditis elegans; identical to SEQ ID NO: 777
  CDS (1)..(2043)

SEQ ID NO: 5310 - protein, 680 aa, Caenorhabditis elegans; identical to SEQ ID NO: 778

SEQ ID NO: 5311 - DNA, 1956 bp, Streptomyces coelicolor; identical to SEQ ID NO: 779
  CDS (1)..(1956)

SEQ ID NO: 5312 - protein, 651 aa, Streptomyces coelicolor; identical to SEQ ID NO: 780

SEQ ID NO: 5313 - DNA, 1989 bp, Schizosaccharomyces pombe; identical to SEQ ID NO: 781
  CDS (1)..(1989)

SEQ ID NO: 5314 - protein, 662 aa, Schizosaccharomyces pombe [sequence omitted]

SEQ ID NO: 5315 - DNA, 2013 bp, Pyrobaculum aerophilum; identical to SEQ ID NO: 783
  CDS (1)..(2013)

SEQ ID NO: 5316 - protein, 670 aa, Pyrobaculum aerophilum [sequence omitted]

SEQ ID NO: 5317 - DNA, 2010 bp, Penicillium chrysogenum; identical to SEQ ID NO: 785
  CDS (1)..(2010)

SEQ ID NO: 5318 - protein, 669 aa, Penicillium chrysogenum; identical to SEQ ID NO: 786

SEQ ID NO: 5319 - DNA, 2323 bp, Homo sapiens; identical to SEQ ID NO: 787
  CDS (92)..(2152)

SEQ ID NO: 5320 - protein, 686 aa, Homo sapiens; identical to SEQ ID NO: 788

SEQ ID NO: 5321 - DNA, 1950 bp, Pseudomonas putida; identical to SEQ ID NO: 789
  CDS (1)..(1950)

SEQ ID NO: 5322 - protein, 649 aa, Pseudomonas putida; identical to SEQ ID NO: 790

SEQ ID NO: 5323 - DNA, 2444 bp, Lysobacter; identical to SEQ ID NO: 791
  CDS (337)..(2232)

SEQ ID NO: 5324 - protein, 631 aa, Lysobacter; identical to SEQ ID NO: 792

SEQ ID NO: 5325 - DNA, 2016 bp, Debaryomyces hansenii; identical to SEQ ID NO: 793
  CDS (1)..(2016)

SEQ ID NO: 5326 - protein, 671 aa, Debaryomyces hansenii; identical to SEQ ID NO: 794

SEQ ID NO: 5327 - DNA, 2040 bp, Debaryomyces hansenii; identical to SEQ ID NO: 795
  CDS (1)..(2040)

SEQ ID NO: 5328 - protein, 679 aa, Debaryomyces hansenii; identical to SEQ ID NO: 796

SEQ ID NO: 5329 - DNA, 1974 bp, Yarrowia lipolytica; identical to SEQ ID NO: 797
  CDS (1)..(1974)

SEQ ID NO: 5330 - protein, 657 aa, Yarrowia lipolytica; identical to SEQ ID NO: 798

SEQ ID NO: 5331 - DNA, 2124 bp, Kluyveromyces lactis; identical to SEQ ID NO: 799
  CDS (1)..(2124)

SEQ ID NO: 5332 - protein, 707 aa, Kluyveromyces lactis; identical to SEQ ID NO: 800

SEQ ID NO: 5333 - DNA, 1962 bp, Pseudomonas putida; identical to SEQ ID NO: 801
  CDS (1)..(1962)

SEQ ID NO: 5334 - protein, 653 aa, Pseudomonas putida; identical to SEQ ID NO: 802

SEQ ID NO: 5335 - DNA, 1644 bp, Acinetobacter sp; identical to SEQ ID NO: 803
  CDS (1)..(1644)

SEQ ID NO: 5336 - protein, 547 aa, Acinetobacter sp; identical to SEQ ID NO: 804

SEQ ID NO: 5337 - DNA, 1644 bp, Acinetobacter sp; identical to SEQ ID NO: 805
  CDS (1)..(1644)

SEQ ID NO: 5338 - protein, 547 aa, Acinetobacter sp; identical to SEQ ID NO: 806

SEQ ID NO: 5339 - DNA, 2115 bp, Candida glabrata; identical to SEQ ID NO: 807
  CDS (1)..(2115)

SEQ ID NO: 5340 - protein, 704 aa, Candida glabrata; identical to SEQ ID NO: 808

SEQ ID NO: 5341 - DNA, 2052 bp, Candida glabrata; identical to SEQ ID NO: 809
  CDS (1)..(2052)

SEQ ID NO: 5342 - protein, 683 aa, Candida glabrata; identical to SEQ ID NO: 810

SEQ ID NO: 5343 - DNA, 1959 bp, Bartonella quintana; identical to SEQ ID NO: 811
  CDS (1)..(1959)

SEQ ID NO: 5344 - protein, 652 aa, Bartonella quintana; identical to SEQ ID NO: 812

SEQ ID NO: 5345 - DNA, 1959 bp, Bartonella henselae; identical to SEQ ID NO: 813
  CDS (1)..(1959)

SEQ ID NO: 5346 - protein, 652 aa, Bartonella henselae; identical to SEQ ID NO: 814

SEQ ID NO: 5347 - DNA, 2763 bp, Oryza sativa; identical to SEQ ID NO: 815
  CDS (355)..(2472)

SEQ ID NO: 5348 - protein, 705 aa, Oryza sativa; identical to SEQ ID NO: 816

SEQ ID NO: 5349 - DNA, 1941 bp, Bacillus thuringiensis serovar konkukian str; identical to SEQ ID NO: 817
  CDS (1)..(1941)

SEQ ID NO: 5350 - protein, 646 aa, Bacillus thuringiensis serovar konkukian str; identical to SEQ ID NO: 818

SEQ ID NO: 5351 - DNA, 1953 bp, Picrophilus torridus; identical to SEQ ID NO: 819
  CDS (1)..(1953)

SEQ ID NO: 5352 - protein, 650 aa, Picrophilus torridus; identical to SEQ ID NO: 820

SEQ ID NO: 5353 - DNA, 2994 bp, Plasmodium falciparum; identical to SEQ ID NO: 821
  CDS (1)..(2994)

SEQ ID NO: 5354 - protein, 997 aa, Plasmodium falciparum; identical to SEQ ID NO: 822

SEQ ID NO: 5355 - DNA, 2007 bp, Photobacterium profundum; identical to SEQ ID NO: 823
  CDS (1)..(2007)

SEQ ID NO: 5356 - protein, 668 aa, Photobacterium profundum; identical to SEQ ID NO: 824

SEQ ID NO: 5357 - DNA, 1899 bp, Photobacterium profundum; identical to SEQ ID NO: 825
  CDS (1)..(1899)

SEQ ID NO: 5358 - protein, 632 aa, Photobacterium profundum; identical to SEQ ID NO: 826

SEQ ID NO: 5359 - DNA, 1950 bp, Photobacterium profundum; identical to SEQ ID NO: 827
  CDS (1)..(1950)

SEQ ID NO: 5360 - protein, 649 aa, Photobacterium profundum; identical to SEQ ID NO: 828

SEQ ID NO: 5361 - DNA, 1674 bp, Methanococcus maripaludis; identical to SEQ ID NO: 829
  CDS (1)..(1674)

SEQ ID NO: 5362 - protein, 557 aa, Methanococcus maripaludis; identical to SEQ ID NO: 830

SEQ ID NO: 5363 - DNA, 1911 bp, Methanococcus maripaludis; identical to SEQ ID NO: 831
  CDS (1)..(1911)

SEQ ID NO: 5364 - protein, 636 aa, Methanococcus maripaludis; identical to SEQ ID NO: 832

SEQ ID NO: 5365 - DNA, 1938 bp, Bdellovibrio bacteriovorus; identical to SEQ ID NO: 833
  CDS (1)..(1938)

SEQ ID NO: 5366 - protein, 645 aa, Bdellovibrio bacteriovorus; identical to SEQ ID NO: 834

SEQ ID NO: 5367 - DNA, 1911 bp, Rhodopseudomonas palustris; identical to SEQ ID NO: 835
  CDS (1)..(1911)

SEQ ID NO: 5368 - protein, 636 aa, Rhodopseudomonas palustris; identical to SEQ ID NO: 836

SEQ ID NO: 5369 - DNA, 1692 bp, Rhodopseudomonas palustris; identical to SEQ ID NO: 837
  CDS (1)..(1692)

SEQ ID NO: 5370 - protein, 563 aa, Rhodopseudomonas palustris; identical to SEQ ID NO: 838

SEQ ID NO: 5371 - DNA, 1953 bp, Rhodopseudomonas palustris; identical to SEQ ID NO: 839
  CDS (1)..(1953)

SEQ ID NO: 5372 - protein, 650 aa, Rhodopseudomonas palustris; identical to SEQ ID NO: 840

SEQ ID NO: 5373 - DNA, 1959 bp, uncultured bacterium 314; identical to SEQ ID NO: 841
  CDS (1)..(1959)

SEQ ID NO: 5374 - protein, 652 aa, uncultured bacterium 314; identical to SEQ ID NO: 842

SEQ ID NO: 5375 - DNA, 1938 bp, uncultured bacterium 311; identical to SEQ ID NO: 843
  CDS (1)..(1938)

SEQ ID NO: 5376 - protein, 645 aa, uncultured bacterium 311; identical to SEQ ID NO: 844

SEQ ID NO: 5377 - DNA, 1743 bp, Rattus norvegicus; identical to SEQ ID NO: 845
  CDS (1)..(1743)

SEQ ID NO: 5378 - protein, 580 aa, Rattus norvegicus; identical to SEQ ID NO: 846

SEQ ID NO: 5379 - DNA, 1740 bp, Klebsiella pneumoniae; identical to SEQ ID NO: 847
  CDS (1)..(1740)

SEQ ID NO: 5380 - protein, 579 aa, Klebsiella pneumoniae; identical to SEQ ID NO: 848

SEQ ID NO: 5381 - DNA, 1821 bp, Homo sapiens; identical to SEQ ID NO: 849
  CDS (1)..(1821)

SEQ ID NO: 5382 - protein, 606 aa, Homo sapiens; identical to SEQ ID NO: 850

SEQ ID NO: 5383 - DNA, 1716 bp, Thermoproteus tenax; identical to SEQ ID NO: 851
  CDS (1)..(1716)

SEQ ID NO: 5384 - protein, 571 aa, Thermoproteus tenax; identical to SEQ ID NO: 852

SEQ ID NO: 5385 - DNA, 2118 bp, Agrobacterium vitis; identical to SEQ ID NO: 853
  CDS (1)..(2118)

SEQ ID NO: 5386 - protein, 705 aa, Agrobacterium vitis; identical to SEQ ID NO: 854

SEQ ID NO: 5387 - DNA, 1578 bp, Listeria monocytogenes; identical to SEQ ID NO: 855
  CDS (1)..(1578)

SEQ ID NO: 5388 - protein, 525 aa, Listeria monocytogenes; identical to SEQ ID NO: 856

SEQ ID NO: 5389 - DNA, 1986 bp, Desulfovibrio vulgaris; identical to SEQ ID NO: 857
  CDS (1)..(1986)

SEQ ID NO: 5390 - protein, 661 aa, Desulfovibrio vulgaris; identical to SEQ ID NO: 858

SEQ ID NO: 5391 - DNA, 1656 bp, Desulfovibrio vulgaris; identical to SEQ ID NO: 859
  CDS (1)..(1656)

SEQ ID NO: 5392 - protein, 551 aa, Desulfovibrio vulgaris; identical to SEQ ID NO: 860

SEQ ID NO: 5393 - DNA, 1947 bp, Desulfovibrio vulgaris; identical to SEQ ID NO: 861
  CDS (1)..(1947)

SEQ ID NO: 5394 - protein, 648 aa, Desulfovibrio vulgaris; identical to SEQ ID NO: 862

SEQ ID NO: 5395 - DNA, 1890 bp, Thermus thermophilus; identical to SEQ ID NO: 863
  CDS (1)..(1890)

SEQ ID NO: 5396 - protein, 629 aa, Thermus thermophilus; identical to SEQ ID NO: 864

SEQ ID NO: 5397 - DNA, 1884 bp, Thermus thermophilus; identical to SEQ ID NO: 865
  CDS (1)..(1884)

SEQ ID NO: 5398 - protein, 627 aa, Thermus thermophilus; identical to SEQ ID NO: 866

SEQ ID NO: 5399 - DNA, 2538 bp, Thermus thermophilus; identical to SEQ ID NO: 867
  CDS (1)..(2538)

SEQ ID NO: 5400 - protein, 845 aa, Thermus thermophilus; identical to SEQ ID NO: 868

SEQ ID NO: 5401 - DNA, 1947 bp, Thermus thermophilus; identical to SEQ ID NO: 869
  CDS (1)..(1947)

SEQ ID NO: 5402 - protein, 648 aa, Thermus thermophilus; identical to SEQ ID NO: 870

SEQ ID NO: 5403 - DNA, 1719 bp, Bacillus cereus; identical to SEQ ID NO: 871
  CDS (1)..(1719)

SEQ ID NO: 5404 - protein, 572 aa, Bacillus cereus; identical to SEQ ID NO: 872

SEQ ID NO: 5405 - DNA, 1653 bp, Treponema denticola; identical to SEQ ID NO: 873
  CDS (1)..(1653)

SEQ ID NO: 5406 - protein, 550 aa, Treponema denticola; identical to SEQ ID NO: 874

SEQ ID NO: 5407 - DNA, 1953 bp, Mycobacterium paratuberculosis; identical to SEQ ID NO: 875
  CDS (1)..(1953)

SEQ ID NO: 5408 - protein, 650 aa, Mycobacterium paratuberculosis; identical to SEQ ID NO: 876

SEQ ID NO: 5409 - DNA, 2064 bp, Ashbya gossypii; identical to SEQ ID NO: 877
  CDS (1)..(2064)

SEQ ID NO: 5410 - protein, 687 aa, Ashbya gossypii; identical to SEQ ID NO: 878

SEQ ID NO: 5411 - DNA, 2085 bp, Ashbya gossypii; identical to SEQ ID NO: 879
  CDS (1)..(2085)

SEQ ID NO: 5412 - protein, 694 aa, Ashbya gossypii; identical to SEQ ID NO: 880

SEQ ID NO: 5413 - DNA, 1977 bp, Dictyostelium discoideum; identical to SEQ ID NO: 881
  CDS (1)..(1977)

SEQ ID NO: 5414 - protein, 658 aa, Dictyostelium discoideum; identical to SEQ ID NO: 882

SEQ ID NO: 5415 - DNA, 2046 bp, Dictyostelium discoideum; identical to SEQ ID NO: 883
  CDS (1)..(2046)

SEQ ID NO: 5416 - protein, 681 aa, Dictyostelium discoideum; identical to SEQ ID NO: 884

SEQ ID NO: 5417 - DNA, 2316 bp, Oryza sativa; identical to SEQ ID NO: 885
  CDS (1)..(2316)

SEQ ID NO: 5418 - protein, 771 aa, Oryza sativa; identical to SEQ ID NO: 886

SEQ ID NO: 5419 - DNA, 1965 bp, Wolinella succinogenes; identical to SEQ ID NO: 887
  CDS (1)..(1965)

SEQ ID NO: 5420 - protein, 654 aa, Wolinella succinogenes; identical to SEQ ID NO: 888

SEQ ID NO: 5421 - DNA, 1956 bp, Photorhabdus luminescens; identical to SEQ ID NO: 889
  CDS (1)..(1956)

SEQ ID NO: 5422 - protein, 651 aa, Photorhabdus luminescens; identical to SEQ ID NO: 890

SEQ ID NO: 5423 - DNA, 2043 bp, Vibrio vulnificus; identical to SEQ ID NO: 891
  CDS (1)..(2043)

SEQ ID NO: 5424 - protein, 680 aa, Vibrio vulnificus; identical to SEQ ID NO: 892

SEQ ID NO: 5425 - DNA, 2013 bp, Vibrio vulnificus; identical to SEQ ID NO: 893
  CDS (1)..(2013)

SEQ ID NO: 5426 - protein, 670 aa, Vibrio vulnificus; identical to SEQ ID NO: 894

SEQ ID NO: 5427 - DNA, 1887 bp, Photorhabdus luminescens; identical to SEQ ID NO: 895
  CDS (1)..(1887)

SEQ ID NO: 5428 - protein, 628 aa, Photorhabdus luminescens; identical to SEQ ID NO: 896

SEQ ID NO: 5429 - DNA, 1944 bp, Gloeobacter violaceus; identical to SEQ ID NO: 897
  CDS (1)..(1944)

SEQ ID NO: 5430 - protein, 647 aa, Gloeobacter violaceus; identical to SEQ ID NO: 898

SEQ ID NO: 5431 - DNA, 1965 bp, Chromobacterium violaceum; identical to SEQ ID NO: 899
  CDS (1)..(1965)

SEQ ID NO: 5432 - protein, 654 aa, Chromobacterium violaceum; identical to SEQ ID NO: 900

SEQ ID NO: 5433 - DNA, 1962 bp, Chromobacterium violaceum; identical to SEQ ID NO: 901
  CDS (1)..(1962)

SEQ ID NO: 5434 - protein, 653 aa, Chromobacterium violaceum; identical to SEQ ID NO: 902

SEQ ID NO: 5435 - DNA, 1713 bp, Anopheles gambiae str; identical to SEQ ID NO: 903
  CDS (1)..(1713)

SEQ ID NO: 5436 - protein, 570 aa, Anopheles gambiae str; identical to SEQ ID NO: 904

SEQ ID NO: 5437 - DNA, 2856 bp, Plasmodium yoelii yoelii; identical to SEQ ID NO: 905
  CDS (1)..(2856)

SEQ ID NO: 5438 - protein, 951 aa, Plasmodium yoelii yoelii; identical to SEQ ID NO: 906

SEQ ID NO: 5439 - DNA, 2130 bp, Neurospora crassa; identical to SEQ ID NO: 907
  CDS (1)..(2130)

SEQ ID NO: 5440 - protein, 709 aa, Neurospora crassa; identical to SEQ ID NO: 908

SEQ ID NO: 5441 - DNA, 2070 bp, Synechococcus sp; identical to SEQ ID NO: 909
  CDS (1)..(2070)

SEQ ID NO: 5442 - protein, 689 aa, Synechococcus sp; identical to SEQ ID NO: 910

SEQ ID NO: 5443 - DNA, 1983 bp, Prochlorococcus marinus subsp; identical to SEQ ID NO: 911
  CDS (1)..(1983)

SEQ ID NO: 5444 - protein, 660 aa, Prochlorococcus marinus subsp; identical to SEQ ID NO: 912

SEQ ID NO: 5445 - DNA, 1977 bp, Prochlorococcus marinus; identical to SEQ ID NO: 913
  CDS (1)..(1977)

SEQ ID NO: 5446 - protein, 658 aa, Prochlorococcus marinus; identical to SEQ ID NO: 914

SEQ ID NO: 5447 - DNA, 1977 bp, Prochlorococcus marinus; identical to SEQ ID NO: 915
  CDS (1)..(1977)

SEQ ID NO: 5448 - protein, 658 aa, Prochlorococcus marinus; identical to SEQ ID NO: 916

SEQ ID NO: 5449 - DNA, 1902 bp, Helicobacter hepaticus; identical to SEQ ID NO: 917
  CDS (1)..(1902)

SEQ ID NO: 5450 - protein, 633 aa, Helicobacter hepaticus; identical to SEQ ID NO: 918

SEQ ID NO: 5451 - DNA, 1890 bp, Bordetella parapertussis; identical to SEQ ID NO: 919
  CDS (1)..(1890)

SEQ ID NO: 5452 - protein, 629 aa, Bordetella parapertussis; identical to SEQ ID NO: 920

SEQ ID NO: 5453 - DNA, 2046 bp, Bordetella parapertussis; identical to SEQ ID NO: 921
  CDS (1)..(2046)

SEQ ID NO: 5454 - protein, 681 aa, Bordetella parapertussis; identical to SEQ ID NO: 922

SEQ ID NO: 5455 - DNA, 1950 bp, Bordetella bronchiseptica; identical to SEQ ID NO: 923
  CDS (1)..(1950)

SEQ ID NO: 5456 - protein, 649 aa, Bordetella bronchiseptica; identical to SEQ ID NO: 924

SEQ ID NO: 5457 - DNA, 3626 bp, Homo sapiens; identical to SEQ ID NO: 925
  CDS (6)..(2069)

SEQ ID NO: 5458 - protein, 687 aa, Homo sapiens [sequence omitted]

SEQ ID NO: 5459 - DNA, 1941 bp, Bacillus cereus; identical to SEQ ID NO: 927
  CDS (1)..(1941)

SEQ ID NO: 5460 - protein, 646 aa, Bacillus cereus; identical to SEQ ID NO: 928

SEQ ID NO: 5461 - DNA, 1968 bp, Streptomyces avermitilis; identical to SEQ ID NO: 929
  CDS (1)..(1968)

SEQ ID NO: 5462 - protein, 655 aa, Streptomyces avermitilis; identical to SEQ ID NO: 930

SEQ ID NO: 5463 - DNA, 2019 bp, Streptomyces avermitilis; identical to SEQ ID NO: 931
  CDS (1)..(2019)

SEQ ID NO: 5464 - protein, 672 aa, Streptomyces avermitilis; identical to SEQ ID NO: 932

SEQ ID NO: 5465 - DNA, 1953 bp, Coxiella burnetii; identical to SEQ ID NO: 933
  CDS (1)..(1953)

SEQ ID NO: 5466 - protein, 650 aa, Coxiella burnetii; identical to SEQ ID NO: 934

SEQ ID NO: 5467 - DNA, 1968 bp, Dictyostelium discoideum; identical to SEQ ID NO: 935
  CDS (1)..(1968)

SEQ ID NO: 5468 - protein, 655 aa, Dictyostelium discoideum; identical to SEQ ID NO: 936

SEQ ID NO: 5469 - DNA, 1956 bp, Dictyostelium discoideum; identical to SEQ ID NO: 937
  CDS (1)..(1956)

SEQ ID NO: 5470 - protein, 651 aa, Dictyostelium discoideum; identical to SEQ ID NO: 938

SEQ ID NO: 5471 - DNA, 1968 bp, Dictyostelium discoideum; identical to SEQ ID NO: 939
  CDS (1)..(1968)

SEQ ID NO: 5472 - protein, 655 aa, Dictyostelium discoideum; identical to SEQ ID NO: 940

SEQ ID NO: 5473 - DNA, 1944 bp, Dictyostelium discoideum; identical to SEQ ID NO: 941
  CDS (1)..(1944)

SEQ ID NO: 5474 - protein, 647 aa, Dictyostelium discoideum; identical to SEQ ID NO: 942

SEQ ID NO: 5475 - DNA, 1941 bp, Dictyostelium discoideum; identical to SEQ ID NO: 943
  CDS (1)..(1941)

SEQ ID NO: 5476 - protein, 646 aa, Dictyostelium discoideum; identical to SEQ ID NO: 944

SEQ ID NO: 5477 - DNA, 2085 bp, Neurospora crassa; identical to SEQ ID NO: 945
  CDS (1)..(2085)

SEQ ID NO: 5478 - protein, 694 aa, Neurospora crassa; identical to SEQ ID NO: 946

SEQ ID NO: 5479 - DNA, 2034 bp, Vibrio parahaemolyticus; identical to SEQ ID NO: 947
  CDS (1)..(2034)

SEQ ID NO: 5480 - protein, 677 aa, Vibrio parahaemolyticus; identical to SEQ ID NO: 948

SEQ ID NO: 5481 - DNA, 1971 bp, Vibrio parahaemolyticus; identical to SEQ ID NO: 949
  CDS (1)..(1971)

SEQ ID NO: 5482 - protein, 656 aa, Vibrio parahaemolyticus; identical to SEQ ID NO: 950

SEQ ID NO: 5483 - DNA, 1905 bp, Vibrio parahaemolyticus; identical to SEQ ID NO: 951
  CDS (1)..(1905)

SEQ ID NO: 5484 - protein, 634 aa, Vibrio parahaemolyticus; identical to SEQ ID NO: 952

SEQ ID NO: 5485 - DNA, 1953 bp, Pseudomonas putida; identical to SEQ ID NO: 953
  CDS (1)..(1953)

SEQ ID NO: 5486 - protein, 650 aa, Pseudomonas putida; identical to SEQ ID NO: 954

SEQ ID NO: 5487 - DNA, 1890 bp, Pseudomonas putida; identical to SEQ ID NO: 955
  CDS (1)..(1890)

SEQ ID NO: 5488 - protein, 629 aa, Pseudomonas putida; identical to SEQ ID NO: 956

SEQ ID NO: 5489 - DNA, 1686 bp, Pseudomonas putida; identical to SEQ ID NO: 957
  CDS (1)..(1686)

SEQ ID NO: 5490 - protein, 561 aa, Pseudomonas putida; identical to SEQ ID NO: 958

SEQ ID NO: 5491 - DNA, 1689 bp, Bradyrhizobium japonicum; identical to SEQ ID NO: 959
  CDS (1)..(1689)

SEQ ID NO: 5492 - protein, 562 aa, Bradyrhizobium japonicum; identical to SEQ ID NO: 960

SEQ ID NO: 5493 - DNA, 2049 bp, Bradyrhizobium japonicum; identical to SEQ ID NO: 961
  CDS (1)..(2049)

SEQ ID NO: 5494 - protein, 682 aa, Bradyrhizobium japonicum; identical to SEQ ID NO: 962

SEQ ID NO: 5495 - DNA, 1911 bp, Bradyrhizobium japonicum; identical to SEQ ID NO: 963
  CDS (1)..(1911)

SEQ ID NO: 5496 - protein, 636 aa, Bradyrhizobium japonicum; identical to SEQ ID NO: 964

SEQ ID NO: 5497 - DNA, 1656 bp, Bacteroides thetaiotaomicron; identical to SEQ ID NO: 965
  CDS (1)..(1656)

SEQ ID NO: 5498 - protein, 551 aa, Bacteroides thetaiotaomicron; identical to SEQ ID NO: 966

SEQ ID NO: 5499 - DNA, 2495 bp, Mus musculus; identical to SEQ ID NO: 967
  CDS (87)..(1580)

SEQ ID NO: 5500 - protein, 497 aa, Mus musculus; identical to SEQ ID NO: 968

SEQ ID NO: 5501 - DNA, 1881 bp, Vibrio vulnificus; identical to SEQ ID NO: 969
  CDS (1)..(1881)

SEQ ID NO: 5502 - protein, 626 aa, Vibrio vulnificus; identical to SEQ ID NO: 970

SEQ ID NO: 5503 - DNA, 1986 bp, Oceanobacillus iheyensis; identical to SEQ ID NO: 971
  CDS (1)..(1986)

SEQ ID NO: 5504 - protein, 661 aa, Oceanobacillus iheyensis; identical to SEQ ID NO: 972

SEQ ID NO: 5505 - DNA, 1716 bp, Oceanobacillus iheyensis; identical to SEQ ID NO: 973
  CDS (1)..(1716)

SEQ ID NO: 5506 - protein, 571 aa, Oceanobacillus iheyensis; identical to SEQ ID NO: 974

SEQ ID NO: 5507 - DNA, 1887 bp, Escherichia coli O6; identical to SEQ ID NO: 975
  CDS (1)..(1887)

SEQ ID NO: 5508 - protein, 628 aa, Escherichia coli O6; identical to SEQ ID NO: 976

SEQ ID NO: 5509 - DNA, 1671 bp, Brucella suis; identical to SEQ ID NO: 977
  CDS (1)..(1671)

SEQ ID NO: 5510 - protein, 556 aa, Brucella suis; identical to SEQ ID NO: 978

SEQ ID NO: 5511 - DNA, 1989 bp, Brucella suis; identical to SEQ ID NO: 979
  CDS (1)..(1989)

SEQ ID NO: 5512 - protein, 662 aa, Brucella suis; identical to SEQ ID NO: 980

SEQ ID NO: 5513 - DNA, 2924 bp, Homo sapiens; identical to SEQ ID NO: 981
  CDS (34)..(2178)

SEQ ID NO: 5514 - protein, 714 aa, Homo sapiens [sequence omitted]

SEQ ID NO: 5515 - DNA, 1899 bp, Encephalitozoon cuniculi; identical to SEQ ID NO: 983
  CDS (1)..(1899)

SEQ ID NO: 5516 - protein, 632 aa, Encephalitozoon cuniculi; identical to SEQ ID NO: 984

SEQ ID NO: 5517 - DNA, 2004 bp, Neurospora crassa; identical to SEQ ID NO: 985
  CDS (1)..(2004)

SEQ ID NO: 5518 - protein, 667 aa, Neurospora crassa; identical to SEQ ID NO: 986

SEQ ID NO: 5519 - DNA, 1899 bp, Ralstonia solanacearum; identical to SEQ ID NO: 987
  CDS (1)..(1899)

SEQ ID NO: 5520 - protein, 632 aa, Ralstonia solanacearum; identical to SEQ ID NO: 988

SEQ ID NO: 5521 - DNA, 1956 bp, Pyrobaculum aerophilum; identical to SEQ ID NO: 989
  CDS (1)..(1956)

SEQ ID NO: 5522 - protein, 651 aa, Pyrobaculum aerophilum; identical to SEQ ID NO: 990

SEQ ID NO: 5523 - DNA, 1881 bp, Pyrobaculum aerophilum; identical to SEQ ID NO: 991
  CDS (1)..(1881)

SEQ ID NO: 5524 - protein, 626 aa, Pyrobaculum aerophilum; identical to SEQ ID NO: 992

SEQ ID NO: 5525 - DNA, 1848 bp, Pyrobaculum aerophilum; identical to SEQ ID NO: 993
  CDS (1)..(1848)

SEQ ID NO: 5526 - protein, 615 aa, Pyrobaculum aerophilum; identical to SEQ ID NO: 994

SEQ ID NO: 5527 - DNA, 1908 bp, Rhizobium meliloti; identical to SEQ ID NO: 995
  CDS (1)..(1908)

SEQ ID NO: 5528 - protein, 635 aa, Rhizobium meliloti; identical to SEQ ID NO: 996

SEQ ID NO: 5529 - DNA, 1647 bp, Rhizobium meliloti; identical to SEQ ID NO: 997
  CDS (1)..(1647)

SEQ ID NO: 5530 - protein, 548 aa, Rhizobium meliloti; identical to SEQ ID NO: 998

SEQ ID NO: 5531 - DNA, 2028 bp, Zygosaccharomyces bailii; identical to SEQ ID NO: 999
  CDS (1)..(2028)

SEQ ID NO: 5532 - protein, 675 aa, Zygosaccharomyces bailii; identical to SEQ ID NO: 1000

SEQ ID NO: 5533 - DNA, 1635 bp, Sulfolobus tokodaii; identical to SEQ ID NO: 1001
  CDS (1)..(1635)

SEQ ID NO: 5534 - protein, 544 aa, Sulfolobus tokodaii; identical to SEQ ID NO: 1002

SEQ ID NO: 5535 - DNA, 1731 bp, Sulfolobus tokodaii; identical to SEQ ID NO: 1003
  CDS (1)..(1731)

SEQ ID NO: 5536 - protein, 576 aa, Sulfolobus tokodaii; identical to SEQ ID NO: 1004

SEQ ID NO: 5537 - DNA, 1986 bp, Sulfolobus tokodaii; identical to SEQ ID NO: 1005
  CDS (1)..(1986)

SEQ ID NO: 5538 - protein, 661 aa, Sulfolobus tokodaii; identical to SEQ ID NO: 1006

SEQ ID NO: 5539 - DNA, 1866 bp, Sulfolobus tokodaii; identical to SEQ ID NO: 1007
  CDS (1)..(1866)

SEQ ID NO: 5540 - protein, 621 aa, Sulfolobus tokodaii; identical to SEQ ID NO: 1008

SEQ ID NO: 5541 - DNA, 1494 bp, Sulfolobus tokodaii; identical to SEQ ID NO: 1009
  CDS (1)..(1494)

SEQ ID NO: 5542 - protein, 497 aa, Sulfolobus tokodaii; identical to SEQ ID NO: 1010

SEQ ID NO: 5543 - DNA, 1980 bp, Sulfolobus tokodaii; identical to SEQ ID NO: 1011
  CDS (1)..(1980)

SEQ ID NO: 5544 - protein, 659 aa, Sulfolobus tokodaii; identical to SEQ ID NO: 1012

SEQ ID NO: 5545 - DNA, 1989 bp, Sulfolobus tokodaii; identical to SEQ ID NO: 1013
  CDS (1)..(1989)

SEQ ID NO: 5546 - protein, 662 aa, Sulfolobus tokodaii; identical to SEQ ID NO: 1014

SEQ ID NO: 5547 - DNA, 1689 bp, Sulfolobus tokodaii; identical to SEQ ID NO: 1015
  CDS (1)..(1689)

SEQ ID NO: 5548 - protein, 562 aa, Sulfolobus tokodaii; identical to SEQ ID NO: 1016

SEQ ID NO: 5549 - DNA, 1860 bp, Thermoplasma volcanium; identical to SEQ ID NO: 1017
  CDS (1)..(1860)

SEQ ID NO: 5550 - protein, 619 aa, Thermoplasma volcanium; identical to SEQ ID NO: 1018

SEQ ID NO: 5551 - DNA, 1926 bp, Thermoplasma volcanium; identical to SEQ ID NO: 1019
  CDS (1)..(1926)

SEQ ID NO: 5552 - protein, 641 aa, Thermoplasma volcanium; identical to SEQ ID NO: 1020

SEQ ID NO: 5553 - DNA, 1953 bp, Thermoplasma volcanium; identical to SEQ ID NO: 1021
  CDS (1)..(1953)

SEQ ID NO: 5554 - protein, 650 aa, Thermoplasma volcanium; identical to SEQ ID NO: 1022

SEQ ID NO: 5555 - DNA, 1959 bp, Rhizobium loti; identical to SEQ ID NO: 1023
  CDS (1)..(1959)

SEQ ID NO: 5556 - protein, 652 aa, Rhizobium loti; identical to SEQ ID NO: 1024

SEQ ID NO: 5557 - DNA, 1689 bp, Rhizobium loti; identical to SEQ ID NO: 1025
  CDS (1)..(1689)

SEQ ID NO: 5558 - protein, 562 aa, Rhizobium loti; identical to SEQ ID NO: 1026

SEQ ID NO: 5559 - DNA, 1929 bp, Rhizobium loti; identical to SEQ ID NO: 1027
  CDS (1)..(1929)

SEQ ID NO: 5560 - protein, 642 aa, Rhizobium loti; identical to SEQ ID NO: 1028

SEQ ID NO: 5561 - DNA, 1680 bp, Rhizobium loti; identical to SEQ ID NO: 1029
  CDS (1)..(1680)

SEQ ID NO: 5562 - protein, 559 aa, Rhizobium loti; identical to SEQ ID NO: 1030

SEQ ID NO: 5563 - DNA, 1686 bp, Pseudomonas putida; identical to SEQ ID NO: 1031
  CDS (1)..(1686)

SEQ ID NO: 5564 - protein, 561 aa, Pseudomonas putida; identical to SEQ ID NO: 1032

SEQ ID NO: 5565 - DNA, 2582 bp, Bos taurus; identical to SEQ ID NO: 1033
  CDS (1)..(2028)

SEQ ID NO: 5566 - protein, 675 aa, Bos taurus; identical to SEQ ID NO: 1034

SEQ ID NO: 5567 - DNA, 1800 bp, Thermoplasma acidophilum; identical to SEQ ID NO: 1035
  CDS (1)..(1800)

SEQ ID NO: 5568 - protein, 599 aa, Thermoplasma acidophilum; identical to SEQ ID NO: 1036

SEQ ID NO: 5569 - DNA, 1944 bp, Thermoplasma acidophilum; identical to SEQ ID NO: 1037
  CDS (1)..(1944)

SEQ ID NO: 5570 - protein, 647 aa, Thermoplasma acidophilum; identical to SEQ ID NO: 1038

SEQ ID NO: 5571 - DNA, 1860 bp, Thermoplasma acidophilum; identical to SEQ ID NO: 1039
  CDS (1)..(1860)

SEQ ID NO: 5572 - protein, 619 aa, Thermoplasma acidophilum; identical to SEQ ID NO: 1040

SEQ ID NO: 5573 - DNA, 1977 bp, Streptomyces coelicolor; identical to SEQ ID NO: 1041
  CDS (1)..(1977)

SEQ ID NO: 5574 - protein, 658 aa, Streptomyces coelicolor; identical to SEQ ID NO: 1042

SEQ ID NO: 5575 - DNA, 2113 bp, Arabidopsis thaliana; identical to SEQ ID NO: 1043
  CDS (1)..(2082)

SEQ ID NO: 5576 - protein, 693 aa, Arabidopsis thaliana; identical to SEQ ID NO: 1044

SEQ ID NO: 5577 - DNA, 2088 bp, Leishmania major; identical to SEQ ID NO: 1045
  CDS (1)..(2088)

SEQ ID NO: 5578 - protein, 695 aa, Leishmania major; identical to SEQ ID NO: 1046

SEQ ID NO: 5579 - DNA, 1956 bp, Tetrahymena pyriformis; identical to SEQ ID NO: 1047
  CDS (1)..(978)

SEQ ID NO: 5580 - protein, 325 aa, Tetrahymena pyriformis; identical to SEQ ID NO: 1048

SEQ ID NO: 5581 - DNA, 2267 bp, Drosophila melanogaster; identical to SEQ ID NO: 1049
  CDS (113)..(2137)

SEQ ID NO: 5582 - protein, 674 aa, Drosophila melanogaster; identical to SEQ ID NO: 1050

SEQ ID NO: 5583 - DNA, 2383 bp, Solanum tuberosum; identical to SEQ ID NO: 1051
  CDS (271)..(2166)

SEQ ID NO: 5584 - protein, 631 aa, Solanum tuberosum; identical to SEQ ID NO: 1052

SEQ ID NO: 5585 - DNA, 3584 bp, Mus musculus; identical to SEQ ID NO: 1053
  CDS (33)..(2081)

SEQ ID NO: 5586 - protein, 682 aa, Mus musculus; identical to SEQ ID NO: 1054

SEQ ID NO: 5587 - DNA, 2052 bp, Kluyveromyces lactis; identical to SEQ ID NO: 1055
  CDS (1)..(2052)

SEQ ID NO: 5588 - protein, 683 aa, Kluyveromyces lactis [sequence omitted]

SEQ ID NO: 5589 - DNA, 2492 bp, Saccharomyces cerevisiae; identical to SEQ ID NO: 1057
  CDS (162)..(2303)

SEQ ID NO: 5590 - protein, 713 aa, Saccharomyces cerevisiae [sequence omitted]

SEQ ID NO: 5591 - DNA, 3543 bp, Kluyveromyces lactis; identical to SEQ ID NO: 1059
  CDS (817)..(2871)

SEQ ID NO: 5592 - protein, 684 aa, Kluyveromyces lactis; identical to SEQ ID NO: 1060

SEQ ID NO: 5593 - DNA, 1935 bp, Pseudomonas putida; identical to SEQ ID NO: 1061
  CDS (1)..(1935)

SEQ ID NO: 5594 - protein, 644 aa, Pseudomonas putida [sequence omitted]

SEQ ID NO: 5595 - DNA, 1950 bp, Rhizobium meliloti; identical to SEQ ID NO: 1063
  CDS (1)..(1950)

SEQ ID NO: 5596 - protein, 649 aa, Rhizobium meliloti [sequence omitted]

SEQ ID NO: 5597 - DNA, 1959 bp, Agrobacterium rhizogenes; identical to SEQ ID NO: 1065
  CDS (1)..(1959)

SEQ ID NO: 5598 - protein, 652 aa, Agrobacterium rhizogenes; identical to SEQ ID NO: 1066

SEQ ID NO: 5599 - DNA, 1956 bp, Agrobacterium tumefaciens; identical to SEQ ID NO: 1067
  CDS (1)..(1956)

SEQ ID NO: 5600 - protein, 651 aa, Agrobacterium tumefaciens; identical to SEQ ID NO: 1068

SEQ ID NO: 5601 - DNA, 1947 bp, Bradyrhizobium japonicum; identical to SEQ ID NO: 1069
  CDS (1)..(1947)

SEQ ID NO: 5602 - protein, 648 aa, Bradyrhizobium japonicum [sequence omitted]

SEQ ID NO: 5603 - DNA, 1956 bp, Brucella suis; identical to SEQ ID NO: 1071
  CDS (1)..(1956)

SEQ ID NO: 5604 - protein, 651 aa, Brucella suis; identical to SEQ ID NO: 1072

SEQ ID NO: 5605 - DNA, 2028 bp, Candida albicans; identical to SEQ ID NO: 1073
  CDS (1)..(2028)

SEQ ID NO: 5606 - protein, 675 aa, Candida albicans [sequence omitted]

SEQ ID NO: 5607 - DNA, 1980 bp, Chlorobium tepidum; identical to SEQ ID NO: 1075
  CDS (1)..(1980)

SEQ ID NO: 5608 - protein, 659 aa, Chlorobium tepidum [sequence omitted]

SEQ ID NO: 5609 - DNA, 2041 bp, Coprinus cinereus; identical to SEQ ID NO: 1077
  CDS (20)..(2005)

SEQ ID NO: 5610 - protein, 661 aa, Coprinus cinereus [sequence omitted]

SEQ ID NO: 5611 - DNA, 2222 bp, Cryptosporidium parvum; identical to SEQ ID NO: 1079
  CDS (70)..(2154)

SEQ ID NO: 5612 - protein, 694 aa, Cryptosporidium parvum [sequence omitted]

SEQ ID NO: 5613 - DNA, 2874 bp, Drosophila melanogaster; identical to SEQ ID NO: 1081
  CDS (451)..(2463)

SEQ ID NO: 5614 - protein, 670 aa, Drosophila melanogaster [sequence omitted]

SEQ ID NO: 5615 - DNA, 1986 bp, Leptospira interrogans; identical to SEQ ID NO: 1083
  CDS (1)..(1986)

SEQ ID NO: 5616 - protein, 661 aa, Leptospira interrogans [sequence omitted]

SEQ ID NO: 5617 - DNA, 2535 bp, Mus musculus; identical to SEQ ID NO: 1085
  CDS (15)..(2120)

SEQ ID NO: 5618 - protein, 701 aa, Mus musculus; identical to SEQ ID NO: 1086

SEQ ID NO: 5619 - DNA, 1956 bp, Mycobacterium bovis; identical to SEQ ID NO: 1087
  CDS (1)..(1956)

SEQ ID NO: 5620 - protein, 651 aa, Mycobacterium bovis [sequence omitted]

SEQ ID NO: 5621 - DNA, 1968 bp, Nitrosomonas europaea; identical to SEQ ID NO: 1089
  CDS (1)..(1968)

SEQ ID NO: 5622 - protein, 655 aa, Nitrosomonas europaea [sequence omitted]

SEQ ID NO: 5623 - DNA, 1962 bp, Pasteurella multocida; identical to SEQ ID NO: 1091
  CDS (1)..(1962)

SEQ ID NO: 5624 - protein, 653 aa, Pasteurella multocida [sequence omitted]

SEQ ID NO: 5625 - DNA, 1926 bp, Gamma; identical to SEQ ID NO: 1093
  CDS (1)..(1926)

SEQ ID NO: 5626 - protein, 641 aa, Gamma [sequence omitted]

SEQ ID NO: 5627 - DNA, 1983 bp, Ralstonia solanacearum; identical to SEQ ID NO: 1095
  CDS (1)..(1983)

SEQ ID NO: 5628 - protein, 660 aa, Ralstonia solanacearum; identical to SEQ ID NO: 1096

SEQ ID NO: 5629 - DNA, 1956 bp, Rhizobium loti; identical to SEQ ID NO: 1097
  CDS (1)..(1956)

SEQ ID NO: 5630 - protein, 651 aa, Rhizobium loti; identical to SEQ ID NO: 1098

SEQ ID NO: 5631 - DNA, 2016 bp, Rhodopirellula baltica; identical to SEQ ID NO: 1099
  CDS (1)..(2016)

SEQ ID NO: 5632 - protein, 671 aa, Rhodopirellula baltica [sequence omitted]

SEQ ID NO: 5633 - DNA, 1959 bp, Salmonella typhimurium; identical to SEQ ID NO: 1101
  CDS (1)..(1959)

SEQ ID NO: 5634 - protein, 652 aa, Salmonella typhimurium; identical to SEQ ID NO: 1102

SEQ ID NO: 5635 - DNA, 1953 bp, Shewanella oneidensis; identical to SEQ ID NO: 1103
  CDS (1)..(1953)

SEQ ID NO: 5636 - protein, 650 aa, Shewanella oneidensis [sequence omitted]

SEQ ID NO: 5637 - DNA, 1959 bp, Streptomyces avermitilis; identical to SEQ ID NO: 1105
  CDS (1)..(1959)

SEQ ID NO: 5638 - protein, 652 aa, Streptomyces avermitilis [sequence omitted]

SEQ ID NO: 5639 - DNA, 1971 bp, Synechococcus elongatus; identical to SEQ ID NO: 1107
  CDS (1)..(1971)

SEQ ID NO: 5640 - protein, 656 aa, Synechococcus elongatus [sequence omitted]

SEQ ID NO: 5641 - DNA, 1950 bp, Vibrio cholerae; identical to SEQ ID NO: 1109
  CDS (1)..(1950)

SEQ ID NO: 5642 - protein, 649 aa, Vibrio cholerae [sequence omitted]

SEQ ID NO: 5643 - DNA, 1953 bp, Vibrio parahaemolyticus; identical to SEQ ID NO: 1111
  CDS (1)..(1953)

SEQ ID NO: 5644 - protein, 650 aa, Vibrio parahaemolyticus; identical to SEQ ID NO: 1112

SEQ ID NO: 5645 - DNA, 1944 bp, Xanthomonas axonopodis; identical to SEQ ID NO: 1113
  CDS (1)..(1944)

SEQ ID NO: 5646 - protein, 647 aa, Xanthomonas axonopodis [sequence omitted]

SEQ ID NO: 5647 - DNA, 1944 bp, Xanthomonas campestris; identical to SEQ ID NO: 1115
  CDS (1)..(1944)

SEQ ID NO: 5648 - protein, 647 aa, Xanthomonas campestris; identical to SEQ ID NO: 1116

SEQ ID NO: 5649 - DNA, 1944 bp, Xylella fastidiosa; identical to SEQ ID NO: 1117
  CDS (1)..(1944)

SEQ ID NO: 5650 - protein, 647 aa, Xylella fastidiosa; identical to SEQ ID NO: 1118

SEQ ID NO: 5651 - DNA, 26 bp, artificial sequence
  primer
atgacaatcaaggaacataaagtagt

SEQ ID NO: 5652 - DNA, 28 bp, artificial sequence
  primer
ttatttctttttttgagagaaaaattgg

SEQ ID NO: 5653 - DNA, 1239 bp, Saccharomyces cerevisiae
  CDS (1)..(1239)
atgacaaagattaaggtagctaaccccattgtggaaatggacggcgatgagcaaacaagaataatctggcatttaatcagggacaagttagtcttgccctatcttgacgttgatttgaagtactacgatctttccgtggagtatcgtgaccagactaatgatcaagtaactgtggattctgccaccgcgactttaaagtatggagtagctgtcaaatgcgcgactattacacccgatgaggcaagggtcgaggaatttcatttgaaaaagatgtggaaatctccaaatggtactattagaaacattttgggtggtacagtgttcagagaacctattattatccctagaattccaaggctagttcctcaatgggagaagcccatcatcattgggagacacgcattcggcgatcagtacaaagctaccgatgtaatagtccctgaagaaggcgagttgaggcttgtttataaatccaagagcggaactcatgatgtagatctgaaggtatttgactacccagaacatggtggggttgccatgatgatgtacaacactacagattcgatcgaagggtttgcgaaggcctcctttgaattggccattgaaaggaagttaccattatattccactactaagaatactattttgaagaagtatgatggtaaattcaaagatgttttcgaagccatgtatgctagaagttataaagagaagtttgaatcccttggcatctggtacgagcaccgtttaattgatgatatggtggcccaaatgttgaaatctaaaggtggatacataattgccatgaaaaattacgacggtgacgtagaatcagatattgttgcacaaggatttggctccttggggttaatgacatctgtgttgattaccccggacggtaaaacctttgaaagcgaagccgcccacggtacagtaacaagacattttagacagcatcagcaaggaaaggagacgtcaacaaattccattgcatcaattttcgcgtggactagaggtattattcaaaggggtaaacttgataatactccagatgtagttaagttcggccaaatattggaaagcgctacggtaaatacagtgcaagaagatggaatcatgactaaagatttggcgctcattctcggtaagtctgaaagatccgcttatgtcactaccgaggagttcattgacgcggtggaatctagattgaaaaaagagttcgaggcagctgcattgtaa

SEQ ID NO: 5654 - protein, 412 aa, Saccharomyces cerevisiae
MTKIKVANPIVEMDGDEQTRIIWHLIRDKLVLPYLDVDLKYYDLSVEYRDQTNDQVTVDSATATLKYGVAVKCATITPDEARVEEFHLKKMWKSPNGTIRNILGGTVFREPIIIPRIPRLVPQWEKPIIIGRHAFGDQYKATDVIVPEEGELRLVYKSKSGTHDVDLKVFDYPEHGGVAMMMYNTTDSIEGFAKASFELAIERKLPLYSTTKNTILKKYDGKFKDVFEAMYARSYKEKFESLGIWYEHRLIDDMVAQMLKSKGGYIIAMKNYDGDVESDIVAQGFGSLGLMTSVLITPDGKTFESEAAHGTVTRHFRQHQQGKETSTNSIASIFAWTRGIIQRGKLDNTPDVVKFGQILESATVNTVQEDGIMTKDLALILGKSERSAYVTTEEFIDAVESRLKKEFEAAAL

SEQ ID NO: 5655 - DNA, 1719 bp, Rattus norvegicus (Norway rat)
  CDS (30)..(1274)
cgggtgtgagcggggttattgaagtaaaaatgtccagaaaaatccatggcggttctgtggtggaaatgcaaggagatgaaatgacacggatcatctgggaattgattaaagaaaagctcattcttccctacgtggaactggatctgcatagctatgacttaggcatagagaatcgggatgccaccaatgaccaggtcaccaaggatgctgcggaggctataaagaaatacaacgtcggcgtcaagtgtgctaccatcacccccgatgagaagagggttgaggagttcaagttgaaacaaatgtggaaatcacccaacggtaccatccggaacattctgggcggcactgtcttcagagaagctattatctgcaaaaatatcccccggctagtgacaggctgggtaaaacccatcatcattggccgacacgcctatggggaccaatacagagcaacagatttcgttgttcctgggcctggaaaagtagagataacctacacaccaaaagatgggtcgcagaaagtgacatacctggtgcatgactttgaagaaggtggtggtgttgccatgggtatgtacaaccaggataagtcaattgaagattttgcacacagttccttccaaatggctctgtcgaagggctggcctttgtatctaagcaccaagaacactattctgaagaagtatgatggacgcttcaaagacatcttccaggagatctatgacaagcaatacaagtccaagtttgaagctcagaagatctggtatgaacacaggctcatagatgacatggtggcccaggctatgaaatcagaaggaggcttcatctgggcctgtaagaactatgatggtgatgtgcagtcagactcagtagcccaaggttatggctcccttggcatgatgaccagtgtgctgatttgtccagatggtaagacggtagaagcagaggctgcccatggcactgtcacacgtcactaccgcatgtaccagaaaggacaggagacgtccaccaatcccattgcttccatttttgcctggtcccgagggttagcccacagagcaaagcttgacaacaatactgagctcagcttctttgcaaatgctttggaagaagtctgcattgagaccattgaggctggctttatgactaaggacttggctgcttgcattaaaggcttacccaatgtacagcgttctgactacttgaatacatttgagtttatggacaaacttggagaaaacttgaaggccaaactagctcaggccaaactttaaggtcaaacctgggcttagggcaaatctttgtggtaactaagtccacagtttacatatttcctttttgttttaataacactcaaggttaaaaacaagaatcattttgtaatttgtttagaagacgaagttgaacttttctatatgtttacagcctattttctttttcatacagttattgccaccttaatgaatgtggtggggaaggtttttttaattgtattttactgtgtaatagcagtctaggaattgtgttagtatctgttcacaattaactgtcactttttatttgctctaatgtaaatgaccaaaatcagaaatgctccaagggtgaacaatcactacactatgtttccccgtaaaggtgaaggagaggctcacctcccctactgtccatgagtgtgaacacagggagcaaaagtgtgcaaatgttgcactgtgtgtggaa

SEQ ID NO: 5656 - protein, 414 aa, Rattus norvegicus (Norway rat)
MSRKIHGGSVVEMQGDEMTRIIWELIKEKLILPYVELDLHSYDLGIENRDATNDQVTKDAAEAIKKYNVGVKCATITPDEKRVEEFKLKQMWKSPNGTIRNILGGTVFREAIICKNIPRLVTGWVKPIIIGRHAYGDQYRATDFVVPGPGKVEITYTPKDGSQKVTYLVHDFEEGGGVAMGMYNQDKSIEDFAHSSFQMALSKGWPLYLSTKNTILKKYDGRFKDIFQEIYDKQYKSKFEAQKIWYEHRLIDDMVAQAMKSEGGFIWACKNYDGDVQSDSVAQGYGSLGMMTSVLICPDGKTVEAEAAHGTVTRHYRMYQKGQETSTNPIASIFAWSRGLAHRAKLDNNTELSFFANALEEVCIETIEAGFMTKDLAACIKGLPNVQRSDYLNTFEFMDKLGENLKAKLAQAKL

SEQ ID NO: 5657 - DNA, 1212 bp, Caulobacter crescentus
  CDS (1)..(1212)
atggccaagatcaaagtcgccaatcccgtcgtcgacatggacggcgatgaaatgacccgcatcatctggaagctcatcaaggacaagctgatcttcccgtacttggacctggaactggactattacgacctctcggtcgagaaccgcgatgcgaccgacgaccaggtgaccatcgacgcggccaacgcgaccaagaagcacggcgtggccgtcaagtgcgcgaccatcacgcccgatgagcagcgcgtcgaagagttcaagctcaagaagatgtggaagtcgccgaacggcacgatccgcaacatcctgggcggcgtcatcttccgcgagccgatcatctgccagaacgtgccgcgcctggtgccgggctggacccagccgatcatcgtcggccgtcacgccttcggcgaccagtatcgcgcgaccgacttcaagttccccggcaagggcaccctgtcgatcaagttcgtcggcgaagacggccagaccatcgagcacgaagtgttcaaggctccggacgccggcgtcgccatggcgatgtacaatctcgacgagtcgatccgcgatttcgcccacgcctcgttcgcctacggtctgaaccgcggttacccggtctatctctccacgaagaacacgatcctcaaggcctatgacggccgcttcaaggacatcttccaggagatctacgacgccgaatacgccgagaagttcaaggcggccggcatccactacgagcaccgtctgatcgacgacatggtcgcctcggccctgaagtggtcgggcggctacgtctgggcctgtaagaactacgacggcgacgtccagtcggacatcgtcgcccagggcttcgggtcgctgggcctgatgacctcggtgctgatgacgccggacggcaagacggtggaagccgaagccgcccacggcacggtgacccgtcactatcgccagcatcagaagggcgagagcacctcgaccaactcgatcgcctcgatcttcgcctggacgcgtggcctggcccaccgcgccaagctggacgacaaccaggatctggccaacttcgccgccaccctggagaaggtctgcatcgataccgtcgagagcggctacatgaccaaggacctggctctgctggtcggcgacaagcaaggctggctgaccaccgaaggcttcctcgacaagatcgacgagaacctgaagaaggccatggcctaa

SEQ ID NO: 5658 - protein, 403 aa, Caulobacter crescentus
MAKIKVANPVVDMDGDEMTRIIWKLIKDKLIFPYLDLELDYYDLSVENRDATDDQVTIDAANATKKHGVAVKCATITPDEQRVEEFKLKKMWKSPNGTIRNILGGVIFREPIICQNVPRLVPGWTQPIIVGRHAFGDQYRATDFKFPGKGTLSIKFVGEDGQTIEHEVFKAPDAGVAMAMYNLDESIRDFAHASFAYGLNRGYPVYLSTKNTILKAYDGRFKDIFQEIYDAEYAEKFKAAGIHYEHRLIDDMVASALKWSGGYVWACKNYDGDVQSDIVAQGFGSLGLMTSVLMTPDGKTVEAEAAHGTVTRHYRQHQKGESTSTNSIASIFAWTRGLAHRAKLDDNQDLANFAATLEKVCIDTVESGYMTKDLALLVGDKQGWLTTEGFLDKIDENLKKAMA

SEQ ID NO: 5659 - DNA, 1551 bp, Arabidopsis thaliana (mouse-ear cress)
  CDS (21)..(1271)
accaacctctgcgggcaaagatggaattcgagaagatcaaggtgatcaatcccgttgttgaaatggatggagacgaaatgactcgagttatctggaaattcatcaaagacaagcttattttccctttcctggagctggatatcaaatactttgatcttggactgcctaaccgcgatttcactgatgataaggttactatagagactgctgaagctactttaaagtataatgtggctattaagtgtgcgacgattactccggatgaagctcgtgttagggagttcggcttaaagaaaatgtggaggagtcctaatggaactataaggaacattttaaacggcacagttttcagggaacctatcatttgcagaaacatccctcgtcttgttccaggatggacgaagccaatctgtattggaaggcatgcttttggtgatcagtatagagccactgatctcattgtcaatgaaccaggaaaactgaaactagtttttgagccaagtggatcttctcagaaaacagaattcgaagtcttcaatttcaccggtggaggtgttgctttagccatgtataacactgatgagtctattcgtgcatttgctgagtcctcgatgtacacagcttaccagaaaaagtggccactttacctctccacaaaaaacaccatcctcaaaatatatgatggaagattcaaggatatattccaagaagtttatgaagctaactggagatccaagtatgaagcagcagggatatggtatgagcatcgtttgatagatgatatggttgcatatgccatgaaaagtgaagggggttacgtctgggcatgcaagaattacgatggagatgtacagagcgatttcttagcccaaggatatggatctctgggaatgatgacttcggtgttggtttgtccagatggaaagaccattgaagcagaagcagctcatggcacagttacacgccactacagagttcaccagaaaggtggtgaaacaagcaccaacagcatagcctctatttttgcttggtccagaggccttgcccacagggcaaagctggacagcaatgccgcactcttgagctatactgagaaactagaagcagcttgcatggggacggtggagtctggcaaaatgaccaaggatctagctcttctgatccacggagccaaggttaggagggatcagtatgtgaatacggaagagttcattgatgcggtggcatgggagttaaaaagaagattgttaggcaacaactccaggttgtgagaagaaagaatggaaatctgaaaagcaaagagtctcagcagcgtgatgtttgatttgatgctctttcataggtgtagaacttaaagcctgaaaaggggctattgcatgaataaaaggagatagactaattgggtaatttattgaggaactcagatttcccaaagccgagactcactcctcattgattcgttaaaaattgaatctttttagcccttctttctctgtataatctctgttgtaaaagctaccaatcaacagaaatggctacgttctcgttgtc

SEQ ID NO: 5660 - protein, 416 aa, Arabidopsis thaliana (mouse-ear cress)
MEFEKIKVINPVVEMDGDEMTRVIWKFIKDKLIFPFLELDIKYFDLGLPNRDFTDDKVTIETAEATLKYNVAIKCATITPDEARVREFGLKKMWRSPNGTIRNILNGTVFREPIICRNIPRLVPGWTKPICIGRHAFGDQYRATDLIVNEPGKLKLVFEPSGSSQKTEFEVFNFTGGGVALAMYNTDESIRAFAESSMYTAYQKKWPLYLSTKNTILKIYDGRFKDIFQEVYEANWRSKYEAAGIWYEHRLIDDMVAYAMKSEGGYVWACKNYDGDVQSDFLAQGYGSLGMMTSVLVCPDGKTIEAEAAHGTVTRHYRVHQKGGETSTNSIASIFAWSRGLAHRAKLDSNAALLSYTEKLEAACMGTVESGKMTKDLALLIHGAKVRRDQYVNTEEFIDAVAWELKRRLLGNNSRL

SEQ ID NO: 5661 - DNA, 1368 bp, Agrobacterium tumefaciens
  CDS (1)..(1368)
atgtggtttggcaatgcgcaaagcgttattgcgctgcgccaaaaaagcgccccccatggctttgcctcagacgctcgcgatgctatagcccgaccggatatttttccgactattggcgtcaacaggcgccacagcttcgaaggtgaggaattcatggcaaagatcaaggtagccaatccagtcgtcgatctcgacggcgacgaaatgacccgtatcatctggcagctcatcaaggacaagctgatcctgccatacctcgatctcgacatcgaatattacgacctctcggttgaaaaccgcgatgccaccaacgaccaggtcaccgtcgatgcggcacacgccatcaagaagcatggcgtcggcatcaagtgcgcgacgatcacgccggacgagcagcgcgtcgaggaattcggcctgaagcagatgtggaagagcccgaacggcacgatccgcaacattctcggcggcgtcatcttccgcgagccgatcatctgcaagaacgttccgcgcctcgttcccggctggaccaagccgatcgtcgtcggccgtcacgcctttggcgaccagtacaaggcaaccgatttcaagttccccggcaagggcaagctgacgatcaagttcgtcggtgaagacggcacggtcatcgaaaaggacgtcttcgacgccccgagcgccggcgtggcactcgccatgtacaacctcgacgaatccatccgcgaattcgcccgcgcctcgatgatgtatggcctgatgcgcaagtggccggtttacctctccaccaagaacaccatcctcaaggcctatgacggccgcttcaaggatatcttcgaagaagtctaccagaccgagttcaaggcaaagttcgacgaagtcggcatcacctacgaacaccgcctgatcgacgacatggttgcctcggcgctgaagtggtccggcggctacgtctgggcctgcaagaactacgatggcgacgtgcagtccgacacggttgcccagggcttcggctcgctcggcctgatgacctcggttctgctgtcgccggatggccgcaccgtcgaagccgaagcggcgcacggcacggtgacgcgtcactaccgccagcaccagaagggtcaggaaacctcgaccaactcgatcgcctcgatcttcgcctggacccgtggcctcgcccaccgcgccaagctggatgacaatgcggaactggcaaagttcgcgacgacgctcgaaaccgtctgcgtcgacaccgtcgaaagcggcttcatgaccaaggatctggccctcctcatcggaccggaccagccctggctctccaccaccgccttcctcgacaagatcgacgaaaacctcaagacggcgatggcggcctga

SEQ ID NO: 5662 - protein, 455 aa, Agrobacterium tumefaciens
MWFGNAQSVIALRQKSAPHGFASDARDAIARPDIFPTIGVNRRHSFEGEEFMAKIKVANPVVDLDGDEMTRIIWQLIKDKLILPYLDLDIEYYDLSVENRDATNDQVTVDAAHAIKKHGVGIKCATITPDEQRVEEFGLKQMWKSPNGTIRNILGGVIFREPIICKNVPRLVPGWTKPIVVGRHAFGDQYKATDFKFPGKGKLTIKFVGEDGTVIEKDVFDAPSAGVALAMYNLDESIREFARASMMYGLMRKWPVYLSTKNTILKAYDGRFKDIFEEVYQTEFKAKFDEVGITYEHRLIDDMVASALKWSGGYVWACKNYDGDVQSDTVAQGFGSLGLMTSVLLSPDGRTVEAEAAHGTVTRHYRQHQKGQETSTNSIASIFAWTRGLAHRAKLDDNAELAKFATTLETVCVDTVESGFMTKDLALLIGPDQPWLSTTAFLDKIDENLKTAMAA

SEQ ID NO: 5663 - DNA, 1230 bp, Mycobacterium tuberculosis
  CDS (1)..(1230)
atgtccaacgcacccaagataaaagtcagcggtccggtcgtagagctcgacggtgacgagatgacccgtgtcatctggaagctcatcaaggacatgcttatccttccctatctcgacatccgcttggactattacgacttgggcatcgagcaccgcgacgccaccgacgaccaggtgacgatcgacgcggcgtatgcgatcaagaaacacggtgtgggcgtaaagtgcgcgacgatcacccccgacgaggcccgtgtcgaggaattcaacctgaagaagatgtggctgtcgcccaatgggacaatccggaacatcttgggcggcacaatctttcgcgaacctatcgtgatttctaatgtgccgcgactggttccggggtggaccaagccgatcgtcatcggccggcacgcttttggtgaccaatatcgggcgacgaacttcaaggtcgaccaaccgggcaccgtcacactgactttcacgcccgccgacggcagcgcgccgatcgtgcacgaaatggtgtccatccccgaggacggcggcgtcgtgctggggatgtacaacttcaaggaatccatccgggatttcgcgcgcgcgtcgttctcctacggcctcaacgcgaaatggccggtatatctgtccaccaagaacaccatcctcaaggcctacgacgggatgttcaaagacgagttcgagcgcgtctacgaagaggaattcaaggcgcagttcgaagcggcggggctgacctacgagcatcggttgatcgacgacatggtcgccgcctgcctgaaatgggaaggcggttacgtctgggcgtgcaagaactacgacggcgacgtgcagtcggacaccgtcgcacagggctacggctcgctgggcctgatgacgtcggtgctgatgacggccgacggcaagacagtcgaggccgaagccgcccacggcaccgtcacccggcattaccggcagtatcaggccggtaaaccgacctcaacaaacccgatcgcgtcgatctttgcctggacccgcggattacagcatcgcggcaagctggatggcactcccgaagtcatcgacttcgcccacaagctggagtccgtcgtcatcgccacggtggagagcgggaagatgaccaaggacctcgcgatcctcatcggtccggagcaggactggctgaatagcgaggaattcctcgatgcgatcgccgacaacctggaaaaggagctggccaattag

SEQ ID NO: 5664 - protein, 409 aa, Mycobacterium tuberculosis
MSNAPKIKVSGPVVELDGDEMTRVIWKLIKDMLILPYLDIRLDYYDLGIEHRDATDDQVTIDAAYAIKKHGVGVKCATITPDEARVEEFNLKKMWLSPNGTIRNILGGTIFREPIVISNVPRLVPGWTKPIVIGRHAFGDQYRATNFKVDQPGTVTLTFTPADGSAPIVHEMVSIPEDGGVVLGMYNFKESIRDFARASFSYGLNAKWPVYLSTKNTILKAYDGMFKDEFERVYEEEFKAQFEAAGLTYEHRLIDDMVAACLKWEGGYVWACKNYDGDVQSDTVAQGYGSLGLMTSVLMTADGKTVEAEAAHGTVTRHYRQYQAGKPTSTNPIASIFAWTRGLQHRGKLDGTPEVIDFAHKLESVVIATVESGKMTKDLAILIGPEQDWLNSEEFLDAIADNLEKELAN

SEQ ID NO: 5665 - DNA, 1608 bp, Saccharomyces cerevisiae
  CDS (111)..(1397)
tttgactcacataattccacttgcccatataaagagggactcatatgatcttatgaaatcttccttcaagcaattgtgagacaacagacgcacaaggaagatcgcccagcatgagtatgttatctagaagattattttccacctctcgccttgctgctttcagtaagattaaggtcaaacaacccgttgtcgagttggacggtgatgaaatgacccgtatcatttgggataagatcaagaagaaattgattctaccctacttggacgtagatttgaagtactacgacttatctgtcgaatctcgtgacgccacctccgacaagattactcaggatgctgctgaggcgatcaagaagtatggtgttggtatcaaatgtgccaccatcactcctgatgaagctcgtgtgaaggaattcaacctgcacaagatgtggaaatctcctaatggtaccatcagaaacattctcggcggtacagtgtttagagagcccattgtgattcctagaattcctagactggtcccacgttgggaaaaaccaatcattattggaagacacgcccacggtgatcaatataaagctacggacacactgatcccaggcccaggatctttggaactggtctacaagccatccgaccctacgactgctcaaccacaaactttgaaagtgtatgactacaagggcagtggtgtggccatggccatgtacaatactgacgaatccatcgaagggtttgctcattcgtctttcaagctggccattgacaaaaagctaaatcttttcttgtcaaccaagaacactattttgaagaaatatgacggtcggttcaaagacattttccaagaagtttatgaagctcaatataaatccaaattcgaacaactagggatccactatgaacaccgtttaattgatgatatggtcgctcaaatgataaaatctaaaggtggctttatcatggcgctaaagaactatgacggtgatgtccaatctgacatcgtcgctcaaggatttggctccttaggtttgatgacttctatcttagttacaccagacggtaaaactttcgaaagtgaagctgctcatggtaccgtgacaagacattatagaaagtaccaaaagggtgaagaaacttctacaaactccattgcatccattttcgcgtggtcgagaggtctattgaagagaggtgaattggacaatactcctgctttgtgtaaatttgccaatattttggaatccgccactttgaacacagttcagcaagacggtatcatgacgaaggacttggctttggcttgcggtaacaacgaaagatctgcttatgttaccacagaagaatttttggatgccgttgaaaaaagactacaaaaagaaatcaagtcgatcgagtaatcgaatttacgtagcccaatctaccacttttttttttcatttttagtgttatacttagttatgctctaggataatgaactacttttttttttttttttttactgttatcataaatatatataccttattgttgtttgcaaccgtcggttaattccttatcaaggttccccaagttcggatcattaccatcaatttccaacattttcatgag

SEQ ID NO: 5666 - protein, 428 aa, Saccharomyces cerevisiae
MSMLSRRLFSTSRLAAFSKIKVKQPVVELDGDEMTRIIWDKIKKKLILPYLDVDLKYYDLSVESRDATSDKITQDAAEAIKKYGVGIKCATITPDEARVKEFNLHKMWKSPNGTIRNILGGTVFREPIVIPRIPRLVPRWEKPIIIGRHAHGDQYKATDTLIPGPGSLELVYKPSDPTTAQPQTLKVYDYKGSGVAMAMYNTDESIEGFAHSSFKLAIDKKLNLFLSTKNTILKKYDGRFKDIFQEVYEAQYKSKFEQLGIHYEHRLIDDMVAQMIKSKGGFIMALKNYDGDVQSDIVAQGFGSLGLMTSILVTPDGKTFESEAAHGTVTRHYRKYQKGEETSTNSIASIFAWSRGLLKRGELDNTPALCKFANILESATLNTVQQDGIMTKDLALACGNNERSAYVTTEEFLDAVEKRLQKEIKSIE

SEQ ID NO: 5667 - DNA, 1242 bp, Sulfolobus solfataricus
  CDS (1)..(1242)
atgatgcaaaagataccagaagatggagaagtaattaaatttgaaaatgggaaatggattgtaccaaaaaagccaataattctgtatgttgaaggggatggaatagggcatgaaataacacatgctgctatgaaggttataaacaaagcagtggaaaaagcttatggatctgatagagaaattaagtgggtagaagttctagcaggagataaggcagaaaagctaaccggaaatagatttcctaaagagtcagaggaattgatagagaagtatagagtcttattaaaaggtcccctagaaacaccaataggcaaaggctggaaatccatcaatgtagcaattagattaatgttggatctttatgcaaatataagaccagtaaaatacattccaggtatagaaagtccaattaagaacgcagataagattgaccttataatatttagggaaaatactgatgatttgtacagaggaatagagtatccttatgacagtgaacaagcaaagaaaattagagattttctaagaaaggagctaggagtggaagtggaagatgatactggaattggtataaaacttatcagtagatttaagacgcaaaggattgcgagaatggctataaaatacgctatagaccataaacgaaagaaagttacaataatgcataaaggtaatgtgatgaaatataccgaaggagcatttagagaatggtcatatgaagttgcaacaaaagaatttagagattatatagttactgaggaagaggtaacaaagaattataatggagtacctccttctgggaaggtcataataaatgataggatagctgataacatgttccaacagataattatcagaccagacgagtacgatataatattagcacctaacgtaaatggggattacatatcggatgctgcgggcgcactggtaggaaatattggtatgttaggcggtgcaaatataggagatactggaggtatgttcgaggcaatacatggtaccgcacctaagtatgctggtaagaatgttgcaaaccccactggaataataaaaggtggtgagttaatgttaagatttatgggatgggataaggctgctgagttaatagattctgcaatcatggaatctataagacagaagaaggttactcaggatttagctagatttatgggtgtaagagccttatcaactactgaatatactgacgagctaattgcgataatcgatacactatcataa

SEQ ID NO: 5668 - protein, 413 aa, Sulfolobus solfataricus
MMQKIPEDGEVIKFENGKWIVPKKPIILYVEGDGIGHEITHAAMKVINKAVEKAYGSDREIKWVEVLAGDKAEKLTGNRFPKESEELIEKYRVLLKGPLETPIGKGWKSINVAIRLMLDLYANIRPVKYIPGIESPIKNADKIDLIIFRENTDDLYRGIEYPYDSEQAKKIRDFLRKELGVEVEDDTGIGIKLISRFKTQRIARMAIKYAIDHKRKKVTIMHKGNVMKYTEGAFREWSYEVATKEFRDYIVTEEEVTKNYNGVPPSGKVIINDRIADNMFQQIIIRPDEYDIILAPNVNGDYISDAAGALVGNIGMLGGANIGDTGGMFEAIHGTAPKYAGKNVANPTGIIKGGELMLRFMGWDKAAELIDSAIMESIRQKKVTQDLARFMGVRALSTTEYTDELIAIIDTLS

SEQ ID NO: 5669 - DNA, 1200 bp, Thermotoga maritima
  CDS (1)..(1200)
atggagaaagtcaaagtcaaaaatcctattgttgagcttgacggtgacgagatggcacgcgtgatgtggaagatgatcaaagaaaaactcatccttccctatctcgacatccagctggtttacttcgatctcggaataaagaagagagacgaaacagacgatcagatcacgatcgaagcggcaaaggccatcaaaaagtacggtgtcggtgtcaagtgcgcaacgatcaccccggatgcggaaagagtgaaggaatacaacctgaagaaagcctggaagagtccaaatgccaccatcagagcgtatctcgatggaacggttttcagaaagcccatcatggtgaagaacgtgccaccgcttgtgaagcgctggaagaaaccgatcatcataggaagacacgcctacggtgacatatacaacgctgtggaagcaaaagtagaaggcccagcagaagtggaacttgtggtgagaaacaaagaaaacaaaacactcctcgtacacaaattcgaaggaaacggtgttgtcatggcaatgcacaacctggagaaatcgatcagaagcttcgctcagtcgtgtataaactacgctatctctgaaaaggtcgacatctggtttgcgacgaaagacacgatctccaaggtgtaccatgcgtacttcaaagacatattccaggaagaggtcgacaaaagaaaagaagaactcgaaaaagctggagtgaactacagatacatgctcatagatgatgcggctgcgcagattttgagaagtgagggcggcatgctctgggcctgtatgaactacgaaggggatatcatgtccgatatgatcgcctcaggattcggcagtctcggcctcatgacgtcggttcttgtctctcccgatggggtctacgagttcgaggcagcccacggcacggtgagaagacactactacagatatttgaagggagaaaagacctcgacgaatccaaccgcatcgatcttcgcgtggacaggtgctataaggaaaaggggagaactcgacggaacaccggaggtgtgtgaattcgcagacaaactggagaaggctgtgataaacaccatagaatccggtgtgatcacaaaggaccttcagcctttcacagaaccaccgatcgacaagtatgtcactctcgaagagttcatagacgaagtgaagaagaatctcgaaaaattactgtga

SEQ ID NO: 5670 - protein, 399 aa, Thermotoga maritima
MEKVKVKNPIVELDGDEMARVMWKMIKEKLILPYLDIQLVYFDLGIKKRDETDDQITIEAAKAIKKYGVGVKCATITPDAERVKEYNLKKAWKSPNATIRAYLDGTVFRKPIMVKNVPPLVKRWKKPIIIGRHAYGDIYNAVEAKVEGPAEVELVVRNKENKTLLVHKFEGNGVVMAMHNLEKSIRSFAQSCINYAISEKVDIWFATKDTISKVYHAYFKDIFQEEVDKRKEELEKAGVNYRYMLIDDAAAQILRSEGGMLWACMNYEGDIMSDMIASGFGSLGLMTSVLVSPDGVYEFEAAHGTVRRHYYRYLKGEKTSTNPTASIFAWTGAIRKRGELDGTPEVCEFADKLEKAVINTIESGVITKDLQPFTEPPIDKYVTLEEFIDEVKKNLEKLL

SEQ ID NO: 5671 - DNA, 1221 bp, Sphingomonas yanoikuyae
  CDS (1)..(1221)
atggcgaagatcaaggtgaaaaaccccgtcgtggaaatcgacggcgacgaaatgacccgcatcatctgggaatggatccgtgagcgcctcattctcccctatctcgacgtcgacctgaaatattatgacctgtcggtcgagaagcgcgacgagaccagcgaccagatcacgatcgacgcggccaacgcgatcaaggaatatggcgtcggcgtgaagtgcgccaccatcaccccggacgaagcgcgcgtcgaggaattcggcctcaagaagatgtggaagtcgcccaacggcaccatccgcaacatcctgggcggcgtcgtgttccgcgaaccgatcgtcatcaagaatgtcccccgcctggttccgggctggaccgacccgatcgtcgtcggccgtcacgcctttggcgaccagtataaggccaccgatttcaaggtgcccggcgccggcacgctgaccatgaagtgggtcggcaccaatggcgaggaactcgaatatgaagtgttcgaattccccagcgccggcgttgccatgggcatgtacaatctcgacgaatcgatccgcgatttcgccaaggccagcttcaactatggcctgaaccgcggctggcccgtctatctgtcgaccaagaacaccatcctcaaggcctatgacggccgcttcaaggatctgttccaggaagtgttcgacgccgaattcgccgacaagttcaaggcggccggcatcgtctacgaacaccgcctgatcgacgacatggtcgcttcggcgctgaagtggagcggcaagttcgtctgggcctgcaagaattatgacggcgacgtccagtcggacaccgtggcccagggcttcggctcgctcggcctgatgacctccgtcctgctgtcgcccgacggcaagaccgtggaagccgaagccgcgcacggcaccgtcacccgtcactatcgccagcaccagcagggcaaggcgacctcgaccaacccgatcgcctcgatcttcgcctggacccagggcctgtcgttccgcggcaagttcgacgacacgccggacgtcgtgaagttcgccgagacgctggagcaggtctgcatcaagaccgtcgaaggcggcgcgatgaccaaggatctggccctgctgatcggcccggatcaggcctggatgaccacggagcagttcttcgaggcgatccgcgtcaatctggaagccgaaatggccaagtgggcctga

SEQ ID NO: 5672 - protein, 406 aa, Sphingomonas yanoikuyae
MAKIKVKNPVVEIDGDEMTRIIWEWIRERLILPYLDVDLKYYDLSVEKRDETSDQITIDAANAIKEYGVGVKCATITPDEARVEEFGLKKMWKSPNGTIRNILGGVVFREPIVIKNVPRLVPGWTDPIVVGRHAFGDQYKATDFKVPGAGTLTMKWVGTNGEELEYEVFEFPSAGVAMGMYNLDESIRDFAKASFNYGLNRGWPVYLSTKNTILKAYDGRFKDLFQEVFDAEFADKFKAAGIVYEHRLIDDMVASALKWSGKFVWACKNYDGDVQSDTVAQGFGSLGLMTSVLLSPDGKTVEAEAAHGTVTRHYRQHQQGKATSTNPIASIFAWTQGLSFRGKFDDTPDVVKFAETLEQVCIKTVEGGAMTKDLALLIGPDQAWMTTEQFFEAIRVNLEAEMAKWA

SEQ ID NO: 5673 - DNA, 1740 bp, Bos primigenius taurus (cattle)
  CDS (67)..(1425)
ctcggatctcgcctaccgggttccttcgttcgctcatccgccagtccgaccgcccacccgctcgggatggctggttacctgcgagtcgtacgctcgctctgcagagcctctggctccgggtcggcctgggcgccacgagccttgacagcccccaacttgcaagagcagccgcggcgccactatgccgacaagaggatcaaggtggcgaagccagtggtggagatggacggcgatgagatgacccgtattatctggcagttcatcaaagagaagctcatcctgccccacgtggacgtccagctcaagtatttcgacctggggctcccgaaccgtgaccagaccaatgatcaggtcaccatcgactccgcgttggccacccagaagtacagtgtggctgtgaagtgtgccaccatcacccccgacgaggcccgtgtggaagagttcaagctgaagaagatgtggaagagccccaatggaaccatccggaacatcctcgggggaacggtcttccgggagcccatcatctgtaagaacatcccgcgtctcgtccctggctggaccaagcccatcaccattggcaggcatgcccacggcgaccagtacaaagccacagactttgtggttgaccgggctggcacattcaaggtggtcttcaccccgaaggatggcagcggccctaaggaatgggaggtgtacaactttcctgctggtggcgtgggcatgggcatgtataacacggatgagtccatctcaggttttgcacacagctgcttccagtatgccatccagaagaagtggccactctacatgagcaccaagaacaccatcctgaaagcttacgacgggcgcttcaaggacatcttccaggccatctttgagaagcactacaagactgagttcgacaaacataagatctggtacgagcaccggctcattgatgacatggtggctcaggtcctcaagtcctcaggcggctttgtgtgggcctgcaagaactacgatggagacgtgcagtcggacatcctggcccagggctttggctcccttggtctgatgacgtccgtgctggtctgcccggatgggaagaccattgaggctgaggctgctcatggcacagtcacccgccactatcgggagcaccagaagggccggccgaccagcaccaaccccatcgccagcatctttgcctggacgcgtggcctagaacaccggggcaagttggatgggaaccaggacctcatcaggttcgcccagaccctggagaaggtgtgcgtcgagacggtggagagcggagccatgaccaaggacctggcgggctgcatccacggcctcagcaatgtgaagctgaacgaacacttcctgaacacctcggacttcctggacaccatcaagagcaacctggacagagctctgggccagcagtagcgggccagggttgctgccagctgccgagctggccgggctggaggcgagcgggcagccaggggtccccctgcccccccgaccgacacgccccgcggcggagggtgagcctcttagcccctgttaggaggcctttctaggggacgttttttttttttataagcaagaagtttttaaaagtatctgtgtgtttcccctcatggtgacgtgaggcagaaacagtgtgttttacctcagccggtggtatcttttgcatactgtaatttatattgccctcgggacacatggtgccatatttagctactaaaaagttcttcc

SEQ ID NO: 5674 - protein, 452 aa, Bos primigenius taurus (cattle)
MAGYLRVVRSLCRASGSGSAWAPRALTAPNLQEQPRRHYADKRIKVAKPVVEMDGDEMTRIIWQFIKEKLILPHVDVQLKYFDLGLPNRDQTNDQVTIDSALATQKYSVAVKCATITPDEARVEEFKLKKMWKSPNGTIRNILGGTVFREPIICKNIPRLVPGWTKPITIGRHAHGDQYKATDFVVDRAGTFKVVFTPKDGSGPKEWEVYNFPAGGVGMGMYNTDESISGFAHSCFQYAIQKKWPLYMSTKNTILKAYDGRFKDIFQAIFEKHYKTEFDKHKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQTLEKVCVETVESGAMTKDLAGCIHGLSNVKLNEHFLNTSDFLDTIKSNLDRALGQQ

SEQ ID NO: 5675 - DNA, 1569 bp, Solanum tuberosum (potato)
  CDS (69)..(1319)
ttttcttccaccaacttttcttcattcggctgagatttctctgcttaatttttctctcaatctgcaaaatggcgtttcagaaaatcactgtgcaaaaccccatcgttgagatggacggagatgaaatgacacgagttatttggaaatctatcaaggataagctcatccttccctttctggaattggacataaaatactttagccttggccttccccaccgtgatgccacagatgataaggttacagttgaaagtgcggaagccactcagaagtacaacgtagctatcaagtgtgcaaccatcaccccagatgaggcccgtgtaaaggagtttaacttgaaatccatgtggaggagcccaaatgggacaatcagaaacatcttaaatggaactgtctttagagaaccaattatgtgcaaaaatatccccagacttgtcccaggttggactaaaccaatttgcattggtagacatgcttttggagatcaataccgagctactgatacagttattaaaggagcgggaaaactcaaattggtgtttgtgccagaaggatcagacgagaagactgagtttgaagtttacaactttactggtgctggtggagtagctttatccatgtacaacacagacgagtctgttcgttcatttgctgaggcttcaatgaacatggcattccaaaagaaatggccactctatcttagtacaaagaataccattcttaagaaatatgatgggaggttcaaggatatcttccaagaagtttatgaagcaaattggaagtccaagtacgaggaagccggaatctggtacgaacaccgtcttatcgacgatatggttgcttatgctttaaagagtgaaggtggttacgtatgggcttgcaagaactacgatggggatgttcagagtgatttcttagcacaaggttttggatcccttgggttgatgacttctgtcctggtgtgtcctgatggcaagaccattgaggctgaagcagcccatggaactgttacccgccactacagggttcaccagaaaggaggtgaaaccagcacaaacagcattgcctctatctttgcctggactcgtggacttgcacacagggcaacattggacaacaacgaaaggctcttggattttactgagaaactagaggcagcatgcattggtgcagtggaatctggaaagatgacgaaagatcttgcactcatcatcatccatggatccaagctttcacgagagcattatctgaacacggaagagttcattgacgctgttgccgatgagctcaaagcaagacttctgaaagcaaaggcctaaatgtgtgaaggcaagtctttcttcctcaggcagtttgaggcatattgaattgaagagaaataaaaggagtaagcctgttggatatcaaattcaagaggtttttatcttttggttgaggattattctgcagacattatatttgaaccatttaaatctgaattcctattgctgatgttgctgcaagttatttgccaatttgtagttgtacacatagcttattgttgcctttttatatcaatttgcttaaaaa

SEQ ID NO: 5676 - protein, 416 aa, Solanum tuberosum (potato)
MAFQKITVQNPIVEMDGDEMTRVIWKSIKDKLILPFLELDIKYFSLGLPHRDATDDKVTVESAEATQKYNVAIKCATITPDEARVKEFNLKSMWRSPNGTIRNILNGTVFREPIMCKNIPRLVPGWTKPICIGRHAFGDQYRATDTVIKGAGKLKLVFVPEGSDEKTEFEVYNFTGAGGVALSMYNTDESVRSFAEASMNMAFQKKWPLYLSTKNTILKKYDGRFKDIFQEVYEANWKSKYEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRATLDNNERLLDFTEKLEAACIGAVESGKMTKDLALIIIHGSKLSREHYLNTEEFIDAVADELKARLLKAKA

SEQ ID NO: 5677 - DNA, 1850 bp, Saccharomyces cerevisiae
  CDS (461)..(1723)
tgcaagactcttacgaaatattaaagtttaataccgtgtaactgcctcttacatatgtatgcatatatacgtacgtactatatttttcttgtatatcttttttattgtctgagagaaagaacatcaaaaaataaaggaagatcctcctcggatttagcatgcttaatgccgaatctttaatacaaaacgaatgatatttcaagtatactaattagaaatcaatcaaacataccaaaagggacagtaaagagaaaagcaggagctctcttttaggggaaaagtaaaatgtgattagtatttcgttgcgtgtactagtcaactcttcttgtcattcttaaatttacattaattaccccaattttgcatcttcgtatataagagtgttccccttataagctttctcctgcacatacctgcagtaaacacaagcaacactttagagatagttgtccaagttaaaatgagtaaaattaaagttgttcatcccatcgtggaaatggacggtgatgagcagacaagagttatttggaaacttatcaaagaaaaattgatattgccatatttagatgtggatttaaaatactatgacctttcaatccaagagcgtgataggactaatgatcaagtaacaaaggattcttcttatgctaccctaaaatatggggttgctgtcaaatgtgccactataacacccgatgaggcaagaatgaaagaatttaaccttaaagaaatgtggaaatctccaaatggaacaatcagaaacatcctaggtggaactgtatttagagaacccatcattattccaaaaatacctcgtctagtccctcactgggagaaacctataattataggccgtcatgcttttggtgaccaatatagggctactgacatcaagattaaaaaagcaggcaaactaaggttacagtttagctcagatgacggtaaagaaaacatcgatttaaaggtttatgaatttcctaaaagtggtgggatcgcaatggcaatgtttaatacaaatgattccattaaagggttcgcaaaggcatccttcgaattagctctcaaaagaaaactaccgttattctttacaaccaaaaacactattctgaaaaattatgataatcagttcaaacaaattttcgataatttgttcgataaagaatataaggaaaagtttcaggctttaaaaataacgtacgagcatcgtttgattgatgatatggtagcacagatgctaaaatcaaagggcgggtttataatcgccatgaagaattatgatggcgatgtccagtctgacattgtggcacaaggatttgggtctcttggtttaatgacgtccatattgattacacctgatggtaaaacgtttgaaagcgaggctgcccatggtacggtgaccagacattttagaaaacatcaaagaggcgaagaaacatcaacaaattcaatagcctcaatatttgcctggacaagggcaattatacaaagaggaaaattagacaatacagatgatgttataaaatttggaaacttactagaaaaggctactttggacacagttcaagtgggcggaaaaatgaccaaggatttagcattgatgcttggaaagactaatagatcatcatatgtaaccacagaagagtttattgatgaagttgccaagaggcttcaaaacatgatgctcagctccaatgaagacaagaaaggtatgtgcaaactataaaccaatccgccattcatttgaaaagacaagtctggcctagggttatagtgttcagacttgaggttgaacatatccaaaaaaaaaaattcctatgatgtcttaaatacgtatacctaataaaataatt

SEQ ID NO: 5678 - protein, 420 aa, Saccharomyces cerevisiae
MSKIKVVHPIVEMDGDEQTRVIWKLIKEKLILPYLDVDLKYYDLSIQERDRTNDQVTKDSSYATLKYGVAVKCATITPDEARMKEFNLKEMWKSPNGTIRNILGGTVFREPIIIPKIPRLVPHWEKPIIIGRHAFGDQYRATDIKIKKAGKLRLQFSSDDGKENIDLKVYEFPKSGGIAMAMFNTNDSIKGFAKASFELALKRKLPLFFTTKNTILKNYDNQFKQIFDNLFDKEYKEKFQALKITYEHRLIDDMVAQMLKSKGGFIIAMKNYDGDVQSDIVAQGFGSLGLMTSILITPDGKTFESEAAHGTVTRHFRKHQRGEETSTNSIASIFAWTRAIIQRGKLDNTDDVIKFGNLLEKATLDTVQVGGKMTKDLALMLGKTNRSSYVTTEEFIDEVAKRLQNMMLSSNEDKKGMCKL

SEQ ID NO: 5679 - DNA, 1584 bp, Nicotiana tabacum (common tobacco)
  CDS (85)..(1332)
cttctttcaccaacttcccccttcactgtttctctcttcggcggagatttttctgttctatcttcacccctttcatctgcaaacatgactttcgacaaaatcaaggttgaaaaccctatcgttgagatggacggagatgaaatgactcgtgttatttggaaatcgatcaaggataagctcatctgtccttttctggagttggatataaaatactttgaccttggccttccgcaccgtgatgccacagacgataaggttacagttgaaagtgcggaagccactcagaaatacaatgtagctattaagtgtgcaaccattactccagatgaggcccgtgtaaaagagtttaacttgaaatccatgtggaggagcccaaatgggacaattagaaacatcctaaatggaacggtcttcagagaaccaattatgtgcaaaaatattccccgacttgtcccaggttggactaaaccaatatgcattggtagacatgcttttggagatcaataccgggctactgatacagttattcaaggagctggaaaactcaaattggtgtttgtgccagagggaacagacgagaagactgaattcgaagtttacaactttactggtgctggtggagtagctttatccatgtacaacacagatgagtccgtccgctcatttgctgaggcttcaatgaacatggcataccaaaagaaatggccactctatcttagtacaaagaatactattcttaagaaatatgatgggaggtttaaggacatcttccaagaagtttatgaagcaaattggaagtccaagtatgaggaagcaggaatttggtatgaacaccgtcttatcgacgatatggctgcttatgctttaaagagtgaaggtggttatgtatgggcctgcaagaactatgatggggatgtacagagtgatttcttagcacaaggttttggatccttgggcttgatgacatctgtcctggtgtgtcctgatggcaagaccattgaggctgaagcagcccatggaactgtcacccgccactacagggttcaccagaaaggaggtgaaaccagcacaaacagtattgcgtcaatctttgcctggactcgtggacttgcacacagggcaacgttagacaacaacgaaaggctcttggattttactgagaaactagaggcagcatgcattggtgcagttgaatctggaaagatgaccaaagatcttgcacttatcatccatggatccaagctctcgagagatcattatctcaacactgaagagttcattgacgccgtggccgatgagctcaaagcaagacttctgaaagcaaaggcctaaatgtctgggcagacaagaggacagtcttttttctggggcagttgagggatattgaagtgaaataaaaggattagggcctgatggtatactaaatctcaagaggttttattttataggttggggttactctccaggcattaatgtttgaaccatttaaatctgaatttctttttgctgaaactgctgcaagttatttcctgatttgcaaattggaccacgtgactgtgttacagtgctaaagaagccctctca

SEQ ID NO: 5680 - protein, 415 aa, Nicotiana tabacum (common tobacco)
MTFDKIKVENPIVEMDGDEMTRVIWKSIKDKLICPFLELDIKYFDLGLPHRDATDDKVTVESAEATQKYNVAIKCATITPDEARVKEFNLKSMWRSPNGTIRNILNGTVFREPIMCKNIPRLVPGWTKPICIGRHAFGDQYRATDTVIQGAGKLKLVFVPEGTDEKTEFEVYNFTGAGGVALSMYNTDESVRSFAEASMNMAYQKKWPLYLSTKNTILKKYDGRFKDIFQEVYEANWKSKYEEAGIWYEHRLIDDMAAYALKSEGGYVWACKNYDGDVQSDFLAQGFGSLGLMTSVLVCPDGKTIEAEAAHGTVTRHYRVHQKGGETSTNSIASIFAWTRGLAHRATLDNNERLLDFTEKLEAACIGAVESGKMTKDLALIIHGSKLSRDHYLNTEEFIDAVADELKARLLKAKA

SEQ ID NO: 5681 - DNA, 1722 bp, Nicotiana tabacum (common tobacco)
  CDS (76)..(1524)
gcacggcgacaaagacaatagagagttgctcagagcagcaaaaactagcaactgattaaagcctacaaaagtgttatgcttaccacccgactcagactccggtgttccgccatggctagtgttgcttcttttatctcatcttcatcggcttcaacatcatccgcagttaccaaaaaccttcccttttccatcatttccaatcggcaactgttcaagaaccgtgtttatctcctccaccgaatccccaatgcttcaattcgatcgttcgcttccactacagcttcgtctaaaatccgcgttgaaaatcctattgtcgaaatggacggtgatgaaatgacgagggttatatggacaatgatcaaagagaagctaatatatccttatctagagttggatacgaagtattacgatttggggatattgaaccgtgatgccactgacgatcaagttactgttgaaagtgctgaggctactcttaagtataatgttgctgtgaaatgcgctactataacacctgatgagaccagagttaaggaatttgggctgaagtctatgtggagaagtcccaatgccacaatcagaaacattttaaatggtactgttttccgggagcctatactatgcaagaacgtccccagaattgttcctggttggaagaaacccatttgtattggtaggcatgcctttggtgaccagtatcgtgccacagatgcagttattaatggaccaggaaagctcaaaatggtttttgagccagaaaatggggaagcccctacggaactggatgtttatgattttaaaggtccaggtgttgcacttgccatgtacaatgttgaccagtcaattcgagcgtttgctgaatcatcaatgtcaatggcattttcgaagaaatggcctctttatttgagtacaaaaaatacaatactaaagaaatacgatggcaggtttaaggacatttttgaagaggtatatgaagagaagtggaagcaacagtttgaggaacactcgatatggtatgagcatagattgatagatgacatggtagcttatgcattaaaaagcgggggtggatatgtttgggcatgcaagaactatgatggagatgtccagagtgatctgctcgctcaaggatttggttctctgggcctcatgacctctgtattgttatcttctgatggcaagacattagaagctgaagcagctcatggcacagtaaccagacattttcggctgcatcaaaagggtcaagaaactagtacaaatagtgttgcttctatttttgcatgggcaaggggacttggacatagggcccagcttgatgggaaccaaaagttatctgaatttgttcacgccctggaagctgcttgcgttggcacaatagagtccgggaagatgactaaggatttagctatattggttcatggacccaaggtatcaagggaacactacttgaatactgaagaatttattgatcctgtagcacagaaacttcaagagaagctcggtgcctgcgcagttgtatgagctgaagcagatcatgagctgcaagtcatcacatatttttcgcttcctactcatacccttcacagtgaacataaatctatatgctgccaatggagattcgtttagacaagtttctgtaatcgcatagataggagataacatctctttgagtggttcatgctcgtgcgacttaagatctcaataaaatgccatttcgcc

SEQ ID NO: 5682 - protein, 482 aa, Nicotiana tabacum (common tobacco)
MLTTRLRLRCSAMASVASFISSSSASTSSAVTKNLPFSIISNRQLFKNRVYLLHRIPNASIRSFASTTASSKIRVENPIVEMDGDEMTRVIWTMIKEKLIYPYLELDTKYYDLGILNRDATDDQVTVESAEATLKYNVAVKCATITPDETRVKEFGLKSMWRSPNATIRNILNGTVFREPILCKNVPRIVPGWKKPICIGRHAFGDQYRATDAVINGPGKLKMVFEPENGEAPTELDVYDFKGPGVALAMYNVDQSIRAFAESSMSMAFSKKWPLYLSTKNTILKKYDGRFKDIFEEVYEEKWKQQFEEHSIWYEHRLIDDMVAYALKSGGGYVWACKNYDGDVQSDLLAQGFGSLGLMTSVLLSSDGKTLEAEAAHGTVTRHFRLHQKGQETSTNSVASIFAWARGLGHRAQLDGNQKLSEFVHALEAACVGTIESGKMTKDLAILVHGPKVSREHYLNTEEFIDPVAQKLQEKLGACAVV

SEQ ID NO: 5683 - DNA, 1308 bp, Caenorhabditis elegans
  CDS (1)..(1308)
atgttaagccgtctgacatcacgcaacgtacttcttgctcgcaatgtggctactgcagcaactcaggaacggcagaaaattaaagtggataacccagttgtcgatttggatggagatgagatgacgagaatcatctggaaagaaattaagaataagttaattcttccatacctggatctcgacatcaaatattatgaccttggtcttgaatacagagacgagacaaatgatcaggtcaccattgacgcagcccatgcaattcttgagcacagtgttggaatcaaatgcgccacaatcactccggacgaggctcgcatcaaagagtttaatcttaagaagatgtggctctcaccaaacggaacaatcagaaatattctaggaggaactgtatttcgtgagccaattctttgcaagaacattccacgactagtgcctggatggactcagccgatcacaattggccgccacgcttttggagatcagtataaatgcacagatttagttattccaagtggatcgacccttcagcttttagttaacaagccagacggatccaaagatgtgcataacgtgtatgacttcaaaaagtcgggaggtgttggattggctatgtataatactgatgagagcattaaaggatttgctcattcttgtttccaatacgcattgatgaagcaatggccactgtatctttccacaaagaacacgattctgaagaaatatgatggacgattcaaggatattttccaagatatatatgaaaagaaatatgaagcggatttcaagaacaataaaatttggtacgagcatcgattaattgatgatcaagttgcacaggcattgaagagctctggaggatttgtgtgggcttgcaagaactacgacggagatgtgcaaagtgacattgttgctcaaggatacggatcgctcggtctcatgtcttcagttttgatgtgtcccgacggaaagacaattgaagcagaagctgcgcatggaacagtcactcgacattatcgtgaacatcagaagggtaactcgacgtctacaaacccaattgcgtctatctttgcttggacaagaggtcttcatcacagaggcgtacttgacaataatgaagcattgaagacgttctcccttactttggaaaaggcatgcattgacactgtcgaggagggaaaaatgacgaaagatctttcaatttgcattcatggaaccaagaagggaaccgagaaaggagcttatcttattactgaagattttctgtccgctattgacaccaagatggcagagctcatgcgccaggattaa

SEQ ID NO: 5684 - protein, 435 aa, Caenorhabditis elegans
MLSRLTSRNVLLARNVATAATQERQKIKVDNPVVDLDGDEMTRIIWKEIKNKLILPYLDLDIKYYDLGLEYRDETNDQVTIDAAHAILEHSVGIKCATITPDEARIKEFNLKKMWLSPNGTIRNILGGTVFREPILCKNIPRLVPGWTQPITIGRHAFGDQYKCTDLVIPSGSTLQLLVNKPDGSKDVHNVYDFKKSGGVGLAMYNTDESIKGFAHSCFQYALMKQWPLYLSTKNTILKKYDGRFKDIFQDIYEKKYEADFKNNKIWYEHRLIDDQVAQALKSSGGFVWACKNYDGDVQSDIVAQGYGSLGLMSSVLMCPDGKTIEAEAAHGTVTRHYREHQKGNSTSTNPIASIFAWTRGLHHRGVLDNNEALKTFSLTLEKACIDTVEEGKMTKDLSICIHGTKKGTEKGAYLITEDFLSAIDTKMAELMRQD

SEQ ID NO: 5685 - DNA, 1239 bp, Caenorhabditis elegans
  CDS (1)..(1239)
atggcggctcaaaagatccaaggaggagacatcgtcgagatgcaaggagacgagatgaccagaatcatctgggatctgatcaaggagaagctcatccttccttacgtcgatctcaacgtacacttcttcgatctcggtattgagcatcgtgatgccaccgatgatcaagtcactatcgatgccgccaacgcgaccctcaagtacaatgttgctgttaagtgtgccaccatcactccagatgaggctcgtgtcgaggagttcaagctcaagaaaatgtggaagtcaccaaacggaactatccgtaacattcttggaggaacagtcttccgtgagccaattattgtcaagaacgtaccacgccttgtcaacacctggtcgaagccaatcatcattggacgtcacgctcatgctgatcaatacaaggccaccgactttgttgttccaggagctggaaagctcgaaatcaagttcgtttctgctgatggtacccagaccattcaggagaccgtcttcgacttcaaaggtccaggagtctccctctcaatgtacaataccgatgattctatccgggatttcgctcatgcatccttcaagtatgctcttcaacgtaaattcccactttacctatccaccaagaacactatcctgaagaagtacgatggacgtttcaaggatatctttgctgagatctacccagaatatgaggctgaattcaaggccgccggaatctggtacgaacatcgtcttatcgatgacatggttgctcaagccatgaagagcgatggaggattcgtgtgggcctgcaagaactatgacggagatgttcaatcagactctgttgctcaaggatatggatccctcggattgatgacatctgtgcttgtgtgcccagatggaaagaccgtcgaagctgaagctgctcacggaactgtcactcgtcattacagaatgcaccaaaagggacaagaaacctccacgaatccaattgcctccatcttcgcttggtctcgtggattggctcaccgtgccactctcgacaagaactctgcccttgagacattcgccaataatttggaagctgtgtgcattgagacaatggaggctggattcctcaccaaggatcttgccatttgcgtgaagggaggaaatgcttcagctgtcactcgtaccgactacctcaacacctttgaattcctcgacaaattggctgagaacctcgccaagaagcaagcccattaa

SEQ ID NO: 5686 - protein, 412 aa, Caenorhabditis elegans
MAAQKIQGGDIVEMQGDEMTRIIWDLIKEKLILPYVDLNVHFFDLGIEHRDATDDQVTIDAANATLKYNVAVKCATITPDEARVEEFKLKKMWKSPNGTIRNILGGTVFREPIIVKNVPRLVNTWSKPIIIGRHAHADQYKATDFVVPGAGKLEIKFVSADGTQTIQETVFDFKGPGVSLSMYNTDDSIRDFAHASFKYALQRKFPLYLSTKNTILKKYDGRFKDIFAEIYPEYEAEFKAAGIWYEHRLIDDMVAQAMKSDGGFVWACKNYDGDVQSDSVAQGYGSLGLMTSVLVCPDGKTVEAEAAHGTVTRHYRMHQKGQETSTNPIASIFAWSRGLAHRATLDKNSALETFANNLEAVCIETMEAGFLTKDLAICVKGGNASAVTRTDYLNTFEFLDKLAENLAKKQAH

SEQ ID NO: 5687 - DNA, 1257 bp, Schizosaccharomyces pombe
  CDS (1)..(1257)
atgaatatgcgtatggcttcaagcaaatcttttcaaaagatcactgttaaaaacccagtcgttgaaatggatggtgatgagatgacgagagtgatttggaagatcattcgtgaaaagttggttctcccatatatggacattaaattggattattatgaccttggaatcgaagctcgcgataagacaaacgaccaaattactgtggatgcagccaaagctatcctcaaaaatgatgtcggtatcaaatgtgccaccattactcctgatgaggctcgtgtgaaagagtataacctcaagaagatgtggaagtctcccaatggtaccattcgtaacattttgaatggtacagtatttcgggagcccattttaatcaaaaacattcccaagtatattcctggatggacgaaccctatttgtatcgggcgtcatgcctttggagatcaatacaagtcaacggacttggtagcttcaggccccggtaagttggaactttcattcacccctaaaggtaatccttctgctaaagaaacatacaatgtttacgagttcaacggtagtggtgtagctatgtctatgtacaacactgacgactctattcgtggatttgctcacagttctttccaaatggctttgcaaaagaaaatgccactttatctttccactaagaatacaattttgaaaaaatatgatggtagatttaaggatacattccaagaagtatatgaatctgattacaagcaaaagtttgaggaactaggtttatggtatcaacatcgtctaattgatgacatggtagcccaagctattaagtccaatggtggttttgtttgggcatgcaaaaattacgatggtgatgttatgtcggatgtggttgcccaagcttatggatccttaggcctaatgacttctgtcctcattcatcccaacggtcgcacttttgagagtgaggctgctcatggtactgtacagcgtcactacatgcaatacttgaaaggtaagaagacttcaaccaacagtattgcctctatctttgcctggactcgtggtcttgcccatcgtggtcgtttagatggcaacgaacgtttagttaagtttgccaacgccctcgagcatgcttgtgttcgatgcgttgagaagggtattatgacaaaggatctttaccttctcagcaagtctcccaatggttatgttgatacattcgagtttttggatgccgtcaagtccgagctcgattcggaattggtcaacattgcctaa

SEQ ID NO: 5688 - protein, 418 aa, Schizosaccharomyces pombe
MNMRMASSKSFQKITVKNPVVEMDGDEMTRVIWKIIREKLVLPYMDIKLDYYDLGIEARDKTNDQITVDAAKAILKNDVGIKCATITPDEARVKEYNLKKMWKSPNGTIRNILNGTVFREPILIKNIPKYIPGWTNPICIGRHAFGDQYKSTDLVASGPGKLELSFTPKGNPSAKETYNVYEFNGSGVAMSMYNTDDSIRGFAHSSFQMALQKKMPLYLSTKNTILKKYDGRFKDTFQEVYESDYKQKFEELGLWYQHRLIDDMVAQAIKSNGGFVWACKNYDGDVMSDVVAQAYGSLGLMTSVLIHPNGRTFESEAAHGTVQRHYMQYLKGKKTSTNSIASIFAWTRGLAHRGRLDGNERLVKFANALEHACVRCVEKGIMTKDLYLLSKSPNGYVDTFEFLDAVKSELDSELVNIA

SEQ ID NO: 5689 - DNA, 1827 bp, Glycine max
  CDS (289)..(1539)
ggcacgagctagcattattgatcgtttgtgtgggtgtgtctgttttcgttgtttcccactttccaaatcacatccaacgtgaatccgtcattcaacttgattgaagtatccaacgaaaattcaaacacacactaaccttactgagtgtgttcattgggaactggttcattccacacattttatttaagccaaaaaaacccacaatttctcttagtgtgtgctttttggttgaaattgttgtttcttcctctgagttccaactttcacctcagccaaagacacaacaaaatggggtttcagaagataagggtgggcaaccccatcgtcgaaatggatggggatgaaatgacccgagtgatttggaaactgataaaagataagcttattttcccttatttggagctggatattaagtattttgaccttggccttcctcatcgcgatgccactaatgatagagttactattgaaagcgctgaagctacactcaagtataatgtagctatcaaatgtgctactataactccagatgaagctcgtgtcaaggagtttaacttaaaacaaatgtggagaagtccaaatgggacgatccgaaacattttaaatggtacagtttttagagagccaattatctgtaagaacattcctcgtcttgtttcaggatggacaaagccaatatgcattggaagacatgcttttggagaccaatatcgggcaactgatacagttataaaaggcccaggaaagctaaaattggtttttgcacccagtggaaatgaaggcattaaagagctagaggtctataactttactggtgctggaggcatagctttgtccatgtataatactgatgagtccattcgagcttttgctgaggcttcaatgaactttgcttaccagaagaaatggcctctctatcttagcactaaaaataccattttaaagaaatatgatggaagattcaaggacattttccaggaagtttttgacacccaatggaatcacaagttcaaagctgcagggatatggtatgaacaccgtcttatagatgatatggttgcttatgctctcaaaagtgatggaggttatgtatgggcctgcaagaattatgatggtgatgtgcagagtgatttcttagctcaaggatttggttcacttggcttgatgacgtcagtactggtttgcccagatgggaaaaccattgaagcagaggcagcccatggcactgttacccgtcattatcgggttcatcagaagggaggtgaaaccagcacaaacagtattgcttcaatttttgcctggtcgcgaggtcttgcacataggccaaaattggatggaaatgctagattgttggacttcacagagaaactggaagcagcttgcattggaacagttgaattgggaaagatgacaaaggatcttgcacttcttgttcatggacctaaggtttctagatcccagtatttgaatactgaagagttcattgatgccgtagccgaggagctgcgaacaagattatcttcacaatcgaagctgtaatgttcaaaatgagtgtgcccaataaatgttctccatttccttcatttttcctttttctttcttgaaggagggaaattctattgcttgagttaaacattttagagcaataaggtccccctaaattcagatgcatcacttattgcaggttgcttccttcagccataagaactcaacatttgaagaactcataccatgtaccacaaaatcaatactatcttttcattgccaaaacaacagtgctactttggaagtccttacaacaatattaaagacatgtaaaaaaaaaaa

SEQ ID NO: 5690 - protein, 416 aa, Glycine max
MGFQKIRVGNPIVEMDGDEMTRVIWKLIKDKLIFPYLELDIKYFDLGLPHRDATNDRVTIESAEATLKYNVAIKCATITPDEARVKEFNLKQMWRSPNGTIRNILNGTVFREPIICKNIPRLVSGWTKPICIGRHAFGDQYRATDTVIKGPGKLKLVFAPSGNEGIKELEVYNFTGAGGIALSMYNTDESIRAFAEASMNFAYQKKWPLYLSTKNTILKKYDGRFKDIFQEVFDTQWNHKFKAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRPKLDGNARLLDFTEKLEAACIGTVELGKMTKDLALLVHGPKVSRSQYLNTEEFIDAVAEELRTRLSSQSKL

SEQ ID NO: 5691 - DNA, 1645 bp, Eucalyptus globulus
  CDS (161)..(1411)
ccgcgttgacacggctgcgagaagacgacagaagggggcagcactgttcaccgctgagctctcgtttcgccctgtccctatctccgtctcgctctctctctgcaaaagagctccctcgaatcgacctgcttcgacccttcctcgagcgcgggagagagcaatgggtttcgagaagatcaaggtcgagaaccccatcgtcgagatggacggggatgaaatgacccgagtgttctggaaatcaatcaaggataagcttatttttcccttcttggagttggatatcaagtacttcgaccttggtcttcctcatcgtgatgccactgatgacaaggttacaattgaaagcgcagaagcaactcttaaatacaatgtggccatcaaatgtgcaactattacaccagatgaagctcggatgaaggagtttactttgaagcaaatgtggaaaagtcccaatgggacgattaggaacatcttgaatggcactgtcttcagagagccaataatgtgcaaaaatattccccggcttgtcccagggtggtccaagccaatatgcattggaagacatgcttttggtgatcaatacaaagctactgatactgtcattaaaggagctgggaaacttaaacttgtctttgtgccagaaggcacagatgagaagactgagctagaagtgtataacttcacgggcgctggtggagttgcattgtccatgtacaacacagatgagtcaatccgttcttttgctgaggcttcaatgaacactgcttatcagaagaagtggccgctctatcttagcacaaagaataccatccttaaaaaatatgatggaagattcaaggatatattccaagaagtttatgaagccaactggaagtcaaagtttgaggctgctggaatctggtatgaacaccgtcttattgatgatatggtggcttatgcgctaaagagcgacggaggttatgtgtgggcatgcaagaactatgatggagatgtccagagtgatttcttagcccaagggtttggatcgcttggcttgatgacatctgtcttggtctgcccagacggaaaaactattgaagcagaagccgctcatggtacggttacccgccattatcgggtccatcagaaaggaggcgaaaccagcactaatagcattgcttctatatttgcttggtcacgagggcttgctcatagggccaagttggataacaatgccaaactccttgattttgccgagaaactagaagcagcttgtattggaactgttgagtctggcaagatgaccaaggatcttgcactcctcattcatggtcctaagtttactagggatcaatacctgaacaccgaagagtttattgatgctgtggcagttgaactcaaggcaaggctttcatgccaaagtctgctgtaggtgactggcggacaacatggggaaagcacttccgcctgtgattgtgatccggaagaagaaataaagggggatcgattcgggggagaatgaggtgaatcctgaatgagattgtttgttggggaggaattaaatgaaagtagttcgtatcattcatgtactcagatggatttgtgtttcaaatttgaattgccttgatcccccattaaaggagttttgagccccgtactgtttaac

SEQ ID NO: 5692 - protein, 416 aa, Eucalyptus globulus
MGFEKIKVENPIVEMDGDEMTRVFWKSIKDKLIFPFLELDIKYFDLGLPHRDATDDKVTIESAEATLKYNVAIKCATITPDEARMKEFTLKQMWKSPNGTIRNILNGTVFREPIMCKNIPRLVPGWSKPICIGRHAFGDQYKATDTVIKGAGKLKLVFVPEGTDEKTELEVYNFTGAGGVALSMYNTDESIRSFAEASMNTAYQKKWPLYLSTKNTILKKYDGRFKDIFQEVYEANWKSKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDNNAKLLDFAEKLEAACIGTVESGKMTKDLALLIHGPKFTRDQYLNTEEFIDAVAVELKARLSCQSLL

SEQ ID NO: 5693 - DNA, 1596 bp, Homo sapiens
  CDS (44)..(1303)
gggaatgagaaaataactttatttcattgtggggagcgggccgatgtccagcctcagaacttctggaactgcttcttggtccggcagccttggtgaccttgagcacgttgaagcgcactgtcttgctcagaggccggcactcgcccactgtgacgatgtcaccgatctggacgtccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatccatggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggcggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcgcaaaaaaaaa

SEQ ID NO: 5694 - protein, 419 aa, Homo sapiens [sequence omitted]

SEQ ID NO: 5695 - DNA, 1233 bp, Debaryomyces hansenii
  CDS (1)..(1233)
atgggattcaataagattaaggttgaccaaccaattgttgaaatggatggtgatgaaatgaccagaatcatctggaaatttatcaaagataagttgatcttcccatacttggacgtagatttgaaatactacgatttaggtattgaatacagaaatcagactgacgacaaggttaccaccgatgctgctgaagcaattttgaagtaccaagtcggagtcaaatgtgcaaccattaccccagacgaagccagagtcgaagaattcaagttgaagaagatgtggttatctccaaacggtacattgagaaatatcttgggtggaactgttttcagagaaccaattgtcattgataacatcccaagaatcgttccacaatgggaaagcccaattatcattggtagacatgcattcggtgatcaatacaaggccaccgatgttgttattccaaaggccggtcaattagaattagttttcaagccagctgatggctcagcaaccgaagtttatccagtgtacaactatgacgcgccaggtgttgcgttagccatgtacaacactgagaagtcaatcactgatttcgccgaatcatccttcaaaatggccttggatagaaaattaatattgttctcctctaccaagaacaccatcttgaagaagtacgatggtagattcaaagacatcttcgaagatttatacgaaaagaaatataagaagcaattcgaagaagccggtatctggtatgaacatagattaattgacgatatggtcgcccaaatgttgaaatccaagggcggttatatcattgccatgaagaactacgatggtgatgtgcaatcagatattgttgcgcaaggttttggttcattaggtttaatgacctctgtcttgatgaccccagatggaaaggcgttcgaagctgaagccgctcatggtacagttaccagacactataggcagcatcaacaaggtaaggagacctccactaactctatcgcttctatctttgcatggaccagaggtataattcaaagaggtaagttagataacaatgctgatgtcgttaaattcggtgaaagcttggaaaaagctactatcgataccgttgctttagacaacgtcatgactaaggatttagctttagctcaaggtaagactgaaagatcatcgtatgtcactaccgaagaattcatcgatgctgttgcaaagagattaaacaagaacttaggagcttaa

SEQ ID NO: 5696 - protein, 410 aa, Debaryomyces hansenii
MGFNKIKVDQPIVEMDGDEMTRIIWKFIKDKLIFPYLDVDLKYYDLGIEYRNQTDDKVTTDAAEAILKYQVGVKCATITPDEARVEEFKLKKMWLSPNGTLRNILGGTVFREPIVIDNIPRIVPQWESPIIIGRHAFGDQYKATDVVIPKAGQLELVFKPADGSATEVYPVYNYDAPGVALAMYNTEKSITDFAESSFKMALDRKLILFSSTKNTILKKYDGRFKDIFEDLYEKKYKKQFEEAGIWYEHRLIDDMVAQMLKSKGGYIIAMKNYDGDVQSDIVAQGFGSLGLMTSVLMTPDGKAFEAEAAHGTVTRHYRQHQQGKETSTNSIASIFAWTRGIIQRGKLDNNADVVKFGESLEKATIDTVALDNVMTKDLALAQGKTERSSYVTTEEFIDAVAKRLNKNLGA

SEQ ID NO: 5697 - DNA, 1296 bp, Debaryomyces hansenii
  CDS (1)..(1296)
atgagaaacccagctatgtctgggtacagcaaatattcaatgcgttcattttcgtcgagtttaatcaacttggacaaaattaaagtgaaaaatccgattgtcgaattagatggtgatgaaatgaccagaatcatctggcaaagaatcaaggacaaattaattaacccatacttggatgttgatttgaaatattacgatttaggtattgaaagtagagataaaacagacgatcagatcaccattgatgcggccaacgccattaaggaatacggggttggtgtcaagtgtgctacgatcacacctgatgaatccagagttgaagaatttaacttgaagaagatgtggttgtcgccaaatggtaccattagaaatattttaggaggtaccgttttcagggaagccattattattcctagaattccaagattggtaccaggatggaaggaacctattgtcattggtagacatgcacatggtgaccaatataaggctactgacttggtcattaacgaaccgggtaaattggaaatgacttttaccccagaaaacggtggagctccagaaactagaactgtgtacgattacaagggacctggtgtcggtttagctatgtataataccgatgagtccatcattggttttgcccattcttccttcaagatggcattaactaagaaattaccattatacttgtcaaccaaaaacactattttgaagaaatacgatggaagattcaaagacattttccatgaaatttatgaatccacctacaaaaaagaatttgaaaccaataacatctggtacgaacatagattaattgatgatatggttgcacaaatgattaaatctaagggtggttttgtcatggccttgaagaactatgatggtgatgtgcaatctgatattgttgcccaaggatttggttcattgggtttaatgacttctgttttgatgaccccagatggtaagaccttcgaaagtgaagctgcacacggtactgtcacaagacatttcagacaacatcaacaaggtaaggaaacttcaaccaactcgattgcctccatttttgcctggactagaggtattgctcaaagaggtagattagatgacaccccagatgtcgtaaaattcgccgaaattgtggaaaaggctacctttgatactgttcaagaagatggtattatgactaaggatttggctttagctcttggcagaaccgatagagaatcctacgtaaccacaactgaatttttggatgcagtttctgacaagttacagaaacaagtccaagtttag

SEQ ID NO: 5698 - protein, 431 aa, Debaryomyces hansenii
MRNPAMSGYSKYSMRSFSSSLINLDKIKVKNPIVELDGDEMTRIIWQRIKDKLINPYLDVDLKYYDLGIESRDKTDDQITIDAANAIKEYGVGVKCATITPDESRVEEFNLKKMWLSPNGTIRNILGGTVFREAIIIPRIPRLVPGWKEPIVIGRHAHGDQYKATDLVINEPGKLEMTFTPENGGAPETRTVYDYKGPGVGLAMYNTDESIIGFAHSSFKMALTKKLPLYLSTKNTILKKYDGRFKDIFHEIYESTYKKEFETNNIWYEHRLIDDMVAQMIKSKGGFVMALKNYDGDVQSDIVAQGFGSLGLMTSVLMTPDGKTFESEAAHGTVTRHFRQHQQGKETSTNSIASIFAWTRGIAQRGRLDDTPDVVKFAEIVEKATFDTVQEDGIMTKDLALALGRTDRESYVTTTEFLDAVSDKLQKQVQV

SEQ ID NO: 5699 - DNA, 1326 bp, Yarrowia lipolytica
  CDS (1)..(1326)
atgacccccacagaccctcccttgccagccatgctaactccagctaccacccggctgctagccctttctaaaaccatgtccaccaccgctactcgaggcctgtccaccaagatcaaggtcaagaaccccattgtcgagctcgatggtgatgagatgacccgaatcatctggaagtccatcaaggacaagctcattctgccctatctcgacattgatcttaagtactacgatctgggcatcgagtaccgagaccagactaacgaccaggtgaccattgacgccgccgaggccatcaagaagtaccaggtcggtgtcaagtgcgccaccatcacccccgacgaggcccgagtcaaggagtttggcctcaagaagatgtggctgtcgcccaacggtaccatccgaaacattctcggcggtactgttttccgagagcccattgtcattcccgccgtcccccggcttgtgcccggatggaaggagcctatcatcattggtcgacacgcccacggcgaccagtacaaggcccaggatgccgtcatccccggcgccggtgagctgactcttaacttcaagcccgctaacggaggcgacgagcaggtcatcaaggtgtacacctacgacgcccctggtgtcgccatggccatgtacaacactgacgagtccatcaccggctttgcctactcttcattcaacctggctctgcagaagaagctgcccctgtacatgtctaccaagaacaccatccttaagaagtacgacggccgattcaaggacattttccaggagatttacgacaaggagtacaaggataagtttgatgctgccggcatttggtacgagcaccgactcattgatgacatggtcgcccagatgatcaagtctaagggaggcttcatcatggccctcaagaactacgacggagacgtgcagtccgacattgttgcccagggctttggctctctcggtctcatgacctctgttctcgtcacccccgacggaaagacctttgagtccgaggccgcccacggcaccgtgactcgacactaccgacagcaccagcagggcaaggagacctctaccaactccattgcctccatcttcgcctggacccgaggcctcatccagcgaggcattctcgacgagacccctgaggtgaccaagtttgccgaggctctcgagaaggccaccgtcgacactgttgacaaggacggcattatgaccaaggatctggctctggccggtggcaagaccgaccgatcctcgtatgtgctgaccgaggagtttatcgacgctgtggccaacagactgaagaaggacctggcttag

SEQ ID NO: 5700 - protein, 441 aa, Yarrowia lipolytica
MTPTDPPLPAMLTPATTRLLALSKTMSTTATRGLSTKIKVKNPIVELDGDEMTRIIWKSIKDKLILPYLDIDLKYYDLGIEYRDQTNDQVTIDAAEAIKKYQVGVKCATITPDEARVKEFGLKKMWLSPNGTIRNILGGTVFREPIVIPAVPRLVPGWKEPIIIGRHAHGDQYKAQDAVIPGAGELTLNFKPANGGDEQVIKVYTYDAPGVAMAMYNTDESITGFAYSSFNLALQKKLPLYMSTKNTILKKYDGRFKDIFQEIYDKEYKDKFDAAGIWYEHRLIDDMVAQMIKSKGGFIMALKNYDGDVQSDIVAQGFGSLGLMTSVLVTPDGKTFESEAAHGTVTRHYRQHQQGKETSTNSIASIFAWTRGLIQRGILDETPEVTKFAEALEKATVDTVDKDGIMTKDLALAGGKTDRSSYVLTEEFIDAVANRLKKDLA

SEQ ID NO: 5701 - DNA, 1248 bp, Kluyveromyces lactis
  CDS (1)..(1248)
atgtcaaagattagtgtcaagactcccattgtggagatggatggtgatgaacaaacaagaatcatttggaaattaatcaaagaccacttgattcacccatatttggacattgatttgaaatactacgatctttccatcgaaaaccgtgatttgactgatgataaagtcactgaacaatccgctcaagcgactttgaaatacggtgttgctgtgaaatgtgctacgattacaccggatgaggctcgtgtcgaggaattcaaattgaaaaagatgtggaaatctccaaacggtaccattagaaatatcctaggtggtaccgtgttccgtgaaccaattgtgattccaagaattccaaagttggtgaccaactgggaaaaaccaatcattattggtagacacgctttcggtgaccaatacagggccactgacgtagttattccaggagcaggtaagttgaagttggtgttcgagagcgatgactcgaatacggaaaatatcgaactgagcgtttacgatttcgatgaagagagtaaaggtggtgttgccatggccatgtacaacactttggaatctatcactgggtttgctcatgcttctttcaagatggctttggaaagaggtttgcctctttactccaccaccaagaataccatcttgaagaaatacgacggtaagttcaaggacgtgttcgaatcgctatacgaaagtcagtacaaatcggcgttcgaagctaaggggatctggtacgaacatcgtttgatcgacgatatggttgctcagatgttgaaatcgaagggtggctacatcatcgcaatgaagaattacgatggtgatgtggaatccgatattgtcgctcaagggttcggttctcttggtctaatgacttctgtgttgattactccagatggtaaggccttcgaaagtgaagctgctcatggtaccgtcactagacattacagacaacaccaacagggtaaagaaacctcgacaaactcgatcgcctcgattttcgcttggaccagaggcttgatccaaaggggtaagttggatagcaccccagatgtggtgaaattcgccgaattggtggaatctgctaccgtcaacacggttcaagaagatgaaattatgactaaagatttggcattgatcttgggtaagaccgacagatcctcatacgtcactaccgaagagttcattgaagctgttcacaagagattggactccgaatttaaatcatcattcaactag

SEQ ID NO: 5702 - protein, 415 aa, Kluyveromyces lactis
MSKISVKTPIVEMDGDEQTRIIWKLIKDHLIHPYLDIDLKYYDLSIENRDLTDDKVTEQSAQATLKYGVAVKCATITPDEARVEEFKLKKMWKSPNGTIRNILGGTVFREPIVIPRIPKLVTNWEKPIIIGRHAFGDQYRATDVVIPGAGKLKLVFESDDSNTENIELSVYDFDEESKGGVAMAMYNTLESITGFAHASFKMALERGLPLYSTTKNTILKKYDGKFKDVFESLYESQYKSAFEAKGIWYEHRLIDDMVAQMLKSKGGYIIAMKNYDGDVESDIVAQGFGSLGLMTSVLITPDGKAFESEAAHGTVTRHYRQHQQGKETSTNSIASIFAWTRGLIQRGKLDSTPDVVKFAELVESATVNTVQEDEIMTKDLALILGKTDRSSYVTTEEFIEAVHKRLDSEFKSSFN

SEQ ID NO: 5703 - DNA, 1290 bp, Kluyveromyces lactis
  CDS (1)..(1290)
atgaaggccgcagtgatgagtattaatcgtcagttttccagctctgctgcaactgggttgcgcaagattaaagttcagactcccgttgtggagttggacggtgatgagatgactagaattatctgggataagattaagagtaaacttatcttaccatatttggatgtggatttgaagtattacgatctttccgtgacgaaccgtgatgccactaacgatcaagttactgtggattctgctaatgccatcaagaaatacggtgttggtgtgaaatgtgccactattacaccggacgagggtcgtgttaaagagttcaatttgaaaaagatgtggaaatcaccaaatggtaccatcagaaacatccttggtggtactgttttccgtgaaccaattgtcattcctagaatcccaagattagtgcctggatgggaaaaacctattgtcatcggtagacatgcccatggtgatcaatataaggccaccgatcttgtcgttccaggtcctggtaagttggaattggtttacaagccaactgatggatccgagaccaagactttggaagtttacgactacaagggtcctggtatcgctttggccatgtacaacacagacgaatccatccgtggattcgctcatgcctctttcaaattggctatcaccaagaaattgaacctttatctttccaccaagaacactatcttgaagaaatacgatggtagattcaaggatatcttccaggaaatttacgattccgagtataaatccgaatttgaaaagttgggtatctggtacgaacaccgtttaattgacgatatggttgcccaaatgatcaaatctaagggtggattcatccttgcgtttaagaactatgatggtgatgtccaatccgatatcgttgctcaagggttcgggtcccttggtttgatgacctctgttctagtgaccccagacggtaaggccttcgaaagtgaagctgctcacggtaccgtcactagacactacagacaataccaacagggtaaagaaacctcaacaaactccatcgcttccatcttcgcttggactagaggtttggccaagagaggtgaactagacaacactccagaagtcgtcgaatttgccaacttgttggaaaaatccactttgaacactgtccaagaagacggtatcatgaccaaagatttggcccttgcctgtggtaacactgacagatcaagttatgtgaacaccgacgaattcttggatgctgttgaaaagagattcagaaatgacgttaaatctctgcagtga

SEQ ID NO: 5704 - protein, 429 aa, Kluyveromyces lactis
MKAAVMSINRQFSSSAATGLRKIKVQTPVVELDGDEMTRIIWDKIKSKLILPYLDVDLKYYDLSVTNRDATNDQVTVDSANAIKKYGVGVKCATITPDEGRVKEFNLKKMWKSPNGTIRNILGGTVFREPIVIPRIPRLVPGWEKPIVIGRHAHGDQYKATDLVVPGPGKLELVYKPTDGSETKTLEVYDYKGPGIALAMYNTDESIRGFAHASFKLAITKKLNLYLSTKNTILKKYDGRFKDIFQEIYDSEYKSEFEKLGIWYEHRLIDDMVAQMIKSKGGFILAFKNYDGDVQSDIVAQGFGSLGLMTSVLVTPDGKAFESEAAHGTVTRHYRQYQQGKETSTNSIASIFAWTRGLAKRGELDNTPEVVEFANLLEKSTLNTVQEDGIMTKDLALACGNTDRSSYVNTDEFLDAVEKRFRNDVKSLQ

SEQ ID NO: 5705 - DNA, 1257 bp, Candida glabrata
  CDS (1)..(1257)
atggcagggaagatcaaagttaagaatcccattgtggagatggatggggatgagatgacgagggttatctgggggatggtgaaggataaattgatatatccatatttagatgttgatttgaagtactacgatctgtctattcagcacagagatgaaactgaggatagagttactgtagatgctgcagaggccaccttgaagcatggggtagcaattaaatgtgccactataacgccggatgaagcaaggatgaaggaattccatttaaagaagatgtggaaatctccaaatggtaccataagaaatatcctaggtggtacagtttttagggaaccgataattatcccacgtatacctagaattgttcctacatggaataagcccataattattggaaggcatgcgtttggggatcaatataaagcatcagatgcagtcatcaaagagccagggaaattagagctagtcttcactcctgcatcaggtcagggcaatcccaagacaattaaagtctatgattataaatcccccggcgtagcgctagcgatgtacaacactgacgaatcaataacaggatttgcaagagcttcgtttgagctagccataaagaggaaattaccattgtttttcactactaaaaatactatactgaagaaatatgacggtaggtttaaagatatcttccaaaagatgtacgatgaagattacaagggtaaattcaaggaactaggtataagttatgagcacaggcttattgatgatatggttgcgcaaatgattaaatccaaaggtgggtttatcattgccatgaaaaactatgacggggatgttcaatctgatatagtagcccaaggtttcggatcacttggcttaatgacatcgacattattgactccagatggtaagatcttcgaaagcgaagctgcacatggcacagtaactaggcattacaggcagtatcaaaagggcaaagagacctcgacaaactcaattgctacaatctttgcttggtcccaaggtataatccacagaggcaaagtggaccagacacctgatgttagactatttggagagatcctagagaggtctacaattgacactgtccagatagacggtatcatgactaaagacctagctctaattctcggaaagactgagagaaaggactacgcaagcacagaagagttcatagacgctgttgcaagaagactcaagcgtgagttcaattcccatttcaacaagccatcgaaactataa

SEQ ID NO: 5706 - protein, 418 aa, Candida glabrata
MAGKIKVKNPIVEMDGDEMTRVIWGMVKDKLIYPYLDVDLKYYDLSIQHRDETEDRVTVDAAEATLKHGVAIKCATITPDEARMKEFHLKKMWKSPNGTIRNILGGTVFREPIIIPRIPRIVPTWNKPIIIGRHAFGDQYKASDAVIKEPGKLELVFTPASGQGNPKTIKVYDYKSPGVALAMYNTDESITGFARASFELAIKRKLPLFFTTKNTILKKYDGRFKDIFQKMYDEDYKGKFKELGISYEHRLIDDMVAQMIKSKGGFIIAMKNYDGDVQSDIVAQGFGSLGLMTSTLLTPDGKIFESEAAHGTVTRHYRQYQKGKETSTNSIATIFAWSQGIIHRGKVDQTPDVRLFGEILERSTIDTVQIDGIMTKDLALILGKTERKDYASTEEFIDAVARRLKREFNSHFNKPSKL

SEQ ID NO: 5707 - DNA, 1272 bp, Candida glabrata
  CDS (1)..(1272)
atgctcggaagaagatgttttgcttcctctgcgaagcttgccaagatcaaagtgaagaccccagttgtagagctggatggtgatgagatgaccagaattatctgggacaagataaagaagcaactgatcctaccattccttgatgtcgatttgaagtactacgacttgtctatccagtcccgtgacaaaaccaaggaccagatcacacatgactctgctgaggctatcaagaaatatggtgtcggtgtcaagtgtgctaccatcaccccagatgaggcccgtgttaaggagttcaatttgaccaagatgtggaagtctcctaacggtacaattagaaacatactcggtggtaccgtcttcagagaaccaattgtcatcccaagagtccccagactggttccaggttgggaaaagccaatcatcataggtagacacgcccatggtgaccagtacaaggctactgatgccgttatacctggtcaaggtaagctagaacttgtctacaagccaaacggcgacgcctccaaggccgaagttatggaagtttatgactataagggcccaggtgttgcactagcaatgtataataccgacgaatccatccgtggttttgcccattcgtctttcaaactagcactacaaaagaaattgaacttgtttttgtccactaaaaacactattctaaagaaatacgatggtagattcaaggacatcttccaagaggtctacgattcagagtacaaacagaagtttgctgaattgaacatcacatatgagcaccgtctaatagatgacatggttgctcagatgatcaaatctaagggtggttttatcatggctttgaagaattacgatggtgatgtgcaatccgacattgttgctcaaggttttggttctctaggtttgatgacttctattttaatcactccagatggtaagaccttcgaaagtgaagctgctcacggtacggtcacaagacactacagaaagcaccaacaaggtgaagaaacttctactaactccattgcctctatttttgcttggaccagaggtctagctaagagaggtgaattggatggtactccagacgttgttagatttgccaacattttagaatctgcaactttgaacactgtccaacaagatggcattatgaccaaggaccttgctttagcatgtggtaagactgatagagcttcttatgtcactaccactgagtttttagatgcagtagaaaagagactacaaactgaaattaaatctattgactaa

SEQ ID NO: 5708 - protein, 423 aa, Candida glabrata
MLGRRCFASSAKLAKIKVKTPVVELDGDEMTRIIWDKIKKQLILPFLDVDLKYYDLSIQSRDKTKDQITHDSAEAIKKYGVGVKCATITPDEARVKEFNLTKMWKSPNGTIRNILGGTVFREPIVIPRVPRLVPGWEKPIIIGRHAHGDQYKATDAVIPGQGKLELVYKPNGDASKAEVMEVYDYKGPGVALAMYNTDESIRGFAHSSFKLALQKKLNLFLSTKNTILKKYDGRFKDIFQEVYDSEYKQKFAELNITYEHRLIDDMVAQMIKSKGGFIMALKNYDGDVQSDIVAQGFGSLGLMTSILITPDGKTFESEAAHGTVTRHYRKHQQGEETSTNSIASIFAWTRGLAKRGELDGTPDVVRFANILESATLNTVQQDGIMTKDLALACGKTDRASYVTTTEFLDAVEKRLQTEIKSID

SEQ ID NO: 5709 - DNA, 1236 bp, Candida glabrata
  CDS (1)..(1236)
atgagtaaagttaaggtagttaatcccatcgttgagatggatggtgatgaacagacaagaattatctggcatttaattcgtgagaaactaattttaccattcttggatgttgatttgaagtattacgacttgtctatcgaatacagagatgagaccaatgataaggtcaccgaagatagtgccttggctactttgaagtatggtgttgcggttaaatgtgctacaatcacccctgatgaggctcgtgttgaggaattcaacttgaaggagatgtggaaatcgccaaatggtactattagaaacattttgggtggtactgtgttcagagaacccattgttattcctagaatcccaaaattggtcccacaatggaaggaacctataatcattggtaggcacgccttcggcgaccagtatagggccaccgatgtcgttatcccagatgaaggtgaagttcgactagtgtacaaatcaaaggatggtaaaactgatatcgatattcctgtttataatttccctaaagaaggcggtgttgctatgatgatgtataatactactgaatctatccgtgggtttgctagagcttcttttaatatggctttggaacatgaaatgccactatattctactactaaaaacaccatcttaaagaaatacgatggtaaattcaaggacacatttgagtctatgtatgaagccgagtataaagaacaatttgaggccaaaggtatctggtatgagcatcgtttaatcgatgatatggtcgcgcaaatgttgaaatctaaaggtggttttattattgccatgaagaattacgacggtgacgttgaatctgatattgttgcccaaggctttggttccctaggtctaatgacttctgtactaatcagtccagacggtaaaacttttgagagtgaagctgctcatggtactgtcactaggcattacagacaacatcaacagggtaaagaaacttccactaactcgattgcatccatctttgcttggactagaggtattatccaaagaggtaagttagatgagaccgcagatgtagtcaaatttggtgaattgctagaaagagcaacagttgacactgttcaagaggatggcatcatgacgaaggatttagctttaattctaggtaaaaccgacaggtcggcttatgttactactgaggaatttattgatgcagtggaaaatcggataaaatcagagttccaaaagaacttttaa

SEQ ID NO: 5710 - protein, 411 aa, Candida glabrata
MSKVKVVNPIVEMDGDEQTRIIWHLIREKLILPFLDVDLKYYDLSIEYRDETNDKVTEDSALATLKYGVAVKCATITPDEARVEEFNLKEMWKSPNGTIRNILGGTVFREPIVIPRIPKLVPQWKEPIIIGRHAFGDQYRATDVVIPDEGEVRLVYKSKDGKTDIDIPVYNFPKEGGVAMMMYNTTESIRGFARASFNMALEHEMPLYSTTKNTILKKYDGKFKDTFESMYEAEYKEQFEAKGIWYEHRLIDDMVAQMLKSKGGFIIAMKNYDGDVESDIVAQGFGSLGLMTSVLISPDGKTFESEAAHGTVTRHYRQHQQGKETSTNSIASIFAWTRGIIQRGKLDETADVVKFGELLERATVDTVQEDGIMTKDLALILGKTDRSAYVTTEEFIDAVENRIKSEFQKNF

SEQ ID NO: 5711 - DNA, 1215 bp, Bartonella quintana
  CDS (1)..(1215)
atggtaaagatcaaagtgcaaaaccccattgttgaaattgatggggatgagatgacccgtatcatctggaaatatatcaaagacaaactgatccatccttatctcgacattgaccttaaatattacgatctttctgtcgaaaatcgagatacaaccaatgatcaagtaactatcgattctgcgaatgctatcaaaaaatatggggttggtataaaatgtgcaaccatcacgcctgatgaagcacgagtcaaagagtttaacctaaaaaaaatgtggaaatcacccaatggcacgatccgcaatattttagggggagtcatttttcgcgaaccgattatctgcaaaaatgtcccacgtctcgttcctaactggaccaaaccaattattatcggacgtcatgcttttggtgatcagtataaggcaactgatttcaaatttcctggcaagggaaagttaagtattaaatttgtcggcgatgacaatcaagttatcgaacatgatgtttttgacgccccaagtgcaggggtcgccatggctatgtataaccttgatgaatcaatttgtgattttgctcgagcatcttttaattatggactacagcggaatgttccagtctatctttcaacaaaaaacaccatactgaaatcttacgatggccgttttaaagatatctttcaagaaatattcgatgctgaatttaaagctgaatttgaaaatcgtaaattacattacgaacaccgcctcattgatgacatggttgcttctgcacttaaatggtcaggtggctacgtgtgggcatgtaaaaattatgatggtgatgttcagtccgatatcgttgctcaaggctttggttcccttggtcttatgacttctgttctcatgacaccagacggtaaaattgttgaagcagaagctgcacacggtacagtgacacgccattaccgtcagtatcaaaaaaatgaagaaacatcaacaaattctattgcatctatttttgcatggacacgtggcctgacgcatcgtgccaaacttgataacaatgagaaattaaaaaactttgccacaacattggaagaagtttgtattaagactgttgaagaaggttttatgaccaaagatctcgcacttttgattggacctaaacaaaaatggctttctacaacaggcttcctcgataaaattcatgaaaatctcaaaaaagcaatgggtaattaa

SEQ ID NO: 5712 - protein, 404 aa, Bartonella quintana
MVKIKVQNPIVEIDGDEMTRIIWKYIKDKLIHPYLDIDLKYYDLSVENRDTTNDQVTIDSANAIKKYGVGIKCATITPDEARVKEFNLKKMWKSPNGTIRNILGGVIFREPIICKNVPRLVPNWTKPIIIGRHAFGDQYKATDFKFPGKGKLSIKFVGDDNQVIEHDVFDAPSAGVAMAMYNLDESICDFARASFNYGLQRNVPVYLSTKNTILKSYDGRFKDIFQEIFDAEFKAEFENRKLHYEHRLIDDMVASALKWSGGYVWACKNYDGDVQSDIVAQGFGSLGLMTSVLMTPDGKIVEAEAAHGTVTRHYRQYQKNEETSTNSIASIFAWTRGLTHRAKLDNNEKLKNFATTLEEVCIKTVEEGFMTKDLALLIGPKQKWLSTTGFLDKIHENLKKAMGN

SEQ ID NO: 5713 - DNA, 1215 bp, Bartonella henselae
  CDS (1)..(1215)
atgataaagatcaaagtggaaaaccccattgttgaaatcgatggggatgaaatgacccgtataatctggaaatatatcaaagacaaattaatccacccgtatctggatattgaactcaaatattacgatctttccgtggaaaatcgagacgcaaccaatgatcaggtaactatcgattctgccaatgctattaaaaaatatggtgttggtataaaatgtgcaactataacaccagatgaatcgcgtgttaaagaattcaatttaaaaaaaatgtggaaatcacccaatggcacgatccgtaatattttaggaggcgttatttttcgcgaacctattatctgtaaaaatgtcccccgcctcgttcctaactggacaaagccaattattatcggacgtcatgcttttggtgatcaatataaggcaacagatttcaaatttcctggcaaaggaaagttaagtattaaatttgttggcgatgacaatcaagttatcgaacatgatgtttttgacgctccaagtgcaggtattgcaatggctatgtataacctcgatgaatcaattcgtgattttgcccgcgcatcttttaattatggactacagcgaaatcttccagtttatctttcaacaaaaaacaccattctgaaaacttacgatggtcgttttaaagacatctttcaagaaatatttgatgcagaatttaaggctgaatttgaaaatcgtaaattatattatgaacatcgcctaattgatgacatggttgcttctgcactgaaatggtcagggggctacgtgtgggcatgtaaaaactacgatggtgatgttcaatcagatatcgttgctcaaggttttggttcccttgggcttatgacttctgttctcatgacaccagacggtaaaattgttgaagcagaagctgcacatggtacagtaacacgccattatcgtcagtatcaaaaaaatgaagaaacatcaacaaattctattgcctctattttcgcatggacacgtggactgacgcaccgtgccaaacttgataacaatgaaaaattaaaaaatttcgccacaacactggaaagcgtttgtattaaaaccgttgaagaaggttttatgaccaaagatctcgcacttttaattggatctaaacaaaaatggctttctacaacaggttttctcgataaaattgatgaaaatctcaaaaaagcaatgggaaactaa

SEQ ID NO: 5714 - protein, 404 aa, Bartonella henselae
MIKIKVENPIVEIDGDEMTRIIWKYIKDKLIHPYLDIELKYYDLSVENRDATNDQVTIDSANAIKKYGVGIKCATITPDESRVKEFNLKKMWKSPNGTIRNILGGVIFREPIICKNVPRLVPNWTKPIIIGRHAFGDQYKATDFKFPGKGKLSIKFVGDDNQVIEHDVFDAPSAGIAMAMYNLDESIRDFARASFNYGLQRNLPVYLSTKNTILKTYDGRFKDIFQEIFDAEFKAEFENRKLYYEHRLIDDMVASALKWSGGYVWACKNYDGDVQSDIVAQGFGSLGLMTSVLMTPDGKIVEAEAAHGTVTRHYRQYQKNEETSTNSIASIFAWTRGLTHRAKLDNNEKLKNFATTLESVCIKTVEEGFMTKDLALLIGSKQKWLSTTGFLDKIDENLKKAMGN

SEQ ID NO: 5715 - DNA, 1212 bp, Rhizobium leguminosarum
  CDS (1)..(1212)
atgaacaagatcaaggtcgccaatcccgtcgccgatctcgacggcgatgaaatgacgcgcatcatctggcagctcatcaaggataagctgatccatccgtatctcgacctcgacatcgactatttcgacctctccgtcgaaaaccgcgacgccaccaacgaccaggtcaccgtcgatgccgccaacgccatcaagaagtatggcgtcggcatcaagtgcgcgacgatcacgccggatgaagcccgcgtcaaggaattcaacctcaaggaaatgtggaagagcccgaacggcacgatccgcaacattctcggcggcgtcatctttcgcgagccgatcatctgcaagaacgtgccgcgcctggttcccggctggaccaagccgatcgtcgtcggccgccacgccttcggcgaccagtaccgcgccaccgatttcaagttccccggcaagggcaagctgacgatcaagttcgtcggcgaggacggcaccgtcatcgagaaggaagtcttcaacgcaccgggcgccggcgtcgccatggccatgtacaacctcgacgaatcgatccgcgaattcgcccgcgcctcgatgatgtacggcctgatgcgcaagtggccggtctatctgtcgaccaagaacaccatcctcaaggcctatgacggccgcttcaaggacatcttcgaggaagtctacgagaccgaattcaaggatcagttcaaggaagccggcatcacctacgaacaccgcctgatcgacgacatggttgcttcggcgctcaagtggtccggcgggtacgtctgggcctgcaagaactacgacggcgacgtccagtccgacacggtcgcccaaggcttcggctcgctcggcctgatgacctcggttctgctgacgcccgacggcaagacggtcgaagccgaagccgctcacggcacggtcacccgtcactaccgccagcatcagaagggccaggaaacctcgacgaactcgatcgcctcgatcttcgcctggacccgcggcctggcgcaccgcgccaagctcgacgacaatgccgagctcgcccgcttcgcctcgacgctcgaaaaagtctgcgtcgacactgtcgaatccggtttcatgaccaaggacctggcgctgctgatcggccccgaccagccgtggctctcgaccaccgccttcctcgacaagatcgaccagaacctgcagaaggccatggcgtaa

SEQ ID NO: 5716 - protein, 403 aa, Rhizobium leguminosarum
MNKIKVANPVADLDGDEMTRIIWQLIKDKLIHPYLDLDIDYFDLSVENRDATNDQVTVDAANAIKKYGVGIKCATITPDEARVKEFNLKEMWKSPNGTIRNILGGVIFREPIICKNVPRLVPGWTKPIVVGRHAFGDQYRATDFKFPGKGKLTIKFVGEDGTVIEKEVFNAPGAGVAMAMYNLDESIREFARASMMYGLMRKWPVYLSTKNTILKAYDGRFKDIFEEVYETEFKDQFKEAGITYEHRLIDDMVASALKWSGGYVWACKNYDGDVQSDTVAQGFGSLGLMTSVLLTPDGKTVEAEAAHGTVTRHYRQHQKGQETSTNSIASIFAWTRGLAHRAKLDDNAELARFASTLEKVCVDTVESGFMTKDLALLIGPDQPWLSTTAFLDKIDQNLQKAMA

SEQ ID NO: 5717 - DNA, 1230 bp, Bdellovibrio bacteriovorus
  CDS (1)..(1230)
atgaaaaaaatcaaagttgccaatcccgtcgttgaactcgacggcgatgaaatgacaagaatcatctggaaattcatcaaacaacaattgatccttccataccttgatatcgacattaagtactatgacctgggcatggagcatcgtgatgctaccaacgaccaagtaactgttgacgctgcggaagcgatcaaaaagtacaacgtgggtatcaaatgcgcgacgatcactcctgacgaagctcgcgtaaaagaattcaacctgaaacaaatgtggaagtccccgaacggcactatccgtaacattttggatggtactgtattccgtgaacccatcatctgcaaaaacgttccacgtctggttcctaactggacagctcccatctgcatcggtcgtcacgctttcggcgaccagtaccgtgcaactgatttcgtaaccaaaggcaaaggcaagctgactgtgactttccagcctgagaacggtggagaaacgatcactcacgaagtttacaacttcaaaggcgatggcgttgctttgactatgtacaacactgacgaatccatcaccggtttcgcacgttcttgcttcaaccaggcgttgaccaagaaatggccgttgtacctttccactaaaaataccatcctgaaaaaatacgatggtcgcttcaaagacatcttcgaagagatctatcaaaaagaattcaaagcgaagttcgatgctgctggcatcacttacgagcaccgcctgatcgacgacatggttgcttccgctttgaaatggaatggtaacttcgtatgggcatgtaagaactacgacggcgacgttcagtccgatacagtagctcaaggcttcggttctttgggtctgatgacttccgtattggtcactccagacggtaagactatggaatctgaagcagctcacggcacagtgactcgtcactaccgtcagcaccagcaaggcaaaccaacttccacgaacccaatcgcttccatctttgcatggactcgcggtcttgagcaccgtggtaacctggataacaaccaggagcttgtgaagttcgctcagactttggaaaaagtctgcgttgagactgttgaagctggcttcatgaccaaagaccttgccgtttgcatctatggcgacaaagttccagctgacaagtacatgaacacggagccgttcctggcgaagttggatgagaacttgaaaaaagctctttccatgtaa

SEQ ID NO: 5718 - protein, 409 aa, Bdellovibrio bacteriovorus
MKKIKVANPVVELDGDEMTRIIWKFIKQQLILPYLDIDIKYYDLGMEHRDATNDQVTVDAAEAIKKYNVGIKCATITPDEARVKEFNLKQMWKSPNGTIRNILDGTVFREPIICKNVPRLVPNWTAPICIGRHAFGDQYRATDFVTKGKGKLTVTFQPENGGETITHEVYNFKGDGVALTMYNTDESITGFARSCFNQALTKKWPLYLSTKNTILKKYDGRFKDIFEEIYQKEFKAKFDAAGITYEHRLIDDMVASALKWNGNFVWACKNYDGDVQSDTVAQGFGSLGLMTSVLVTPDGKTMESEAAHGTVTRHYRQHQQGKPTSTNPIASIFAWTRGLEHRGNLDNNQELVKFAQTLEKVCVETVEAGFMTKDLAVCIYGDKVPADKYMNTEPFLAKLDENLKKALSM

SEQ ID NO: 5719 - DNA, 1227 bp, Rhodopseudomonas palustris
  CDS (1)..(1227)
atggcgaaaatcaaggtgaagaaccccgtcgtggaactcgacggtgacgagatgaccaggatcatatggcagatgatcaaggacaagctcatcaccccgttccttgatgtcgagctgatgtatttcgacctcgggatggagcaccgcgacaagaccgacgatcaggtcacgatcgatgcggccaacgccatcaagcaggtcggcgtcggcgtgaagtgcgccaccatcaccccggacgaagcgcgggtgaaggagttcggcctcaagagcatgtggaagtcgccgaacggcaccatccgcaacatcctcggcggcgtgatcttccgcgagccgatcatctgcaagaacgtgccgcggctggtgccgggctggaccaagccgatcgtgatcggccgccacgcctacggcgaccagtatcgtgcgaccgacatcaagttccccggcccgggcacgctgacgatgaagttcgtcggcgaggacggctcggtgatcgagcgcgaagtgttcaaggcgcccggcgccggcgtcgcgatgtcgatgtacaacctcgacgagtcgatcaaggacttcgcccgcgcctcgctgaactacggcctgatgcgcaactacccggtctatttgtcgaccaaaaacaccatcatgaaggtgtacgatggccgcttcaaagacatcttccaggagatcttcgacgccgagttcaagaaggaatacgacgccaagggcctgacctacgagcaccgcctgatcgacgacatggtcgcctcggcgctgaagtggtcgggcggctacgtctgggcctgtaagaactacgacggcgacgtgcagtccgacaccgtggcgcagggttacggctcgctcggcctgatgacctcggtgctgatgacgccggacggcaagacggtggaagccgaagccgcccacggcaccgtcacccgtcactaccgcgaacaccagaagggcaaggcgacctcgaccaactcgatcgcctcgatcttcgcctggacccgcggcctcgcgcatcgcgccaagctcgacagcaacgaagagctcgctcgcttcgccgacctgctcgagaaggtctgcgtcgacaccgtcgaagccggcgcgatgaccaaggacctcgcgctcctggtcggcgccgaccagcgctggctgtcgaccgagggcttcctcgacaaggtcgcgcagaacctcaacaaggcgatggaagacgccaaggccgcctga

SEQ ID NO: 5720 - protein, 408 aa, Rhodopseudomonas palustris
MAKIKVKNPVVELDGDEMTRIIWQMIKDKLITPFLDVELMYFDLGMEHRDKTDDQVTIDAANAIKQVGVGVKCATITPDEARVKEFGLKSMWKSPNGTIRNILGGVIFREPIICKNVPRLVPGWTKPIVIGRHAYGDQYRATDIKFPGPGTLTMKFVGEDGSVIEREVFKAPGAGVAMSMYNLDESIKDFARASLNYGLMRNYPVYLSTKNTIMKVYDGRFKDIFQEIFDAEFKKEYDAKGLTYEHRLIDDMVASALKWSGGYVWACKNYDGDVQSDTVAQGYGSLGLMTSVLMTPDGKTVEAEAAHGTVTRHYREHQKGKATSTNSIASIFAWTRGLAHRAKLDSNEELARFADLLEKVCVDTVEAGAMTKDLALLVGADQRWLSTEGFLDKVAQNLNKAMEDAKAA

SEQ ID NO: 5721 - DNA, 1564 bp, Pisum sativum
  CDS (79)..(1317)
aggatccgggtaccatggttctcacctaacatctcgttctccgcatcttcatcctcttctcttcttccgatcaccaccatggcattccagaaaatcaaagtcgccagtcccatcgttgagatggacggagatgaaatgacccgagttatctggaagtcaatcaaggataagctcatttttcctttcttggagttggacatcaagtactttgacctaggccttcctcatcgtgatcagactgatgataaagttacagttgaaagtgccgaagcaactctcaagtataatgttgcaatcaagtgtgcaactatcactccagatgaagctcgtgtcgaggagttcggcctgaagagcatgtggaggagtccaaatgggacaattagaaacattttgaatggaactgtcttcagagaaccaattatttgcaaaaatgtccctcgccttattcctggttggacaaagccaatatgtattggaaggcatgcttttggtgatcaatatagggccactgatgcagttattaaaggacctggaaagctgaagatggtgtttgttccagaaggcaaaggtgagaccactgatttggaggtttataacttcactggtgaaggaggtgttgcattggctatgtacaacactgatgagtctattcgttcttttgctgaggcatctatggcaactgctttagagaaaaaatggccactttatcttagcaccaaaaatacaattcttaagaaatatgatggaagattcaaggacatatttcaagaagtttacgaggcaagctggaaatcaaagtacgaggctgctggtatatggtatgagcatcgactcattgatgatatggtggcatatgcactcaagagtgaaggaggttatgtatgggcatgcaagaactatgatggagatgtccagagtgatttcttagctcaaggttttggatcgttgggtttgatgacatctgtattggtttgccctgatgggaagactattgaagcagaagcagcccatgggacagttacccgtcatttcagggttcatcaaaagggcggagaaaccagcacaaacggcatagcatccatctttgcttggacaagaggtctagcccatagggcaaagctagatgacaatgctaaactcttggaactcactgaaaagctagaggcagcttgtattggagcagtagaatctgggaagatgaccaaggatttggcacttattcttcatggatcccagcttaagagggagcattatttgaacacagaggaattcatcgatgctgtggcagccgagcttaaatcgaagatctctgcgtagatttgtgattttagatattagaaaagtgatgagattggagaggttcgcatgcactttcaaaagaaataagaaagaggattgaagcattggacttggctatttttctttccttcatttgtgtgttgggtcggatagcatgggttgtgcttccccccgtttagtttgaaattttgaattgggtacctttgaattttgacttacaaatttaaatggattttgttttgctatctctgctgaaaaaaaaaaa

SEQ ID NO: 5722 - protein, 412 aa, Pisum sativum
MAFQKIKVASPIVEMDGDEMTRVIWKSIKDKLIFPFLELDIKYFDLGLPHRDQTDDKVTVESAEATLKYNVAIKCATITPDEARVEEFGLKSMWRSPNGTIRNILNGTVFREPIICKNVPRLIPGWTKPICIGRHAFGDQYRATDAVIKGPGKLKMVFVPEGKGETTDLEVYNFTGEGGVALAMYNTDESIRSFAEASMATALEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHFRVHQKGGETSTNGIASIFAWTRGLAHRAKLDDNAKLLELTEKLEAACIGAVESGKMTKDLALILHGSQLKREHYLNTEEFIDAVAAELKSKISA

SEQ ID NO: 5723 - DNA, 2254 bp, Ovis aries
  CDS (167)..(1411)
tgccggaacagctgtggtctagccgggattgccagagtagacactgagtgactgtgtgctcccgagtcatcgccaacgtaccttccccgcaggaggtaagctgagtctgcgagactgagaggagttggggtgattagaaattgtaaagaggtttattgaagtcaacatgtctcacaaaatccaaggcggatctgtggtagagatgcaaggagatgaaatgacacgaatcatttgggagttgattaaagagaaactcatttttccctacgtggacctggacctgcacagctacgatttaagcatagagaatcgcgatgccaccaatgaccaggtcaccaaggacgctgcagaagctataaagaagtacaacgttggtgtcaagtgtgccaccatcacccccgatgagaagagagtggaggagttcaagctgaaacagatgtggaagtctccgaatggcaccatccgaaatatcctgggtggcactgtcttcagggaagctattatctgcaaaaatattccccggctcgtgagcggatgggtaaaacccattatcataggtcgtcatgcttatggggatcaatatagagcaactgattttgttgtgccggggcctggaaaagtagagatatgctataccccaagcgatggatcccccaaaacggtatacctagtacataacttcacagagagtggtggtgttgccatggggatgttcaatcaagataagtcaatcgaagattttgcacacagttctttccagatggctttgtctaagaattggcctttgtatctgagcaccaaaaacactattctgaagaaatacgatggacgttttaaagacatctttcaggagatatatgacaagcagtacaaatctcagtttgaagctcaaaatatctggtatgagcacaggcttattgatgacatggtggcccaagctatgaaatcggaggggggcttcatttgggcctgtaagaactatgatggggacgtgcagtcggactccgtggcccaaggttatggctctctcggcatgatgaccagtgtgctggtttgtccagatggcaagacagtagaagcagaggctgcccatgggactgtcacccgtcactaccgaatgtaccagaaaggacaggagacgtccaccaatcccattgcttccatttttgcctggaccagaggcttagcccacagagctaagcttgataacaataaagagctcagcttttttgcaaaggctttggaagaagtctgtattgagaccattgaggctggcttcatgaccaaggacttagctgcatgtattaaaggtttacccaacgtgcaacgttctgactacttgaatacgtttgagttcatggataaactcggagagaacctgcagttgaaactagcccaggccaaactttaaggtcatttcttgtctttggaggatgtttttttttctggtaactagggtctactggtttacatttttctctataactctcaagggtaaaggcaaatcaattttgtaatttgtttagaagccagagtttatcttttctataagtttacagcctttttcttatgcatacagttatgccacctttgtgaacgtggccggggacttttttttaattttattttctactaatagcctaggaattatttttaatgtccacttgtactcactgtcactttttcttatgtgctgagatcaatgaccaaaatcaacagtgctcaaaaggataaactgtagccacggtgttattccctgaaattgtatagagattcattccctttctcgattttcatggcctggggcgctgggtcattctaatgtaacaggtatctcattatttgcagtagaagctgcatgttagacttgcttatgatttgaaatgaagagcatggctgtaactaaatcgtattgaagactcatctttgttaagagctctagttgaatcttttaaaaatactaaatatttttgagctccttggagaatccagaagaaatactacctgagggggcgggggttgtcctctgtgtttgtctcctcctcctggccttgtgtggcctaagtattttgcgaccttgaacagcacgtttcatccaagtgcaataatacaagctgcaccttttttttggacctctgctggcctcttttatttcctttatgtaaatgtgatttttcagaagttgattgtaaacactatcctagtcctgttcttcatctaaactatcgattttaattaaaattcagtgctaatg

SEQ ID NO: 5724 - protein, 414 aa, Ovis aries
MSHKIQGGSVVEMQGDEMTRIIWELIKEKLIFPYVDLDLHSYDLSIENRDATNDQVTKDAAEAIKKYNVGVKCATITPDEKRVEEFKLKQMWKSPNGTIRNILGGTVFREAIICKNIPRLVSGWVKPIIIGRHAYGDQYRATDFVVPGPGKVEICYTPSDGSPKTVYLVHNFTESGGVAMGMFNQDKSIEDFAHSSFQMALSKNWPLYLSTKNTILKKYDGRFKDIFQEIYDKQYKSQFEAQNIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELSFFAKALEEVCIETIEAGFMTKDLAACIKGLPNVQRSDYLNTFEFMDKLGENLQLKLAQAKL

SEQ ID NO: 5725 - DNA, 1197 bp, Leptospira interrogans
  CDS (1)..(1197)
atggcaaagatcaaggtaaaaaccccgctcgtggagcttgacggggacgagatgaccaggatcatctggaaggagattaaggatagattcattcatccgtatctcgatatagaactggattattatgatttaggcgtggagtacagggacaaaacggatgataaagtaaccgtggattctgctcacgcgattcaaaaatatggagtaggcgtaaaatgtgcgacgattactcctaaccaagatagagttaaagaatacaatctcaaacaagaatggaaatctccgaacggaaccattcgttctattttagacggaaccgtttttcgtaaaccgatcatcgtaaaaaatattcctcctgcggttcgttcttggaaaaaaccgattacagtaggacgtcacgcttacggagatctttataaggacacagaactttatattcccgaagccggaaaggtggaactcgtttataccggaaaggacggaaaagaaaaacaaagagctttgattcacgactttgaaggagccggtgtgatcatggggcaacataacttggataagtcgatcttaagttttgcccaggcttgttttaactacgctatttccgaaaagattgatctttggttcgctacaaaggacacaatctccaaaaaatatcacgccagattccgcgccatctttgacgaacttgcaaaggctaaagctgcggatctcaaaaaagcgggaattgaatattcgtattatctaatcgatgacgcagtcgctcagctgatgaaaaatgaaggtggaatgctctgggccctgatgaattacgacggagatgttatgagcgacatggtcgcctccggatttggatctttaggacttatgacttctgtgctcgtttctcctgatggaaaatttgaatacgaagcagcacacggtactgtgaccagacattatcgtaaataccaacagggtgaaactacttctacaaattcggtagcttctatttttgcttggacgggtgcgttgattaaaaggggagagttggacggaactcccgatgtggtcgcatttggtcataagctggaaaaagcggtgattgatacaatcgaaagcggagagatgacaaaagatttaactcttctttgcaccgattcgaatgcaaaagctttagacacttttcaatttatggaagcaattcaaaaacgactttaa

SEQ ID NO: 5726 - protein, 398 aa, Leptospira interrogans
MAKIKVKTPLVELDGDEMTRIIWKEIKDRFIHPYLDIELDYYDLGVEYRDKTDDKVTVDSAHAIQKYGVGVKCATITPNQDRVKEYNLKQEWKSPNGTIRSILDGTVFRKPIIVKNIPPAVRSWKKPITVGRHAYGDLYKDTELYIPEAGKVELVYTGKDGKEKQRALIHDFEGAGVIMGQHNLDKSILSFAQACFNYAISEKIDLWFATKDTISKKYHARFRAIFDELAKAKAADLKKAGIEYSYYLIDDAVAQLMKNEGGMLWALMNYDGDVMSDMVASGFGSLGLMTSVLVSPDGKFEYEAAHGTVTRHYRKYQQGETTSTNSVASIFAWTGALIKRGELDGTPDVVAFGHKLEKAVIDTIESGEMTKDLTLLCTDSNAKALDTFQFMEAIQKRL

SEQ ID NO: 5727 - DNA, 1239 bp, Mycobacterium paratuberculosis
  CDS (1)..(1239)
atgtccaaccccgccaacacgtccaagatcaaggtcaagggccgcgtcgtcgagctcgacggtgacgagatgacccgggtcatctggaagatgatcaaggagaacttgatccttccctacctcgacatcgacctggactactacgacctgggcatcgagcaccgcgaccgcaccgacgaccaggtgacgatcgacgcggcgtatgccatcaagaagcacggcgtgggcgtcaagtgcgcgacgatcacccccgacgaggcgagggtccgggagttcaacctcaagaggatgtggctgtccccgaacgggacgatccggaacatcttgggcggcaccatcttccgcgagccgatcgtgatatccaatgtgccccggctggttccgggctggaccaagccgatcgtcatcggccgccacgcattcggtgaccagtaccggtcgaccaacttcaaggtggacaagccgggcaccgtcgcgatcaccttcactcccgccgacggcagcgagccgatcgtgcacgagatggtgtccatccccgaggacggcggggtggtgatggggatgtacaacttccgggagtcgatccgcgacttcgcccgcgcgtcgttcaagtacggcctgaacgccaaatggccggtgtacctgtcgaccaagaacaccatcctcaaggcctacgacggcatgttcaaggacgagttccagcgcatctacgacgaggaattcaaggagcagttcgaagccgagggactgacctacgaacaccggctgatcgacgacatggtggcggcctgcctcaaatgggagggcggctacgtgtgggcctgcaagaactacgacggcgacgtccaatccgacgcgatagcacagggttacggctcgctggggctgatgacctcggtgctgatgaccgccgacggcaagacggtcgaggccgaggccgcgcacggcaccgtcacccggcacttccgtcagtaccaggccggcaagccgacctcgaccaacccgatcgcctcgatcttcgcctggacgcgcgggctggcgcaccgcggcaagctggacgacacccccgaggtggtcgagttcgcgcagaccctggaacgcgtcgtcgtctccaccgtggagagcggcaagatgaccaaggacctcgccatcctgatcggccccgaccaaaagtggcagcagagcgaggaattcctcaactcgatcgccgagaacctgcggcgggagctgactaactag

SEQ ID NO: 5728 - protein, 412 aa, Mycobacterium paratuberculosis
MSNPANTSKIKVKGRVVELDGDEMTRVIWKMIKENLILPYLDIDLDYYDLGIEHRDRTDDQVTIDAAYAIKKHGVGVKCATITPDEARVREFNLKRMWLSPNGTIRNILGGTIFREPIVISNVPRLVPGWTKPIVIGRHAFGDQYRSTNFKVDKPGTVAITFTPADGSEPIVHEMVSIPEDGGVVMGMYNFRESIRDFARASFKYGLNAKWPVYLSTKNTILKAYDGMFKDEFQRIYDEEFKEQFEAEGLTYEHRLIDDMVAACLKWEGGYVWACKNYDGDVQSDAIAQGYGSLGLMTSVLMTADGKTVEAEAAHGTVTRHFRQYQAGKPTSTNPIASIFAWTRGLAHRGKLDDTPEVVEFAQTLERVVVSTVESGKMTKDLAILIGPDQKWQQSEEFLNSIAENLRRELTN

SEQ ID NO: 5729 - DNA, 1278 bp, Ashbya gossypii
  CDS (1)..(1278)
atgctcggcagaggcaggatgctcggcagaaggttgttttcaggtagcagggcggcggcgcggatccgggtgaagacgccggtggtggagttggacggggatgagatgacgcggatcatctgggagcgcatcaagcagcagctggtgctgccgcacgtggacgtggagctgaagtactacgacctgtcgatcacgtcgcgggacgcgacgtcggaccaggtgacggtggacgcggcccacgcgatcaagcagtacggggtgggcgtgaagtgcgcgacgatcacgcccgatgaggcgcgcgtgcgggagttcgggctgaagaagatgtggcggtcgcccaacggcacgatccgcaacattctgggcgggacggtgttccgcgagccgattgtgattccacggatccccaggctggtgccggggtgggaaaagccgatcatcatcggcaggcacgcgcacggggaccagtacaaggccacggacgcggtggtccctggcgcgggcacgctcgacctggtgttccggccggcggacggatctgcacccacttcgctgcatgtgtacgacttcgcggggcctggcgttgccctggcgatgtacaacaccgaggagtccatacgcggcttcgcgcacgcgtcgttccgcctggcgctggccaagcagctgaacctgttcctgtcgacgaagaacacgatcctcaagcagtacgacggccgcttcaaggacgtgttcgaggagctgtaccaggcgcagtacaaggccgagttcgagcgcctgggcatctactacgagcaccgcctcatcgacgacatggttgcgcagatggtcaagtccaagggcggcttcatcatggcactcaagaactacgacggcgacgtccagtcggacatcgttgcgcagggcttcggctcgctcggcctgatgacctcggtcctggtgacgccggacggcaagaccttcgagagcgaggctgcccacggcaccgtcacgcgccacttccgccagcaccaggcgggtaaggagacgtccaccaactccatcgcgtccatctttgcctggacccgcggcctcgccaagcgcggggagctcgacaacacgccggacgtggtcaacttcgcccacgcgctcgaggcggccaccacgaacacggtccagctcgacgggatcatgaccaaggacctcgcgctggcctgcggcaggtcggaccgctcggcctacgtgaacacgaacgagttcatcgatgccgtcgaggcacggctcaagaaggagcttgcttag

SEQ ID NO: 5730 - protein, 425 aa, Ashbya gossypii
MLGRGRMLGRRLFSGSRAAARIRVKTPVVELDGDEMTRIIWERIKQQLVLPHVDVELKYYDLSITSRDATSDQVTVDAAHAIKQYGVGVKCATITPDEARVREFGLKKMWRSPNGTIRNILGGTVFREPIVIPRIPRLVPGWEKPIIIGRHAHGDQYKATDAVVPGAGTLDLVFRPADGSAPTSLHVYDFAGPGVALAMYNTEESIRGFAHASFRLALAKQLNLFLSTKNTILKQYDGRFKDVFEELYQAQYKAEFERLGIYYEHRLIDDMVAQMVKSKGGFIMALKNYDGDVQSDIVAQGFGSLGLMTSVLVTPDGKTFESEAAHGTVTRHFRQHQAGKETSTNSIASIFAWTRGLAKRGELDNTPDVVNFAHALEAATTNTVQLDGIMTKDLALACGRSDRSAYVNTNEFIDAVEARLKKELA

SEQ ID NO: 5731 - DNA, 1248 bp, Ashbya gossypii
  CDS (1)..(1248)
atgggcaaggtgaaggtacaacaacccatcgtcgagatggacggcgacgaacagacgcggatcatctggcacttgatcaaggatcagctcatcttcccctacttggacgtggacttgaagtactacgatctttccattgagaacagggatgccaccgaggaccgcgtgactgtggagtctgcggaggcgaccctcaagtacggcgttgccgtcaagtgtgcgaccattaccccggacgaggcgcgtgtcgaggagttcgggctcaaggagatgtggaagtctcccaacgggaccatccggaacatcctcggcgggaccgtcttcagagagcccattattatcccaaggatccccagactggtgcccggctggaacgagccgatcattgtcggcagacacgcgtttggggaccagtacaaggcgaccgacgttgtcattccaggcgagggcacgttgaagctggtctttgaaagcaaggacggggacaagtccaagaatcttgacctggaggtctttgaataccccaaggatggcggtgttgccatgaccatgtacaacaccaccgactcgatcaccggctttgccaagtcgagcttcgagttggcgttgcaaagaaagatgccgctatattcgacaacgaagaacacgatcttgaagaagtacgacggcaagtttaaggatattttcgagggcatgtacgcagcggagtacaaggagaagtttgaggctgctggcatctggtatgaacacagactgattgacgatatggttgcgcagatgttgaagtccaagggcggcttcatcattgccatgaagaactacgatggtgatgtgcagtcggacatcgtcgcccagggcttcgggtctttgggtctcatgacttctgttcttgtgtctccagatggaaagaccttcgagagtgaggccgcacatggcactgtcacccggcactacagacagcaccagcagggcaaggaaacatccaccaactcaattgcctctatttttgcctggacgcgcggtattatacacagaggtaaggtcgacggtaccccagatgtcgtgaagttcggcgagttgttggagaagtccaccctggacacggtgcaggaggacaacatcatgaccaaggacctagcgttgattttgggcaagaccgacagagccagctatgttaccacggaagagtttatcacagcagtagcgaaccgcttagcggatggctacaagcgtcttttttgtgaataa

SEQ ID NO: 5732 - protein, 415 aa, Ashbya gossypii
MGKVKVQQPIVEMDGDEQTRIIWHLIKDQLIFPYLDVDLKYYDLSIENRDATEDRVTVESAEATLKYGVAVKCATITPDEARVEEFGLKEMWKSPNGTIRNILGGTVFREPIIIPRIPRLVPGWNEPIIVGRHAFGDQYKATDVVIPGEGTLKLVFESKDGDKSKNLDLEVFEYPKDGGVAMTMYNTTDSITGFAKSSFELALQRKMPLYSTTKNTILKKYDGKFKDIFEGMYAAEYKEKFEAAGIWYEHRLIDDMVAQMLKSKGGFIIAMKNYDGDVQSDIVAQGFGSLGLMTSVLVSPDGKTFESEAAHGTVTRHYRQHQQGKETSTNSIASIFAWTRGIIHRGKVDGTPDVVKFGELLEKSTLDTVQEDNIMTKDLALILGKTDRASYVTTEEFITAVANRLADGYKRLFCE

SEQ ID NO: 5733 - DNA, 1287 bp, Dictyostelium discoideum
  CDS (1)..(1287)
atgatttcaaatattagtaaaaaaatcctttcaaattcatcaaaattcattcaacaacaatcttattccacaaaaagaattaaagtaacaggaccagttgttgaaatggatggtgatgaacaaactagaattatgtgggaatcaattaaatcaaaattaattttcccatatgttgatattacaccagaatattatgatttaggtttaccaaatcgtgatgcaaccaatgatcaagttacaattgatgcagccaatgcaattaagagagcaaagattggtgttaaatgtgcaaccatcacaccggatgaagcacgtgtaaaagagtttggattaaaggagatgtggaaatcaccaaacggtaccattcgtaatattttggatggtacagtattcagaggaccaatcatttgtaagaatttaccattgttagtaccaggttggaagaaaccaatcatcattggtcgtcatgctcatggtgatcaatacaaagccaccgatttcgttgttaacggtccaggtaaattagagatgattttcacaccaagtcaaggcgagccaattaaaaaggtgatctatgatttcaaaggttcaggtgttgcaatgggtatgtataatacaactagctcaatcactgctttcgctcatagttgtttccaatacgctatcgataaaaagtatccattatatctctccacaaagaacacaattctcaagaaatacgacggtcaattcaaagacattttccaagagatctacgaaagagaatacagcactaaatttggtgaattgggtatttggtatgaacatagactcattgatgatatggttgcttttgcactcaagagtgagggtggtttcgtttgggcttgtaaaaactatgatggtgatgttcaatcagatatcgtcgcccaaggttatggtagtttaggtcttatgacttcagtattaaccaatgctgatggagttttcgcaagtgaagcctcccatggtactgtcactagacatttccgtgaacatcaaaaaggtaatgaaactagtaccaattctgttgcttccattttcgcttggacaagtgcacttggtcaacgtggtaaattagataacaataaagatctcgttaaattcgctcaagatatggaaaaagcatgtgttgaatcaattgaatctggtttcatgactaaagatttagcaatttgtatcaaaggaaaccaagttaaaagatcaaattacttaaatactgaagaatatattaacaaagttgctgaattttataataaaattaaataa

SEQ ID NO: 5734 - protein, 428 aa, Dictyostelium discoideum
MISNISKKILSNSSKFIQQQSYSTKRIKVTGPVVEMDGDEQTRIMWESIKSKLIFPYVDITPEYYDLGLPNRDATNDQVTIDAANAIKRAKIGVKCATITPDEARVKEFGLKEMWKSPNGTIRNILDGTVFRGPIICKNLPLLVPGWKKPIIIGRHAHGDQYKATDFVVNGPGKLEMIFTPSQGEPIKKVIYDFKGSGVAMGMYNTTSSITAFAHSCFQYAIDKKYPLYLSTKNTILKKYDGQFKDIFQEIYEREYSTKFGELGIWYEHRLIDDMVAFALKSEGGFVWACKNYDGDVQSDIVAQGYGSLGLMTSVLTNADGVFASEASHGTVTRHFREHQKGNETSTNSVASIFAWTSALGQRGKLDNNKDLVKFAQDMEKACVESIESGFMTKDLAICIKGNQVKRSNYLNTEEYINKVAEFYNKIK

SEQ ID NO: 5735 - DNA, 1594 bp, Oryza sativa
  CDS (66)..(1304)
tgcttcccaccggctcccgatctccgaggcaagcagcgccgcacccggccgctgccgccgccgccatggcgttcgagaagatcaaggtcgccaaccccatcgtcgagatggacggtgatgagatgaccaggatattctggcagtctatcaaggacaagcttatctttccatttttggatctggacattaagtactatgacttgggagttctccaccgtgatgcaactgatgacaaggtcaccgtggaggctgcagaggctactctcaagtacaatgtggctattaagtgtgcgacgattactccagatgaggctcgggttaaggagttcaacctaaagcaaatgtggaagagccccaatggcacaattaggaatattatcaatggcactgtattcagagagccaattatatgcaaaaatgtcccaaggcttgttccaggatggactaagcccatttgcattggaaggcatgcttttggtgatcagtaccgagcaactgatgcagttctgaaggggcctggcaagctcaagctggtttttgagggaaaggatgagcagattgatctggaggtgttcaacttcactggtgctggaggagttgctttgtctatgtacaacactgatgagtcaatccgagcttttgctgaagcttctatgacaactgcttatgagaagaaatggccgctttatcttagcaccaaaaacacaatcctgaagaaatatgatggaaggttcaaggatattttccaggaggtctatgaagctgggtggaaatccaagtttgaggctgccggaatatggtatgagcatcgtctcatcgatgacatggttgcttatgcacttaagagtgaagggggctatgtgtgggcttgcaagaattacgatggagatgtgcagagtgatttcttagctcaaggctttggttcattgggtttgatgacatcagtattggtgtgccctgatggaaaaacaattgaagctgaagctgcccatggcacggttacccgtcatttccgtgttcaccagaagggaggtgaaaccagcacaaacagcattgcttcaatctttgcttggaccagaggacttgcacacagggcaaagcttgacgacaatgctagacttcttgactttgcactaaaacttgaagctgcttgcgttggaaccgtggaatctgggaagatgaccaaagaccttgctcttcttattcacgggtcttcaaacgtcacaagaagccattacctgaacactgaagagttcattgatgcggttgctgcggagctccggtcaagactggcagccaactgagctttttacaagatactcttgccaacttcagtgcttcatttcccttcttttaaagtcattttggctgtatcaccattaccattcgagttctcattctggactgaatgaacatttacagcatcggtacaaattgttgtcgatccaagcagtccatagatgctgatatcacgtagacgggacctcccaaataaaggatatatagaacaatctgtcattgctgatagttgttttatccctatcagttagcgtccgactggaaaattatctatgttcctcatttggatggtttg

SEQ ID NO: 5736 - protein, 412 aa, Oryza sativa
MAFEKIKVANPIVEMDGDEMTRIFWQSIKDKLIFPFLDLDIKYYDLGVLHRDATDDKVTVEAAEATLKYNVAIKCATITPDEARVKEFNLKQMWKSPNGTIRNIINGTVFREPIICKNVPRLVPGWTKPICIGRHAFGDQYRATDAVLKGPGKLKLVFEGKDEQIDLEVFNFTGAGGVALSMYNTDESIRAFAEASMTTAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGTVESGKMTKDLALLIHGSSNVTRSHYLNTEEFIDAVAAELRSRLAAN

SEQ ID NO: 5737 - DNA, 1230 bp, Gloeobacter violaceus
  CDS (1)..(1230)
atgtccaaattgacggtgaagacgaccgtggttgatatcgacggcgatgagatgacccggattatctgggagatgatccagcagaagctgctcaggccgtatctggagatgacgatcgagcgctacgacctcggcatcgaaaaccgtgacgccaccgacgatcgggtgacggtggaggcggccgaggccgttatgcgccacggcgtgggtgtcaagtgcgccacgatcacccccgacgaagcacgcgtcaaagagttcggcctcaaaaaaatgtggaagtcccccaacggcaccatccgcaacatcctcggggggacggtctttcgcgagccgatcatctgtcgcaacatcccgcgattggtgcccggctggacacggcctatcgtcgtcgcccgccacgccttcggcgatcagtaccgggccaccgagtaccgcgtgccggggccgggaaaactcaaactcgtctttgagccgacccaagggggcgagccggtcgagcagacggttttcgatttcgcggacaaaggcgtcgccctgggcatgtacaacctcgatgtgtcgatcgccgggtttgccagggcctgcttcaactttgccctgacccgcaactggccggtgtacctgtcgaccaaaaacacgatcctcaaagtctacgacggcaactttaaagacatcttccagagcgtctacgacagcgaattcaaggccgccttcgcggagcgcggtttgagttacgaacaccgcctgatcgacgacatggtggccgccgccctcaaatggtcgggcgggtttgtctgggcctgcaagaactacgacggcgacgtgcaatcggacgtggtggcgcagggcttcggctccctcggcttgatgacttcgattttgctcactcccgacggcaagtcggtcgagaccgaggccgcccacggcacagttacccgccactaccgcctgcaccagcagggcaagcagacttccaccaacccgatcgcttcgatttttgcctggagccggggactttggtaccgcggccagttcgacggtaccccggagatttgcgcttttgccgaattgctggagcacgtctgcgtcgagacggtcgaggcgggcgagatgaccagggatctggcgctgctggtgagccccgagcagccgtacctcaccaccggcgcatttatcgacgccgtcgcccgcaggctcgacgccgcttacgcagaacgcttcgccgcctga

SEQ ID NO: 5738 - protein, 409 aa, Gloeobacter violaceus
MSKLTVKTTVVDIDGDEMTRIIWEMIQQKLLRPYLEMTIERYDLGIENRDATDDRVTVEAAEAVMRHGVGVKCATITPDEARVKEFGLKKMWKSPNGTIRNILGGTVFREPIICRNIPRLVPGWTRPIVVARHAFGDQYRATEYRVPGPGKLKLVFEPTQGGEPVEQTVFDFADKGVALGMYNLDVSIAGFARACFNFALTRNWPVYLSTKNTILKVYDGNFKDIFQSVYDSEFKAAFAERGLSYEHRLIDDMVAAALKWSGGFVWACKNYDGDVQSDVVAQGFGSLGLMTSILLTPDGKSVETEAAHGTVTRHYRLHQQGKQTSTNPIASIFAWSRGLWYRGQFDGTPEICAFAELLEHVCVETVEAGEMTRDLALLVSPEQPYLTTGAFIDAVARRLDAAYAERFAA

SEQ ID NO: 5739 - DNA, 1410 bp, Plasmodium yoelii yoelii
  CDS (1)..(1410)
atggaacgcagcatccattctctaaaaaaacatataacctaccgtattacaaagagatatgtaagcaatggacaatccgctttcaatcttagtgggaaagtaaaggtggaaaatccaatagttgaattagatggagatgaaatgactaaagttatatggaaagatatcaaagaaaaattgatattaccatatttagatcttaatataaaatattttgatttatctatagaaaacagagataaaacaaatgaccaaataacattagacgcagcacaagaaataaaaaaatatagtgttgggataaaatgcgcaactataactccagattctgcaagagtaaaagaatttaatttaaaagaaatgtggaaaagtccaaatggtacaattagaaatatattagatggaactgtatttagagctcctatattaattaaaaatattcctaaacttatatctaattggaaaaaaccaatagtaataggaagacatgcatatgccgatcaatataaacaaaaatcattaaaagtaacaaaaagtggtaaattcgaaattgtttttacccctgatgataattcaccagttgttagagaaacaatattcaattttaaatctccaggtgtatgtttaggtatgtataatactgaagaatccattaaaaattttgcattatcatgttttcaatatgcattagatttaaaaatgcctgtatattttagtaccaaatcaactatacttaagatatatgatggactatttaaagatatatttcaagatatttatgaacaaaaatttaaaaaaatttttgaacaaaataatttatggtatgagcacaaattaattgatgatatggttgctcaagtattaaaatctgaaggagggtttgtttgggcgtgtaaaaattatgatggtgatatacaatcagatgcagttgcacaaggatatggaagtctaggtttaatgagttctatattaatgtgccccgatggggttacttgcatatctgaagctgcacatggtactgtaactaaacattatagggcctatcaaagaggagaaaaaacctcaactaatcctattgcatctatttttgcatggactagaggtttacaacatagagcaaaattagatcaaaataaaaatttacaacaattttgttatgctcttgaaaaagcatgtatagaaacagtggaaaatggactcatgcctaaagatctagctatttgtattaaaggtattaaaaatgttactgaaaaagattatctatgtactgacgattttatagatgccataaacgaaaaccttaaattgaaacttttgatgaatcaaaaaaaaaacgatgttcaagcaactgataccaaattacacaacgaaaattgggtcaactatgccccccaagaacattctacataa

SEQ ID NO: 5740 - protein, 469 aa, Plasmodium yoelii yoelii
MERSIHSLKKHITYRITKRYVSNGQSAFNLSGKVKVENPIVELDGDEMTKVIWKDIKEKLILPYLDLNIKYFDLSIENRDKTNDQITLDAAQEIKKYSVGIKCATITPDSARVKEFNLKEMWKSPNGTIRNILDGTVFRAPILIKNIPKLISNWKKPIVIGRHAYADQYKQKSLKVTKSGKFEIVFTPDDNSPVVRETIFNFKSPGVCLGMYNTEESIKNFALSCFQYALDLKMPVYFSTKSTILKIYDGLFKDIFQDIYEQKFKKIFEQNNLWYEHKLIDDMVAQVLKSEGGFVWACKNYDGDIQSDAVAQGYGSLGLMSSILMCPDGVTCISEAAHGTVTKHYRAYQRGEKTSTNPIASIFAWTRGLQHRAKLDQNKNLQQFCYALEKACIETVENGLMPKDLAICIKGIKNVTEKDYLCTDDFIDAINENLKLKLLMNQKKNDVQATDTKLHNENWVNYAPQEHST

SEQ ID NO: 5741 - DNA, 1389 bp, Neurospora crassa
  CDS (1)..(1389)
atgtcgcccgtcaccgcaaacctcatccgctcctccctccgtcaggcttctgtctactcccgtctcaacatcgccactgctcctgcctttactcgccctgctgccccttccctcttcgtctccaataacagattccgcacaatggcttccgaggctttccagaagatcaaggtcaagaaccccgtcgtcgagctcgatggcgatgagatgacccgcatcatctggcaggacatcaaggagaagttcatctaccccttccttgacatcgacctcaagtactatgacttgggtctcgagtaccgtgaccagaccaacgaccaggtcactattgatgccgccgaggccatcaagaagtactccgtcggtgttaagtgtgctaccatcactcccgatgagtctcgtgtagaggagttcaagctcaagcagatgtggctgtcccccaacggcaccatccgcaatgctctcggtggcactgttttccgtgagcccatcgtcattccccgcgtccctcgcctggtgcccggctggaagaagcccatcattattggccgccacgcctttggtgaccagtaccgcgccaaggacctcgtcgctcccggccccggtaagctccagatggtttacacccctgagggtggtgagccccaggtcatcgacgtcttcgactacaagaacggcggcggtgttgcccagacccagtacaacactgatgagtccatcgagggcttcgcccacgcttccttcaagctcgctcttgacaagggtcttcccctctacatgagcaccaagaacaccatcctcaagaagtacgatggccgcttcaaggatatcttccaacagatctacgatacccagtacaaggaggctttcgaggccaagaagatctggtacgagcaccgtctcatcgacgacatggtcgcccagatgatcaagagctccggtggctacatcatggccctcaagaactatgatggtgatgtccagtccgatatcgttgctcagggcttcggctccctcggtctcatgacctccgtcctcatcacccccgatggtaagaccttcgagtccgaggctgcccacggtaccgtcactcgccactaccgcgagcaccagaagggtaaccagacctccaccaaccccatcgcctccatctttgcctggacccgtggtcttgtccagcgtggcaagctcgacaacactcccgagctcattgctttcgctgaggctctcgagaaggcctgcattgacaccgtcgatatcgatggcatcatgaccaaggatctcgcgcttgcctgcggcaagaccggccgtgaggattgggtcaccacctccgagtacatggctgccgtcgagcgccgcctcaagagcactctcaaggagaagctctaa

SEQ ID NO: 5742 - protein, 462 aa, Neurospora crassa
MSPVTANLIRSSLRQASVYSRLNIATAPAFTRPAAPSLFVSNNRFRTMASEAFQKIKVKNPVVELDGDEMTRIIWQDIKEKFIYPFLDIDLKYYDLGLEYRDQTNDQVTIDAAEAIKKYSVGVKCATITPDESRVEEFKLKQMWLSPNGTIRNALGGTVFREPIVIPRVPRLVPGWKKPIIIGRHAFGDQYRAKDLVAPGPGKLQMVYTPEGGEPQVIDVFDYKNGGGVAQTQYNTDESIEGFAHASFKLALDKGLPLYMSTKNTILKKYDGRFKDIFQQIYDTQYKEAFEAKKIWYEHRLIDDMVAQMIKSSGGYIMALKNYDGDVQSDIVAQGFGSLGLMTSVLITPDGKTFESEAAHGTVTRHYREHQKGNQTSTNPIASIFAWTRGLVQRGKLDNTPELIAFAEALEKACIDTVDIDGIMTKDLALACGKTGREDWVTTSEYMAAVERRLKSTLKEKL

SEQ ID NO: 5743 - DNA, 1765 bp, Oryza sativa
  CDS (83)..(1489)
gtggcgcctcttcgacctcgtgggtgggtgtgcgggtgcgggactcggtgggatgcgccacctgctgctcctgcgctgcggcatggctcctctctacggctcctcctcctccgccgccgcgaccaaagccctcctcttaaaccccgccgccgcgcacgccttcgtcccttcttcccccggaccccgcgcgctccgccgcggcggcgcctccctccgctgctatgccgccgccgccgcggcggtggccgagcagcaccgcatcaaggtccacaaccccatcgtcgagatggacggtgacgagatgacgcgggtcatttggaagatgataaaggataagctcatcttcccttacctggagctggatgtcaagtatttcgaccttgggctgctcaaccgggatgccaccgatgataaggtcactgttgagagtgccgaggctacgttggagtataatgttgctgttaagtgtgctaccattacacctgatgaaacaagagttaaagagttcaaactcaagtcaatgtggaggagcccaaatggcaccatcaggaatattctaaatggaactgttttccgggagcccatcttgtgtaaaaatgtaccacggatactttctggctggaagaagcccatttgcattggaaggcatgcatttggagaccagtatcgagctactgatacaataattaatggtccaggaaagcttaaaatggtttttgtcccagatggtgctgaacctgtggagttaaatgtttataattttaaagggcctggtgtggctttatcaatgtataatgtggatgagtctattagagcttttgctgagtcatcaatggcaatggcactttccaaaaaatggcctctttatctcagcaccaagaacacaatattgaagaaatatgatggcaggttcaaggacatcttccaggaggtatatgaagagaaatggaaggagaagttcgaggaaaactcgatatggtatgagcaccggttgattgatgacatggtggcatatgctgtgaaaagtgaaggtggatatgtttgggcttgcaaaaactatgatggagatgttcagagtgacttccttgcccaaggttttggttccttgggtttgatgtcatctgttttgttatcttctgatgggaaaacgttagaagctgaggcagctcatgggactgtcactagacatttcaggctacatcagaagggacaggagacaagtacaaatagcattgcttctatatttgcttggactcgtggactagaacatagagcaaagctggataaaaatgataggctgctggatttcacaaagaaacttgaatctgcatgtattgaaacagttgaatcggggaagatgacaaaggatcttgcactccttatccatggccccaaggtaacaagggagttctaccttaacaccgaagaattcattgacgctgtggctcagcaactgcgagaaaagattcaaataccagctgtggtttaatcctcaatatgcaaattctatgtctggttggaagcctatcattgggtgcagcaggttcactcgctgtgcattcgcgcgcattttgattggggtgatgagacggatgatcccatttaatagtttgcctcgaagcgatttttgtttcagcctaccattttatcatgttaaactgttaataatctgctagtgctaagtgaattggtgatttcgctactcaattcacaacctcgcatggttgggtaaattaccttgaggtcaatacataagcgtagtctc

SEQ ID NO: 5744 - protein, 468 aa, Oryza sativa
MAPLYGSSSSAAATKALLLNPAAAHAFVPSSPGPRALRRGGASLRCYAAAAAAVAEQHRIKVHNPIVEMDGDEMTRVIWKMIKDKLIFPYLELDVKYFDLGLLNRDATDDKVTVESAEATLEYNVAVKCATITPDETRVKEFKLKSMWRSPNGTIRNILNGTVFREPILCKNVPRILSGWKKPICIGRHAFGDQYRATDTIINGPGKLKMVFVPDGAEPVELNVYNFKGPGVALSMYNVDESIRAFAESSMAMALSKKWPLYLSTKNTILKKYDGRFKDIFQEVYEEKWKEKFEENSIWYEHRLIDDMVAYAVKSEGGYVWACKNYDGDVQSDFLAQGFGSLGLMSSVLLSSDGKTLEAEAAHGTVTRHFRLHQKGQETSTNSIASIFAWTRGLEHRAKLDKNDRLLDFTKKLESACIETVESGKMTKDLALLIHGPKVTREFYLNTEEFIDAVAQQLREKIQIPAVV

SEQ ID NO: 5745 - DNA, 1794 bp, Lupinus albus
  CDS (58)..(1515)
acatagtaggcatcgatattgttgagctccctccactcgcaaccaaattaagttttgatgataagagcagcttttcgatcaagtgctatctccggcggcgcaaccaccaccactacgatgttttattcttgttcaaactttgtcattaaaaacccttatttcctctttacttcttcaacaactccgtcatccttgaaacacaaccttctttctttctccactgctccctttcatcgggtttcacttcgctgctatgcaacccaccctaacttccataggcttcaagtccttaatccaattgttgaaatggacggtgatgaaatgaccaggattatatggaagatgataaaggataaacttatatttccgtacctggatttaaacataaagtattttgatttgggggttgagaaccgcgatgctaccgatgacagagttactgtcgaaagtgctgaagccactctcaagtacaatgttgctgtgaaatgtgcaacaataactcctgatgagacccgagtcaaagaatttggattgaagtctatgtggagaagccccaatgggacaatcaggaatattttaaatggtactgttttccgtgaacccataatatgccgcaacatacccagaattgttcctgggtggaaaaaacccatatgtattggcagacatgcttttggtgatcagtatcgtgccactgatgcaataattaaaggaccagggaagctgaagttggtatttgtcccagaagatggtgaggctccaacggagcttgatgtttatgatttcaaaggcccaggtgtagcgcttgctatgtataatattgacgagtcaattcgagcttttgcggaatcatcaatgtcattggcatttgcaaagaaatggccactttacttgagcaccaaaaacacaattctcaagaaatatgacggcagatttaaagacatattccaggaggtatatgaagaaaggtggaggcaaaattttgaagaacactcaatatggtatgagcataggctaattgatgacatggtggcatatgcggtcaagagtgaaggtggatatgtttgggcttgcaagaattatgatggtgatgtccaaagtgatttactagctcaaggatttggctcattgggtctcatgacttctgtactgttatcttctgatggtaagacattagaagctgaagcagctcatggaaccgtaactcgacattttcggcttcatcaaaaggggcaggaaactagtacaaacagtattgcttccatatttgcatggacgcgaggactggaacatagggccaagctggataataatgaaaaactaagggatttcacatataagttggaggctgcatgtgttgagacagtggagtctggaaagatgaccaaagatcttgcacttctcattcacggacctaaggtatcaagggaatattacttgaacactgaggaatttattgatgctgtggctcataatcttaagagaaagctccaagagactcctgcattggtctgagtagtagcttttgataagtttgaaaaggttgacactggttttgatagatgcccctattatttaaccattcataatgatgctattttgggatgatataaaatagttttgatgtgttgaacaaaatgtaggtgtgggaatatgaatttatgaatttggttttttatgaataattcgttgatagtgactgtaacatggagatatgcaacaatggcattaacaataagcatgttaacaaatacctactagccctcaagcaaattgaatagaattggtgcatgt

SEQ ID NO: 5746 - protein, 485 aa, Lupinus albus
MIRAAFRSSAISGGATTTTTMFYSCSNFVIKNPYFLFTSSTTPSSLKHNLLSFSTAPFHRVSLRCYATHPNFHRLQVLNPIVEMDGDEMTRIIWKMIKDKLIFPYLDLNIKYFDLGVENRDATDDRVTVESAEATLKYNVAVKCATITPDETRVKEFGLKSMWRSPNGTIRNILNGTVFREPIICRNIPRIVPGWKKPICIGRHAFGDQYRATDAIIKGPGKLKLVFVPEDGEAPTELDVYDFKGPGVALAMYNIDESIRAFAESSMSLAFAKKWPLYLSTKNTILKKYDGRFKDIFQEVYEERWRQNFEEHSIWYEHRLIDDMVAYAVKSEGGYVWACKNYDGDVQSDLLAQGFGSLGLMTSVLLSSDGKTLEAEAAHGTVTRHFRLHQKGQETSTNSIASIFAWTRGLEHRAKLDNNEKLRDFTYKLEAACVETVESGKMTKDLALLIHGPKVSREYYLNTEEFIDAVAHNLKRKLQETPALV

SEQ ID NO: 5747 - DNA, 1583 bp, Lupinus albus
  CDS (43)..(1281)
cctcatatcatttctgtgttctcatcatctccgatcgaaaccatggcattccagaagatcaacgtcgccaaccccatcgtcgaaatggacggagatgaaatgactcgagttatctggaaatcaatcaaggacaagctcattttgcccttcttggagttggacatcaagtattatgaccttggccttccttaccgtgatgagacagatgacaaagtcacagttgaaagtgctgaagcaactctgaagtacaatgtagcaatcaagtgtgcaactattactccagatgaagcccgtgtgaaggagtttggcctgaagcaaatgtggaagagtccaaatgggacaatcaggaatattttgaacggaactgttttcagagaaccaattctttgcaaaaacatcccccgccttgttcctggttggaacaagccaatatgtattggaagacatgcttttggtgatcaatataaggctactgatgcagtgattaaaggagctggaaaactgaaactggtgtttgtcccagaaggccaaagtgaggcgactgaattagaggtttataatttcactggtgaaggaggtgttgcacaggcgatgtataacactgatgagtctatccgtgcttttgccgatgcttctatgacaactgcttatgagaaaaaatggccactttatcttagcaccaagaatacaattcttaagaaatatgatggaagattcaaggacatctttcaagaagtttatgaagcaagctggaaatcaaactttgaggctgctggtatatggtatgagcatcggctcattgatgatatggtggcatacgcagtcaagagtgatggaggttatgtatgggcatgcaaaaactatgatggagatgttcagagtgatttcttagctcaaggttttggatcactgggcttgatgacatctgtattggtttgccctgatggaaagaccatagaagcagaagcagcccatggcacagttacccgtcattttagggttcatcagaagggaggggaaaccagcacaaacagcatagcatccatctttgcttggagtagggggctagcccacagggcaaaacttgatgacaatgctaaactcttggacttcactaaaaaactagaggaagcttgcattggagcagtagagtctggaaagatgaccaaggatttggcactcattattcatggatccaaactttcaagggagcattatctgaacacagaggagttcattgatgccgtggcaaacgagctcaaagcaaagatttctgcttgattttagatagatgagaaaagattagaatgaaaagagatgtttcatgtggtcgtaaactatcttctgaagaaataagaaagcattggtggttggagccttttccttctttgctggttgggtctaagaatgcttcgccattttatttcaactgatttgtcttatgtaattttgaacgatttactttggagtttaattgggcttttcattgtttttgctgattttactttgcatgtttcacttattgttctcaagagttttttattaactcttacctaattacttctaagctttaatttgttact

SEQ ID NO: 5748 - protein, 412 aa, Lupinus albus
MAFQKINVANPIVEMDGDEMTRVIWKSIKDKLILPFLELDIKYYDLGLPYRDETDDKVTVESAEATLKYNVAIKCATITPDEARVKEFGLKQMWKSPNGTIRNILNGTVFREPILCKNIPRLVPGWNKPICIGRHAFGDQYKATDAVIKGAGKLKLVFVPEGQSEATELEVYNFTGEGGVAQAMYNTDESIRAFADASMTTAYEKKWPLYLSTKNTILKKYDGRFKDIFQEVYEASWKSNFEAAGIWYEHRLIDDMVAYAVKSDGGYVWACKNYDGDVQSDFLAQGFGSLGLMTSVLVCPDGKTIEAEAAHGTVTRHFRVHQKGGETSTNSIASIFAWSRGLAHRAKLDDNAKLLDFTKKLEEACIGAVESGKMTKDLALIIHGSKLSREHYLNTEEFIDAVANELKAKISA

SEQ ID NO: 5749 - DNA, 1627 bp, Lupinus albus
  CDS (79)..(1317)
aagtgtcgcggcgcctctacatacgtgtttgtctcatttctcaggtctcacctaacttcctcatttctcatcggagccatggcattccagaagatcaacgtcgccaatcccatcgttgagatggacggagatgaaatgactcgagttatctggaaatcaatcaaggataagctcatttttcccttcttggagttggacatcaagtattatgaccttggccttccttaccgtgacgagacagatgataaagtcactgttgaaagtgctgaagcaactctgaagtataatgtagcaatcaagtgtgcaactattactccagatgagggccgtgtgaaggaatttggcctgaagcaaatgtggaggagtccaaatgggacaattaggaacattttgaatggaactgttttcagagaaccaattctttgcaaaaacatcccccgccttcttcctggctggaacaagccaatatgtattggaagacatgcttttggtgatcaatatcgggcgactgactcagtgattaaaggagctggaaaactaaaactggtgtttgtcccagaaggccaaagtgaggcgactgaattagaagtttataatttcactggtgaaggaggtgttgcattggctatgtataacaccgacgagtctatccgtgcttttgctgaggcttctatgacaactgcttatgagaaaaaatggccactttatcttagcaccaaaaatacaattctgaagaaatatgatggaagattcaaggacatctttcaagaagtttatgaagcaagctggaaatcgaagtttgaggctgctggtatatggtatgaacatcggctcatcgatgatatggtggcatacgcagtcaaaagtgatggaggttatgtatgggcatgcaaaaactatgatggagatgtccagagtgatttcttagcacaaggttttggttcactgggcttgatgacatctgtattggtttgccctgatgggaaaactatagaatcagaagcagcccatggcacagttacccgtcattttagggttcatcagaagggaggggaaaccagcacaaacagcatagcatccatctttgcttggagtaggggtctagcccacagggcaaaacttgatgacaatgctaaactcttggatttcactcaaaaactagaggcagcttgcattggagcagtagagtctgggaagatgaccaaggatctggcactcattcttcatggatccaagctttcaagggagcactatctgaacacagaggagttcattgatgctgtggcaaacgagctcaaagcaaggctttctgcttaggcttgattttagataaatgagaaaggattagagtgaaaggagatctctccagtgttgttatactctcttctgaagaaataagaaagcattggttggcgcatttttcttgtttgttgagttagtctgggaatgcagcggttggctgcttggctattttgcttgaactgatttgtcttgtaattttgagttgaattacttcagagtttaattgggctttgctatgtgttttttgctgattttactttgcatgcttgacatattattctgcaaataacacatgcgtacttaattttggggatttttctccgac

SEQ ID NO: 5750 - protein, 412 aa, Lupinus albus
MAFQKINVANPIVEMDGDEMTRVIWKSIKDKLIFPFLELDIKYYDLGLPYRDETDDKVTVESAEATLKYNVAIKCATITPDEGRVKEFGLKQMWRSPNGTIRNILNGTVFREPILCKNIPRLLPGWNKPICIGRHAFGDQYRATDSVIKGAGKLKLVFVPEGQSEATELEVYNFTGEGGVALAMYNTDESIRAFAEASMTTAYEKKWPLYLSTKNTILKKYDGRFKDIFQEVYEASWKSKFEAAGIWYEHRLIDDMVAYAVKSDGGYVWACKNYDGDVQSDFLAQGFGSLGLMTSVLVCPDGKTIESEAAHGTVTRHFRVHQKGGETSTNSIASIFAWSRGLAHRAKLDDNAKLLDFTQKLEAACIGAVESGKMTKDLALILHGSKLSREHYLNTEEFIDAVANELKARLSA

SEQ ID NO: 5751 - DNA, 2305 bp, Homo sapiens
  CDS (196)..(1440)
gggggcggagctccagcggccttcagaggggtcgctaggccacacggggcgagagggggctgggggaaacacccccgccagttccgggtgcctggagtttaaaaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaaccgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactctgaaggaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactccgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaggatactgcagtcatttttgtaaagaccttgctgaatgtttccaatagactaaatactgtttaggccgcaggagagtttggaatccggaataaataccacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaaaaaaaaaaaaaaaaaaa

SEQ ID NO: 5752 - protein, 414 aa, Homo sapiens [sequence omitted]

SEQ ID NO: 5753 - DNA, 1215 bp, Bradyrhizobium japonicum
  CDS (1)..(1215)
atggcaaaaatcaaggtatccaatcccgtcgtcgaactcgatggcgacgagatgacccggatcatctggcagtacatcaaggacaagctgatcaccccgttcctggatgtcgagctgatgtatttcgacctggggatggaataccgcgaccacaccaacgatcaggtcaccatcgacgccgccgaagcgatcaagaaggtcggcgtcggcgtcaagtgcgccaccatcacccctgatgaagcccgggtgaaggagttcaacctcaagcagatgtggaagtcgccgaacggcaccatccgcaacatcctcggcggcgtgatcttccgcgagccgatcatctgcaagaacgtgccgcgcctggttcccggctggaccaagccgatcatcatcggccgccacgcctatggcgaccagtaccgcgccaccgatttcaagttcccgggcaagggcaccctgtcgatgaagttcgtcggcgaggacggcaccgtgatcgagaaggaagtgttcaaggcccccggcgccggcgtcgccatggagatgtacaatctcgacgactccatcatcgacttcgcccgcgcctcgctgaactacggcctgctgcgcaactacccggtctatctgtcgaccaagaacaccatcctcaaggtctatgacggccgcttcaaggacatcttccaggacatctacgaccgcgagttcaagaaggaattcgaggccaagggcctgacctacgagcaccgcctgatcgacgacatggtggcctcggcgctgaaatggtccggcggctatgtctgggcctgcaagaactacgacggcgacgtgcagtccgacacggtcgcgcagggctacggctcgctcggcctgatgacctcggtgctgctcaccccggacggcaagaccgtggaagcggaagccgcccacggcacggtgacccgccactaccgcgagcaccagaagggcaaggagacctcgaccaactcgatcgcgtcgatcttcgcctggacccgtggcctcgcccaccgcgccaagctcgacaacaacgccgagctcgccaagttcgcgaacaccctcgagaaggtctgcgtcgacaccgtcgaggccggctacatgaccaaggacctcgcgctgctggtcggcgccgaccagcgctggctctcgaccaccggcttcctcgacaaagtcgcggagaacctcaccaaggcgatggcggcgtaa

SEQ ID NO: 5754 - protein, 404 aa, Bradyrhizobium japonicum
MAKIKVSNPVVELDGDEMTRIIWQYIKDKLITPFLDVELMYFDLGMEYRDHTNDQVTIDAAEAIKKVGVGVKCATITPDEARVKEFNLKQMWKSPNGTIRNILGGVIFREPIICKNVPRLVPGWTKPIIIGRHAYGDQYRATDFKFPGKGTLSMKFVGEDGTVIEKEVFKAPGAGVAMEMYNLDDSIIDFARASLNYGLLRNYPVYLSTKNTILKVYDGRFKDIFQDIYDREFKKEFEAKGLTYEHRLIDDMVASALKWSGGYVWACKNYDGDVQSDTVAQGYGSLGLMTSVLLTPDGKTVEAEAAHGTVTRHYREHQKGKETSTNSIASIFAWTRGLAHRAKLDNNAELAKFANTLEKVCVDTVEAGYMTKDLALLVGADQRWLSTTGFLDKVAENLTKAMAA

SEQ ID NO: 5755 - DNA, 1215 bp, Brucella suis
  CDS (1)..(1215)
atggcaaaaatcaaggttgcaaacccggtcgtcgagctcgacggcgacgagatgacccgcattatctggcagttcatcaaggacaagcttatccatccctatctcgacatcgacctgaaatactacgatctttcggtcgagaaccgcgatgcgaccaatgatcaggtcacgatcgatgcagccaatgccatcaaggaatatggcgtgggcgtaaaatgcgcgaccatcacgcccgacgaagcgcgcgtggaagaattcaagctgaagaaaatgtggaagtcgcccaacggcaccatccgcaatatcctcggcggcgtgatcttccgcgagccgatcatctgcaagaacgtgccgcgcctcgtgccgggctggacccagccgatcatcgtcggccgccatgctttcggcgaccagtaccgcgcgactgacttcaagttccccggcaagggcacactgacgatcaagttcgtcggtgaagatggccagaccatcgaacatgaagtctatcaggccccttcggctggcgtggccatggccatgtataatctggacgaatcgatccgcgaattcgcacgcgcttccttcaattacggcttgcagcgcggctatccggtctatctctccacgaagaacaccatcctcaaggcctatgatggccgcttcaaggacatcttccaggaagtcttcgacgccgaattcaagtcgaagtttgaagaaaagaagatctggtacgaacaccgcctcatcgacgacatggtcgcctcggcgctcaagtggtcgggcggctatgtctgggcctgtaagaactatgatggcgacgtgcagtcggatatcgtcgcgcagggcttcggctcgctcggcctgatgacctcggttctgatgacgccggatggcaagacggtggaagcggaagccgcccacggcaccgtaacccgccactatcgccagtatcagaagggcgaggaaacctcgaccaactccatcgcttcgatcttcgcatggacccgcggtctggcgcatcgcgccaagctcgacaacaatgccgatctgaagaagttcgccgaaacgctggaaaaggtctgcgtggacaccgttgaaagcggcttcatgaccaaggatctggcgctcctcatcggcccggatcagccttggctctcgaccaccggcttcctcgacaagatcgacgaaaatcttcagaaagccatggctgcctga

SEQ ID NO: 5756 - protein, 404 aa, Brucella suis
MAKIKVANPVVELDGDEMTRIIWQFIKDKLIHPYLDIDLKYYDLSVENRDATNDQVTIDAANAIKEYGVGVKCATITPDEARVEEFKLKKMWKSPNGTIRNILGGVIFREPIICKNVPRLVPGWTQPIIVGRHAFGDQYRATDFKFPGKGTLTIKFVGEDGQTIEHEVYQAPSAGVAMAMYNLDESIREFARASFNYGLQRGYPVYLSTKNTILKAYDGRFKDIFQEVFDAEFKSKFEEKKIWYEHRLIDDMVASALKWSGGYVWACKNYDGDVQSDIVAQGFGSLGLMTSVLMTPDGKTVEAEAAHGTVTRHYRQYQKGEETSTNSIASIFAWTRGLAHRAKLDNNADLKKFAETLEKVCVDTVESGFMTKDLALLIGPDQPWLSTTGFLDKIDENLQKAMAA

SEQ ID NO: 5757 - DNA, 1221 bp, Bifidobacterium longum
  CDS (1)..(1221)
atggccaaaatcaaggtcgaaggcactgtcgtcgaactcgacggcgacgagatgacccgcgtgatctggaaggacatcaaggatcgtctgatcctgccgtacctcgacgtgaacctcgactactacgatctgggcatcgagcaccgcgacgagaccgatgaccaggtgaccatcgacgccgcccacgccatccagaagcaccatgtcggtgtcaagtgcgccaccatcacccccgatgaggcccgagtcaaggaattcggtctcaagaagatgtggaagtcccccaacggcaccatccgcaacatcctgggcggcacgatcttccgcgagccgattgtgatgagcaacgtgcctcgtctggtgcccggctggaccaagccgatcgtcgtagcccgtcacgcattcggcgaccagtacaaggccaccgatttcaaggttccgggagccggccagctgaccgtcaccttcactccggacgatggctccgagccgattcagcacgtggtctacaactacggcgaagacggcggcgtggcccaggtgcagtacaacgtcaacgattcgatccgcggtttcgctcgcgcctgcttcaactacggcctgatgcgtcattacccggtgtacttgtccaccaagaacacgattttgaaggcctacgacggccagttcaaggacatctttgccgaggtgttcgagaccgaatacaaggacaggtacgccgaggccggcctgacttacgagcaccgcctgatcgacgacatggtggccagctccctgaagtggcacggcggttacatctgggcctgcaagaactacgatggcgatgtgcagtccgactccgtggcccagggcttcggttcgctgggcctcatgacctccgtgctcatgaccccggacggccagaccgtcgaggccgaagcggcgcacggcaccgtgacccgtcactaccgccgctggcagaagggcgagaagacctccaccaacccaatcgcatccatcttcgcgtggaccggcggccttaagcaccgcgccgatctggacggcacgcccgaagtccgtcacttcgccaagacgctggagaaggtcatcgtcgacaccgttgaaggcggtcagatgaccaaggatctggccatgctcatcggcccggacgaaccgtggctcgacaccgacggcttcatgaacgcgctggacgagaacctggccaaggctctggccgagtaa

SEQ ID NO: 5758 - protein, 406 aa, Bifidobacterium longum
MAKIKVEGTVVELDGDEMTRVIWKDIKDRLILPYLDVNLDYYDLGIEHRDETDDQVTIDAAHAIQKHHVGVKCATITPDEARVKEFGLKKMWKSPNGTIRNILGGTIFREPIVMSNVPRLVPGWTKPIVVARHAFGDQYKATDFKVPGAGQLTVTFTPDDGSEPIQHVVYNYGEDGGVAQVQYNVNDSIRGFARACFNYGLMRHYPVYLSTKNTILKAYDGQFKDIFAEVFETEYKDRYAEAGLTYEHRLIDDMVASSLKWHGGYIWACKNYDGDVQSDSVAQGFGSLGLMTSVLMTPDGQTVEAEAAHGTVTRHYRRWQKGEKTSTNPIASIFAWTGGLKHRADLDGTPEVRHFAKTLEKVIVDTVEGGQMTKDLAMLIGPDEPWLDTDGFMNALDENLAKALAE

SEQ ID NO: 5759 - DNA, 1407 bp, Plasmodium falciparum
  CDS (1)..(1407)
atgggaaagcatatacgaattttaaaaaatcaatacctacaatttatgtcgaagagatgtattcaaagcaaggcggcttttaacatatgcggtaaaattaacgtagaaaaccctattgtagagttagatggagatgaaatgactagaataatttggaaagatataaaagaaaaattaatcttaccatatgttaacttaaagataaaatattttgatttatctattgaaaatcgagataagactaatgatcaagttaccatagaagctgctgaagaaataaaaaaaacttcagtaggtataaaatgtgcaactataacacctgatgctgcaagagttaaagaatttaatttaaaggaaatgtggaaaagtccaaacggtactataagaaatatattagatggtactgtttttagaacacctatacttattaaaaatatacctaaactagtacctaattggaagaaaccaattgttataggaagacatgcatatgctgatcaatataaacagaaatctttaaaaatcgaaaaaagtgggaaatttgaaattgtatttactccagatgataattcacaagtacttagagaaactgtgtttcattttaaatctcctggtgtatgtttaggtatgtataatacagaagaatctatacgaaattttgcattgtcttgttttcaatatgctttagatcttaaaatgccagtttatatgagtactaaaagtactatactaaaaatatatgatggtttatttaaagatatttttgatgaaatttatgaaaaacaatttaaaaaatcttttgaacaacataatttatggtatgaacataaactaattgatgatatggttgctcaagtattaaaatcagaaggtggatttttatgggcatgtaaaaattatgatggtgatatccaatctgatgctgttgctcaaggttatggaagtttaggattaatgtcatctgtgttattatgtccagacggtgttacgtgtgtttcagaagctgcccatggtaccgtcactagacattatagagcttatcaaaagggagaaaaaacatcaacaaatcctatagcctctatttttgcatggaccaaaggattagaacacagagcaaaattagataaaaatgataatttaaaacaattttgttatgctttagaaaaggcatgtatcgaaacggtagaagatggattgatgtctaaagatctagcaggatgtattaaaggtattaaaaatgttactgagaaggattatatctttactcaagatttaatcaatgctattaatgaaaaactaaaattaaagatacttcaaaatcaatccaaaaatgatccacaagctacttcatataaattgaaaaacgataactggaatttttatgctccccaagaacattcaacataa

SEQ ID NO: 5760 - protein, 468 aa, Plasmodium falciparum
MGKHIRILKNQYLQFMSKRCIQSKAAFNICGKINVENPIVELDGDEMTRIIWKDIKEKLILPYVNLKIKYFDLSIENRDKTNDQVTIEAAEEIKKTSVGIKCATITPDAARVKEFNLKEMWKSPNGTIRNILDGTVFRTPILIKNIPKLVPNWKKPIVIGRHAYADQYKQKSLKIEKSGKFEIVFTPDDNSQVLRETVFHFKSPGVCLGMYNTEESIRNFALSCFQYALDLKMPVYMSTKSTILKIYDGLFKDIFDEIYEKQFKKSFEQHNLWYEHKLIDDMVAQVLKSEGGFLWACKNYDGDIQSDAVAQGYGSLGLMSSVLLCPDGVTCVSEAAHGTVTRHYRAYQKGEKTSTNPIASIFAWTKGLEHRAKLDKNDNLKQFCYALEKACIETVEDGLMSKDLAGCIKGIKNVTEKDYIFTQDLINAINEKLKLKILQNQSKNDPQATSYKLKNDNWNFYAPQEHST

SEQ ID NO: 5761 - DNA, 1514 bp, Arabidopsis thaliana
  CDS (1)..(1458)
atgctgaataagctcacgcacggcgttttcacgtaccgtgccagcctcaccgccatgttatcttcttcaacctctgctggtttatcgtcttcgttcgtttcttcgagatttcttagttccggtatattctctagtggcgcttcgaggaatcgcgtgacttttcccgttcagtttcatcgcgcatcagctgttcgatgttttgcttcttcaggcggttctgatagaattcaggttcagaatcctatcgttgaaatggatggcgatgaaatgacgagggtgatatggagtatgataaaggagaaacttattcttccttatctggatttggacattaagtacttcgacttggggattctgaatcgcgatgctactgatgacaaggttacagttgaaagtgcagaagcagctcttaagtacaatgttgctatcaaatgtgccactataactcctgatgagggtagagtgaaggagtttggactgaaatcaatgtggaggagtcctaatgggacgatcagaaacattctagatggaaccgtattccgtgaacctattatgtgcagcaatatcccccggcttgttcctggttgggaaaagcctatatgcattggtagacatgcctttggtgaccagtatcgtgccactgatacagtaattaaagggccaggaaagttgaaaatggtttttgtcccagaagatggaaacgcacctgtggagctagatgtatatgatttcaagggcccaggtgtcgcacttgctatgtacaacgtagatgagtcaattagagcttttgctgagtcatctatggcgatggcattaactaagaaatggccattatacttgagcaccaagaacacaattctcaagaaatatgatggcagatttaaggacatatttcaagaagtttatgaggcgaattggaagcaaaagtttgaagagcactcaatctggtacgagcaccggttgattgatgacatggtggcttacgcagtcaaaagtgaaggtggctatgtctgggcttgcaaaaactacgacggtgatgttcaaagcgatcttcttgcccaagggtttggctcattaggcctcatgacctccgttttgctgtccgctgatgggaaaacactcgagtcggaagcggctcatggaacagtaactcggcatttccgactgcaccaaaagggacaagaaaccagtactaacagcatagcctcaatatttgcatggacacgcggcttagaacacagggcgaaactggataagaacgagaaattaatggatttcgtgaagaagctcgagtcgtcatgtgtaaacactgttgagacagggaaaatgaccaaggatcttgcccttttaatccatggtcccaaggtgagtagggatttgtttttgaacacggaagagttcattgatgcagtagcctccaagctcaaaacacagttcaaagagcttcctcttgtctgaccattcctgggaattgggaacaatacaaaaataatgctcgcaataattcataaccc

SEQ ID NO: 5762 - protein, 485 aa, Arabidopsis thaliana
MLNKLTHGVFTYRASLTAMLSSSTSAGLSSSFVSSRFLSSGIFSSGASRNRVTFPVQFHRASAVRCFASSGGSDRIQVQNPIVEMDGDEMTRVIWSMIKEKLILPYLDLDIKYFDLGILNRDATDDKVTVESAEAALKYNVAIKCATITPDEGRVKEFGLKSMWRSPNGTIRNILDGTVFREPIMCSNIPRLVPGWEKPICIGRHAFGDQYRATDTVIKGPGKLKMVFVPEDGNAPVELDVYDFKGPGVALAMYNVDESIRAFAESSMAMALTKKWPLYLSTKNTILKKYDGRFKDIFQEVYEANWKQKFEEHSIWYEHRLIDDMVAYAVKSEGGYVWACKNYDGDVQSDLLAQGFGSLGLMTSVLLSADGKTLESEAAHGTVTRHFRLHQKGQETSTNSIASIFAWTRGLEHRAKLDKNEKLMDFVKKLESSCVNTVETGKMTKDLALLIHGPKVSRDLFLNTEEFIDAVASKLKTQFKELPLV

SEQ ID NO: 5763 - DNA, 1212 bp, Thermoanaerobacter tengcongensis
  CDS (1)..(1212)
atggcacaaaaaattgagatgaaggttcctattgtggaaatggacggagatgaaatgacaagaattatatggaaattgataaaagaaatgcttataaagccctatgtagatttaaagacagagtactatgatttgggcattaaaaacagagatgaaacagaagaccaggtcacagttgatgcagcatacgcaataaaaaaatacggagtcggggtaaaatgcgcaacaatcaccccaaatgctgaaagagtaaaagaatacaatttgaaaaatatgtggaaaagccctaacgctactatacgatccatactcgatgggacagtatttcgcacacctattctggttgaaggaataaagccgcttgtaaggacatggaaaaaacctattacaattgcaaggcatgcttatggggatatttataaaggggtagaatacagaatccctgaaaaaggtaaggctgagcttgtctttacttctgaaaaaggagaagagataaggtatgcaatacacgagtttgaaactcctggtgtcatattaggtatgcacaacactgatgagtcaataaaaagttttgcgagagcatgttttaattatgctttagatacgaagcaggatttgtggtttgcgactaaagacaccatttcaaaaatatacgaccacagatttaaagacatattccaggaaatatatgaaaatgaatataaagaaaaatttgaagaagcaggtattgaatatttttacacccttattgacgatgccgtagctcgaattgtaaggtctgaaggcggaatgatttgggcatgcaaaaattatgacggcgatgtaatgtcagatatggtagcaacagcatttggcagccttgccatgatgacttctgtactggtatctcctgatggtaaatacgaatttgaagcggctcatgggacagttacaaggcattattataaataccttaaaggtgaagaaacttctactaatcctattgctacaattttcgcgtggacaggtgctttgaaaaagagaggagaacttgacggaataaaagaccttgttgattttgcagataagcttgaaaaagcctcacttaaaacggttgaaaaaggaataatgacaaaagacttagccgctttatctgaattgccaaataaaactgttgtaaacacggaaactttcctcattgaaattaaaaaaactttagaagagatgctgtaa

SEQ ID NO: 5764 - protein, 403 aa, Thermoanaerobacter tengcongensis
MAQKIEMKVPIVEMDGDEMTRIIWKLIKEMLIKPYVDLKTEYYDLGIKNRDETEDQVTVDAAYAIKKYGVGVKCATITPNAERVKEYNLKNMWKSPNATIRSILDGTVFRTPILVEGIKPLVRTWKKPITIARHAYGDIYKGVEYRIPEKGKAELVFTSEKGEEIRYAIHEFETPGVILGMHNTDESIKSFARACFNYALDTKQDLWFATKDTISKIYDHRFKDIFQEIYENEYKEKFEEAGIEYFYTLIDDAVARIVRSEGGMIWACKNYDGDVMSDMVATAFGSLAMMTSVLVSPDGKYEFEAAHGTVTRHYYKYLKGEETSTNPIATIFAWTGALKKRGELDGIKDLVDFADKLEKASLKTVEKGIMTKDLAALSELPNKTVVNTETFLIEIKKTLEEML

SEQ ID NO: 5765 - DNA, 1551 bp, Cucumis sativus
  CDS (62)..(1294)
ctgtactctccattttcgatcttctctctgagtgtttccatcaggagcaagaccacgaaccatggctttccagaagatcaaggtcgccaatcccatcgttgagatggacggagatgaaatgactcgagttatctgggagtcaattaagaataagcttattttcccatttttggaattggacatcaagtattttgaccttggccttccacaccgtgatgccacagatgataaagttacaattgaaagtgcagaagctactttaaagtacaatgtagcaatcaaatgtgcaacaattactccagatgaggcacgtgttaaggaatttggcttgaagcagatgtggagaagtccaaatggaacaatcaggaatattctgaatggaactgtcttcagagaaccgattctttgcaaaaatgttcctcgccttgtaccaggttggacgaagcctatctgtattggaagacatgcttttggtgatcaatacagagctactgatacagtcatcagaggacctgggaaattgaaattagtttttgaggggcaggagacgcaagagatagaggttttcaatttcactggtgctggaggagttgcgttagccatgtataacactgatgagtccatccgatcttttgctgaggcatcaatggccactgcttatgagaagaaatggcccctttaccttagcacaaaaaatactattctaaagaaatacgatggaagattcaaggatatattccaagaagtctacgaatctcagtggaaatcaaagtttgaggctgctggcatatggtatgaacaccgtctcatcgatgatatggtggcttatgcccttaagagtgaaggaggttatgtctgggcatgcaagaactatgatggagatgttcagagtgatttcttagctcaaggatttggatctcttggcttgatgacttctgtattggtttgtcctgatggaaaaacaattgaagcagaagcagctcatggcactgttacacgacattttagggttcatcaaaaaggtggtgaaaccagcacaaacagcatagcatccatctttgcttggtctcgtggccttgctcacagggctaaactagatgacaatgctagtctcttagagttcaccgagaaactagaattggcttatatcgatactgtggaatctggaaagatgaccaaggatcttgctcttatccttcatggatccaagctttctcgtgaccaatatctgaatactgaggagttcattgatgctgttgctgaggaactaaaatccagactcctcaaggcatagtggtattttaaatgttcaatggtcaataattgttaagaatatctttctcatttcatcttctttcctaaggtacatagtttggtgggatattgttaatgcatttggcttctaactatcaactcaactaggctatagtcatcttgaggttgtttaacagttacttcttttacaatcatttatccaatctcttgtgcactgtattcggccattttaggtaattgcactaccattttgttggtaaaaaaaaaaaaaaaaaa

SEQ ID NO: 5766 - protein, 410 aa, Cucumis sativus
MAFQKIKVANPIVEMDGDEMTRVIWESIKNKLIFPFLELDIKYFDLGLPHRDATDDKVTIESAEATLKYNVAIKCATITPDEARVKEFGLKQMWRSPNGTIRNILNGTVFREPILCKNVPRLVPGWTKPICIGRHAFGDQYRATDTVIRGPGKLKLVFEGQETQEIEVFNFTGAGGVALAMYNTDESIRSFAEASMATAYEKKWPLYLSTKNTILKKYDGRFKDIFQEVYESQWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWSRGLAHRAKLDDNASLLEFTEKLELAYIDTVESGKMTKDLALILHGSKLSRDQYLNTEEFIDAVAEELKSRLLKA

SEQ ID NO: 5767 - DNA, 1610 bp, Arabidopsis thaliana
  CDS (165)..(1397)
ggcacgagtttttcacctacttcatcactcatcaccagcttcgcatcttcttctccggcttgatcttctctcgtttctagatctccgacgatcggaatatcaaatccgatcgattaattctgtcaatcacacaaaaaccgaaaaccgaaaacccaaaaaaaaccatggcgtttgagaagatcaaggtggcaaatcccatcgtcgagatggatggtgatgaaatgaccagggttatttggaagtctatcaaggataagcttattactccttttgtggagttggatatcaagtacttcgaccttggtcttcctcaccgtgatgctacggatgacaaagttactattgaaagtgctgaagctactaagaagtacaatgtggcgatcaagtgtgccaccatcactccagatgaaggccgtgtcacggaatttggcttgaagcagatgtggagaagtccaaatgggaccatcaggaatatcctgaatggaactgtatttagagagccaattatctgcaaaaatgttcccaagcttgtcccaggctggacaaagcccatctgcattggaaggcatgcttttggtgatcagtaccgtgccactgatgctgtaatcaagggaccaggaaaactgactatgacctttgagggaaaagatgggaaaactgaaaccgaagtctttacatttactggtgaaggtggtgttgctatggtaatgtacaacactgatgagtccatccgtgcttttgctgatgcatcgatgaacactgcttatgagaaaaagtggccactttaccttagcacaaagaataccattcttaagaaatacgatggcagattcaaagacatcttccaagaagtctatgaagccagctggaagtcgaagtatgatgctgctggaatctggtatgaacaccgtctcattgatgatatggtggcctacgctcttaagagtgagggaggctatgtttgggcatgcaaaaactatgatggtgatgtccaaagtgatttgttggcacaaggattcgggtcacttggattgatgacatctgttctggtctgcccagatggaaagtcgattgaagctgaagcggcccatggaactgtcacccgtcacttcagggttcatcagaaaggtggtgagaccagcacaaacagcatagcctctatttttgcttggactcgtggacttgcacacagggctaagttagatgacaacgcaaaactcttggatttcactgagaagctggaagccgcttgtgttgggacagtggagtcagggaaaatgaccaaagatcttgcactcatcattcacggctcaaagctttcgagggacacgtacctgaacacagaggagttcatcgatgcagtcgctgctgagctcaaagaaagactcaatgcttaagaaactgaagaaattgggtaaaattcgaacgtctcagttcctaagtgtcttatctggttggtggggttggttgggatcgggaggaataaacttttgtggagaggagtgttgagaacgatttgtttcctctcttataatatttccaaaatattgcgacatttttccatttttattcagatctcgaattttatgtttaaaaaaaaaaaaaaaaaa

SEQ ID NO: 5768 - protein, 410 aa, Arabidopsis thaliana
MAFEKIKVANPIVEMDGDEMTRVIWKSIKDKLITPFVELDIKYFDLGLPHRDATDDKVTIESAEATKKYNVAIKCATITPDEGRVTEFGLKQMWRSPNGTIRNILNGTVFREPIICKNVPKLVPGWTKPICIGRHAFGDQYRATDAVIKGPGKLTMTFEGKDGKTETEVFTFTGEGGVAMVMYNTDESIRAFADASMNTAYEKKWPLYLSTKNTILKKYDGRFKDIFQEVYEASWKSKYDAAGIWYEHRLIDDMVAYALKSEGGYVWACKNYDGDVQSDLLAQGFGSLGLMTSVLVCPDGKSIEAEAAHGTVTRHFRVHQKGGETSTNSIASIFAWTRGLAHRAKLDDNAKLLDFTEKLEAACVGTVESGKMTKDLALIIHGSKLSRDTYLNTEEFIDAVAAELKERLNA

SEQ ID NO: 5769 - DNA, 1215 bp, Rhizobium meliloti
  CDS (1)..(1215)
atggcaaagatcaaggtcgccaatccggtcgtcgaactcgacggcgacgagatgacccgcatcatctggcagttcatcaaggacaagctgatccacccttatctcgacctcgatctcgaatattacgacctgggcgtcgaaaaccgtgatgcaactgacgaccaggtgacgatcgacgccgcaaacgccatcaagaagcacggcgtcggcgtaaaatgcgccacgatcacgccggacgagggtcgcgtcgaggagttcaagctgaagaagatgtggaagtcgccgaacggcacgatccgcaacatcctcggcggcgtcatcttccgcgagccgatcatctgcaagaacgtgccgcgcctggtccccggctggaccaagccgatcatcgtcggccgccacgccttcggcgaccagtaccgcgcgaccgatttcaagttcccgggcaagggcaagctctcgatcaaattcgtcggcgaagacggccagacgatcgagcatgacgtttacgacgcgccgggcgccggcgtggcactcgccatgtacaacctggacgaatcgatcaccgaattcgcgcgcgcctcgttcaactacggcctgcagcgcaaggttccggtctatctctcgaccaagaacacgatcctgaaggcctatgacggccgcttcaaagacatcttccagaaggtgttcgacgaggaattcgccgcccagttcaaggccgagaagctctggtacgaacaccgcctgatcgacgacatggtcgcctcggcgctgaagtggtccggcggctatgtctgggcctgcaagaactacgacggcgacgtgcagtccgacatcgtcgcgcagggcttcggctcgctcggcctgatgacctcggtgctgatgacgccggacggcaagacggtcgaggcggaagccgcccacggcacggtgacgcgccactaccgccagcatcagaagggcgaggaaacctcgaccaactcgatcgcatcgatcttcgcctggacccgcggcctcgcccaccgcgccaagctcgacggcaacgccgaactcgcgaagttctccgagaccctggagcgcgtctgcgtggatacggtcgagtccggcttcatgaccaaggatctggcacttctcatcggtcccgaccagccctggctgtcgaccaccggtttcctcgacaagatcgacgagaacctcaggaaggcaatggcggcgtaa

SEQ ID NO: 5770 - protein, 404 aa, Rhizobium meliloti
MAKIKVANPVVELDGDEMTRIIWQFIKDKLIHPYLDLDLEYYDLGVENRDATDDQVTIDAANAIKKHGVGVKCATITPDEGRVEEFKLKKMWKSPNGTIRNILGGVIFREPIICKNVPRLVPGWTKPIIVGRHAFGDQYRATDFKFPGKGKLSIKFVGEDGQTIEHDVYDAPGAGVALAMYNLDESITEFARASFNYGLQRKVPVYLSTKNTILKAYDGRFKDIFQKVFDEEFAAQFKAEKLWYEHRLIDDMVASALKWSGGYVWACKNYDGDVQSDIVAQGFGSLGLMTSVLMTPDGKTVEAEAAHGTVTRHYRQHQKGEETSTNSIASIFAWTRGLAHRAKLDGNAELAKFSETLERVCVDTVESGFMTKDLALLIGPDQPWLSTTGFLDKIDENLRKAMAA

SEQ ID NO: 5771 - DNA, 1561 bp, Prunus persica
  CDS (1)..(1245)
atggctttccagaagatcaaggtggccaaccccatcgtggagatggacggagatgaaatgacgcgagttttctggaaatccataaaggataagcttattttaccctttttggaattggacatcaagtactttgaccttggtcttcctcatcgtgatgccactgatgataaagttactgttgaaagtgcagaggctactcttaagtacaatgtagcaatcaaatgtgcaactatcactccagatgaaggtcgtgttaaggagtttaacttgaagagtatgtggaggagtcccaatggcactattaggaatattttgaatggtactgttttcagagaaccaattctttgcaaaaacatccctcgccttatcccaggctggacaaagccaatatgcattggaagacatgctttcggtgatcagtatcgagcaactgatgctgtcattaaaggacctgggaaactgaaattggtgtttgtgccagacggaaaggatgagaaaacagaactagaggtgtacaacttcacaggtgaggggggagtagcattggccatgtacaacactgatgagtccatccgtgcttttgcagaggcttccatgaccactgcttatgagaaaaagtggcctctttatcttagcacaaagaacactattcttaagaagtatgatggaagattcaaggacatatttcaagaagtttatgaagccaagtggaagtcacagtatgaggctgctggcatatggtacgagcaccgtctcattgatgatatggtggcttatgcacttaaaagtgatggtgggtatgtttgggcatgcaagaattatgatggagatgtgcagagtgatttcttagctcaagggtttggctctcttggattgatgacatcagtactggtgtgcccagatggaaagactatagaagcagaagctgcccacggtacagttactcggcattacagggttcaccagaaaggaggtgaaaccagtacaaacagcatagcttctatctttgcttggacaagagggcttgcacacagggcaaagttggatgacaatgcaaagcttttggatttcactcagaaactggaagaagcttgcattggaactgtggaatctgggaaaatgaccaaggatcttgcactcattattcatggacctaagcttgctaggaaccactacttgaatacggaagagttcattgaagctgtggcagaggaactcagagcaaggctttctttgaaagaatagttgtacgtgaggggtttgcagacttgactctatgcattgggatagacaactgtggacttgtccttttgtactcccgaaagaaataatggaaggcggaatctttcccctctggtggttagagatgttgactcatctgtttttagtgtattagtttcttgtgcacaatttaattgctcgactcttactgatttgaatgttctttcttcatcagtttgcttccgcaagcaagtttgacctttttcatggctaagccaattttagtgatttccagcaagaaatcaagttttagaaaaaaaaaaaaaaagggggggcccgg

SEQ ID NO: 5772 - protein, 414 aa, Prunus persica
MAFQKIKVANPIVEMDGDEMTRVFWKSIKDKLILPFLELDIKYFDLGLPHRDATDDKVTVESAEATLKYNVAIKCATITPDEGRVKEFNLKSMWRSPNGTIRNILNGTVFREPILCKNIPRLIPGWTKPICIGRHAFGDQYRATDAVIKGPGKLKLVFVPDGKDEKTELEVYNFTGEGGVALAMYNTDESIRAFAEASMTTAYEKKWPLYLSTKNTILKKYDGRFKDIFQEVYEAKWKSQYEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWTRGLAHRAKLDDNAKLLDFTQKLEEACIGTVESGKMTKDLALIIHGPKLARNHYLNTEEFIEAVAEELRARLSLKE

SEQ ID NO: 5773 - DNA, 1242 bp, Emericella nidulans
  CDS (1)..(1242)
atggcgactgaagtacagaagatcaaggtcaagaaccccgtcgtggagttggacggtgatgagatgacccgcattatctggaaggagatcagggaaaagttgatcttgcctttcctcgatattgacctcaagtactacgacctgggtcttgagtaccgtgaccagaccgatgacaaggtcaccaccgagtccgctgaggccatcaagaagtatggtgtcggtgtcaagtgcgccaccatcactcctgatgaggcccgtgttgaggagttcaagctgaagaagatgtggctgtctcctaacggtactatccgtaacatccttggcggtactgtcttccgtgagcccattgtcattcctcgcattcctcgcctcgtccccggatggactaagcccatcatcatcggtcgtcatgctttcggtgaccagtaccgtgctaccgaccgtgtgatccctgggcctggcaagcttgagctcgtctacacccccgagggcggccagcctgaggctatcaaggtctttgatttccctggcggtggtgttacccagactcagtacaacaccgatgagtcgattcgcggcttcgcccacgccagtttcaagcttgccttgactaagggccttcctctctacatgagcaccaagaacactattctgaagaagtacgatggccgcttcaaggacatcttccaagagatcttcgagtccgactacaagaaggaatttgatgccaagggcatctggtacgagcaccgtctcattgatgacatggtcgctcaaatgatcaagagcgagggtggtttcatcatggctttgaagaactacgatggtgacgttcagtccgacattgttgcccagggcttcggctccctgggtctgatgacctccacactcatcacccctgacggccaggcctttgagtctgaagctgcccacggcaccgtcacccgtcactaccgcgagcaccagaagggccgcgagacctccaccaaccccattgcctccatcttcgcctggacccgtggtcttatccagcgtggtaagctcgacgaaacccccgacgttgtcaagttcgccgaggagctcgagcgcgcttgtatcgatgttgtcaacgaggagggtatcatgaccaaggaccttgctctgtcctgcggccgcaaggagcgcgacgcgtgggttaccacccgcgagtacatggctgccgtcgagcgccgactcagggcaaacttgaaggcccgtctatag

SEQ ID NO: 5774 - protein, 413 aa, Emericella nidulans
MATEVQKIKVKNPVVELDGDEMTRIIWKEIREKLILPFLDIDLKYYDLGLEYRDQTDDKVTTESAEAIKKYGVGVKCATITPDEARVEEFKLKKMWLSPNGTIRNILGGTVFREPIVIPRIPRLVPGWTKPIIIGRHAFGDQYRATDRVIPGPGKLELVYTPEGGQPEAIKVFDFPGGGVTQTQYNTDESIRGFAHASFKLALTKGLPLYMSTKNTILKKYDGRFKDIFQEIFESDYKKEFDAKGIWYEHRLIDDMVAQMIKSEGGFIMALKNYDGDVQSDIVAQGFGSLGLMTSTLITPDGQAFESEAAHGTVTRHYREHQKGRETSTNPIASIFAWTRGLIQRGKLDETPDVVKFAEELERACIDVVNEEGIMTKDLALSCGRKERDAWVTTREYMAAVERRLRANLKARL

SEQ ID NO: 5775 - DNA, 1212 bp, Rhizobium loti
  CDS (1)..(1212)
atggcgaagatcaaggtggcgaacccggtcgtcgagctcgacggcgacgagatgacccgcatcatctggcagttcatcaaggacaagctgatccacccttatctcgacctgaagctcgaatattacgatctcggcatcgagcatcgtgacgccaccaacgaccaggtgaccatcgattcggccaacgccatcaagaaatacggcgtcggcgtgaagtgcgcgacgatcacccccgacgaacagcgcgtcgaggagttcaagctgaagaagatgtggaagtcgccgaatggcaccatccgcaacatccttggcggcaccatcttccgcgagccgatcatcatgaagaacgtgccgcgcctggtgcccggctggaccaagccgatcatcgtcggccgccacgccttcggcgaccagtaccgcgccaccgatttccgcttccccggcaagggcaagctgacgatcaagttcgtcggtgaagacggaaaggtcatcgagcatgacgtgttcgacgcacccggcgccggcgtcgccatggccatgtacaatctcgacgagtcgatccgcgagtttgcccgcgcctcgctgaattacggcctgctgcgcaactatccggtctatctgtcgaccaagaacaccatcctgaaagcctatgacggccgcttcaaggacattttccaggaagtctacgaggctgaattcgaggccgacttcaagtcgaagaagctgtggtacgaacaccgcctgatcgacgacatggtggcgtccagtctgaaatggtcgggcggctatgtctgggcctgcaagaactatgacggcgacgtccagtccgataccgtggcgcaaggtttcggctcgctcggccttatgacttcggtgctgatgacgccggacggcaagacggtggaagccgaagccgcgcacggcaccgtaacccgccactaccgccagcaccagaagggcgaggaaacctcgaccaattcgatcgcctcgatcttcgcctggacgcgcgggctggcccaccgcgccaagctcgacgacaatgcggagctgaagcgctttgccgagacgctggaaaaggtctgtatccagaccgtcgagtccggcttcatgaccaaggacctgtcgctgttgatcggtcccgatcagccctggctctcgaccaccggcttcctcgacaagatcgacgaaaacttgcagaaggcgatggcgtaa

SEQ ID NO: 5776 - protein, 403 aa, Rhizobium loti
MAKIKVANPVVELDGDEMTRIIWQFIKDKLIHPYLDLKLEYYDLGIEHRDATNDQVTIDSANAIKKYGVGVKCATITPDEQRVEEFKLKKMWKSPNGTIRNILGGTIFREPIIMKNVPRLVPGWTKPIIVGRHAFGDQYRATDFRFPGKGKLTIKFVGEDGKVIEHDVFDAPGAGVAMAMYNLDESIREFARASLNYGLLRNYPVYLSTKNTILKAYDGRFKDIFQEVYEAEFEADFKSKKLWYEHRLIDDMVASSLKWSGGYVWACKNYDGDVQSDTVAQGFGSLGLMTSVLMTPDGKTVEAEAAHGTVTRHYRQHQKGEETSTNSIASIFAWTRGLAHRAKLDDNAELKRFAETLEKVCIQTVESGFMTKDLSLLIGPDQPWLSTTGFLDKIDENLQKAMA

SEQ ID NO: 5777 - DNA, 1679 bp, Mus musculus
  CDS (46)..(1404)
cgcacagcccggtgcagcggcgtgctcggacctcgcgtgctcgggatggccggctacctgcgggctgtgagctcgctctgcagagcctcgggctcagcgcggacctgggcaccggcagcactgactgtccccagctggccggagcagccgcggcgccactatgctgagaagaggatcaaggtggagaagccggtagtggagatggacggtgacgagatgacccggatcatctggcagttcatcaaggagaagctcatcctgcctcacgtggatgttcagctcaagtattttgaccttgggcttccaaaccgtgaccagaccaatgaccaggtcaccattgactctgctctggccacccagaagtacagtgtggctgtcaagtgtgccacaatcacccctgatgaggcccgtgtggaagagttcaagctgaagaaaatgtggaagagccctaacggaacgatccggaacatccttgggggaaccgtcttcagagagccaatcatctgcaaaaacatcccccgccttgtccctggctggaccaagcccatcaccattggcaggcacgcccatggcgaccagtacaaggccacagattttgtggtagatcgagctggcacgttcaagttggtcttcaccccaaaggatggcagcagtgccaaggagtgggaggtgtataacttccctgccggaggcgttgggatggggatgtacaacaccgacgagtccatttcgggcttcgcgcacagctgcttccagtactctatccagaagaaatggccgctctacttgagcaccaagaacaccattctgaaggcctatgacgggcgtttcaaggacatcttccaggagatctttgacaagcactataagactgacttcgacaggaataagatctggtatgaacatcggctcatcgacgacatggtggcccaggtgctcaagtcttccggtggctttgtgtgggcttgcaaaaactatgatggagacgtgcagtctgacatcctggctcaaggctttggctccctcggcctgatgacatctgtgctggtctgccctgatgggaagacaattgaggctgaggctgctcatgggacagtcacccgccattaccgagaacaccagaagggccggcccaccagtaccaaccctattgccagcatctttgcctggacacggggtctggagcatcgtgggaagctggatgggaaccaggaccttatcaggtttgcacagacgctggagaaggtgtgcgtgcagactgtggagagcggagcgatgaccaaggacctggctggctgtatccatggcctcagcaatgtgaagctgaacgagcacttcctgaacaccacagacttcctggacaccattaagagcaacctggacagagctctgggcaagcagtaggggtggacactactcagctccagtgggtactctgtacatggcagagggtgggcctcacagccctctctggtggcctttctagggacatttttttacatatatatatgatggagatgttttttaaagtatatgagcattttcctcacggtggacatgaggcaggaacgtgtgctttacctcagacagtcagtgttctgcatactgtaatttatattgctctggaatcacatggtgccatatttagctactaaaaagctcttcgcaaaaaaaaaaaa

SEQ ID NO: 5778 - protein, 452 aa, Mus musculus
MAGYLRAVSSLCRASGSARTWAPAALTVPSWPEQPRRHYAEKRIKVEKPVVEMDGDEMTRIIWQFIKEKLILPHVDVQLKYFDLGLPNRDQTNDQVTIDSALATQKYSVAVKCATITPDEARVEEFKLKKMWKSPNGTIRNILGGTVFREPIICKNIPRLVPGWTKPITIGRHAHGDQYKATDFVVDRAGTFKLVFTPKDGSSAKEWEVYNFPAGGVGMGMYNTDESISGFAHSCFQYSIQKKWPLYLSTKNTILKAYDGRFKDIFQEIFDKHYKTDFDRNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQTLEKVCVQTVESGAMTKDLAGCIHGLSNVKLNEHFLNTTDFLDTIKSNLDRALGKQ

SEQ ID NO: 5779 - DNA, 1227 bp, Oryza sativa
  CDS (1)..(1227)
atggcgttcgagaagatcgtcgtggccaaccccgtcgtcgagatggacggtgatgagatgactcgagttatttggaaatggatcaaagataagcttatattccctttcttggacttggacataaaatactatgacttaggtctacctaatcgtgacgctactggggacaaagttacaatagagagtgcagaagcgaccctaaagtataatgtagccatcaaatgtgcaactataactccagatgaaggacgcgtgaaagagtttaatttaagtgcaatgtggaagagtccaaatgggacaataaggaacattttgaatggaactgttttccgagaaccaatcatctgcaagaatattcctcggcttgtacctgggtggataaagcccatatgcattggacgacatgcatttggtgatcaataccgagcaacagatacagttattaaaggtcctgggaagttgaagttagtatttgatggcagagaggaacaaatagagttggatgtgttcaactttactggtgctggtggagtagccttgtctatgtataatactgacgagtctatttgggcattcgctgaagcttccatgaacatggcttaccagaaaagatggccactttatcttagcaccaaaaacacgatcctcaaaaaatacgatggaaggtttaaagatatatttcaggagaactatgaaacaaaatggagagccaagtttgatgatgcaggaatatggtacgaacatcggctgattgatgatatggtggcctatgcccttaagagtgaaggtggctatgtttgggcttgcaagaactatgatggagatgtgcagagcgatctaattgctcaaggtttttgcttattatatgtgtgccctgatggtagaaccattgaagctgaagctgctcatggtacagtcacacgccattacagagttcaccaaaaaggaggcgaaactagtacaaatagcattgcttcaatatttgcttggacaaccggactaggacatagggcaaagctcgatgacaataaaagactgttagattttgtacaaaaacttgaagctgcttgtgtgggaacagtggaatctggaaagatgacaaaggatctagctcttcttgtacatgggccaaatgttagccgagataagtatcttaacactgttgagttcatcgatgctgttgctgaggatttaagaacaagattgtcagtaacatccaagttatga

SEQ ID NO: 5780 - protein, 408 aa, Oryza sativa
MAFEKIVVANPVVEMDGDEMTRVIWKWIKDKLIFPFLDLDIKYYDLGLPNRDATGDKVTIESAEATLKYNVAIKCATITPDEGRVKEFNLSAMWKSPNGTIRNILNGTVFREPIICKNIPRLVPGWIKPICIGRHAFGDQYRATDTVIKGPGKLKLVFDGREEQIELDVFNFTGAGGVALSMYNTDESIWAFAEASMNMAYQKRWPLYLSTKNTILKKYDGRFKDIFQENYETKWRAKFDDAGIWYEHRLIDDMVAYALKSEGGYVWACKNYDGDVQSDLIAQGFCLLYVCPDGRTIEAEAAHGTVTRHYRVHQKGGETSTNSIASIFAWTTGLGHRAKLDDNKRLLDFVQKLEAACVGTVESGKMTKDLALLVHGPNVSRDKYLNTVEFIDAVAEDLRTRLSVTSKL

SEQ ID NO: 5781 - DNA, 1554 bp, Solanum tuberosum
  CDS (61)..(1473)
cttttttaagccatctaaagtggtatgctggccgtccgactcagactccggtgttcctccatggccggcgttgcttcttttgtctcatcttcatcggcttctgcatcatctatagctagtaaaaaactctattttcaagtcaattccaatcggcagctcttcaatagcagagtatctctcactacgcgaatccctaatgcctcaattcggtgcttcgcttcttcctctggtccgactagcaaaattcgcgttcaaaatcccatcgtcgaaatggacggtgatgaaatgacgagggttatatggaaaatgatcaaagacaagctaatatatccttatctagagttggatacaaagtattatgatttaggtatattgaaccgtgatgccactgatgaccaagttactgttgaaagtgctgaggcaaccctgaagtacaatgttgctgtgaaatgcgctactataacacctgatgagaccagagtcaaggaatttgggctgaagtctatgtggaaaagtcccaatggcacaatcagaaacattttaaacggtactgttttccgggagcctatactatgcacgaacattcccaggattgttcctggttggaagaaacccatttgtattggtaggcatgcttttggtgatcagtatcgtgccacagatcgaattattaatgggcccggaaagctcaaaatggtttttgtgccagaaaatggggaatcccctatggagctggatgtttatgattttaaaggtccgggtattgcacttgccatgtacaatgttgaccagtcaattcgagcgtttgctgaatcatcaatgtcaatggcattttcaaagaaatggcctctttacttgagtacaaaaaacacaattttaaagaaatacgatggaaggtttaaggacatttttcaagaggtatacgaagagaagtggaagcaacagtttgaggaacactctatatggtatgagcatagactgatagatgacatggtagcttatgcattaaaaagtgagggtggatatgtttgggcatgcaagaactatgatggagatgtccagagtgatttgctcgctcaaggatttggttctctgggcctcatgacttctatattgttatcttctgatggcaagacattagaagctgaagcagctcacggcactgtaacaatacattttcggctgcatcaaaagggtcaagaaactagtacaaacagtgttgcttccatttttgcatggacaaagggacttggacatagggctcagcttgatgggaatcaaaagttgttggaatttgttcacacccttgaagcttcttgcattgggacaatagaatccgggaagatgactaacttagctatattagctcatggatccaaggtgtcaagagaattctacttgaacactgaagagtttattgatgctgtagcacagaaacttcaagagaagcttcatgcctcggtgcctatttaagttatcctgaattatgtagtgagaacatgtatgagctgaagaagatcatgagcagcatccttttcacagtgaagcggccgc

SEQ ID NO: 5782 - protein, 470 aa, Solanum tuberosum
MAGVASFVSSSSASASSIASKKLYFQVNSNRQLFNSRVSLTTRIPNASIRCFASSSGPTSKIRVQNPIVEMDGDEMTRVIWKMIKDKLIYPYLELDTKYYDLGILNRDATDDQVTVESAEATLKYNVAVKCATITPDETRVKEFGLKSMWKSPNGTIRNILNGTVFREPILCTNIPRIVPGWKKPICIGRHAFGDQYRATDRIINGPGKLKMVFVPENGESPMELDVYDFKGPGIALAMYNVDQSIRAFAESSMSMAFSKKWPLYLSTKNTILKKYDGRFKDIFQEVYEEKWKQQFEEHSIWYEHRLIDDMVAYALKSEGGYVWACKNYDGDVQSDLLAQGFGSLGLMTSILLSSDGKTLEAEAAHGTVTIHFRLHQKGQETSTNSVASIFAWTKGLGHRAQLDGNQKLLEFVHTLEASCIGTIESGKMTNLAILAHGSKVSREFYLNTEEFIDAVAQKLQEKLHASVPI

SEQ ID NO: 5783 - DNA, 1708 bp, Citrus limon
  CDS (155)..(1399): n means a or g or c or t/u, s means g or c
cgaaagcagcagcatttcaattttcatagtattattattattattattgcttcttgctgcttctttttgtccacacgacctcggcacctccgctctgaccctattatctgactctctctagttgtgaatcaaccgaaactgaacaaagaagaaaatggcttttcagaagatcaaggtcgccaatcccatcgttgaaatggacggagatgaaatgactcgagttttctggaaatcgattaaggataagcttattttcccttttctggagttggacataaagtacttcgaccttggccttccgaatcgtgatgcaactgatgacaaagttaccgttgaaagtgcagaagccactctcaagtacaatgtagcgatcaagtgtgctactattactccagatgaagctcgtgttaaggaatttgtcttgaaacagatgtggaagagtccaaatgggacaatcaggaatattttgaatggcactgttttcagagaaccaatcatttgcaaaaatgtccctcggcttattccaggctggacaaagcccatatgcattggcaggcatgcttttggtgatcaatatcgagcaactgatacagttattcaaggacctggcaaacttaaattggtgtttgtaccagagggaaaagatgagaagacagagttagaggtttacaactttacgggtgagggtggagttgcattgtccatgtataacactgatgagtccatccgaagttttgctgaggcttctatgaacactgcctatcaaaaaaagtggccactctatcttagtacaaaaaacactatccttaaaaattatgatggaaaattcaaagacatatttcaagaggtttatgaggcaaactggaagtcaaagtttgaagctgctggcatatggtatgaacatcgtctcattgatgatatggtagcttatgctctcaaaagtgaaggaggttacgtgtgggcttgcaaagattatgatggaaatgtccaaagtgatttcctagctcaagggtttggatctcttggattgatgacatctgtactggtatgccctgatgggaaaacaattgaagccgaagcagcccatggaacagtcacccgacactacagagttcatcagaaaggtggtgaaactagcacaaacagcatagcctccatctttgcttggtcacgagggcttgcacatagggcgaagttggacaacaatgctaggctgttggattttactgagaaactagaagctgcatgtgttggcactgttgaatctgggaagatgaccaaggatcttgcacttattatccatggatctaagatgactagggaacactatctgaatactgaagagttcattgatgctgtggccgacgatttaagagcaagactctctggcaaagcatgattttatgctacacattcaaaggtaaagacttggggaagcttccctttggttatttttttcatactatgctgagaagaaataattgaagaggggaaaattggggattgggatttggtttttttttaattcctacnatagactgctttcctgttgatcgacaaactttcattttcatgcaagcaaatgttttgaacatggcttgttataaacaaaactattgctgccaaatttacgttcatggtttatttgagctgcacctctgttgcccaaaaaaaaaaaaaaaaaaaaaaaaaaaaaaaaaaaaaaaaa

SEQ ID NO: 5784 - protein, 414 aa, Citrus limon
MAFQKIKVANPIVEMDGDEMTRVFWKSIKDKLIFPFLELDIKYFDLGLPNRDATDDKVTVESAEATLKYNVAIKCATITPDEARVKEFVLKQMWKSPNGTIRNILNGTVFREPIICKNVPRLIPGWTKPICIGRHAFGDQYRATDTVIQGPGKLKLVFVPEGKDEKTELEVYNFTGEGGVALSMYNTDESIRSFAEASMNTAYQKKWPLYLSTKNTILKNYDGKFKDIFQEVYEANWKSKFEAAGIWYEHRLIDDMVAYALKSEGGYVWACKDYDGNVQSDFLAQGFGSLGLMTSVLVCPDGKTIEAEAAHGTVTRHYRVHQKGGETSTNSIASIFAWSRGLAHRAKLDNNARLLDFTEKLEAACVGTVESGKMTKDLALIIHGSKMTREHYLNTEEFIDAVADDLRARLSGKA

SEQ ID NO: 5785 - DNA, 1782 bp, Drosophila melanogaster
  CDS (430)..(1782)
ttcgccgagtgcttattgttttttatactctcgttacattattaattaaaacacttgcttttaagtgtgccgagtgttgtgagagcagcttatcaaagtccgaggttctaaatcttatctgactgggcatttagaacgttgtgattacgccgattgcgcaacaatttgacgattgtacgccacccaagagagtcggaaactgtagcgcttaacggcactttacagttatcagttacggttagagcgcgtctgacgcccacagcatttaattttgctttgtccgaaaattgttctctttcccgggactccagtgtcatattgtctcgtattgtttcacattggtgacaaacactatcgtctctcgtttccagtcgtcggtcggttcattcataataataatacccacatccacaccaatccggttgtaaaatgttcgccctgcgccgcacagccgcaatgatgacgtcggtccaccggcagccgcatctcagccaggccgtttttcgggccaatttcgccatcagcgccgcgatggcccagaagatcaaagccggtcccgttgtggatgtcctcggtgacgagatgacccgcatcatttgggactccattaagagccaactgattctgcccttcctggacattgagctgcatacctacgatcttggtattgagaaccgcgataaaaccgaggaccaggtcaccattgactgtgctgaggccatcaagaagtacaacgtgggcatcaagtgcgccacaatcactcccgacgagaagcgcgtagaggagttcaacctgaagaagatgtggaagtcgcccaacggtaccatccgtaacatcttgggaggaaccgtcttccgtgaggcaatcatctgcaagaacgtgccccgtctggtgactggctggcagaagcctattgtgatcggtcgccatgcccacgccgatcagtacaaggccgtcgactacgtggttcccggacccggcaagctgaccctcacctggaagggaaccgacggtcaggtgatcgatgaggtcattaatgacttcaagggccccggtattgccctgggaatgttcaacacggacgattccattgtggactttgcccacgcctctttcaaatatgctctggaccgcaagctgccgctgtacatgagcaccaagaacaccattctgaagaagtacgatggacgcttcaaggacatattcgaggacctgtacaacaagcagtacaagaaggagtacgaggcggcgggcatctggtatgaacaccgtctcatcgacgatatggttgcttatgccatgaagtcggagggtggcttcgtgtgggcctgcaagaactacgacggtgatgtgcagtcggactccgttgcccagggctacggatctctgggtctgatgacctccgtgctgctatgccccgatggcaagaccgtggaggctgaagccgctcacggaacggtgacgcgtcacttccgcttctaccagcagggcaaggagacctccaccaaccccattgcctcgatattcgcctggacccgtggcctgctgcatcgtgccaagctggacaacaatgagccactgaagcagttcgccgacacccttgagcaggtgtgcatcgacacaattgagagcggcgccatgaccaaggatctggccatctgcattaaaggcaacatcaacgccgttactcgcagggactaccaggagacttttgagttcattaacacgctggccaagaacctggagggtgccctggccaagaatgccgttgctgccaaatga

SEQ ID NO: 5786 - protein, 450 aa, Drosophila melanogaster
MFALRRTAAMMTSVHRQPHLSQAVFRANFAISAAMAQKIKAGPVVDVLGDEMTRIIWDSIKSQLILPFLDIELHTYDLGIENRDKTEDQVTIDCAEAIKKYNVGIKCATITPDEKRVEEFNLKKMWKSPNGTIRNILGGTVFREAIICKNVPRLVTGWQKPIVIGRHAHADQYKAVDYVVPGPGKLTLTWKGTDGQVIDEVINDFKGPGIALGMFNTDDSIVDFAHASFKYALDRKLPLYMSTKNTILKKYDGRFKDIFEDLYNKQYKKEYEAAGIWYEHRLIDDMVAYAMKSEGGFVWACKNYDGDVQSDSVAQGYGSLGLMTSVLLCPDGKTVEAEAAHGTVTRHFRFYQQGKETSTNPIASIFAWTRGLLHRAKLDNNEPLKQFADTLEQVCIDTIESGAMTKDLAICIKGNINAVTRRDYQETFEFINTLAKNLEGALAKNAVAAK

SEQ ID NO: 5787 - DNA, 1503 bp, Oryza sativa
  CDS (84)..(1322)
cttcttcttcttcctcaagactaccaatccaatctcctcctcgccgccatcgcgatctccgccgccgcccgcctgtcgcggccatggcatccaccaagatcaaggtcgccaaccccattgtcgagatggacggtgatgagatgactcgagtattctggaaatctatcaaggacaagcttatcttcccgttcttggagttggacattaagtactttgatctcggacttccataccgtgatcaaaccgacgataaagtcacagtggaggcagcagaggctaccctcaagtacaatgtggccatcaagtgtgcaaccattacaccagatgaagcaagggttaaagagttcagcctaaaatccatgtggaagagcccaaacggcacaattagaaatatcctaaatggcactgtgttcagagaaccaataatctgcaaaaacatccctcggcttgttccaggatggactaagcccatttgcattggaaggcacgcatttggtgatcagtaccgtgcaacggatgcagttatcaagggacctggcaagcttaaattggtttatgagggaaaagatgaggagattgagctggaggtgttcaacttcactggtgctggaggagtggcacagtctatgtacaacactgacgagtccatccgttcctttgctgaggcctctatggccactgcttatgagaagaaatggccattgtacctcagcaccaaaaacacaattttgaagaaatatgatggcaggttcaaggacatcttccaggaggtatatgaagctcagtggaaatcaaaatttgaggctgctggaatatggtatgagcatcgtctcattgatgacatggttgcctatgcactcaagagtgaaggaggctatgtttgggcttgcaagaactatgatggagatgtgcagagtgatttcttagcacaaggttttggatcattgggtttgatgacatcagttttggtatgtcctgatgggaaaaccattgaagctgaagctgcccatgggactgtcacccgtcattaccgtgttcatcagaaaggtggtgaaactagcacaaacagcattgcctcaatctttgcctggacaagaggacttgcacacagggcaaagctagatgacaatgctaggctactggacttcactcagaagcttgaagctgcctgcattggcgctgtcgagtctgggaagatgaccaaggaccttgctctgcttgttcacggatcttcaaatgtcacgaggagtcattacctgaacactgaagagttcatcgatgctgttgctgacgagctcagatcaaggctggcagccaactaaagctaatcaaatcaagtgattttgctgttattgatgtgatccgatgcacttcgattatacatttctagaaccgcatcattcgacgttacaaatattttttttcttaatgaattttgaatcacttggtaggtggagattacaaataaagtttcagagctattcatgagaaagctccagattc

SEQ ID NO: 5788 - protein, 412 aa, Oryza sativa
MASTKIKVANPIVEMDGDEMTRVFWKSIKDKLIFPFLELDIKYFDLGLPYRDQTDDKVTVEAAEATLKYNVAIKCATITPDEARVKEFSLKSMWKSPNGTIRNILNGTVFREPIICKNIPRLVPGWTKPICIGRHAFGDQYRATDAVIKGPGKLKLVYEGKDEEIELEVFNFTGAGGVAQSMYNTDESIRSFAEASMATAYEKKWPLYLSTKNTILKKYDGRFKDIFQEVYEAQWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACIGAVESGKMTKDLALLVHGSSNVTRSHYLNTEEFIDAVADELRSRLAAN

SEQ ID NO: 5789 - DNA, 1859 bp, Oryza sativa
  CDS (201)..(1445)
ggcaggccgaacgcccgcgccgtgtctgcttatgatgcttcgttctctccgcgctccgtgtccgaccttcttcagacttcacacctcgcgcgccgccgcagctccgatcggaagacgctcgattcgtctccgactccgacgaccagaagctaccggcgacgcgagcggagaagcgcggaggggagggggcgcgcgccgccatggcgttcgagaagatcgtcgtggccaaccccgtcgtcgagatggacggtgatgagatgactcgagttatttggaaatggatcaaagataagcttatattccctttcttggacttggacataaaatactatgacttaggtctacctaatcgtgacgctactggggacaaagttacaatagagagtgcagaagcgaccctaaagtataatgtagccatcaaatgtgcaactataactccagatgaaggacgcgtgaaagagtttaatttaagtgcaatgtggaagagtccaaatgggacaataaggaacattttgaatggaactgttttccgagaaccaatcatctgcaagaatattcctcggcttgtacctgggtggataaagcccatatgcattggacgacatgcatttggtgatcaataccgagcaacagatacagttattaaaggtcctgggaagttgaagttagtatttgatggcagagaggaacaaatagagttggatgtgttcaactttactggtgctggtggagtagccttgtctatgtataatactgacgagtctatttgggcattcgctgaagcttccatgaacatggcttaccagaaaagatggccactttatcttagcaccaaaaacacgatcctcaaaaaatacgatggaaggtttaaagatatatttcaggagaactatgaaacaaaatggagagccaagtttgatgatgcaggaatatggtacgaacatcggctgattgatgatatggtggcctatgcccttaagagtgaaggtggctatgtttgggcttgcaagaactatgatggagatgtgcagagcgatctaattgctcaaggttttggatcgctaggtctaatgacatcagttctggtgtgccctgatggtagaaccattgaagctgaagctgctcatggtacagtcacacgccattacagagttcaccaaaaaggaggcgaaactagtacaaatagcattgcttcaatatttgcttggacaaccggactaggacatagggcaaagctcgatgacaataaaagactgttagattttgtacaaaaacttgaagctgcttgtgtgggaacagtggaatctggaaagatgacaaaggatctagctcttcttgtacatgggccaaatgttagccgagataagtatcttaacactgttgagttcatcgatgctgttgctgaggatttaagaacaagattgtcagtaacatccaagttatgaaggaatgaatagggcaacggcaggggacatgttaggatcccatgatacaaagtttatacatttttactttgaataagagcgattgaagcattggtatgcgcagctatcaaccacggtgctctgataaaatctggtaaagattgtatgcatactccatacaacaatggaggtggaggaggatattttgctcgaaataagaagtttgaacttttattcgtcagacttctacttataactactttgatgattaaatcatggccgtgtagcttagttcttctatgccaaaagagcaagtagaactatcctaaaggtacccaccacaagtggtgtttgtgctttgtaccatacaaacaagactgtttatttactacggtatatagcttggaataaaaaagcaggtgcagatctgttggt

SEQ ID NO: 5790 - protein, 414 aa, Oryza sativa
MAFEKIVVANPVVEMDGDEMTRVIWKWIKDKLIFPFLDLDIKYYDLGLPNRDATGDKVTIESAEATLKYNVAIKCATITPDEGRVKEFNLSAMWKSPNGTIRNILNGTVFREPIICKNIPRLVPGWIKPICIGRHAFGDQYRATDTVIKGPGKLKLVFDGREEQIELDVFNFTGAGGVALSMYNTDESIWAFAEASMNMAYQKRWPLYLSTKNTILKKYDGRFKDIFQENYETKWRAKFDDAGIWYEHRLIDDMVAYALKSEGGYVWACKNYDGDVQSDLIAQGFGSLGLMTSVLVCPDGRTIEAEAAHGTVTRHYRVHQKGGETSTNSIASIFAWTTGLGHRAKLDDNKRLLDFVQKLEAACVGTVESGKMTKDLALLVHGPNVSRDKYLNTVEFIDAVAEDLRTRLSVTSKL

SEQ ID NO: 5791 - DNA, 1488 bp, Daucus carota
  CDS (91)..(1341)
agacaaactcagttgtaaattccgccagtttgattacttgtttgtaaaatataattttgtgatcctgggttttgcaaattggaagtaaagatggctatgcagaagatcaaagtgttgaatccaatcgttgaaatggatggtgatgaaatgacaagggttttttggaaatctattaaggagaaacttatatttccatttctggatttagacataaagtattttgatcttggcctccctaatcgtgatgccaccgatgatagagttacaattgaaagtgcagaagccactcttaagtacaatgtagcaattaagtgtgcaactatcacaccagatgaaactcgtctcaaggagttcaacttaaagcagatgtggaagagtccgaacgggactattcgtaacatattaaatggaactgttttccgcgaaccaatcatttgcaaaaatataccgcgacttgtccaaggctggaataagccaatatgcattggcaggcatgcttttggagatcaatatcgagctactgatctagttgttcaaggacctggaaaactcaaaatggtgtttgtaccagatgggcaaagtgagaaaacagagttagaggttttcaactttactggcgctggaggagtagctctttcaatgtacaacactgacgagtccattcatgcttttgctgaggcttctatgaacacagcttaccaaaaaagatggccactatatcttagcactaagaatactatccttaagaaatacgatggaagatttaaggatattttccaagaagtttatgaaaaagagtggaagtcaaagtttgaatctgtaggaatatggtatgagcatcgcttaattgatgatatggttgcttatgctcttaagagcgatggaggttatgtatgggcatgcaaaaactatgatggagatgtccaaagtgactttttagcccaaggattcggatctcttggtttgatgacatctgtactggtatgcccggatggaaagaccattgaagctgaagcagcccatggcacagttactcgtcattatcgtgtccatcaaaaaggaggtgaaactagcactaacagcatagcttcaatctttgcttggtctcgagggctagctcatagagcaaaattagatgacaatgccctcctcctggatttcactgagaaattggaagcagcttgcattggaactgttgaacgcggaaagatgaccaaggaccttgcaattcttctctatgggtctagggtaactaaggctcattatttgaacaccgagggatttatcgatgctgttgctgcagaactgagatcaagactatataagaaatcaaagttataacacatgtgtgttctctatgagatgtcagtgcttgacactgttttttccaatgtatgcaacatttttatttgtgaccatccttataaaataaattcatgtatagcaacttcgatccaaatactcattaatattattaaatcaatgctt

SEQ ID NO: 5792 - protein, 416 aa, Daucus carota
MAMQKIKVLNPIVEMDGDEMTRVFWKSIKEKLIFPFLDLDIKYFDLGLPNRDATDDRVTIESAEATLKYNVAIKCATITPDETRLKEFNLKQMWKSPNGTIRNILNGTVFREPIICKNIPRLVQGWNKPICIGRHAFGDQYRATDLVVQGPGKLKMVFVPDGQSEKTELEVFNFTGAGGVALSMYNTDESIHAFAEASMNTAYQKRWPLYLSTKNTILKKYDGRFKDIFQEVYEKEWKSKFESVGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDDNALLLDFTEKLEAACIGTVERGKMTKDLAILLYGSRVTKAHYLNTEGFIDAVAAELRSRLYKKSKL

SEQ ID NO: 5793 - DNA, 1512 bp, Daucus carota
  CDS (93)..(1331)
ggcgtctctcactaaaacccttcttcactatttttctcttcacatctgagctgagctgagtcgagtccgagtcgagatcatcatcatcagaaatggcgtttcagaagatcaaggtcgcgaatcccatcgtcgaaatggacggagatgaaatgactcgtgtattctggaaatctatcaaggacaagcttatatttcccttcgttgagctggatataaaatactttgaccttggccttcctcaccgtgatgcaactgatgataaagttactgttgaaagtgcagaggctaccctcaagtataatgtagctatcaaatgtgcaacaattaccccagatgaagctcgtgtgaaggagtttggcttgaaacagatgtggaagagtccaaatgggacaattagaaatattttaaacggcacggtatttagggaaccaattatatgcaaaaatatcccaaagctcatccctgggtggacaaagccaatatgcattggaagacatgcttttggcgatcagtaccgcgcaacagatgcagttatccaaggaccaggaaagcttaagttggtttttgtaccagaaggtaaagaagagaagacagagttagaagtttacaacttcactggtgctggaggtgttgctttgtcgatgtacaacactgatgagtctattcgttcttttgctgaagcttcaatggccacagcttatgaaaagaagtggccactttatcttagcacaaaaaatactattctgaagaaatatgatggaagatttaaggacatattccaagaagtttatgaagccagctggaaatcgaagtatgatgctgcagggatatggtacgagcaccgtcttattgatgatatggttgcatatgctcttaaaagtgatggaggttatgtctgggcatgcaaaaattatgatggggatgtccaaagtgatttccttgctcaaggttttggatctctggggttgatgacatcagtcctggtatgccctgatggaaagaccatagaagctgaagcagcccatggcactgttacccggcattacagggttcatcagaagggtggagagaccagcacaaacagcatagcatcaatctttgcatggtctcgaggccttgctcacagggcaaagctggatgataatgctgccctcttgagttttgctgaaaagcttgaggctgcttgtgttggtactgtggagtctgggaagatgactaaggatcttgctctcatactacatggatccaaactcagcagggaacactatcttaacactgaagagttcattgatgcagtagcaagtgatttgaaagcaagactcgccaactaagtttaaatgccttgaatgaaatgaaagttggaattattggggagttcagaattaagaaaaaacaacaataagaaaggcagttgctgcattattttgatagtgatgtttgcaatttcttttgagaatatttgtaacttttgtttgaattgcttacctatgatgtgactggaagagttaaatt

SEQ ID NO: 5794 - protein, 412 aa, Daucus carota
MAFQKIKVANPIVEMDGDEMTRVFWKSIKDKLIFPFVELDIKYFDLGLPHRDATDDKVTVESAEATLKYNVAIKCATITPDEARVKEFGLKQMWKSPNGTIRNILNGTVFREPIICKNIPKLIPGWTKPICIGRHAFGDQYRATDAVIQGPGKLKLVFVPEGKEEKTELEVYNFTGAGGVALSMYNTDESIRSFAEASMATAYEKKWPLYLSTKNTILKKYDGRFKDIFQEVYEASWKSKYDAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDDNAALLSFAEKLEAACVGTVESGKMTKDLALILHGSKLSREHYLNTEEFIDAVASDLKARLAN

SEQ ID NO: 5795 - DNA, 1600 bp, Candida tropicalis
  CDS (201)..(1493)
tctcctgtatcggggaatcacaaaagaaagttcgcggcagagcgttgactaattcctcaaaaattttccactttttcttcgctttatattttgccgattaggaatgaatttttttttttgagttttcgatcaagtagttctccaggaataacacctccgcccataacacttcctattccgcataacaactattccccagaatgatcagagctagtgctatccaacgtaccgcaatgttgctgagacaattgcgcgggttttcgaccagtgctaccttggccgataagatcaaggtcaagaacccaattgttgaattggatggtgacgaaatgacccgtatcatttggcaaaagattaaagaccagttgatcttgccttaccttgacgtcgacttgaagtactatgacttgggtatcgaatctcgtgatgccacagacgatcaaatcaccattgacgccgctaacgctatcaaagaatacggtgttggtgtcaagtgtgcaaccatcaccccagacgaagcaagagtcaaggaattccacttgaagaagatgtggctttctccaaacggtaccattagaaacattctcggtggtactgtcttcagagaatctatcatcatcccatgtatcccaagattgattcccggttgggaaaagccaattgtcatcggtagacacgctttcggcgatcaatacaaggctactgatttggttatcaacgagccaggtagattggaattgagattcactccagccagcggcggcgaagcccagacccaaaaggtttacgactacactggtccaggtgtcggtttggccatgtacaacaccgacgagtccattactggattcgctcatgcttccttcaagatggctttggctaaaggcttgccattgtacatgtccaccaagaacaccatcttgaagaaatacgacggtagattcaaggacatttttcaacagatttacgaacaagattatgctgctgaattcgaaaaacagggcttgtggtacgaacacagattgattgacgacatggttgcccagatgatcaagtccaaaggtggatttgtcatggctttgaagaactacgatggtgacgtgcaatccgatatcgtcgctcaaggttttggttctttgggtttgatgacttctgccttgatgactccagatggtaaggcttatgaagccgaagctgctcacggtaccgtcaccagacactacagacaacaccaacaaggtaaagagacttccaccaactcaattgcttctatctttgcctggaccagaggtttagctcaaagaggtaagttggacgaaactccagacgtggttgactttgccagcaagctcgaacaagctaccattgacactgttgaagttgaccgtataatgaccaaggacttggctttggctatgggcaaaactgatagatctgcatacgtcaccaccactgaatttttggacgctgttgctgacagattgaagaagtaaagtgcaacgtatatatatttgaatacacttcaatgcaagataaactcataaatttatgtacttttcgtttcccgttcccgcgcttctttatctaggtgttcccacaa

SEQ ID NO: 5796 - protein, 430 aa, Candida tropicalis
MIRASAIQRTAMLLRQLRGFSTSATLADKIKVKNPIVELDGDEMTRIIWQKIKDQLILPYLDVDLKYYDLGIESRDATDDQITIDAANAIKEYGVGVKCATITPDEARVKEFHLKKMWLSPNGTIRNILGGTVFRESIIIPCIPRLIPGWEKPIVIGRHAFGDQYKATDLVINEPGRLELRFTPASGGEAQTQKVYDYTGPGVGLAMYNTDESITGFAHASFKMALAKGLPLYMSTKNTILKKYDGRFKDIFQQIYEQDYAAEFEKQGLWYEHRLIDDMVAQMIKSKGGFVMALKNYDGDVQSDIVAQGFGSLGLMTSALMTPDGKAYEAEAAHGTVTRHYRQHQQGKETSTNSIASIFAWTRGLAQRGKLDETPDVVDFASKLEQATIDTVEVDRIMTKDLALAMGKTDRSAYVTTTEFLDAVADRLKK

SEQ ID NO: 5797 - DNA, 1560 bp, Glycine max
  CDS (87)..(1328)
cagcaattcacactggtctttgcttctcgttactcatttctcacctaactttctattcttctcagtctcagatcagaaccttagccatggcagcgttccagaagatcaaggtcgccaaccccatcgtcgagatggacggagatgaaatgactagggttatctggaagtcaatcaaggacaagctcattttgcccttcttggagttggacatcaagtattatgacttaggccttccttaccgtgatgagaccgatgataaagttacaattgaaagtgcggaagcaactctcaagtataatgtggcaattaagtgcgcaactattactccagatgaagctcgtgtgaaggagtttggtctgaagtcaatgtggaagagtccaaatgggacaattaggaacattttgaatggaactgtcttcagagaaccaattctttgcaaaaacattccccgccttgttcctggttggacaaaggcaatatgcattggaagacatgcgtttggtgatcaatatcgggcgactgacacagtaattaaaggagctggaaagctgaagctggtgtttgttccagaaggccagggtgaggagactgaattcgaggtttttaacttcactggtgaagggggtgtttcattggctatgtacaatactgatgagtctattcgttcttttgctgaggcctctatggcaactgctttagagaaaaagtggccactttatcttagcaccaaaaatacaattctgaagaaatatgatggaagattcaaggacatatttcaagaagtttatgaggcaagctggaaatcaaagtttgaggctgctggtatatggtatgagcatcgactcattgatgatatggtggcgtatgcacttaagagtgaaggaggttatgtatgggcatgcaaaaactatgatggagatgtccagagtgatttcttagctcaaggttttggatcactgggtttgatgacatctgtattggtttgccctgatggaaagactattgaagcagaagcagcccacggcacagttacccgccattttagggttcatcagaagggaggcgaaaccagcacaaatagcatagcatccatctttgcctggacaagagggctagcccacagggcaaaactggatgacaatgctaaactcttggatttcactgaaaagctagaggcagcttgcattggagtagtagaggctgggaagatgaccaaggatttggcacttattcttcatggatccaagctgtcaagggagcattatttgaacacagaggaattcatcgatgccgtggcagccgagcttagtgcgaggctttctgcatagacttgattcaagacaagcggaaaaaagacgttagcaacaaggagcgtgcgtgcgtctgctactctcttctattcagaagaaataagaaagggaaaaaaagcattggtccttagccccgtttccttcatttgtttgttggttgggaatgcaagggttggctgtttcttctccataatattggttgtgaactgatttgtcctttgtaatttcttattgatcccttccaactccc

SEQ ID NO: 5798 - protein, 413 aa, Glycine max
MAAFQKIKVANPIVEMDGDEMTRVIWKSIKDKLILPFLELDIKYYDLGLPYRDETDDKVTIESAEATLKYNVAIKCATITPDEARVKEFGLKSMWKSPNGTIRNILNGTVFREPILCKNIPRLVPGWTKAICIGRHAFGDQYRATDTVIKGAGKLKLVFVPEGQGEETEFEVFNFTGEGGVSLAMYNTDESIRSFAEASMATALEKKWPLYLSTKNTILKKYDGRFKDIFQEVYEASWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLLDFTEKLEAACIGVVEAGKMTKDLALILHGSKLSREHYLNTEEFIDAVAAELSARLSA

SEQ ID NO: 5799 - DNA, 1985 bp, Aspergillus niger
  CDS (288)..(1784)
tccgttcttccctcattcctccccaggttcttgcttattgcaggaaagattatttcccagagtgaacagaaacgattttccgggttctccgatctgccccgtgaaggtcccttacagcaacagcatctcgtccagtccggcttaacggcagcttccgaactccaccaccgcctccttccagccgagagcttcacggcttcttgcttgtctttccctcggactttccccggttcctcccacacagcaggcccagttactgtcgagtctttggcaatccatcccacaccatgtcgtctgtccggttcagttccgcattggcgcgccgctccttcgccgtcgcttcccctcctctctctgcccctctctcttcctccgctcgtcgctttctctcttcttcctcttctactatttcttcttcttcctcctctgtctctactcgctctcccagatctcttacttctgcctcatcccttctctcctctcgtactgcttctgcccgctggaccggtctatcctcgttgaaccttactcaatcccgcaccatggctaccgaaatccccaagatcaaggtcaagaaccccgtcgttgagctcgacggtgatgagatgacccgtatcatctggcaggagatcagagaaaagttgattctgccttaccttgacgtcgacctcaagtactatgacctgggtctcgaataccgtgaccagaccgatgaccaggtcaccgttgaggctgccgaggctatcaagaagtatggtgtcggtgtcaagtgcgccaccatcactcccgatgaggctcgtgttgaggagttcaagctgaagaagatgtggctgtcccccaacggcaccatccgtaacatcctcggcggtaccgtcttccgtgaacccatcatcatccccgccattccccgtctcgtccccggctggaacaagcccatcatcatcggtcgtcacgctttcggtgaccagtaccgtgccaccgaccgtgtcatccctggccccggcaagctcgagcttgtctacacccctgtcaatggcgagcccgagaccgtcaaggtctacgacttccagggtggtggtattgcccagactcagtacaacaccgatgagtcgatccgtggcttcgcccacgccagtttccagatggccctgctcaagggtctccctctgtacatgagcaccaagaacaccatcctgaagcgctacgatggtcgcttcaaggatatcttccaggagatctacgagtccacctaccagaaggactttgaggccaagaacctctggtacgagcaccgtctcattgacgacatggttgcccagatgatcaagagtgagggtggattcgtcatggccctgaagaactacgacggtgatgtccagtccgacattgtcgcccagggtttcggctcccttggtctgatgacctcgaccctggtcacccctactggcgaggctttcgagtctgaggctgcccacggtaccgtgacccgtcactaccgcgagcaccagaagggccgcgagacctccaccaaccccattgcctccatcttcgcctggacccgcggtctgatccagcgtggcaagctcgacgagactcctgatgtcgttacctttgctgaggagcttgagcgcgcttgcattgaggttgtcaacgatgagggcatcatgaccaaggatctggctctggcctgcggccgcaaggagcgtgaggcctgggttactacccgcgagtacatggctgccgtcgagcgcagactcaaggccaacctcaagtcccgcctttaaatacccgattgttttccattgatacactaacgctagcgtgactcgatgagtcgatattcttagaattacgggttgcattatgtagattttacaaaaggtggagacagttgttgaaaccacatgtatagtgcaactgatgtttgttccatgtctcatgaacttgtacatgcttgataatgaaaatagatgcagtcttctgat

SEQ ID NO: 5800 - protein, 498 aa, Aspergillus niger
MSSVRFSSALARRSFAVASPPLSAPLSSSARRFLSSSSSTISSSSSSVSTRSPRSLTSASSLLSSRTASARWTGLSSLNLTQSRTMATEIPKIKVKNPVVELDGDEMTRIIWQEIREKLILPYLDVDLKYYDLGLEYRDQTDDQVTVEAAEAIKKYGVGVKCATITPDEARVEEFKLKKMWLSPNGTIRNILGGTVFREPIIIPAIPRLVPGWNKPIIIGRHAFGDQYRATDRVIPGPGKLELVYTPVNGEPETVKVYDFQGGGIAQTQYNTDESIRGFAHASFQMALLKGLPLYMSTKNTILKRYDGRFKDIFQEIYESTYQKDFEAKNLWYEHRLIDDMVAQMIKSEGGFVMALKNYDGDVQSDIVAQGFGSLGLMTSTLVTPTGEAFESEAAHGTVTRHYREHQKGRETSTNPIASIFAWTRGLIQRGKLDETPDVVTFAEELERACIEVVNDEGIMTKDLALACGRKEREAWVTTREYMAAVERRLKANLKSRL

SEQ ID NO: 5801 - DNA, 1727 bp, Homo sapiens
  CDS (67)..(1425)
ggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaaaaaaaaa

SEQ ID NO: 5802 - protein, 452 aa, Homo sapiens
MAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 5803 - DNA, 1863 bp, Mus musculus
  CDS (24)..(1595)
agtctctggccgagataacactgatgcagaaattggtctatatgcaactctggatccagctcggatcagagcgggggtgcgggcgagcttggccaggcgaacatctttcttcctggcggcgcggcgtggatctaggtgacaggcgacgtgggctcctctcccgcttcctctctcccgaggcggcggcagtggcggcggcagaggtagaagcagcggcgtgctcggacctcgcgtgctcggaatggccggctactgcgggctgtgagctcctctgcagagcctcgggctcagcgcggacctgggcaccggcagcactgactgtccccagctggccggagcagccgcggcgccactatgctgagaagaggatcaaggtggagaagccggtagtggagatggacggtgacgagatgacccggatcatctggcagttcatcaaggagaagctcatcctgcctcacgtggatgttcagctcaagtattttgaccttgggcttccaaaccgtgaccagaccaatgaccaggtcaccattgactctgctctggccgcccagaagtacagtatggctgtcaagtgtgccacaatcacccctgatgaggcccgtgtggaagagttcaagctgaagaaaatgtggaagagccctaacggaacgatccggaacatccttgggggaaccgtcttcagagagccaagcatctgcaaaaacatcccccgccttgtccctgggtggaccaagcccatcaccattggcaggcacgcccatggcgaccagtacaaggccacagattttgtggtagatcgagctggcacgttcaagttggtcttcaccccaaagaatggcagcagtgccaaggagtgggaggtgtataacttccctggcggaggcgttgggatggggatgtacaacaccgacgagtccatttcgggcttcgcgcacagctgcttccagtactctatccagaagaaatggccgctctacttgagcaccaagaacaccattctgaaggcctatgacgggcgtttcaaggacatcttccaggagatctttgacaagcactataagactgacttcgacaggaataagatctggtatgaacatcggctcatcgacgacatggtggcccaggtgctcaagtcttccggtggctttgtgtgggcttgcaaaaactatgatggagacgtgcagtctgacatcctggcctcaaggtttggctccctcggcctgatgacatctgtgctggtctgccctgatgggaagacaattgaggctgaggctgctcatgggacagtcacccgccattaccgagaacaccagaagggccggcccaccagtaccaagggtattgccagcatctttgcctggacacggggtctggagcatcgtgggaagctggatgggaaccaggaccttatcaggtttgcacagacgcgggagaaggtgtgcgtgcagactgtggagggagcgatgaccaaggacctggctggctgtatccatggcctcagcaatgtgaagctgaacgagcacttcctgaacaccacagacttcctggacaccattaagagcaacctggacagagctctgggcaagcagtaggggtgacactactcagcaccagtgggtactctgtacatggtagagggtgcctcacagcccctctctggtggcctttctagggtcatttttttacatatatatgatggagatgttttttaaagtatatgagcattttcctcacggtggacatgaggcaggaacgtgtgctttacctcagacagtcagtgttctgcatactgtaatttatattgctctggaatcacatggtgccatatttagctactaaaaagctcttcgcaaaaaaaaa

SEQ ID NO: 5804 - protein, 523 aa, Mus musculus
MQKLVYMQLWIQLGSERGCGRAWPGEHLSSWRRGVDLGDRRRGLLSRFLSPEAAAVAAAEVEAAACSDLACSEWPATAGCELLCRASGSARTWAPAALTVPSWPEQPRRHYAEKRIKVEKPVVEMDGDEMTRIIWQFIKEKLILPHVDVQLKYFDLGLPNRDQTNDQVTIDSALAAQKYSMAVKCATITPDEARVEEFKLKKMWKSPNGTIRNILGGTVFREPSICKNIPRLVPGWTKPITIGRHAHGDQYKATDFVVDRAGTFKLVFTPKNGSSAKEWEVYNFPGGGVGMGMYNTDESISGFAHSCFQYSIQKKWPLYLSTKNTILKAYDGRFKDIFQEIFDKHYKTDFDRNKIWYEHRLIDDMVAQVLKSSGGFVWACKNYDGDVQSDILASRFGSLGLMTSVLVCPDGKTIEAEAAHGTVTRHYREHQKGRPTSTKGIASIFAWTRGLEHRGKLDGNQDLIRFAQTREKVCVQTVEGAMTKDLAGCIHGLSNVKLNEHFLNTTDFLDTIKSNLDRALGKQ

SEQ ID NO: 5805 - DNA, 1740 bp, Brachydanio rerio
  CDS (80)..(1429)
attcattcgacccttccttcgaccggagtgaagtcgggcagcaacctctagtgtttttggcgagagagagaaaaaaaacatggcaggttatttgaaggtcctaagttctctcagcaggtctgctgccactctatccaaaagccccgccgttcttgctccagcttgccagagtttgcaacagaggaactatgccgataaacgtatccaggtggcacagccggtggtggagatggatggagatgagatgaccaggatcatctgggagttcattaaagaaaagcttattctgaccaatgtgaatgtggatctgaagtactatgacctgggtcttccctatcgtgaccagactgatgatcaagtcacaatcgactccgctattgccactaagaaatacaacgttgctgtcaaatgcgccactattacacctgacgaagctagggtcgaagagttcaaactgaagaaaatgtggaagagtcctaatggaaccatcaggaacattctgggcggcactgtcttccgtgagccaatcatctgcaagaacattcccagacttgttcctggttggacacaggccatcaccattggcagacatgccttcggtgaccagtacaaggcaacagattttgttgtaaaccaaccaggcaaattcaaaatggtctttactccagccgatggaagcaaaaacaaggagtgggaggtgtatgatttccctggtggaggctgtggaatgggcatgtacaacactgatgagtctatcaccggcttcgctcacagctgcttccagtacgccatccagaagaaatggcctctctacatgagcaccaagaacaccatcctgaaggcttatgacggcagattcaaggacatcttccaggatatctttgagaaaaactacaagccagagtttgacaagctgaagatctggtatgaacacagactgattgatgacatggtggctcaggtgctgaagtcatccggtgcctttgtgtgggcctgcaagaactatgatggagatgtgcagtcggacattcttgctcagggtttcggttctctgggtttgatgacctcagttctggtgtgtcctgatggtaagaccattgaagccgaggcagcacacggcacagtaaccaggcattaccgtgagcaccagaagggaaggccaactagcactaaccccattgccagcatcttcgcatggactagaggactggaacaccgtggcaaacttgatggaaacccagacctgatcaagttctctcaaactcttgaacgtgtgtgcgtggagactgtggagagcggcgttatgaccaaggatctggccggctgcattcacggtctggccaactgcaagctgaatgagcattacgtcaacaccacagacttcctggatgccatcaagacaaacctggacaaggctctgggcaaatgaaggacaacaggcccggacaccgcggagcgcgtctgtctttttgtacctcatttttaacttaaaggtcatgaatacaacaatgtattaagggaggagtaataaaacaatagtgatgttcctagctgttctgttagctaatcctgctgatgggtcgctcccatctcttcccaaacctccaggggtctatttttgtaagatgaagtactgtatgtcagaaactgtataataccacaggagaaaaggaaagttcaagggccatgtgagaaaccctctaataaatcaccaagtcacctggaaaaaaaaaaaaaaaa

SEQ ID NO: 5806 - protein, 449 aa, Brachydanio rerio
MAGYLKVLSSLSRSAATLSKSPAVLAPACQSLQQRNYADKRIQVAQPVVEMDGDEMTRIIWEFIKEKLILTNVNVDLKYYDLGLPYRDQTDDQVTIDSAIATKKYNVAVKCATITPDEARVEEFKLKKMWKSPNGTIRNILGGTVFREPIICKNIPRLVPGWTQAITIGRHAFGDQYKATDFVVNQPGKFKMVFTPADGSKNKEWEVYDFPGGGCGMGMYNTDESITGFAHSCFQYAIQKKWPLYMSTKNTILKAYDGRFKDIFQDIFEKNYKPEFDKLKIWYEHRLIDDMVAQVLKSSGAFVWACKNYDGDVQSDILAQGFGSLGLMTSVLVCPDGKTIEAEAAHGTVTRHYREHQKGRPTSTNPIASIFAWTRGLEHRGKLDGNPDLIKFSQTLERVCVETVESGVMTKDLAGCIHGLANCKLNEHYVNTTDFLDAIKTNLDKALGK

SEQ ID NO: 5807 - DNA, 25 bp, artificial sequence
  primer
atgacaaagattaaggtagctaacc

SEQ ID NO: 5808 - DNA, 23 bp, artificial sequence
  primer
ttacaatgcagctgcctcgaact

SEQ ID NO: 5809 - DNA, 1518 bp, Saccharomyces cerevisiae; identical to SEQ ID NO: 2533
  CDS (1)..(1518)

SEQ ID NO: 5810 - protein, 505 aa, Saccharomyces cerevisiae; identical to SEQ ID NO: 2534

SEQ ID NO: 5811 - DNA, 1548 bp, Mus musculus (house mouse); identical to SEQ ID NO: 2535
  CDS (1)..(1548)

SEQ ID NO: 5812 - protein, 515 aa, Mus musculus (house mouse); identical to SEQ ID NO: 2536

SEQ ID NO: 5813 - DNA, 1593 bp, Fugu rubripes (Japanese pufferfish); identical to SEQ ID NO: 2537
  CDS (1)..(1593)

SEQ ID NO: 5814 - protein, 530 aa, Fugu rubripes (Japanese pufferfish); identical to SEQ ID NO: 2538

SEQ ID NO: 5815 - DNA, 1506 bp, Vibrio cholerae; identical to SEQ ID NO: 2539
  CDS (1)..(1506)

SEQ ID NO: 5816 - protein, 501 aa, Vibrio cholerae; identical to SEQ ID NO: 2540

SEQ ID NO: 5817 - DNA, 1470 bp, Pseudomonas aeruginosa; identical to SEQ ID NO: 2541
  CDS (1)..(1470)

SEQ ID NO: 5818 - protein, 489 aa, Pseudomonas aeruginosa; identical to SEQ ID NO: 2542

SEQ ID NO: 5819 - DNA, 1485 bp, Staphylococcus aureus; identical to SEQ ID NO: 2543
  CDS (1)..(1485)

SEQ ID NO: 5820 - protein, 494 aa, Staphylococcus aureus; identical to SEQ ID NO: 2544

SEQ ID NO: 5821 - DNA, 1488 bp, Streptococcus pneumoniae; identical to SEQ ID NO: 2545
  CDS (1)..(1488)

SEQ ID NO: 5822 - protein, 495 aa, Streptococcus pneumoniae; identical to SEQ ID NO: 2546

SEQ ID NO: 5823 - DNA, 1476 bp, Salmonella enterica subsp. enterica serovar Typhi; identical to SEQ ID NO: 2547
  CDS (1)..(1476)

SEQ ID NO: 5824 - protein, 491 aa, Salmonella enterica subsp. enterica serovar Typhi; identical to SEQ ID NO: 2548

SEQ ID NO: 5825 - DNA, 1476 bp, Agrobacterium tumefaciens; identical to SEQ ID NO: 2549
  CDS (1)..(1476)

SEQ ID NO: 5826 - protein, 491 aa, Agrobacterium tumefaciens; identical to SEQ ID NO: 2550

SEQ ID NO: 5827 - DNA, 1530 bp, Nostoc sp. PCC 7120; identical to SEQ ID NO: 2551
  CDS (1)..(1530)

SEQ ID NO: 5828 - protein, 509 aa, Nostoc sp. PCC 7120; identical to SEQ ID NO: 2552

SEQ ID NO: 5829 - DNA, 1386 bp, Agrobacterium tumefaciens; identical to SEQ ID NO: 2553
  CDS (1)..(1386)

SEQ ID NO: 5830 - protein, 461 aa, Agrobacterium tumefaciens; identical to SEQ ID NO: 2554

SEQ ID NO: 5831 - DNA, 1476 bp, Brucella melitensis; identical to SEQ ID NO: 2555
  CDS (1)..(1476)

SEQ ID NO: 5832 - protein, 491 aa, Brucella melitensis; identical to SEQ ID NO: 2556

SEQ ID NO: 5833 - DNA, 1458 bp, Zymomonas mobilis; identical to SEQ ID NO: 2557
  CDS (1)..(1458)

SEQ ID NO: 5834 - protein, 485 aa, Zymomonas mobilis; identical to SEQ ID NO: 2558

SEQ ID NO: 5835 - DNA, 1470 bp, Bacillus subtilis; identical to SEQ ID NO: 2559
  CDS (1)..(1470)

SEQ ID NO: 5836 - protein, 489 aa, Bacillus subtilis; identical to SEQ ID NO: 2560

SEQ ID NO: 5837 - DNA, 1401 bp, Mycobacterium tuberculosis; identical to SEQ ID NO: 2561
  CDS (1)..(1401)

SEQ ID NO: 5838 - protein, 466 aa, Mycobacterium tuberculosis; identical to SEQ ID NO: 2562

SEQ ID NO: 5839 - DNA, 1545 bp, Mycobacterium tuberculosis; identical to SEQ ID NO: 2563
  CDS (1)..(1545)

SEQ ID NO: 5840 - protein, 514 aa, Mycobacterium tuberculosis; identical to SEQ ID NO: 2564

SEQ ID NO: 5841 - DNA, 1320 bp, Chlamydia trachomatis; identical to SEQ ID NO: 2565
  CDS (1)..(1320)

SEQ ID NO: 5842 - protein, 439 aa, Chlamydia trachomatis; identical to SEQ ID NO: 2566

SEQ ID NO: 5843 - DNA, 1773 bp, Deinococcus radiodurans; identical to SEQ ID NO: 2567
  CDS (1)..(1773)

SEQ ID NO: 5844 - protein, 590 aa, Deinococcus radiodurans; identical to SEQ ID NO: 2568

SEQ ID NO: 5845 - DNA, 1467 bp, Pseudomonas aeruginosa; identical to SEQ ID NO: 2569
  CDS (1)..(1467)

SEQ ID NO: 5846 - protein, 488 aa, Pseudomonas aeruginosa; identical to SEQ ID NO: 2570

SEQ ID NO: 5847 - DNA, 1422 bp, Caulobacter crescentus; identical to SEQ ID NO: 2571
  CDS (1)..(1422)

SEQ ID NO: 5848 - protein, 473 aa, Caulobacter crescentus; identical to SEQ ID NO: 2572

SEQ ID NO: 5849 - DNA, 1437 bp, Borrelia burgdorferi (Lyme disease spirochete); identical to SEQ ID NO: 2573
  CDS (1)..(1437)

SEQ ID NO: 5850 - protein, 478 aa, Borrelia burgdorferi (Lyme disease spirochete); identical to SEQ ID NO: 2574

SEQ ID NO: 5851 - DNA, 1539 bp, Chlamydophila pneumoniae, Chlamydia pneumoniae; identical to SEQ ID NO: 2575
  CDS (1)..(1539)

SEQ ID NO: 5852 - protein, 512 aa, Chlamydophila pneumoniae, Chlamydia pneumoniae; identical to SEQ ID NO: 2576

SEQ ID NO: 5853 - DNA, 1476 bp, Escherichia coli; identical to SEQ ID NO: 2577
  CDS (1)..(1476)

SEQ ID NO: 5854 - protein, 491 aa, Escherichia coli; identical to SEQ ID NO: 2578

SEQ ID NO: 5855 - DNA, 1548 bp, Treponema pallidum subsp. pallidum (syphilis spirochete); identical to SEQ ID NO: 2579
  CDS (1)..(1548)

SEQ ID NO: 5856 - protein, 515 aa, Treponema pallidum subsp. pallidum (syphilis spirochete); identical to SEQ ID NO: 2580

SEQ ID NO: 5857 - DNA, 1476 bp, Buchnera sp; identical to SEQ ID NO: 2581
  CDS (1)..(1476)

SEQ ID NO: 5858 - protein, 491 aa, Buchnera sp; identical to SEQ ID NO: 2582

SEQ ID NO: 5859 - DNA, 1512 bp, Lactococcus lactis subsp. lactis; identical to SEQ ID NO: 2583
  CDS (1)..(1512)

SEQ ID NO: 5860 - protein, 503 aa, Lactococcus lactis subsp. lactis; identical to SEQ ID NO: 2584

SEQ ID NO: 5861 - DNA, 1572 bp, Drosophila melanogaster; identical to SEQ ID NO: 2585
  CDS (1)..(1572)

SEQ ID NO: 5862 - protein, 523 aa, Drosophila melanogaster; identical to SEQ ID NO: 2586

SEQ ID NO: 5863 - DNA, 1575 bp, Synechococcus sp; identical to SEQ ID NO: 2587
  CDS (1)..(1575)

SEQ ID NO: 5864 - protein, 524 aa, Synechococcus sp; identical to SEQ ID NO: 2588

SEQ ID NO: 5865 - DNA, 1485 bp, Haemophilus influenzae; identical to SEQ ID NO: 2589
  CDS (1)..(1485)

SEQ ID NO: 5866 - protein, 494 aa, Haemophilus influenzae; identical to SEQ ID NO: 2590

SEQ ID NO: 5867 - DNA, 1446 bp, Neisseria meningitidis; identical to SEQ ID NO: 2591
  CDS (1)..(1446)

SEQ ID NO: 5868 - protein, 481 aa, Neisseria meningitidis; identical to SEQ ID NO: 2592

SEQ ID NO: 5869 - DNA, 1278 bp, Helicobacter pylori; identical to SEQ ID NO: 2593
  CDS (1)..(1278)

SEQ ID NO: 5870 - protein, 425 aa, Helicobacter pylori; identical to SEQ ID NO: 2594

SEQ ID NO: 5871 - DNA, 1434 bp, Xylella fastidiosa; identical to SEQ ID NO: 2595
  CDS (1)..(1434)

SEQ ID NO: 5872 - protein, 477 aa, Xylella fastidiosa; identical to SEQ ID NO: 2596

SEQ ID NO: 5873 - DNA, 1296 bp, Aquifex aeolicus; identical to SEQ ID NO: 2597
  CDS (1)..(1296)

SEQ ID NO: 5874 - protein, 431 aa, Aquifex aeolicus; identical to SEQ ID NO: 2598

SEQ ID NO: 5875 - DNA, 1491 bp, Thermotoga maritima; identical to SEQ ID NO: 2599
  CDS (1)..(1491)

SEQ ID NO: 5876 - protein, 496 aa, Thermotoga maritima; identical to SEQ ID NO: 2600

SEQ ID NO: 5877 - DNA, 1494 bp, Kluyveromyces marxianus var. lactis, Candida sphaerica; identical to SEQ ID NO: 2601
  CDS (1)..(1494)

SEQ ID NO: 5878 - protein, 497 aa, Kluyveromyces marxianus var. lactis, Candida sphaerica; identical to SEQ ID NO: 2602

SEQ ID NO: 5879 - DNA, 2813 bp, Erwinia chrysanthemi; identical to SEQ ID NO: 2603
  CDS (322)..(1797)

SEQ ID NO: 5880 - protein, 491 aa, Erwinia chrysanthemi; identical to SEQ ID NO: 2604

SEQ ID NO: 5881 - DNA, 3244 bp, Plasmodium falciparum; identical to SEQ ID NO: 2605
  CDS (184)..(2916)

SEQ ID NO: 5882 - protein, 910 aa, Plasmodium falciparum; identical to SEQ ID NO: 2606

SEQ ID NO: 5883 - DNA, 1785 bp, Medicago sativa (alfalfa); identical to SEQ ID NO: 2607
  CDS (38)..(1585)

SEQ ID NO: 5884 - protein, 515 aa, Medicago sativa (alfalfa); identical to SEQ ID NO: 2608

SEQ ID NO: 5885 - DNA, 1689 bp, Solanum tuberosum (potato); identical to SEQ ID NO: 2609
  CDS (46)..(1581)

SEQ ID NO: 5886 - protein, 511 aa, Solanum tuberosum (potato); identical to SEQ ID NO: 2610

SEQ ID NO: 5887 - DNA, 1530 bp, Synechocystis sp; identical to SEQ ID NO: 2611
  CDS (1)..(1530)

SEQ ID NO: 5888 - protein, 509 aa, Synechocystis sp; identical to SEQ ID NO: 2612

SEQ ID NO: 5889 - DNA, 1953 bp, Nicotiana tabacum (common tobacco); identical to SEQ ID NO: 2613
  CDS (43)..(1824)

SEQ ID NO: 5890 - protein, 593 aa, Nicotiana tabacum (common tobacco); identical to SEQ ID NO: 2614

SEQ ID NO: 5891 - DNA, 1869 bp, Nicotiana tabacum (common tobacco); identical to SEQ ID NO: 2615
  CDS (22)..(1788)

SEQ ID NO: 5892 - protein, 588 aa, Nicotiana tabacum (common tobacco); identical to SEQ ID NO: 2616

SEQ ID NO: 5893 - DNA, 2058 bp, Solanum tuberosum (potato); identical to SEQ ID NO: 2617
  CDS (41)..(1774)

SEQ ID NO: 5894 - protein, 577 aa, Solanum tuberosum (potato); identical to SEQ ID NO: 2618

SEQ ID NO: 5895 - DNA, 2049 bp, Spinacia oleracea (spinach); identical to SEQ ID NO: 2619
  CDS (147)..(1871)

SEQ ID NO: 5896 - protein, 574 aa, Spinacia oleracea (spinach); identical to SEQ ID NO: 2620

SEQ ID NO: 5897 - DNA, 2359 bp, Petroselinum crispum (parsley); identical to SEQ ID NO: 2621
  CDS (172)..(1986)

SEQ ID NO: 5898 - protein, 604 aa, Petroselinum crispum (parsley); identical to SEQ ID NO: 2622

SEQ ID NO: 5899 - DNA, 1848 bp, Petroselinum crispum (parsley); identical to SEQ ID NO: 2623
  CDS (41)..(1528)

SEQ ID NO: 5900 - protein, 495 aa, Petroselinum crispum (parsley); identical to SEQ ID NO: 2624

SEQ ID NO: 5901 - DNA, 1957 bp, Petroselinum crispum (parsley); identical to SEQ ID NO: 2625
  CDS (74)..(1678)

SEQ ID NO: 5902 - protein, 534 aa, Petroselinum crispum (parsley); identical to SEQ ID NO: 2626

SEQ ID NO: 5903 - DNA, 1569 bp, Caenorhabditis elegans; identical to SEQ ID NO: 2627
  CDS (1)..(1569)

SEQ ID NO: 5904 - protein, 522 aa, Caenorhabditis elegans; identical to SEQ ID NO: 2628

SEQ ID NO: 5905 - DNA, 1779 bp, Streptomyces coelicolor; identical to SEQ ID NO: 2629
  CDS (1)..(1779)

SEQ ID NO: 5906 - protein, 592 aa, Streptomyces coelicolor; identical to SEQ ID NO: 2630

SEQ ID NO: 5907 - DNA, 1524 bp, Streptomyces coelicolor; identical to SEQ ID NO: 2631
  CDS (1)..(1524)

SEQ ID NO: 5908 - protein, 507 aa, Streptomyces coelicolor; identical to SEQ ID NO: 2632

SEQ ID NO: 5909 - DNA, 1422 bp, Schizosaccharomyces pombe; identical to SEQ ID NO: 2633
  CDS (1)..(1422)

SEQ ID NO: 5910 - protein, 473 aa, Schizosaccharomyces pombe; identical to SEQ ID NO: 2634

SEQ ID NO: 5911 - DNA, 1503 bp, Schizosaccharomyces pombe; identical to SEQ ID NO: 2635
  CDS (1)..(1503)

SEQ ID NO: 5912 - protein, 500 aa, Schizosaccharomyces pombe; identical to SEQ ID NO: 2636

SEQ ID NO: 5913 - DNA, 1428 bp, Schizosaccharomyces pombe; identical to SEQ ID NO: 2637
  CDS (1)..(1428)

SEQ ID NO: 5914 - protein, 475 aa, Schizosaccharomyces pombe; identical to SEQ ID NO: 2638

SEQ ID NO: 5915 - DNA, 1461 bp, Leuconostoc mesenteroides; identical to SEQ ID NO: 2639
  CDS (1)..(1461)

SEQ ID NO: 5916 - protein, 486 aa, Leuconostoc mesenteroides; identical to SEQ ID NO: 2640

SEQ ID NO: 5917 - DNA, 3038 bp, Corynebacterium glutamicum; identical to SEQ ID NO: 2641
  CDS (115)..(1659)

SEQ ID NO: 5918 - protein, 514 aa, Corynebacterium glutamicum; identical to SEQ ID NO: 2642

SEQ ID NO: 5919 - DNA, 1852 bp, Nicotiana tabacum; identical to SEQ ID NO: 2643
  CDS (102)..(1634)

SEQ ID NO: 5920 - protein, 510 aa, Nicotiana tabacum; identical to SEQ ID NO: 2644

SEQ ID NO: 5921 - DNA, 1821 bp, Nicotiana tabacum; identical to SEQ ID NO: 2645
  CDS (88)..(1623)

SEQ ID NO: 5922 - protein, 511 aa, Nicotiana tabacum; identical to SEQ ID NO: 2646

SEQ ID NO: 5923 - DNA, 1808 bp, Chlamydia trachomatis; identical to SEQ ID NO: 2647
  CDS (105)..(1643)

SEQ ID NO: 5924 - protein, 512 aa, Chlamydia trachomatis; identical to SEQ ID NO: 2648

SEQ ID NO: 5925 - DNA, 2750 bp, Plasmodium falciparum; identical to SEQ ID NO: 2649
  CDS (48)..(2258)

SEQ ID NO: 5926 - protein, 736 aa, Plasmodium falciparum; identical to SEQ ID NO: 2650

SEQ ID NO: 5927 - DNA, 1509 bp, Debaryomyces hansenii; identical to SEQ ID NO: 2651
  CDS (1)..(1509)

SEQ ID NO: 5928 - protein, 502 aa, Debaryomyces hansenii; identical to SEQ ID NO: 2652

SEQ ID NO: 5929 - DNA, 1503 bp, Candida glabrata; identical to SEQ ID NO: 2653
  CDS (1)..(1503)

SEQ ID NO: 5930 - protein, 500 aa, Candida glabrata; identical to SEQ ID NO: 2654

SEQ ID NO: 5931 - DNA, 1485 bp, Bacillus thuringiensis serovar konkukian str; identical to SEQ ID NO: 2655
  CDS (1)..(1485)

SEQ ID NO: 5932 - protein, 494 aa, Bacillus thuringiensis serovar konkukian str; identical to SEQ ID NO: 2656

SEQ ID NO: 5933 - DNA, 1554 bp, Oryza sativa; identical to SEQ ID NO: 2657
  CDS (1)..(1554)

SEQ ID NO: 5934 - protein, 517 aa, Oryza sativa; identical to SEQ ID NO: 2658

SEQ ID NO: 5935 - DNA, 1500 bp, Photobacterium profundum; identical to SEQ ID NO: 2659
  CDS (1)..(1500)

SEQ ID NO: 5936 - protein, 499 aa, Photobacterium profundum; identical to SEQ ID NO: 2660

SEQ ID NO: 5937 - DNA, 1551 bp, Parachlamydia sp; identical to SEQ ID NO: 2661
  CDS (1)..(1551)

SEQ ID NO: 5938 - protein, 516 aa, Parachlamydia sp; identical to SEQ ID NO: 2662

SEQ ID NO: 5939 - DNA, 1515 bp, Rhodopseudomonas palustris; identical to SEQ ID NO: 2663
  CDS (1)..(1515)

SEQ ID NO: 5940 - protein, 504 aa, Rhodopseudomonas palustris; identical to SEQ ID NO: 2664

SEQ ID NO: 5941 - DNA, 1650 bp, Corynebacterium diphtheriae; identical to SEQ ID NO: 2665
  CDS (1)..(1650)

SEQ ID NO: 5942 - protein, 549 aa, Corynebacterium diphtheriae; identical to SEQ ID NO: 2666

SEQ ID NO: 5943 - DNA, 1446 bp, uncultured bacterium 581; identical to SEQ ID NO: 2667
  CDS (1)..(1446)

SEQ ID NO: 5944 - protein, 481 aa, uncultured bacterium 581; identical to SEQ ID NO: 2668

SEQ ID NO: 5945 - DNA, 1602 bp, Nonomuraea sp; identical to SEQ ID NO: 2669
  CDS (1)..(1602)

SEQ ID NO: 5946 - protein, 533 aa, Nonomuraea sp; identical to SEQ ID NO: 2670

SEQ ID NO: 5947 - DNA, 1476 bp, Listeria monocytogenes; identical to SEQ ID NO: 2671
  CDS (1)..(1476)

SEQ ID NO: 5948 - protein, 491 aa, Listeria monocytogenes; identical to SEQ ID NO: 2672

SEQ ID NO: 5949 - DNA, 1485 bp, Bacillus cereus; identical to SEQ ID NO: 2673
  CDS (1)..(1485)

SEQ ID NO: 5950 - protein, 494 aa, Bacillus cereus; identical to SEQ ID NO: 2674

SEQ ID NO: 5951 - DNA, 1410 bp, Mycobacterium paratuberculosis; identical to SEQ ID NO: 2675
  CDS (1)..(1410)

SEQ ID NO: 5952 - protein, 469 aa, Mycobacterium paratuberculosis; identical to SEQ ID NO: 2676

SEQ ID NO: 5953 - DNA, 2454 bp, Mycobacterium paratuberculosis; identical to SEQ ID NO: 2677
  CDS (1)..(2454)

SEQ ID NO: 5954 - protein, 817 aa, Mycobacterium paratuberculosis; identical to SEQ ID NO: 2678

SEQ ID NO: 5955 - DNA, 1545 bp, Mycobacterium paratuberculosis; identical to SEQ ID NO: 2679
  CDS (1)..(1545)

SEQ ID NO: 5956 - protein, 514 aa, Mycobacterium paratuberculosis; identical to SEQ ID NO: 2680

SEQ ID NO: 5957 - DNA, 1449 bp, Lactobacillus johnsonii; identical to SEQ ID NO: 2681
  CDS (1)..(1449)

SEQ ID NO: 5958 - protein, 482 aa, Lactobacillus johnsonii; identical to SEQ ID NO: 2682

SEQ ID NO: 5959 - DNA, 1539 bp, Ashbya gossypii; identical to SEQ ID NO: 2683
  CDS (1)..(1539)

SEQ ID NO: 5960 - protein, 512 aa, Ashbya gossypii; identical to SEQ ID NO: 2684

SEQ ID NO: 5961 - DNA, 1734 bp, Oryza sativa; identical to SEQ ID NO: 2685
  CDS (1)..(1734)

SEQ ID NO: 5962 - protein, 577 aa, Oryza sativa; identical to SEQ ID NO: 2686

SEQ ID NO: 5963 - DNA, 1467 bp, Gluconobacter oxydans; identical to SEQ ID NO: 2687
  CDS (1)..(1467)

SEQ ID NO: 5964 - protein, 488 aa, Gluconobacter oxydans; identical to SEQ ID NO: 2688

SEQ ID NO: 5965 - DNA, 1581 bp, Vibrio vulnificus; identical to SEQ ID NO: 2689
  CDS (1)..(1581)

SEQ ID NO: 5966 - protein, 526 aa, Vibrio vulnificus; identical to SEQ ID NO: 2690

SEQ ID NO: 5967 - DNA, 1476 bp, Photorhabdus luminescens; identical to SEQ ID NO: 2691
  CDS (1)..(1476)

SEQ ID NO: 5968 - protein, 491 aa, Photorhabdus luminescens; identical to SEQ ID NO: 2692

SEQ ID NO: 5969 - DNA, 1539 bp, Gloeobacter violaceus; identical to SEQ ID NO: 2693
  CDS (1)..(1539)

SEQ ID NO: 5970 - protein, 512 aa, Gloeobacter violaceus; identical to SEQ ID NO: 2694

SEQ ID NO: 5971 - DNA, 1539 bp, Gloeobacter violaceus; identical to SEQ ID NO: 2695
  CDS (1)..(1539)

SEQ ID NO: 5972 - protein, 512 aa, Gloeobacter violaceus; identical to SEQ ID NO: 2696

SEQ ID NO: 5973 - DNA, 1479 bp, Chromobacterium violaceum; identical to SEQ ID NO: 2697
  CDS (1)..(1479)

SEQ ID NO: 5974 - protein, 492 aa, Chromobacterium violaceum; identical to SEQ ID NO: 2698

SEQ ID NO: 5975 - DNA, 2229 bp, Giardia lamblia ATCC 50803; identical to SEQ ID NO: 2699
  CDS (1)..(2229)

SEQ ID NO: 5976 - protein, 742 aa, Giardia lamblia ATCC 50803; identical to SEQ ID NO: 2700

SEQ ID NO: 5977 - DNA, 2850 bp, Plasmodium yoelii yoelii; identical to SEQ ID NO: 2701
  CDS (1)..(2850)

SEQ ID NO: 5978 - protein, 949 aa, Plasmodium yoelii yoelii; identical to SEQ ID NO: 2702

SEQ ID NO: 5979 - DNA, 1476 bp, Neurospora crassa; identical to SEQ ID NO: 2703
  CDS (1)..(1476)

SEQ ID NO: 5980 - protein, 491 aa, Neurospora crassa; identical to SEQ ID NO: 2704

SEQ ID NO: 5981 - DNA, 1524 bp, Synechococcus sp; identical to SEQ ID NO: 2705
  CDS (1)..(1524)

SEQ ID NO: 5982 - protein, 507 aa, Synechococcus sp; identical to SEQ ID NO: 2706

SEQ ID NO: 5983 - DNA, 1455 bp, Rhodopirellula baltica; identical to SEQ ID NO: 2707
  CDS (1)..(1455)

SEQ ID NO: 5984 - protein, 484 aa, Rhodopirellula baltica; identical to SEQ ID NO: 2708

SEQ ID NO: 5985 - DNA, 1524 bp, Prochlorococcus marinus subsp; identical to SEQ ID NO: 2709
  CDS (1)..(1524)

SEQ ID NO: 5986 - protein, 507 aa, Prochlorococcus marinus subsp; identical to SEQ ID NO: 2710

SEQ ID NO: 5987 - DNA, 1524 bp, Prochlorococcus marinus; identical to SEQ ID NO: 2711
  CDS (1)..(1524)

SEQ ID NO: 5988 - protein, 507 aa, Prochlorococcus marinus; identical to SEQ ID NO: 2712

SEQ ID NO: 5989 - DNA, 1521 bp, Prochlorococcus marinus; identical to SEQ ID NO: 2713
  CDS (1)..(1521)

SEQ ID NO: 5990 - protein, 506 aa, Prochlorococcus marinus; identical to SEQ ID NO: 2714

SEQ ID NO: 5991 - DNA, 1488 bp, Haemophilus ducreyi; identical to SEQ ID NO: 2715
  CDS (1)..(1488)

SEQ ID NO: 5992 - protein, 495 aa, Haemophilus ducreyi; identical to SEQ ID NO: 2716

SEQ ID NO: 5993 - DNA, 1497 bp, Candidatus Blochmannia floridanus; identical to SEQ ID NO: 2717
  CDS (1)..(1497)

SEQ ID NO: 5994 - protein, 498 aa, Candidatus Blochmannia floridanus; identical to SEQ ID NO: 2718

SEQ ID NO: 5995 - DNA, 1768 bp, Oryza sativa; identical to SEQ ID NO: 2719
  CDS (2)..(1768)

SEQ ID NO: 5996 - protein, 588 aa, Oryza sativa; identical to SEQ ID NO: 2720

SEQ ID NO: 5997 - DNA, 1548 bp, Bos indicus; identical to SEQ ID NO: 2721
  CDS (1)..(1548)

SEQ ID NO: 5998 - protein, 515 aa, Bos indicus; identical to SEQ ID NO: 2722

SEQ ID NO: 5999 - DNA, 1536 bp, Chlamydophila caviae; identical to SEQ ID NO: 2723
  CDS (1)..(1536)

SEQ ID NO: 6000 - protein, 511 aa, Chlamydophila caviae; identical to SEQ ID NO: 2724

SEQ ID NO: 6001 - DNA, 1524 bp, Streptomyces avermitilis; identical to SEQ ID NO: 2725
  CDS (1)..(1524)

SEQ ID NO: 6002 - protein, 507 aa, Streptomyces avermitilis; identical to SEQ ID NO: 2726

SEQ ID NO: 6003 - DNA, 1647 bp, Streptomyces avermitilis; identical to SEQ ID NO: 2727
  CDS (1)..(1647)

SEQ ID NO: 6004 - protein, 548 aa, Streptomyces avermitilis; identical to SEQ ID NO: 2728

SEQ ID NO: 6005 - DNA, 1491 bp, Nitrosomonas europaea; identical to SEQ ID NO: 2729
  CDS (1)..(1491)

SEQ ID NO: 6006 - protein, 496 aa, Nitrosomonas europaea; identical to SEQ ID NO: 2730

SEQ ID NO: 6007 - DNA, 1524 bp, Enterococcus faecalis; identical to SEQ ID NO: 2731
  CDS (1)..(1524)

SEQ ID NO: 6008 - protein, 507 aa, Enterococcus faecalis; identical to SEQ ID NO: 2732

SEQ ID NO: 6009 - DNA, 1464 bp, Tropheryma whipplei; identical to SEQ ID NO: 2733
  CDS (1)..(1464)

SEQ ID NO: 6010 - protein, 487 aa, Tropheryma whipplei; identical to SEQ ID NO: 2734

SEQ ID NO: 6011 - DNA, 2145 bp, Leishmania mexicana; identical to SEQ ID NO: 2735
  CDS (298)..(1986)

SEQ ID NO: 6012 - protein, 562 aa, Leishmania mexicana; identical to SEQ ID NO: 2736

SEQ ID NO: 6013 - DNA, 1494 bp, Dictyostelium discoideum; identical to SEQ ID NO: 2737
  CDS (1)..(1494)

SEQ ID NO: 6014 - protein, 497 aa, Dictyostelium discoideum; identical to SEQ ID NO: 2738

SEQ ID NO: 6015 - DNA, 1503 bp, Xylella fastidiosa; identical to SEQ ID NO: 2739
  CDS (1)..(1503)

SEQ ID NO: 6016 - protein, 500 aa, Xylella fastidiosa; identical to SEQ ID NO: 2740

SEQ ID NO: 6017 - DNA, 1506 bp, Vibrio parahaemolyticus; identical to SEQ ID NO: 2741
  CDS (1)..(1506)

SEQ ID NO: 6018 - protein, 501 aa, Vibrio parahaemolyticus; identical to SEQ ID NO: 2742

SEQ ID NO: 6019 - DNA, 1533 bp, Pseudomonas syringae; identical to SEQ ID NO: 2743
  CDS (1)..(1533)

SEQ ID NO: 6020 - protein, 510 aa, Pseudomonas syringae; identical to SEQ ID NO: 2744

SEQ ID NO: 6021 - DNA, 1470 bp, Pseudomonas syringae; identical to SEQ ID NO: 2745
  CDS (1)..(1470)

SEQ ID NO: 6022 - protein, 489 aa, Pseudomonas syringae; identical to SEQ ID NO: 2746

SEQ ID NO: 6023 - DNA, 1458 bp, Pseudomonas putida; identical to SEQ ID NO: 2747
  CDS (1)..(1458)

SEQ ID NO: 6024 - protein, 485 aa, Pseudomonas putida; identical to SEQ ID NO: 2748

SEQ ID NO: 6025 - DNA, 1506 bp, Pseudomonas putida; identical to SEQ ID NO: 2749
  CDS (1)..(1506)

SEQ ID NO: 6026 - protein, 501 aa, Pseudomonas putida; identical to SEQ ID NO: 2750

SEQ ID NO: 6027 - DNA, 1470 bp, Pseudomonas putida; identical to SEQ ID NO: 2751
  CDS (1)..(1470)

SEQ ID NO: 6028 - protein, 489 aa, Pseudomonas putida; identical to SEQ ID NO: 2752

SEQ ID NO: 6029 - DNA, 1485 bp, Lactobacillus plantarum; identical to SEQ ID NO: 2753
  CDS (1)..(1485)

SEQ ID NO: 6030 - protein, 494 aa, Lactobacillus plantarum; identical to SEQ ID NO: 2754

SEQ ID NO: 6031 - DNA, 1440 bp, Clostridium tetani; identical to SEQ ID NO: 2755
  CDS (1)..(1440)

SEQ ID NO: 6032 - protein, 479 aa, Clostridium tetani; identical to SEQ ID NO: 2756

SEQ ID NO: 6033 - DNA, 1512 bp, Bradyrhizobium japonicum; identical to SEQ ID NO: 2757
  CDS (1)..(1512)

SEQ ID NO: 6034 - protein, 503 aa, Bradyrhizobium japonicum; identical to SEQ ID NO: 2758

SEQ ID NO: 6035 - DNA, 1497 bp, Bacteroides thetaiotaomicron; identical to SEQ ID NO: 2759
  CDS (1)..(1497)

SEQ ID NO: 6036 - protein, 498 aa, Bacteroides thetaiotaomicron; identical to SEQ ID NO: 2760

SEQ ID NO: 6037 - DNA, 4583 bp, Mus musculus; identical to SEQ ID NO: 2761
  CDS (119)..(2488)

SEQ ID NO: 6038 - protein, 789 aa, Mus musculus; identical to SEQ ID NO: 2762

SEQ ID NO: 6039 - DNA, 1485 bp, Staphylococcus epidermidis; identical to SEQ ID NO: 2763
  CDS (1)..(1485)

SEQ ID NO: 6040 - protein, 494 aa, Staphylococcus epidermidis; identical to SEQ ID NO: 2764

SEQ ID NO: 6041 - DNA, 1590 bp, Yersinia pestis; identical to SEQ ID NO: 2765
  CDS (1)..(1590)

SEQ ID NO: 6042 - protein, 529 aa, Yersinia pestis; identical to SEQ ID NO: 2766

SEQ ID NO: 6043 - DNA, 1530 bp, Synechococcus elongatus; identical to SEQ ID NO: 2767
  CDS (1)..(1530)

SEQ ID NO: 6044 - protein, 509 aa, Synechococcus elongatus; identical to SEQ ID NO: 2768

SEQ ID NO: 6045 - DNA, 1473 bp, Shewanella oneidensis; identical to SEQ ID NO: 2769
  CDS (1)..(1473)

SEQ ID NO: 6046 - protein, 490 aa, Shewanella oneidensis; identical to SEQ ID NO: 2770

SEQ ID NO: 6047 - DNA, 1476 bp, Oceanobacillus iheyensis; identical to SEQ ID NO: 2771
  CDS (1)..(1476)

SEQ ID NO: 6048 - protein, 491 aa, Oceanobacillus iheyensis; identical to SEQ ID NO: 2772

SEQ ID NO: 6049 - DNA, 1344 bp, Corynebacterium efficiens; identical to SEQ ID NO: 2773
  CDS (1)..(1344)

SEQ ID NO: 6050 - protein, 447 aa, Corynebacterium efficiens; identical to SEQ ID NO: 2774

SEQ ID NO: 6051 - DNA, 1545 bp, Corynebacterium efficiens; identical to SEQ ID NO: 2775
  CDS (1)..(1545)

SEQ ID NO: 6052 - protein, 514 aa, Corynebacterium efficiens; identical to SEQ ID NO: 2776

SEQ ID NO: 6053 - DNA, 1668 bp, Bifidobacterium longum; identical to SEQ ID NO: 2777
  CDS (1)..(1668)

SEQ ID NO: 6054 - protein, 555 aa, Bifidobacterium longum; identical to SEQ ID NO: 2778

SEQ ID NO: 6055 - DNA, 1284 bp, Rhodococcus opacus; identical to SEQ ID NO: 2779
  CDS (1)..(1284)

SEQ ID NO: 6056 - protein, 427 aa, Rhodococcus opacus; identical to SEQ ID NO: 2780

SEQ ID NO: 6057 - DNA, 2879 bp, Leishmania guyanensis; identical to SEQ ID NO: 2781
  CDS (205)..(1893): n means a or g or c or t/u, s means g or c

SEQ ID NO: 6058 - protein, 562 aa, Leishmania guyanensis; identical to SEQ ID NO: 2782

SEQ ID NO: 6059 - DNA, 1689 bp, Leishmania mexicana; identical to SEQ ID NO: 2783
  CDS (1)..(1689): n means a or g or c or t/u, s means g or c

SEQ ID NO: 6060 - protein, 562 aa, Leishmania mexicana; identical to SEQ ID NO: 2784
  Xaa in position 76-148 is unknown

SEQ ID NO: 6061 - DNA, 2916 bp, Leishmania amazonensis; identical to SEQ ID NO: 2785
  CDS (207)..(1895): n means a or g or c or t/u, y means t/u or c

SEQ ID NO: 6062 - protein, 562 aa, Leishmania amazonensis; identical to SEQ ID NO: 2786
  Xaa in position 463 and 481 is unknown

SEQ ID NO: 6063 - DNA, 1440 bp, Chlorobium tepidum; identical to SEQ ID NO: 2787
  CDS (1)..(1440)

SEQ ID NO: 6064 - protein, 479 aa, Chlorobium tepidum; identical to SEQ ID NO: 2788

SEQ ID NO: 6065 - DNA, 2187 bp, Methylobacterium extorquens; identical to SEQ ID NO: 2789
  CDS (640)..(2187)

SEQ ID NO: 6066 - protein, 515 aa, Methylobacterium extorquens; identical to SEQ ID NO: 2790

SEQ ID NO: 6067 - DNA, 1476 bp, Bartonella henselae; identical to SEQ ID NO: 2791
  CDS (1)..(1476)

SEQ ID NO: 6068 - protein, 491 aa, Bartonella henselae; identical to SEQ ID NO: 2792

SEQ ID NO: 6069 - DNA, 2266 bp, Toxoplasma gondii; identical to SEQ ID NO: 2793
  CDS (169)..(1851)

SEQ ID NO: 6070 - protein, 560 aa, Toxoplasma gondii; identical to SEQ ID NO: 2794

SEQ ID NO: 6071 - DNA, 1923 bp, Xanthomonas campestris; identical to SEQ ID NO: 2795
  CDS (1)..(1923)

SEQ ID NO: 6072 - protein, 640 aa, Xanthomonas campestris; identical to SEQ ID NO: 2796

SEQ ID NO: 6073 - DNA, 1431 bp, Xanthomonas campestris; identical to SEQ ID NO: 2797
  CDS (1)..(1431)

SEQ ID NO: 6074 - protein, 476 aa, Xanthomonas campestris; identical to SEQ ID NO: 2798

SEQ ID NO: 6075 - DNA, 1839 bp, Xanthomonas axonopodis; identical to SEQ ID NO: 2799
  CDS (1)..(1839)

SEQ ID NO: 6076 - protein, 612 aa, Xanthomonas axonopodis; identical to SEQ ID NO: 2800

SEQ ID NO: 6077 - DNA, 1431 bp, Xanthomonas axonopodis; identical to SEQ ID NO: 2801
  CDS (1)..(1431)

SEQ ID NO: 6078 - protein, 476 aa, Xanthomonas axonopodis; identical to SEQ ID NO: 2802

SEQ ID NO: 6079 - DNA, 1458 bp, Thermoanaerobacter tengcongensis; identical to SEQ ID NO: 2803
  CDS (1)..(1458)

SEQ ID NO: 6080 - protein, 485 aa, Thermoanaerobacter tengcongensis; identical to SEQ ID NO: 2804

SEQ ID NO: 6081 - DNA, 1762 bp, Oryza sativa; identical to SEQ ID NO: 2805
  CDS (41)..(1558)

SEQ ID NO: 6082 - protein, 505 aa, Oryza sativa; identical to SEQ ID NO: 2806

SEQ ID NO: 6083 - DNA, 1305 bp, Encephalitozoon cuniculi; identical to SEQ ID NO: 2807
  CDS (1)..(1305)

SEQ ID NO: 6084 - protein, 434 aa, Encephalitozoon cuniculi; identical to SEQ ID NO: 2808

SEQ ID NO: 6085 - DNA, 2125 bp, Drosophila melanogaster; identical to SEQ ID NO: 2809
  CDS (158)..(1738)

SEQ ID NO: 6086 - protein, 526 aa, Drosophila melanogaster; identical to SEQ ID NO: 2810

SEQ ID NO: 6087 - DNA, 1470 bp, Ralstonia solanacearum; identical to SEQ ID NO: 2811
  CDS (1)..(1470)

SEQ ID NO: 6088 - protein, 489 aa, Ralstonia solanacearum; identical to SEQ ID NO: 2812

SEQ ID NO: 6089 - DNA, 1521 bp, Enterococcus mundtii; identical to SEQ ID NO: 2813
  CDS (1)..(1521)

SEQ ID NO: 6090 - protein, 506 aa, Enterococcus mundtii; identical to SEQ ID NO: 2814

SEQ ID NO: 6091 - DNA, 2230 bp, Homo sapiens; identical to SEQ ID NO: 2815
  CDS (54)..(1601)

SEQ ID NO: 6092 - protein, 515 aa, Homo sapiens [sequence omitted]

SEQ ID NO: 6093 - DNA, 1470 bp, Rhizobium loti; identical to SEQ ID NO: 2817
  CDS (1)..(1470)

SEQ ID NO: 6094 - protein, 489 aa, Rhizobium loti; identical to SEQ ID NO: 2818

SEQ ID NO: 6095 - DNA, 1428 bp, Rhizobium loti; identical to SEQ ID NO: 2819
  CDS (1)..(1428)

SEQ ID NO: 6096 - protein, 475 aa, Rhizobium loti; identical to SEQ ID NO: 2820

SEQ ID NO: 6097 - DNA, 3584 bp, Plasmodium berghei; identical to SEQ ID NO: 2821
  CDS (370)..(3222)

SEQ ID NO: 6098 - protein, 950 aa, Plasmodium berghei; identical to SEQ ID NO: 2822

SEQ ID NO: 6099 - DNA, 1491 bp, Pasteurella multocida; identical to SEQ ID NO: 2823
  CDS (1)..(1491)

SEQ ID NO: 6100 - protein, 496 aa, Pasteurella multocida; identical to SEQ ID NO: 2824

SEQ ID NO: 6101 - DNA, 1470 bp, Pseudomonas putida; identical to SEQ ID NO: 2825
  CDS (1)..(1470)

SEQ ID NO: 6102 - protein, 489 aa, Pseudomonas putida; identical to SEQ ID NO: 2826

SEQ ID NO: 6103 - DNA, 1566 bp, Trypanosoma brucei; identical to SEQ ID NO: 2827
  CDS (1)..(1566)

SEQ ID NO: 6104 - protein, 521 aa, Trypanosoma brucei; identical to SEQ ID NO: 2828

SEQ ID NO: 6105 - DNA, 1904 bp, Triticum aestivum; identical to SEQ ID NO: 2829
  CDS (153)..(1682)

SEQ ID NO: 6106 - protein, 509 aa, Triticum aestivum; identical to SEQ ID NO: 2830

SEQ ID NO: 6107 - DNA, 2098 bp, Solanum tuberosum; identical to SEQ ID NO: 2831
  CDS (27)..(1775)

SEQ ID NO: 6108 - protein, 582 aa, Solanum tuberosum; identical to SEQ ID NO: 2832

SEQ ID NO: 6109 - DNA, 1924 bp, Dunaliella bioculata; identical to SEQ ID NO: 2833
  CDS (68)..(1840)

SEQ ID NO: 6110 - protein, 590 aa, Dunaliella bioculata; identical to SEQ ID NO: 2834

SEQ ID NO: 6111 - DNA, 1976 bp, Cyanidium caldarium; identical to SEQ ID NO: 2835
  CDS (46)..(1848)

SEQ ID NO: 6112 - protein, 600 aa, Cyanidium caldarium; identical to SEQ ID NO: 2836

SEQ ID NO: 6113 - DNA, 2106 bp, Drosophila melanogaster; identical to SEQ ID NO: 2837
  CDS (28)..(1746)

SEQ ID NO: 6114 - protein, 572 aa, Drosophila melanogaster; identical to SEQ ID NO: 2838

SEQ ID NO: 6115 - DNA, 1777 bp, Mesembryanthemum crystallinum; identical to SEQ ID NO: 2839
  CDS (39)..(1589)

SEQ ID NO: 6116 - protein, 516 aa, Mesembryanthemum crystallinum; identical to SEQ ID NO: 2840

SEQ ID NO: 6117 - DNA, 1542 bp, Mus musculus; identical to SEQ ID NO: 2841
  CDS (1)..(1542)

SEQ ID NO: 6118 - protein, 513 aa, Mus musculus; identical to SEQ ID NO: 2842

SEQ ID NO: 6119 - DNA, 1485 bp, Actinobacillus actinomycetemcomitans; identical to SEQ ID NO: 2843
  CDS (1)..(1485)

SEQ ID NO: 6120 - protein, 494 aa, Actinobacillus actinomycetemcomitans; identical to SEQ ID NO: 2844

SEQ ID NO: 6121 - DNA, 1473 bp, Buchnera aphidicola; identical to SEQ ID NO: 2845
  CDS (1)..(1473)

SEQ ID NO: 6122 - protein, 490 aa, Buchnera aphidicola; identical to SEQ ID NO: 2846

SEQ ID NO: 6123 - DNA, 1473 bp, Buchnera aphidicola; identical to SEQ ID NO: 2847
  CDS (1)..(1473)

SEQ ID NO: 6124 - protein, 490 aa, Buchnera aphidicola; identical to SEQ ID NO: 2848

SEQ ID NO: 6125 - DNA, 2049 bp, Ceratitis capitata; identical to SEQ ID NO: 2849
  CDS (60)..(1640)

SEQ ID NO: 6126 - protein, 526 aa, Ceratitis capitata; identical to SEQ ID NO: 2850

SEQ ID NO: 6127 - DNA, 1524 bp, Chlamydia muridarum; identical to SEQ ID NO: 2851
  CDS (1)..(1524)

SEQ ID NO: 6128 - protein, 507 aa, Chlamydia muridarum; identical to SEQ ID NO: 2852

SEQ ID NO: 6129 - DNA, 2062 bp, Drosophila melanogaster; identical to SEQ ID NO: 2853
  CDS (303)..(1877)

SEQ ID NO: 6130 - protein, 524 aa, Drosophila melanogaster; identical to SEQ ID NO: 2854

SEQ ID NO: 6131 - DNA, 1536 bp, Emericella nidulans; identical to SEQ ID NO: 2855
  CDS (1)..(1536)

SEQ ID NO: 6132 - protein, 511 aa, Emericella nidulans; identical to SEQ ID NO: 2856

SEQ ID NO: 6133 - DNA, 1957 bp, Leuconostoc mesenteroides; identical to SEQ ID NO: 2857
  CDS (206)..(1666)

SEQ ID NO: 6134 - protein, 486 aa, Leuconostoc mesenteroides; identical to SEQ ID NO: 2858

SEQ ID NO: 6135 - DNA, 2055 bp, Macropus robustus; identical to SEQ ID NO: 2859
  CDS (94)..(1641)

SEQ ID NO: 6136 - protein, 515 aa, Macropus robustus; identical to SEQ ID NO: 2860

SEQ ID NO: 6137 - DNA, 1530 bp, Nostoc punctiforme; identical to SEQ ID NO: 2861
  CDS (1)..(1530)

SEQ ID NO: 6138 - protein, 509 aa, Nostoc punctiforme; identical to SEQ ID NO: 2862

SEQ ID NO: 6139 - DNA, 1476 bp, Rhizobium meliloti; identical to SEQ ID NO: 2863
  CDS (1)..(1476)

SEQ ID NO: 6140 - protein, 491 aa, Rhizobium meliloti; identical to SEQ ID NO: 2864

SEQ ID NO: 6141 - DNA, 2853 bp, Homo sapiens; identical to SEQ ID NO: 2865
  CDS (273)..(2648)

SEQ ID NO: 6142 - protein, 791 aa, Homo sapiens; identical to SEQ ID NO: 2866

SEQ ID NO: 6143 - DNA, 1970 bp, Arabidopsis thaliana; identical to SEQ ID NO: 2867
  CDS (60)..(1790)

SEQ ID NO: 6144 - protein, 576 aa, Arabidopsis thaliana; identical to SEQ ID NO: 2868

SEQ ID NO: 6145 - DNA, 2112 bp, Arabidopsis thaliana; identical to SEQ ID NO: 2869
  CDS (142)..(1932)

SEQ ID NO: 6146 - protein, 596 aa, Arabidopsis thaliana; identical to SEQ ID NO: 2870

SEQ ID NO: 6147 - DNA, 2161 bp, Arabidopsis thaliana; identical to SEQ ID NO: 2871
  CDS (90)..(1967)

SEQ ID NO: 6148 - protein, 625 aa, Arabidopsis thaliana; identical to SEQ ID NO: 2872

SEQ ID NO: 6149 - DNA, 1936 bp, Arabidopsis thaliana; identical to SEQ ID NO: 2873
  CDS (136)..(1686)

SEQ ID NO: 6150 - protein, 516 aa, Arabidopsis thaliana; identical to SEQ ID NO: 2874

SEQ ID NO: 6151 - DNA, 1959 bp, Arabidopsis thaliana; identical to SEQ ID NO: 2875
  CDS (194)..(1741)

SEQ ID NO: 6152 - protein, 515 aa, Arabidopsis thaliana [sequence omitted]

SEQ ID NO: 6153 - DNA, 1503 bp, Xenopus laevis; identical to SEQ ID NO: 2877
  CDS (1)..(1503)

SEQ ID NO: 6154 - protein, 500 aa, Xenopus laevis; identical to SEQ ID NO: 2878

SEQ ID NO: 6155 - DNA, 2004 bp, Arabidopsis thaliana; identical to SEQ ID NO: 2879
  CDS (51)..(1850)

SEQ ID NO: 6156 - protein, 599 aa, Arabidopsis thaliana; identical to SEQ ID NO: 2880

SEQ ID NO: 6157 - DNA, 23 bp, artificial sequence
  primer
atgagtgaaggccccgtcaaatt

SEQ ID NO: 6158 - DNA, 25 bp, artificial sequence
  primer
ctaattatccttcgtatcttctggc

SEQ ID NO: 6159 - protein, 65 aa, consensus
  MISC_FEATURE (1)..(65): consensus for the disclosure of Xaa see table VIII
XHXXXTXXXXXXXXXXXXXXXXXXXXXXXXXXXXXXXXXXXXXXXXXXXXXXXXXXXXXXXXXXG

SEQ ID NO: 6160 - protein, 15 aa, consensus
  MISC_FEATURE (1)..(15): consensus for the disclosure of Xaa see table VIII
XSSXMXXKXNXXXXX

SEQ ID NO: 6161 - protein, 396 aa, consensus
  MISC_FEATURE (1)..(396): Xaa in all positions is any amino acid
RYXXXXXXXXXXXXXXXXXXXXXXXXXXXEXXXXXXXXXXXXXXXXXXXXXXXXXXXXXXXXXXXXXXXXXXXXXXXXXXXXXXXXXXEXXXXXXXXXXXHDXXAXXXXXXXXXXXXXXXXXXXXXXXXXXXHXXXTSXDXXXXXXXXXXXXXXXXXXXXXXXXXXXXXXXXAXXXXXXXXXXRXHXXXAXPXTXGXXXAXXXXXXXXXXXXXXXXXXXXXXXXXXXGXXGXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXGSSXMPHKXNPXXXEXXXXXXXXXXXXXXXXXXXXXXXXXXXXXXXSXXXXXXXXXXXXXXXXXXXXXXXXXXXL

SEQ ID NO: 6162 - protein, 55 aa, consensus
  MISC_FEATURE (1)..(55): consensus for the disclosure of Xaa see table VIII
XXXXXXXXXXXXXXXXXXXXXXXXXXSPEXXXXXXXXXXXXXXXXXXXXXPXXGX

SEQ ID NO: 6163 - protein, 49 aa, consensus
  MISC_FEATURE (1)..(49): consensus for the disclosure of Xaa see table VIII
KXXXEXXXXXDXXRXXXXXXXXXXXXXXXXXXXXXXXXXXXXXXXXXXX

SEQ ID NO: 6164 - protein, 52 aa, consensus
  MISC_FEATURE (1)..(52): consensus for the disclosure of Xaa see table VIII
XXXXGXPKXXXXXXXXXXXXXXRXXXXGXXXXXXXXXXXXXXXXXXXXXXRX

SEQ ID NO: 6165 - protein, 20 aa, consensus
  MISC_FEATURE (1)..(20): consensus for the disclosure of Xaa see table VIII
XXXXXXXSXXXXEXXEXXXK

SEQ ID NO: 6166 - protein, 58 aa, consensus
  MISC_FEATURE (1)..(58): consensus for the disclosure of Xaa see table VIII
XXXXXXXXXXGKXXXXXXXXXXXXXXXXXXXXXXXXXXXXXXXXXXXXXXXXXXXDXX

SEQ ID NO: 6167 - protein, 74 aa, consensus
  MISC_FEATURE (1)..(74): consensus for the disclosure of Xaa see table VIII
XXXXXXXXXXXXXXXXXXXXXXPXYXXXXXXXXXXXXXXXXXXXXXXXXXXGXXXXXXXXXXXXXXXXXXXXXX

SEQ ID NO: 6168 - protein, 44 aa, consensus
  MISC_FEATURE (1)..(44): consensus for the disclosure of Xaa see table VIII
XXXRDXXXXXXXXXXXXXXXXXXXXXXXXXXXXXXXXXXXAXXX

SEQ ID NO: 6169 - protein, 229 aa, consensus
  MISC_FEATURE (1)..(229): consensus for the disclosure of Xaa see table VIII
XXXXXXXXXXDSRXXPTXXXXXXXXXXXXXXXXXPSGXSTGXXEAXEXRDXXXXXXXXXXXGXXXXXXXXXXXXXXXXXXXXXXXXXXXQXXXDXXXXXXXXDXXXXXXXXXXXXXGXNXXLXVSXAXXXXXXXXXXXXLXXXXXXXXXXXXXXXXXXPXPXXNXXNGGXHXXXXXXXXXEXXXXPXXXXXXXXXXXXXXXXXXXLXXXXXXXXXXXXXXXGXXGGXAP

SEQ ID NO: 6170 - protein, 134 aa, consensus
  MISC_FEATURE (1)..(134): consensus for the disclosure of Xaa see table VIII
XPXXXXXEDXXXXXDXXXXXXXXXXXXXXXXXXXDDXXXTNXXXXXXXXXXXXXXXXLXKXNQIXXXXEXXXXXXXXXXXXXXXXXXHRSXEXXDXXIXXXXVXXXXXXXKXGXXXRXXRXXKXNXXXXIEXXX

SEQ ID NO: 6171 - protein, 598 aa, consensus
  MISC_FEATURE (1)..(598): Xaa in all Positions is any amino acid
XXXXXXXXXXXXXXXXXXXXXXXXXXXXXXXXXXXXXXXXXXXXXXXXXXXXXXXXXXXXXXXXXXXXXIXXXXARXXXDSRGNPTVEXXXXXXXGXXXXAXVPSGASTGXXEAXELRDXXXXXXXXXXXGKGVXXAVXXVNXXIXXXXXXXXXXXXXQXXXDXXXXXXXLDGTXNKXXXXXXXLGANAILXVSXAXXXAXAXXXXXPLYXXXXXXXXXXXXXXXXXPXPXXNXXNGGXHAXXXXXXXQEFMIXPXGAXXXXEAXXXGXEXXHXLKXXXXXXXGXXXXXVGDEGGFAPXXXXXXXXXXXXXXXXXXXXXXXXXXXXXAIXXAGYXXXXXXXXXXXXXXXXXXXXDXAXSEFXXXXXXXXXXYXXXXXXXXXXXXXXXXXXXXXXXXXXXXXXXXXXXXXXXXXYPXXXXIXSIEDXXXXXDWXXXXXXTXXXXXXXQXVGDDLXVTNXXXXXXXIXXXXXNXXLXKXNQIGXXTEXXXAXXXXXXXXXXXXXSHRSGETEDXXIADXXVXXXXGQIKTGXXXRXXRXAKYNQLXRIEXXLGXXXXXXXXXXXXXXXXXGXXXXXXXXXXXXXXXXXXXXXXXXXXXXX

SEQ ID NO: 6172 - protein, 48 aa, consensus
  MISC_FEATURE (1)..(48): consensus for the disclosure of Xaa see table VIII
XXXXGXGPXXXXXXXXXXXXGXXXXXXXXXXXXXXXGGXXXXXXXXXX

SEQ ID NO: 6173 - protein, 19 aa, consensus
  MISC_FEATURE (1)..(19): consensus for the disclosure of Xaa see table VIII
XXXXGXGXXXXDXXXXXXX

SEQ ID NO: 6174 - protein, 28 aa, consensus
  MISC_FEATURE (1)..(28): consensus for the disclosure of Xaa see table VIII
XXXXXXXXXXXXXXXXXXXXXXXXXXXX

SEQ ID NO: 6175 - protein, 313 aa, consensus
  MISC_FEATURE (1)..(313): Xaa in all positions is any amino acid
CPXXXXIPXXXXXXXXXXXXXXXXXXXAXXXXXXXNXXPXXXGRXCPXXXXXXXXXXXXXXXXXXXXXXXXXXXIXXXXXXXXXXXXXXXXXXXXXXXXXXXXXXXXXXXXXXXXXXXXXXXXXXXXAXXGXGPAGLXXAXXLXXXGXXXXXXXXXXXXXXGGXXXXGIPXXXXXXXXXXXXXXXXXXXXGXXXXXXXXXGXXXXXXXXXXXXXXXXXXXXXXXXXXAXXXXXGXXXXXXXXXXXXXXXXXXXXXXAXXXLXXXXXXXXXXXXXXXXXXXXXXXXXXXXXXXXXVXVXGGGXTXXDXXXXXXR

SEQ ID NO: 6176 - protein, 56 aa, consensus
  MISC_FEATURE (1)..(56): consensus for the disclosure of Xaa see table VIII
XXXXXXXXXXVSXXXXXXXXXXXXXXXXXXXXXXXXXXXXXXXXXXNGXDXXXXXX

SEQ ID NO: 6177 - protein, 65 aa, consensus
  MISC_FEATURE (1)..(65): consensus for the disclosure of Xaa see table VIII
XXXXXXXXXXXXXXXXXXXXXXXXXXXXRXXXXQKGXXXXXXXXXXXXXXXXXXXXXXXXXXGXX

SEQ ID NO: 6178 - protein, 51 aa, consensus
  MISC_FEATURE (1)..(51): consensus for the disclosure of Xaa see table VIII
XXXXXXXXXXXXXDXXXXXSXXEXXGXXXXXXXXXXXXXXXXXXGGXXXXX

SEQ ID NO: 6179 - protein, 70 aa, consensus
  MISC_FEATURE (1)..(70): consensus for the disclosure of Xaa see table VIII
XXYTXIDXXXYXXXXXXXXXXGXXXYXXXXGXTGXXVYPXXXXXXXXXXXXXXXXXXXXXXXQXXXXXXX

SEQ ID NO: 6180 - protein, 15 aa, consensus
  MISC_FEATURE (1)..(15): consensus for the disclosure of Xaa see table VIII
XXRXXSXXXLRXFND

SEQ ID NO: 6181 - protein, 16 aa, consensus
  MISC_FEATURE (1)..(16): consensus for the disclosure of Xaa see table VIII
XXXXXXKMXXXLXXPX

SEQ ID NO: 6182 - protein, 63 aa, consensus
  MISC_FEATURE (1)..(63): consensus for the disclosure of Xaa see table VIII
QXXXXXXFXXXXXXXXXXXXXXXXYXXXXFXXXRXFXXXWXXNXXXXXXXXXXXXXXFXXXXF

SEQ ID NO: 6183 - protein, 26 aa, consensus
  MISC_FEATURE (1)..(26): consensus for the disclosure of Xaa see table VIII
NXXGXXXXXSLHYQFXXXXXXXXPXX

SEQ ID NO: 6184 - protein, 640 aa, consensus
  MISC_FEATURE (1)..(640): Xaa in all positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXVXYTEIDXXAYMXXXXXXXXXGXXXYXXXXGXTGPLVYPAXXXXXXXXLXXXTXXXXXXXXXQXXFXXXYXXXXXXXXXXYXXXXXXXXPXXXXXXXXXSXRXHSIXVLRLFNDXXXXXXXXXXXXXXXXXXXXXXXXXXXXXXXXXXXXXXXXSXAXXXKMNXLLXXPXXXXXXXXXXXXXXXXXXXXXXXXXXXQXXXXXXFLXXXXXXXXXXXXXXXYXXXXFXXXRXFXXXWXVNXXFXXXXXXXXXXXFXXXXFXXXLLXXHXXXLXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXIGXXXXRSLHYQFXXWYXXXXPXLXXXXXXXXXXXXXXXXXXXXXXXXXXXXXXXXXXXXXXXXXXXXXXXXXEXXWNXXPXXXXXSXXLXXXXXXXXXXXXXXXXXXXXXXXXXXXXXXXXXXXXXXXXXXXXXXXXXXXXXX

SEQ ID NO: 6185 - protein, 37 aa, consensus
  MISC_FEATURE (1)..(37): consensus for the disclosure of Xaa see table VIII
XXXXXXXXXXXXXXXXXXXXXXXXXXXXXGXXXXXXX

SEQ ID NO: 6186 - protein, 42 aa, consensus
  MISC_FEATURE (1)..(42): consensus for the disclosure of Xaa see table VIII
XXXXXXXXXXHDXXHXXXXXXXXXXXEXXXXXXXXXXXXXXX

SEQ ID NO: 6187 - protein, 197 aa, consensus
  MISC_FEATURE (1)..(197): Xaa in all positions is any amino acid
PXXXXXXXXXXXXXXXXXXXXXXXXXXXXXXXXGXXXLXXXPXXXXXXXXXXXLXXXPXXXXGXXYXXXXXXXXXXXXXRXXXXXXXXXXXXYXXXRXRXXHDXXHXXXXXXXXXXGEXXXKXXEXXXXXXPXXXXXXXXXXXXXXXXXXXXXXXXXXPXXXXXXXXXXXXXXXXXXXXXXXXXXEXXXXXXXXXXR

SEQ ID NO: 6188 - protein, 65 aa, consensus; identical to SEQ ID NO: 1307
  MISC_FEATURE (1)..(65): consensus for the disclosure of Xaa see table VIII

SEQ ID NO: 6189 - protein, 43 aa, consensus; identical to SEQ ID NO: 1308
  MISC_FEATURE (1)..(43): consensus for the disclosure of Xaa see table VIII

SEQ ID NO: 6190 - protein, 14 aa, consensus
  MISC_FEATURE (1)..(14): consensus for the disclosure of Xaa see table VIII
XXXXSGXTGXXKXX

SEQ ID NO: 6191 - protein, 55 aa, consensus; identical to SEQ ID NO: 1310
  MISC_FEATURE (1)..(55): consensus for the disclosure of Xaa see table VIII

SEQ ID NO: 6192 - protein, 14 aa, consensus
  MISC_FEATURE (1)..(14): consensus for the disclosure of Xaa see table VIII
XPXXXXXKXXXXXX

SEQ ID NO: 6193 - protein, 1077 aa, consensus; identical to SEQ ID NO: 1312
  MISC_FEATURE (1)..(1077): Xaa in all Positions is any amino acid

SEQ ID NO: 6194 - protein, 137 aa, consensus
  MISC_FEATURE (1)..(137): consensus for the disclosure of Xaa see table VIII
XXXXXXXXXXXXGDEXXXXXWXXXXXXXXXXXXXXXXXXXXLXXXXRXXTXDXXTXXXXXXXXXXXXXXKCATITPXXXRXXEXXLKXMWXSPNXTXRXXXXGXXFRXXIXXXXXPXXXXXWXXXIXXXRHAXXDXY

SEQ ID NO: 6195 - protein, 166 aa, consensus
  MISC_FEATURE (1)..(166): consensus for the disclosure of Xaa see table VIII
XXNXXXSXXXFAXXXXXXXXXXXXXXXXXTKXTIXKXYXXXFXXXFXXXXXXXXXXXXXXXXXXYXXXLIDDXXAXXXXXXGXXXXAXXNYXGDXXSDXXAXXXGSLXXMXSXLXXXXGXXXXXEAXHGTVTXHXXXXXXXXXTSTNXXAXIFAWXXXXXXRXXXD

SEQ ID NO: 6196 - protein, 447 aa, consensus
  MISC_FEATURE (1)..(447): Xaa in all positions is any amino acid
XXKIXVXXPXVEXDGDEMTRXIWXXIKXKLIXPXXXXXXXYXDLXXXXRDXTXDXVTXXXAXAXXKXXVXXKCATITPDEXRVXEFXLKXMWXSPNGTIRNILXGTVFREPIXXXXXPRLVPXWXKPIXIGRHAXGDQYXATDXXXXXXGXXXXXXXXXXXXXXXXXXXXVXXXXXXXXXGVXXXMYNXDXSIXXFAXXXXXXXXXXXXPXYXSTKNTILKXYDGRFKDIFXXXXXXXXKXXFXXXXXXYEHRLIDDMVAXXXKXXGGXXXAXKNYDGDVQSDXXAQGXGSLGLMTSVLXXPDGKXXEXEAAHGTVTRHXRXXQXGXXTSTNXIASIFAWXRGLXXRXXLDXXXXXXXFXXXLEXXXXXTVXXXXXMTKDLAXXXXXXXXXXXXXXXXXXTXXFXXXXXXXLXXXXXXXXXXXXXXXXXXXXXXXXXXXXXXXXXXX

SEQ ID NO: 6197 - protein, 447 aa, consensus
  MISC_FEATURE (1)..(447): Xaa in all positions is any amino acid
XXXXXXXXXXXXXXGDEXXXXXWXXXXXXXXXXXXXXXXXXXXLXXXXRXXTXDXXTXXXXXXXXXXXXXXKCATITPXXXRXXEXXLXXXWXSPNXTXRXXXXGXXFRXXXXXXXXXXXXXXWXXXIXXXRHAXXDXYXXXXXXXXXXXXXXXXXXXXXXXXXXXXXXXXXXXXXXXXXXXXXXXXNXXXSXXXFAXXXXXXXXXXXXXXXXXTKXTIXKXYXXXFXXXFXXXXXXXXXXXXXXXXXXYXXXLIDDXXAXXXXXXGXXXXAXXXYXGXXXSDXXAXXXGSLXXMXSXLXXXXGXXXXXEAXHGTVXXHXXXXXXXXXTSTXXXAXIFAWXXXXXXRXXXDXXXXXXXXXXXXEXXXXXXXXXXXXXXXXLXXXXXXXXXXXXXXXXXXXXXXXXXXXXXXXXXXXXXXXXXXXXXXXXXXXXXXXXXXXXXXXXXX

SEQ ID NO: 6198 - protein, 150 aa, consensus; identical to SEQ ID NO: 2917
  MISC_FEATURE (1)..(150): consensus for the disclosure of Xaa see table VIII

SEQ ID NO: 6199 - protein, 44 aa, consensus; identical to SEQ ID NO: 2918
  MISC_FEATURE (1)..(44): consensus for the disclosure of Xaa see table VIII

SEQ ID NO: 6200 - protein, 97 aa, consensus; identical to SEQ ID NO: 2919
  MISC_FEATURE (1)..(97): consensus for the disclosure of Xaa see table VIII

SEQ ID NO: 6201 - protein, 1277 aa, consensus; identical to SEQ ID NO: 2920
  MISC_FEATURE (1)..(1277): Xaa in all Positions is any amino acid

SEQ ID NO: 6202 - DNA, 1047 bp, Escherichia coli K12; identical to SEQ ID NO: 1323
  CDS (1)..(1047)

SEQ ID NO: 6203 - protein, 348 aa, Escherichia coli K12; identical to SEQ ID NO: 1324

SEQ ID NO: 6204 - DNA, 1235 bp, Salmonella typhimurium; identical to SEQ ID NO: 1325
  CDS (165)..(1235)

SEQ ID NO: 6205 - protein, 356 aa, Salmonella typhimurium; identical to SEQ ID NO: 1326

SEQ ID NO: 6206 - DNA, 1086 bp, Deinococcus radiodurans; identical to SEQ ID NO: 1327
  CDS (1)..(1086)

SEQ ID NO: 6207 - protein, 361 aa, Deinococcus radiodurans; identical to SEQ ID NO: 1328

SEQ ID NO: 6208 - DNA, 1056 bp, Neisseria meningitidis; identical to SEQ ID NO: 1329
  CDS (1)..(1056)

SEQ ID NO: 6209 - protein, 351 aa, Neisseria meningitidis; identical to SEQ ID NO: 1330

SEQ ID NO: 6210 - DNA, 1047 bp, Yersinia pestis; identical to SEQ ID NO: 1331
  CDS (1)..(1047)

SEQ ID NO: 6211 - protein, 348 aa, Yersinia pestis; identical to SEQ ID NO: 1332

SEQ ID NO: 6212 - DNA, 1071 bp, Escherichia coli; identical to SEQ ID NO: 1333
  CDS (1)..(1071)

SEQ ID NO: 6213 - protein, 356 aa, Escherichia coli; identical to SEQ ID NO: 1334

SEQ ID NO: 6214 - DNA, 1131 bp, Nostoc sp. PCC 7120; identical to SEQ ID NO: 1335
  CDS (1)..(1131)

SEQ ID NO: 6215 - protein, 376 aa, Nostoc sp. PCC 7120; identical to SEQ ID NO: 1336

SEQ ID NO: 6216 - DNA, 1053 bp, Salmonella enterica subsp. enterica serovar Typhi; identical to SEQ ID NO: 1337
  CDS (1)..(1053)

SEQ ID NO: 6217 - protein, 350 aa, Salmonella enterica subsp. enterica serovar Typhi; identical to SEQ ID NO: 1338

SEQ ID NO: 6218 - DNA, 1077 bp, Pseudomonas aeruginosa; identical to SEQ ID NO: 1339
  CDS (1)..(1077)

SEQ ID NO: 6219 - protein, 358 aa, Pseudomonas aeruginosa; identical to SEQ ID NO: 1340

SEQ ID NO: 6220 - DNA, 1047 bp, Buchnera sp; identical to SEQ ID NO: 1341
  CDS (1)..(1047)

SEQ ID NO: 6221 - protein, 348 aa, Buchnera sp; identical to SEQ ID NO: 1342

SEQ ID NO: 6222 - DNA, 1074 bp, Vibrio cholerae; identical to SEQ ID NO: 1343
  CDS (1)..(1074)

SEQ ID NO: 6223 - protein, 357 aa, Vibrio cholerae; identical to SEQ ID NO: 1344

SEQ ID NO: 6224 - DNA, 1038 bp, Lactococcus lactis subsp. lactis; identical to SEQ ID NO: 1345
  CDS (1)..(1038)

SEQ ID NO: 6225 - protein, 345 aa, Lactococcus lactis subsp. lactis; identical to SEQ ID NO: 1346

SEQ ID NO: 6226 - DNA, 1023 bp, Lactococcus lactis subsp. lactis; identical to SEQ ID NO: 1347
  CDS (1)..(1023)

SEQ ID NO: 6227 - protein, 340 aa, Lactococcus lactis subsp. lactis; identical to SEQ ID NO: 1348

SEQ ID NO: 6228 - DNA, 1032 bp, Streptococcus pneumoniae; identical to SEQ ID NO: 1349
  CDS (1)..(1032)

SEQ ID NO: 6229 - protein, 343 aa, Streptococcus pneumoniae; identical to SEQ ID NO: 1350

SEQ ID NO: 6230 - DNA, 1095 bp, Pseudomonas aeruginosa; identical to SEQ ID NO: 1351
  CDS (1)..(1095)

SEQ ID NO: 6231 - protein, 364 aa, Pseudomonas aeruginosa; identical to SEQ ID NO: 1352

SEQ ID NO: 6232 - DNA, 1110 bp, Caulobacter crescentus; identical to SEQ ID NO: 1353
  CDS (1)..(1110)

SEQ ID NO: 6233 - protein, 369 aa, Caulobacter crescentus; identical to SEQ ID NO: 1354

SEQ ID NO: 6234 - DNA, 1032 bp, Streptococcus pneumoniae; identical to SEQ ID NO: 1355
  CDS (1)..(1032)

SEQ ID NO: 6235 - protein, 343 aa, Streptococcus pneumoniae; identical to SEQ ID NO: 1356

SEQ ID NO: 6236 - DNA, 1047 bp, Buchnera aphidicola; identical to SEQ ID NO: 1357
  CDS (1)..(1047)

SEQ ID NO: 6237 - protein, 348 aa, Buchnera aphidicola; identical to SEQ ID NO: 1358

SEQ ID NO: 6238 - DNA, 1089 bp, Haemophilus influenzae; identical to SEQ ID NO: 1359
  CDS (1)..(1089)

SEQ ID NO: 6239 - protein, 362 aa, Haemophilus influenzae; identical to SEQ ID NO: 1360

SEQ ID NO: 6240 - DNA, 1502 bp, Candida albicans; identical to SEQ ID NO: 1361
  CDS (336)..(1442)

SEQ ID NO: 6241 - protein, 368 aa, Candida albicans; identical to SEQ ID NO: 1362

SEQ ID NO: 6242 - DNA, 1113 bp, Saccharomyces cerevisiae; identical to SEQ ID NO: 1363
  CDS (1)..(1113)

SEQ ID NO: 6243 - protein, 370 aa, Saccharomyces cerevisiae; identical to SEQ ID NO: 1364

SEQ ID NO: 6244 - DNA, 2048 bp, Saccharomyces cerevisiae; identical to SEQ ID NO: 1365
  CDS (619)..(1731)

SEQ ID NO: 6245 - protein, 370 aa, Saccharomyces cerevisiae; identical to SEQ ID NO: 1366

SEQ ID NO: 6246 - DNA, 1107 bp, Schizosaccharomyces pombe; identical to SEQ ID NO: 1367
  CDS (1)..(1107)

SEQ ID NO: 6247 - protein, 368 aa, Schizosaccharomyces pombe; identical to SEQ ID NO: 1368

SEQ ID NO: 6248 - DNA, 1089 bp, Amycolatopsis orientalis; identical to SEQ ID NO: 1369
  CDS (1)..(1089)

SEQ ID NO: 6249 - protein, 362 aa, Amycolatopsis orientalis; identical to SEQ ID NO: 1370

SEQ ID NO: 6250 - DNA, 1119 bp, Schizosaccharomyces pombe; identical to SEQ ID NO: 1371
  CDS (1)..(1119)

SEQ ID NO: 6251 - protein, 372 aa, Schizosaccharomyces pombe; identical to SEQ ID NO: 1372

SEQ ID NO: 6252 - DNA, 1248 bp, Corynebacterium glutamicum; identical to SEQ ID NO: 1373
  CDS (101)..(1228)

SEQ ID NO: 6253 - protein, 375 aa, Corynebacterium glutamicum; identical to SEQ ID NO: 1374

SEQ ID NO: 6254 - DNA, 1083 bp, Methylophilus methylotrophus; identical to SEQ ID NO: 1375
  CDS (1)..(1083)

SEQ ID NO: 6255 - protein, 360 aa, Methylophilus methylotrophus; identical to SEQ ID NO: 1376

SEQ ID NO: 6256 - DNA, 1107 bp, Debaryomyces hansenii; identical to SEQ ID NO: 1377
  CDS (1)..(1107)

SEQ ID NO: 6257 - protein, 368 aa, Debaryomyces hansenii; identical to SEQ ID NO: 1378

SEQ ID NO: 6258 - DNA, 1074 bp, Yarrowia lipolytica; identical to SEQ ID NO: 1379
  CDS (1)..(1074)

SEQ ID NO: 6259 - protein, 357 aa, Yarrowia lipolytica; identical to SEQ ID NO: 1380

SEQ ID NO: 6260 - DNA, 1089 bp, Yarrowia lipolytica; identical to SEQ ID NO: 1381
  CDS (1)..(1089)

SEQ ID NO: 6261 - protein, 362 aa, Yarrowia lipolytica; identical to SEQ ID NO: 1382

SEQ ID NO: 6262 - DNA, 1119 bp, Kluyveromyces lactis; identical to SEQ ID NO: 1383
  CDS (1)..(1119)

SEQ ID NO: 6263 - protein, 372 aa, Kluyveromyces lactis; identical to SEQ ID NO: 1384

SEQ ID NO: 6264 - DNA, 1095 bp, Kluyveromyces lactis; identical to SEQ ID NO: 1385
  CDS (1)..(1095)

SEQ ID NO: 6265 - protein, 364 aa, Kluyveromyces lactis; identical to SEQ ID NO: 1386

SEQ ID NO: 6266 - DNA, 1074 bp, Erwinia carotovora subsp; identical to SEQ ID NO: 1387
  CDS (1)..(1074)

SEQ ID NO: 6267 - protein, 357 aa, Erwinia carotovora subsp; identical to SEQ ID NO: 1388

SEQ ID NO: 6268 - DNA, 1047 bp, Erwinia carotovora subsp; identical to SEQ ID NO: 1389
  CDS (1)..(1047)

SEQ ID NO: 6269 - protein, 348 aa, Erwinia carotovora subsp; identical to SEQ ID NO: 1390

SEQ ID NO: 6270 - DNA, 1056 bp, Erwinia carotovora subsp; identical to SEQ ID NO: 1391
  CDS (1)..(1056)

SEQ ID NO: 6271 - protein, 351 aa, Erwinia carotovora subsp; identical to SEQ ID NO: 1392

SEQ ID NO: 6272 - DNA, 1113 bp, Acinetobacter sp; identical to SEQ ID NO: 1393
  CDS (1)..(1113)

SEQ ID NO: 6273 - protein, 370 aa, Acinetobacter sp; identical to SEQ ID NO: 1394

SEQ ID NO: 6274 - DNA, 1056 bp, Acinetobacter sp; identical to SEQ ID NO: 1395
  CDS (1)..(1056)

SEQ ID NO: 6275 - protein, 351 aa, Acinetobacter sp; identical to SEQ ID NO: 1396

SEQ ID NO: 6276 - DNA, 1119 bp, Candida glabrata; identical to SEQ ID NO: 1397
  CDS (1)..(1119)

SEQ ID NO: 6277 - protein, 372 aa, Candida glabrata; identical to SEQ ID NO: 1398

SEQ ID NO: 6278 - DNA, 1071 bp, Candida glabrata; identical to SEQ ID NO: 1399
  CDS (1)..(1071)

SEQ ID NO: 6279 - protein, 356 aa, Candida glabrata; identical to SEQ ID NO: 1400

SEQ ID NO: 6280 - DNA, 1083 bp, Photobacterium profundum; identical to SEQ ID NO: 1401
  CDS (1)..(1083)

SEQ ID NO: 6281 - protein, 360 aa, Photobacterium profundum; identical to SEQ ID NO: 1402

SEQ ID NO: 6282 - DNA, 1053 bp, Photobacterium profundum; identical to SEQ ID NO: 1403
  CDS (1)..(1053)

SEQ ID NO: 6283 - protein, 350 aa, Photobacterium profundum; identical to SEQ ID NO: 1404

SEQ ID NO: 6284 - DNA, 1113 bp, Photobacterium profundum; identical to SEQ ID NO: 1405
  CDS (1)..(1113)

SEQ ID NO: 6285 - protein, 370 aa, Photobacterium profundum; identical to SEQ ID NO: 1406

SEQ ID NO: 6286 - DNA, 1056 bp, Photobacterium profundum; identical to SEQ ID NO: 1407
  CDS (1)..(1056)

SEQ ID NO: 6287 - protein, 351 aa, Photobacterium profundum; identical to SEQ ID NO: 1408

SEQ ID NO: 6288 - DNA, 1092 bp, Parachlamydia sp; identical to SEQ ID NO: 1409
  CDS (1)..(1092)

SEQ ID NO: 6289 - protein, 363 aa, Parachlamydia sp; identical to SEQ ID NO: 1410

SEQ ID NO: 6290 - DNA, 1095 bp, Rhodopseudomonas palustris; identical to SEQ ID NO: 1411
  CDS (1)..(1095)

SEQ ID NO: 6291 - protein, 364 aa, Rhodopseudomonas palustris; identical to SEQ ID NO: 1412

SEQ ID NO: 6292 - DNA, 1100 bp, Amycolatopsis methanolica; identical to SEQ ID NO: 1413
  CDS (1)..(1086)

SEQ ID NO: 6293 - protein, 361 aa, Amycolatopsis methanolica; identical to SEQ ID NO: 1414

SEQ ID NO: 6294 - DNA, 1071 bp, Treponema denticola; identical to SEQ ID NO: 1415
  CDS (1)..(1071)

SEQ ID NO: 6295 - protein, 356 aa, Treponema denticola; identical to SEQ ID NO: 1416

SEQ ID NO: 6296 - DNA, 1068 bp, Geobacter sulfurreducens; identical to SEQ ID NO: 1417
  CDS (1)..(1068)

SEQ ID NO: 6297 - protein, 355 aa, Geobacter sulfurreducens; identical to SEQ ID NO: 1418

SEQ ID NO: 6298 - DNA, 1095 bp, Ashbya gossypii; identical to SEQ ID NO: 1419
  CDS (1)..(1095)

SEQ ID NO: 6299 - protein, 364 aa, Ashbya gossypii; identical to SEQ ID NO: 1420

SEQ ID NO: 6300 - DNA, 1122 bp, Ashbya gossypii; identical to SEQ ID NO: 1421
  CDS (1)..(1122)

SEQ ID NO: 6301 - protein, 373 aa, Ashbya gossypii; identical to SEQ ID NO: 1422

SEQ ID NO: 6302 - DNA, 1098 bp, Amycolatopsis balhimycina; identical to SEQ ID NO: 1423
  CDS (1)..(1098)

SEQ ID NO: 6303 - protein, 365 aa, Amycolatopsis balhimycina; identical to SEQ ID NO: 1424

SEQ ID NO: 6304 - DNA, 1071 bp, Vibrio vulnificus; identical to SEQ ID NO: 1425
  CDS (1)..(1071)

SEQ ID NO: 6305 - protein, 356 aa, Vibrio vulnificus; identical to SEQ ID NO: 1426

SEQ ID NO: 6306 - DNA, 1047 bp, Photorhabdus luminescens; identical to SEQ ID NO: 1427
  CDS (1)..(1047)

SEQ ID NO: 6307 - protein, 348 aa, Photorhabdus luminescens; identical to SEQ ID NO: 1428

SEQ ID NO: 6308 - DNA, 1053 bp, Photorhabdus luminescens; identical to SEQ ID NO: 1429
  CDS (1)..(1053)

SEQ ID NO: 6309 - protein, 350 aa, Photorhabdus luminescens; identical to SEQ ID NO: 1430

SEQ ID NO: 6310 - DNA, 1095 bp, Photorhabdus luminescens; identical to SEQ ID NO: 1431
  CDS (1)..(1095)

SEQ ID NO: 6311 - protein, 364 aa, Photorhabdus luminescens; identical to SEQ ID NO: 1432

SEQ ID NO: 6312 - DNA, 1119 bp, Gloeobacter violaceus; identical to SEQ ID NO: 1433
  CDS (1)..(1119)

SEQ ID NO: 6313 - protein, 372 aa, Gloeobacter violaceus; identical to SEQ ID NO: 1434

SEQ ID NO: 6314 - DNA, 1107 bp, Chromobacterium violaceum; identical to SEQ ID NO: 1435
  CDS (1)..(1107)

SEQ ID NO: 6315 - protein, 368 aa, Chromobacterium violaceum; identical to SEQ ID NO: 1436

SEQ ID NO: 6316 - DNA, 1059 bp, Chromobacterium violaceum; identical to SEQ ID NO: 1437
  CDS (1)..(1059)

SEQ ID NO: 6317 - protein, 352 aa, Chromobacterium violaceum; identical to SEQ ID NO: 1438

SEQ ID NO: 6318 - DNA, 1140 bp, Neurospora crassa; identical to SEQ ID NO: 1439
  CDS (1)..(1140)

SEQ ID NO: 6319 - protein, 379 aa, Neurospora crassa; identical to SEQ ID NO: 1440

SEQ ID NO: 6320 - DNA, 1092 bp, Neurospora crassa; identical to SEQ ID NO: 1441
  CDS (1)..(1092)

SEQ ID NO: 6321 - protein, 363 aa, Neurospora crassa; identical to SEQ ID NO: 1442

SEQ ID NO: 6322 - DNA, 1068 bp, Synechococcus sp; identical to SEQ ID NO: 1443
  CDS (1)..(1068)

SEQ ID NO: 6323 - protein, 355 aa, Synechococcus sp; identical to SEQ ID NO: 1444

SEQ ID NO: 6324 - DNA, 1053 bp, Rhodopirellula baltica; identical to SEQ ID NO: 1445
  CDS (1)..(1053)

SEQ ID NO: 6325 - protein, 350 aa, Rhodopirellula baltica; identical to SEQ ID NO: 1446

SEQ ID NO: 6326 - DNA, 1068 bp, Prochlorococcus marinus subsp; identical to SEQ ID NO: 1447
  CDS (1)..(1068)

SEQ ID NO: 6327 - protein, 355 aa, Prochlorococcus marinus subsp; identical to SEQ ID NO: 1448

SEQ ID NO: 6328 - DNA, 1083 bp, Prochlorococcus marinus; identical to SEQ ID NO: 1449
  CDS (1)..(1083)

SEQ ID NO: 6329 - protein, 360 aa, Prochlorococcus marinus; identical to SEQ ID NO: 1450

SEQ ID NO: 6330 - DNA, 1074 bp, Prochlorococcus marinus; identical to SEQ ID NO: 1451
  CDS (1)..(1074)

SEQ ID NO: 6331 - protein, 357 aa, Prochlorococcus marinus; identical to SEQ ID NO: 1452

SEQ ID NO: 6332 - DNA, 1113 bp, Haemophilus ducreyi; identical to SEQ ID NO: 1453
  CDS (1)..(1113)

SEQ ID NO: 6333 - protein, 370 aa, Haemophilus ducreyi; identical to SEQ ID NO: 1454

SEQ ID NO: 6334 - DNA, 1080 bp, Haemophilus ducreyi; identical to SEQ ID NO: 1455
  CDS (1)..(1080)

SEQ ID NO: 6335 - protein, 359 aa, Haemophilus ducreyi; identical to SEQ ID NO: 1456

SEQ ID NO: 6336 - DNA, 1086 bp, Candidatus Blochmannia floridanus; identical to SEQ ID NO: 1457
  CDS (1)..(1086)

SEQ ID NO: 6337 - protein, 361 aa, Candidatus Blochmannia floridanus; identical to SEQ ID NO: 1458

SEQ ID NO: 6338 - DNA, 1074 bp, Bordetella pertussis; identical to SEQ ID NO: 1459
  CDS (1)..(1074)

SEQ ID NO: 6339 - protein, 357 aa, Bordetella pertussis; identical to SEQ ID NO: 1460

SEQ ID NO: 6340 - DNA, 1119 bp, Bordetella bronchiseptica; identical to SEQ ID NO: 1461
  CDS (1)..(1119)

SEQ ID NO: 6341 - protein, 372 aa, Bordetella bronchiseptica; identical to SEQ ID NO: 1462

SEQ ID NO: 6342 - DNA, 1179 bp, Nitrosomonas europaea; identical to SEQ ID NO: 1463
  CDS (1)..(1179)

SEQ ID NO: 6343 - protein, 392 aa, Nitrosomonas europaea; identical to SEQ ID NO: 1464

SEQ ID NO: 6344 - DNA, 1083 bp, Coxiella burnetii; identical to SEQ ID NO: 1465
  CDS (1)..(1083)

SEQ ID NO: 6345 - protein, 360 aa, Coxiella burnetii; identical to SEQ ID NO: 1466

SEQ ID NO: 6346 - DNA, 834 bp, Vibrio anguillarum; identical to SEQ ID NO: 1467
  CDS (1)..(834)

SEQ ID NO: 6347 - protein, 277 aa, Vibrio anguillarum; identical to SEQ ID NO: 1468

SEQ ID NO: 6348 - DNA, 1143 bp, Xylella fastidiosa; identical to SEQ ID NO: 1469
  CDS (1)..(1143)

SEQ ID NO: 6349 - protein, 380 aa, Xylella fastidiosa; identical to SEQ ID NO: 1470

SEQ ID NO: 6350 - DNA, 1053 bp, Vibrio parahaemolyticus; identical to SEQ ID NO: 1471
  CDS (1)..(1053)

SEQ ID NO: 6351 - protein, 350 aa, Vibrio parahaemolyticus; identical to SEQ ID NO: 1472

SEQ ID NO: 6352 - DNA, 1053 bp, Vibrio parahaemolyticus; identical to SEQ ID NO: 1473
  CDS (1)..(1053)

SEQ ID NO: 6353 - protein, 350 aa, Vibrio parahaemolyticus; identical to SEQ ID NO: 1474

SEQ ID NO: 6354 - DNA, 1074 bp, Vibrio parahaemolyticus; identical to SEQ ID NO: 1475
  CDS (1)..(1074)

SEQ ID NO: 6355 - protein, 357 aa, Vibrio parahaemolyticus; identical to SEQ ID NO: 1476

SEQ ID NO: 6356 - DNA, 1083 bp, Pseudomonas syringae; identical to SEQ ID NO: 1477
  CDS (1)..(1083)

SEQ ID NO: 6357 - protein, 360 aa, Pseudomonas syringae; identical to SEQ ID NO: 1478

SEQ ID NO: 6358 - DNA, 1077 bp, Pseudomonas syringae; identical to SEQ ID NO: 1479
  CDS (1)..(1077)

SEQ ID NO: 6359 - protein, 358 aa, Pseudomonas syringae; identical to SEQ ID NO: 1480

SEQ ID NO: 6360 - DNA, 1062 bp, Pseudomonas putida; identical to SEQ ID NO: 1481
  CDS (1)..(1062)

SEQ ID NO: 6361 - protein, 353 aa, Pseudomonas putida; identical to SEQ ID NO: 1482

SEQ ID NO: 6362 - DNA, 1113 bp, Pseudomonas putida; identical to SEQ ID NO: 1483
  CDS (1)..(1113)

SEQ ID NO: 6363 - protein, 370 aa, Pseudomonas putida; identical to SEQ ID NO: 1484

SEQ ID NO: 6364 - DNA, 1086 bp, Bradyrhizobium japonicum; identical to SEQ ID NO: 1485
  CDS (1)..(1086)

SEQ ID NO: 6365 - protein, 361 aa, Bradyrhizobium japonicum; identical to SEQ ID NO: 1486

SEQ ID NO: 6366 - DNA, 1053 bp, Yersinia pestis; identical to SEQ ID NO: 1487
  CDS (1)..(1053)

SEQ ID NO: 6367 - protein, 350 aa, Yersinia pestis; identical to SEQ ID NO: 1488

SEQ ID NO: 6368 - DNA, 1077 bp, Yersinia pestis; identical to SEQ ID NO: 1489
  CDS (1)..(1077)

SEQ ID NO: 6369 - protein, 358 aa, Yersinia pestis; identical to SEQ ID NO: 1490

SEQ ID NO: 6370 - DNA, 1038 bp, Wigglesworthia glossinidia brevipalpis; identical to SEQ ID NO: 1491
  CDS (1)..(1038)

SEQ ID NO: 6371 - protein, 345 aa, Wigglesworthia glossinidia brevipalpis; identical to SEQ ID NO: 1492

SEQ ID NO: 6372 - DNA, 1053 bp, Vibrio vulnificus; identical to SEQ ID NO: 1493
  CDS (1)..(1053)

SEQ ID NO: 6373 - protein, 350 aa, Vibrio vulnificus; identical to SEQ ID NO: 1494

SEQ ID NO: 6374 - DNA, 1053 bp, Vibrio vulnificus; identical to SEQ ID NO: 1495
  CDS (1)..(1053)

SEQ ID NO: 6375 - protein, 350 aa, Vibrio vulnificus; identical to SEQ ID NO: 1496

SEQ ID NO: 6376 - DNA, 1071 bp, Vibrio vulnificus; identical to SEQ ID NO: 1497
  CDS (1)..(1071)

SEQ ID NO: 6377 - protein, 356 aa, Vibrio vulnificus; identical to SEQ ID NO: 1498

SEQ ID NO: 6378 - DNA, 1062 bp, Synechococcus elongatus; identical to SEQ ID NO: 1499
  CDS (1)..(1062)

SEQ ID NO: 6379 - protein, 353 aa, Synechococcus elongatus; identical to SEQ ID NO: 1500

SEQ ID NO: 6380 - DNA, 1032 bp, Streptococcus mutans; identical to SEQ ID NO: 1501
  CDS (1)..(1032)

SEQ ID NO: 6381 - protein, 343 aa, Streptococcus mutans; identical to SEQ ID NO: 1502

SEQ ID NO: 6382 - DNA, 1035 bp, Streptococcus mutans; identical to SEQ ID NO: 1503
  CDS (1)..(1035)

SEQ ID NO: 6383 - protein, 344 aa, Streptococcus mutans; identical to SEQ ID NO: 1504

SEQ ID NO: 6384 - DNA, 1008 bp, Streptococcus agalactiae; identical to SEQ ID NO: 1505
  CDS (1)..(1008)

SEQ ID NO: 6385 - protein, 335 aa, Streptococcus agalactiae; identical to SEQ ID NO: 1506

SEQ ID NO: 6386 - DNA, 1065 bp, Shewanella oneidensis; identical to SEQ ID NO: 1507
  CDS (1)..(1065)

SEQ ID NO: 6387 - protein, 354 aa, Shewanella oneidensis; identical to SEQ ID NO: 1508

SEQ ID NO: 6388 - DNA, 1092 bp, Shewanella oneidensis; identical to SEQ ID NO: 1509
  CDS (1)..(1092)

SEQ ID NO: 6389 - protein, 363 aa, Shewanella oneidensis; identical to SEQ ID NO: 1510

SEQ ID NO: 6390 - DNA, 1059 bp, Shewanella oneidensis; identical to SEQ ID NO: 1511
  CDS (1)..(1059)

SEQ ID NO: 6391 - protein, 352 aa, Shewanella oneidensis; identical to SEQ ID NO: 1512

SEQ ID NO: 6392 - DNA, 1053 bp, Escherichia coli O6; identical to SEQ ID NO: 1513
  CDS (1)..(1053)

SEQ ID NO: 6393 - protein, 350 aa, Escherichia coli O6; identical to SEQ ID NO: 1514

SEQ ID NO: 6394 - DNA, 1170 bp, Corynebacterium efficiens; identical to SEQ ID NO: 1515
  CDS (1)..(1170)

SEQ ID NO: 6395 - protein, 389 aa, Corynebacterium efficiens; identical to SEQ ID NO: 1516

SEQ ID NO: 6396 - DNA, 1134 bp, Bifidobacterium longum; identical to SEQ ID NO: 1517
  CDS (1)..(1134)

SEQ ID NO: 6397 - protein, 377 aa, Bifidobacterium longum; identical to SEQ ID NO: 1518

SEQ ID NO: 6398 - DNA, 1233 bp, Bifidobacterium longum; identical to SEQ ID NO: 1519
  CDS (1)..(1233)

SEQ ID NO: 6399 - protein, 410 aa, Bifidobacterium longum; identical to SEQ ID NO: 1520

SEQ ID NO: 6400 - DNA, 1221 bp, Phytophthora infestans; identical to SEQ ID NO: 1521
  CDS (20)..(1153)

SEQ ID NO: 6401 - protein, 377 aa, Phytophthora infestans; identical to SEQ ID NO: 1522

SEQ ID NO: 6402 - DNA, 1062 bp, Chlorobium tepidum; identical to SEQ ID NO: 1523
  CDS (1)..(1062)

SEQ ID NO: 6403 - protein, 353 aa, Chlorobium tepidum; identical to SEQ ID NO: 1524

SEQ ID NO: 6404 - DNA, 1074 bp, Xanthomonas campestris; identical to SEQ ID NO: 1525
  CDS (1)..(1074)

SEQ ID NO: 6405 - protein, 357 aa, Xanthomonas campestris; identical to SEQ ID NO: 1526

SEQ ID NO: 6406 - DNA, 1074 bp, Xanthomonas axonopodis; identical to SEQ ID NO: 1527
  CDS (1)..(1074)

SEQ ID NO: 6407 - protein, 357 aa, Xanthomonas axonopodis; identical to SEQ ID NO: 1528

SEQ ID NO: 6408 - DNA, 1080 bp, Ralstonia solanacearum; identical to SEQ ID NO: 1529
  CDS (1)..(1080)

SEQ ID NO: 6409 - protein, 359 aa, Ralstonia solanacearum; identical to SEQ ID NO: 1530

SEQ ID NO: 6410 - DNA, 1179 bp, Ralstonia solanacearum; identical to SEQ ID NO: 1531
  CDS (1)..(1179)

SEQ ID NO: 6411 - protein, 392 aa, Ralstonia solanacearum; identical to SEQ ID NO: 1532

SEQ ID NO: 6412 - DNA, 1065 bp, Synechococcus sp; identical to SEQ ID NO: 1533
  CDS (1)..(1065)

SEQ ID NO: 6413 - protein, 354 aa, Synechococcus sp; identical to SEQ ID NO: 1534

SEQ ID NO: 6414 - DNA, 1035 bp, Escherichia coli; identical to SEQ ID NO: 1535
  CDS (1)..(1035)

SEQ ID NO: 6415 - protein, 344 aa, Escherichia coli; identical to SEQ ID NO: 1536

SEQ ID NO: 6416 - DNA, 1200 bp, Stigmatella aurantiaca; identical to SEQ ID NO: 1537
  CDS (62)..(1147)

SEQ ID NO: 6417 - protein, 361 aa, Stigmatella aurantiaca; identical to SEQ ID NO: 1538

SEQ ID NO: 6418 - DNA, 1092 bp, Rhizobium loti; identical to SEQ ID NO: 1539
  CDS (1)..(1092)

SEQ ID NO: 6419 - protein, 363 aa, Rhizobium loti; identical to SEQ ID NO: 1540

SEQ ID NO: 6420 - DNA, 1083 bp, Amycolatopsis mediterranei; identical to SEQ ID NO: 1541
  CDS (1)..(1083)

SEQ ID NO: 6421 - protein, 360 aa, Amycolatopsis mediterranei; identical to SEQ ID NO: 1542

SEQ ID NO: 6422 - DNA, 1053 bp, Pasteurella multocida; identical to SEQ ID NO: 1543
  CDS (1)..(1053)

SEQ ID NO: 6423 - protein, 350 aa, Pasteurella multocida; identical to SEQ ID NO: 1544

SEQ ID NO: 6424 - DNA, 1086 bp, Pasteurella multocida; identical to SEQ ID NO: 1545
  CDS (1)..(1086)

SEQ ID NO: 6425 - protein, 361 aa, Pasteurella multocida; identical to SEQ ID NO: 1546

SEQ ID NO: 6426 - DNA, 1125 bp, Emericella nidulans; identical to SEQ ID NO: 1547
  CDS (1)..(1125)

SEQ ID NO: 6427 - protein, 374 aa, Emericella nidulans; identical to SEQ ID NO: 1548

SEQ ID NO: 6428 - DNA, 1089 bp, Emericella nidulans; identical to SEQ ID NO: 1549
  CDS (1)..(1089)

SEQ ID NO: 6429 - protein, 362 aa, Emericella nidulans; identical to SEQ ID NO: 1550

SEQ ID NO: 6430 - DNA, 1239 bp, Vibrio cholerae; identical to SEQ ID NO: 1551
  CDS (114)..(1175)

SEQ ID NO: 6431 - protein, 353 aa, Vibrio cholerae; identical to SEQ ID NO: 1552

SEQ ID NO: 6432 - DNA, 2184 bp, Candida albicans; identical to SEQ ID NO: 1553
  CDS (461)..(1573)

SEQ ID NO: 6433 - protein, 370 aa, Candida albicans; identical to SEQ ID NO: 1554

SEQ ID NO: 6434 - DNA, 1047 bp, Buchnera aphidicola; identical to SEQ ID NO: 1555
  CDS (1)..(1047)

SEQ ID NO: 6435 - protein, 348 aa, Buchnera aphidicola; identical to SEQ ID NO: 1556

SEQ ID NO: 6436 - DNA, 1047 bp, Buchnera aphidicola; identical to SEQ ID NO: 1557
  CDS (1)..(1047)

SEQ ID NO: 6437 - protein, 348 aa, Buchnera aphidicola; identical to SEQ ID NO: 1558

SEQ ID NO: 6438 - DNA, 1047 bp, Erwinia herbicola; identical to SEQ ID NO: 1559
  CDS (1)..(1047)

SEQ ID NO: 6439 - protein, 348 aa, Erwinia herbicola; identical to SEQ ID NO: 1560

SEQ ID NO: 6440 - DNA, 1047 bp, Salmonella typhimurium; identical to SEQ ID NO: 1561
  CDS (1)..(1047)

SEQ ID NO: 6441 - protein, 348 aa, Salmonella typhimurium; identical to SEQ ID NO: 1562

SEQ ID NO: 6442 - DNA, 23 bp, artificial sequence
  primer
atgaacagaactgacgaactccg

SEQ ID NO: 6443 - DNA, 24 bp, artificial sequence
  primer
ttagaagcgggtatctaccgcaga

SEQ ID NO: 6444 - DNA, 785 bp, Escherichia coli K12; identical to SEQ ID NO: 3693
  CDS (86)..(781)

SEQ ID NO: 6445 - protein, 231 aa, Escherichia coli K12; identical to SEQ ID NO: 3694

SEQ ID NO: 6446 - DNA, 1005 bp, Nostoc sp. PCC 7120; identical to SEQ ID NO: 3695
  CDS (1)..(1005)

SEQ ID NO: 6447 - protein, 334 aa, Nostoc sp. PCC 7120; identical to SEQ ID NO: 3696

SEQ ID NO: 6448 - DNA, 642 bp, Salmonella enterica subsp. enterica serovar Typhi; identical to SEQ ID NO: 3697
  CDS (1)..(642)

SEQ ID NO: 6449 - protein, 213 aa, Salmonella enterica subsp. enterica serovar Typhi; identical to SEQ ID NO: 3698

SEQ ID NO: 6450 - DNA, 942 bp, Nostoc sp. PCC 7120; identical to SEQ ID NO: 3699
  CDS (1)..(942)

SEQ ID NO: 6451 - protein, 313 aa, Nostoc sp. PCC 7120; identical to SEQ ID NO: 3700

SEQ ID NO: 6452 - DNA, 642 bp, Yersinia pestis; identical to SEQ ID NO: 3701
  CDS (1)..(642)

SEQ ID NO: 6453 - protein, 213 aa, Yersinia pestis; identical to SEQ ID NO: 3702

SEQ ID NO: 6454 - DNA, 1668 bp, Thermotoga maritima; identical to SEQ ID NO: 3703
  CDS (1)..(1668)

SEQ ID NO: 6455 - protein, 555 aa, Thermotoga maritima; identical to SEQ ID NO: 3704

SEQ ID NO: 6456 - DNA, 2056 bp, Arabidopsis thaliana (mouse-ear cress); identical to SEQ ID NO: 3705
  CDS (1)..(2025)

SEQ ID NO: 6457 - protein, 674 aa, Arabidopsis thaliana (mouse-ear cress); identical to SEQ ID NO: 3706

SEQ ID NO: 6458 - DNA, 624 bp, Staphylococcus aureus; identical to SEQ ID NO: 3707
  CDS (1)..(624)

SEQ ID NO: 6459 - protein, 207 aa, Staphylococcus aureus; identical to SEQ ID NO: 3708

SEQ ID NO: 6460 - DNA, 639 bp, Streptococcus pneumoniae; identical to SEQ ID NO: 3709
  CDS (1)..(639)

SEQ ID NO: 6461 - protein, 212 aa, Streptococcus pneumoniae; identical to SEQ ID NO: 3710

SEQ ID NO: 6462 - DNA, 642 bp, Mycoplasma genitalium; identical to SEQ ID NO: 3711
  CDS (1)..(642): transl_table=4

SEQ ID NO: 6463 - protein, 213 aa, Mycoplasma genitalium; identical to SEQ ID NO: 3712

SEQ ID NO: 6464 - DNA, 636 bp, Bacillus halodurans; identical to SEQ ID NO: 3713
  CDS (1)..(636)

SEQ ID NO: 6465 - protein, 211 aa, Bacillus halodurans; identical to SEQ ID NO: 3714

SEQ ID NO: 6466 - DNA, 1668 bp, Treponema pallidum subsp. pallidum (syphilis spirochete); identical to SEQ ID NO: 3715
  CDS (1)..(1668)

SEQ ID NO: 6467 - protein, 555 aa, Treponema pallidum subsp. pallidum (syphilis spirochete); identical to SEQ ID NO: 3716

SEQ ID NO: 6468 - DNA, 669 bp, Chlamydophila pneumoniae, Chlamydia pneumoniae; identical to SEQ ID NO: 3717
  CDS (1)..(669)

SEQ ID NO: 6469 - protein, 222 aa, Chlamydophila pneumoniae, Chlamydia pneumoniae; identical to SEQ ID NO: 3718

SEQ ID NO: 6470 - DNA, 621 bp, Lactococcus lactis subsp. lactis; identical to SEQ ID NO: 3719
  CDS (1)..(621)

SEQ ID NO: 6471 - protein, 206 aa, Lactococcus lactis subsp. lactis; identical to SEQ ID NO: 3720

SEQ ID NO: 6472 - DNA, 633 bp, Deinococcus radiodurans; identical to SEQ ID NO: 3721
  CDS (1)..(633)

SEQ ID NO: 6473 - protein, 210 aa, Deinococcus radiodurans; identical to SEQ ID NO: 3722

SEQ ID NO: 6474 - DNA, 1932 bp, Arabidopsis thaliana (mouse-ear cress); identical to SEQ ID NO: 3723
  CDS (1)..(1932)

SEQ ID NO: 6475 - protein, 643 aa, Arabidopsis thaliana (mouse-ear cress); identical to SEQ ID NO: 3724

SEQ ID NO: 6476 - DNA, 636 bp, Bacillus subtilis; identical to SEQ ID NO: 3725
  CDS (1)..(636)

SEQ ID NO: 6477 - protein, 211 aa, Bacillus subtilis; identical to SEQ ID NO: 3726

SEQ ID NO: 6478 - DNA, 624 bp, Borrelia burgdorferi (Lyme disease spirochete); identical to SEQ ID NO: 3727
  CDS (1)..(624)

SEQ ID NO: 6479 - protein, 207 aa, Borrelia burgdorferi (Lyme disease spirochete); identical to SEQ ID NO: 3728

SEQ ID NO: 6480 - DNA, 624 bp, Ureaplasma urealyticum; identical to SEQ ID NO: 3729
  CDS (1)..(624): transl_table=4

SEQ ID NO: 6481 - protein, 207 aa, Ureaplasma urealyticum; identical to SEQ ID NO: 3730

SEQ ID NO: 6482 - DNA, 642 bp, Haemophilus influenzae; identical to SEQ ID NO: 3731
  CDS (1)..(642)

SEQ ID NO: 6483 - protein, 213 aa, Haemophilus influenzae; identical to SEQ ID NO: 3732

SEQ ID NO: 6484 - DNA, 1470 bp, Spinacia oleracea (spinach); identical to SEQ ID NO: 3733
  CDS (49)..(1257)

SEQ ID NO: 6485 - protein, 402 aa, Spinacia oleracea (spinach); identical to SEQ ID NO: 3734

SEQ ID NO: 6486 - DNA, 1533 bp, Triticum sp. (wheat); identical to SEQ ID NO: 3735
  CDS (65)..(1279)

SEQ ID NO: 6487 - protein, 404 aa, Triticum sp. (wheat); identical to SEQ ID NO: 3736

SEQ ID NO: 6488 - DNA, 1240 bp, Arabidopsis thaliana (mouse-ear cress); identical to SEQ ID NO: 3737
  CDS (1)..(1188)

SEQ ID NO: 6489 - protein, 395 aa, Arabidopsis thaliana (mouse-ear cress); identical to SEQ ID NO: 3738

SEQ ID NO: 6490 - DNA, 2077 bp, Saccharomyces cerevisiae; identical to SEQ ID NO: 3739
  CDS (482)..(1987)

SEQ ID NO: 6491 - protein, 501 aa, Saccharomyces cerevisiae; identical to SEQ ID NO: 3740

SEQ ID NO: 6492 - DNA, 642 bp, Mycoplasma pneumoniae; identical to SEQ ID NO: 3741
  CDS (1)..(642): transl_table=4

SEQ ID NO: 6493 - protein, 213 aa, Mycoplasma pneumoniae; identical to SEQ ID NO: 3742

SEQ ID NO: 6494 - DNA, 1245 bp, Chlamydomonas reinhardtii; identical to SEQ ID NO: 3743
  CDS (28)..(1155)

SEQ ID NO: 6495 - protein, 375 aa, Chlamydomonas reinhardtii; identical to SEQ ID NO: 3744

SEQ ID NO: 6496 - DNA, 1520 bp, Mesembryanthemum crystallinum (common ice plant); identical to SEQ ID NO: 3745
  CDS (127)..(1320)

SEQ ID NO: 6497 - protein, 397 aa, Mesembryanthemum crystallinum (common ice plant); identical to SEQ ID NO: 3746

SEQ ID NO: 6498 - DNA, 690 bp, Caenorhabditis elegans; identical to SEQ ID NO: 3747
  CDS (1)..(690)

SEQ ID NO: 6499 - protein, 229 aa, Caenorhabditis elegans; identical to SEQ ID NO: 3748

SEQ ID NO: 6500 - DNA, 1668 bp, Caenorhabditis elegans; identical to SEQ ID NO: 3749
  CDS (1)..(1668)

SEQ ID NO: 6501 - protein, 555 aa, Caenorhabditis elegans; identical to SEQ ID NO: 3750

SEQ ID NO: 6502 - DNA, 1365 bp, Schizosaccharomyces pombe; identical to SEQ ID NO: 3751
  CDS (1)..(1365)

SEQ ID NO: 6503 - protein, 454 aa, Schizosaccharomyces pombe; identical to SEQ ID NO: 3752

SEQ ID NO: 6504 - DNA, 1647 bp, Homo sapiens; identical to SEQ ID NO: 3753
  CDS (1)..(1647)

SEQ ID NO: 6505 - protein, 548 aa, Homo sapiens; identical to SEQ ID NO: 3754

SEQ ID NO: 6506 - DNA, 738 bp, Debaryomyces hansenii; identical to SEQ ID NO: 3755
  CDS (1)..(738)

SEQ ID NO: 6507 - protein, 245 aa, Debaryomyces hansenii; identical to SEQ ID NO: 3756

SEQ ID NO: 6508 - DNA, 1521 bp, Debaryomyces hansenii; identical to SEQ ID NO: 3757
  CDS (1)..(1521)

SEQ ID NO: 6509 - protein, 506 aa, Debaryomyces hansenii; identical to SEQ ID NO: 3758

SEQ ID NO: 6510 - DNA, 1353 bp, Yarrowia lipolytica; identical to SEQ ID NO: 3759
  CDS (1)..(1353)

SEQ ID NO: 6511 - protein, 450 aa, Yarrowia lipolytica; identical to SEQ ID NO: 3760

SEQ ID NO: 6512 - DNA, 1380 bp, Kluyveromyces lactis; identical to SEQ ID NO: 3761
  CDS (1)..(1380)

SEQ ID NO: 6513 - protein, 459 aa, Kluyveromyces lactis; identical to SEQ ID NO: 3762

SEQ ID NO: 6514 - DNA, 642 bp, Erwinia carotovora subsp; identical to SEQ ID NO: 3763
  CDS (1)..(642)

SEQ ID NO: 6515 - protein, 213 aa, Erwinia carotovora subsp; identical to SEQ ID NO: 3764

SEQ ID NO: 6516 - DNA, 627 bp, Mesoplasma florum L1; identical to SEQ ID NO: 3765
  CDS (1)..(627)

SEQ ID NO: 6517 - protein, 208 aa, Mesoplasma florum L1; identical to SEQ ID NO: 3766

SEQ ID NO: 6518 - DNA, 1431 bp, Candida glabrata; identical to SEQ ID NO: 3767
  CDS (1)..(1431)

SEQ ID NO: 6519 - protein, 476 aa, Candida glabrata; identical to SEQ ID NO: 3768

SEQ ID NO: 6520 - DNA, 639 bp, Bacillus thuringiensis serovar konkukian str; identical to SEQ ID NO: 3769
  CDS (1)..(639)

SEQ ID NO: 6521 - protein, 212 aa, Bacillus thuringiensis serovar konkukian str; identical to SEQ ID NO: 3770

SEQ ID NO: 6522 - DNA, 834 bp, Homo sapiens; identical to SEQ ID NO: 3771
  CDS (1)..(834)

SEQ ID NO: 6523 - protein, 277 aa, Homo sapiens [sequence omitted]

SEQ ID NO: 6524 - DNA, 1965 bp, Oryza sativa; identical to SEQ ID NO: 3773
  CDS (257)..(1726)

SEQ ID NO: 6525 - protein, 489 aa, Oryza sativa; identical to SEQ ID NO: 3774

SEQ ID NO: 6526 - DNA, 747 bp, Photobacterium profundum; identical to SEQ ID NO: 3775
  CDS (1)..(747)

SEQ ID NO: 6527 - protein, 248 aa, Photobacterium profundum; identical to SEQ ID NO: 3776

SEQ ID NO: 6528 - DNA, 621 bp, Bdellovibrio bacteriovorus; identical to SEQ ID NO: 3777
  CDS (1)..(621)

SEQ ID NO: 6529 - protein, 206 aa, Bdellovibrio bacteriovorus; identical to SEQ ID NO: 3778

SEQ ID NO: 6530 - DNA, 624 bp, Bdellovibrio bacteriovorus; identical to SEQ ID NO: 3779
  CDS (1)..(624)

SEQ ID NO: 6531 - protein, 207 aa, Bdellovibrio bacteriovorus; identical to SEQ ID NO: 3780

SEQ ID NO: 6532 - DNA, 618 bp, Mycoplasma mycoides; identical to SEQ ID NO: 3781
  CDS (1)..(618)

SEQ ID NO: 6533 - protein, 205 aa, Mycoplasma mycoides; identical to SEQ ID NO: 3782

SEQ ID NO: 6534 - DNA, 2638 bp, Oryza sativa; identical to SEQ ID NO: 3783
  CDS (248)..(2206)

SEQ ID NO: 6535 - protein, 652 aa, Oryza sativa; identical to SEQ ID NO: 3784

SEQ ID NO: 6536 - DNA, 1494 bp, Oryza sativa; identical to SEQ ID NO: 3785
  CDS (20)..(1231)

SEQ ID NO: 6537 - protein, 403 aa, Oryza sativa; identical to SEQ ID NO: 3786

SEQ ID NO: 6538 - DNA, 1824 bp, Homo sapiens; identical to SEQ ID NO: 3787
  CDS (45)..(1232)

SEQ ID NO: 6539 - protein, 395 aa, Homo sapiens [sequence omitted]

SEQ ID NO: 6540 - DNA, 630 bp, Listeria monocytogenes; identical to SEQ ID NO: 3789
  CDS (1)..(630)

SEQ ID NO: 6541 - protein, 209 aa, Listeria monocytogenes; identical to SEQ ID NO: 3790

SEQ ID NO: 6542 - DNA, 636 bp, Thermus thermophilus; identical to SEQ ID NO: 3791
  CDS (1)..(636)

SEQ ID NO: 6543 - protein, 211 aa, Thermus thermophilus; identical to SEQ ID NO: 3792

SEQ ID NO: 6544 - DNA, 1653 bp, Treponema denticola; identical to SEQ ID NO: 3793
  CDS (1)..(1653)

SEQ ID NO: 6545 - protein, 550 aa, Treponema denticola; identical to SEQ ID NO: 3794

SEQ ID NO: 6546 - DNA, 636 bp, Lactobacillus johnsonii; identical to SEQ ID NO: 3795
  CDS (1)..(636)

SEQ ID NO: 6547 - protein, 211 aa, Lactobacillus johnsonii; identical to SEQ ID NO: 3796

SEQ ID NO: 6548 - DNA, 1497 bp, Ashbya gossypii; identical to SEQ ID NO: 3797
  CDS (1)..(1497)

SEQ ID NO: 6549 - protein, 498 aa, Ashbya gossypii; identical to SEQ ID NO: 3798

SEQ ID NO: 6550 - DNA, 651 bp, Vibrio vulnificus; identical to SEQ ID NO: 3799
  CDS (1)..(651)

SEQ ID NO: 6551 - protein, 216 aa, Vibrio vulnificus; identical to SEQ ID NO: 3800

SEQ ID NO: 6552 - DNA, 630 bp, Porphyromonas gingivalis; identical to SEQ ID NO: 3801
  CDS (1)..(630)

SEQ ID NO: 6553 - protein, 209 aa, Porphyromonas gingivalis; identical to SEQ ID NO: 3802

SEQ ID NO: 6554 - DNA, 642 bp, Photorhabdus luminescens; identical to SEQ ID NO: 3803
  CDS (1)..(642)

SEQ ID NO: 6555 - protein, 213 aa, Photorhabdus luminescens; identical to SEQ ID NO: 3804

SEQ ID NO: 6556 - DNA, 645 bp, Mycoplasma gallisepticum; identical to SEQ ID NO: 3805
  CDS (1)..(645): transl_table=4

SEQ ID NO: 6557 - protein, 214 aa, Mycoplasma gallisepticum; identical to SEQ ID NO: 3806

SEQ ID NO: 6558 - DNA, 930 bp, Gloeobacter violaceus; identical to SEQ ID NO: 3807
  CDS (1)..(930)

SEQ ID NO: 6559 - protein, 309 aa, Gloeobacter violaceus; identical to SEQ ID NO: 3808

SEQ ID NO: 6560 - DNA, 996 bp, Gloeobacter violaceus; identical to SEQ ID NO: 3809
  CDS (1)..(996)

SEQ ID NO: 6561 - protein, 331 aa, Gloeobacter violaceus; identical to SEQ ID NO: 3810

SEQ ID NO: 6562 - DNA, 1038 bp, Gloeobacter violaceus; identical to SEQ ID NO: 3811
  CDS (1)..(1038)

SEQ ID NO: 6563 - protein, 345 aa, Gloeobacter violaceus; identical to SEQ ID NO: 3812

SEQ ID NO: 6564 - DNA, 615 bp, Chromobacterium violaceum; identical to SEQ ID NO: 3813
  CDS (1)..(615)

SEQ ID NO: 6565 - protein, 204 aa, Chromobacterium violaceum; identical to SEQ ID NO: 3814

SEQ ID NO: 6566 - DNA, 2049 bp, Giardia lamblia ATCC 50803; identical to SEQ ID NO: 3815
  CDS (1)..(2049)

SEQ ID NO: 6567 - protein, 682 aa, Giardia lamblia ATCC 50803; identical to SEQ ID NO: 3816

SEQ ID NO: 6568 - DNA, 1425 bp, Neurospora crassa; identical to SEQ ID NO: 3817
  CDS (1)..(1425)

SEQ ID NO: 6569 - protein, 474 aa, Neurospora crassa; identical to SEQ ID NO: 3818

SEQ ID NO: 6570 - DNA, 612 bp, Synechococcus sp; identical to SEQ ID NO: 3819
  CDS (1)..(612)

SEQ ID NO: 6571 - protein, 203 aa, Synechococcus sp; identical to SEQ ID NO: 3820

SEQ ID NO: 6572 - DNA, 654 bp, Haemophilus ducreyi; identical to SEQ ID NO: 3821
  CDS (1)..(654)

SEQ ID NO: 6573 - protein, 217 aa, Haemophilus ducreyi; identical to SEQ ID NO: 3822

SEQ ID NO: 6574 - DNA, 1609 bp, Chlorarachnion sp; identical to SEQ ID NO: 3823
  CDS (10)..(1464)

SEQ ID NO: 6575 - protein, 484 aa, Chlorarachnion sp; identical to SEQ ID NO: 3824

SEQ ID NO: 6576 - DNA, 630 bp, Enterococcus faecalis; identical to SEQ ID NO: 3825
  CDS (1)..(630)

SEQ ID NO: 6577 - protein, 209 aa, Enterococcus faecalis; identical to SEQ ID NO: 3826

SEQ ID NO: 6578 - DNA, 648 bp, Coxiella burnetii; identical to SEQ ID NO: 3827
  CDS (1)..(648)

SEQ ID NO: 6579 - protein, 215 aa, Coxiella burnetii; identical to SEQ ID NO: 3828

SEQ ID NO: 6580 - DNA, 1659 bp, Clostridium tetani; identical to SEQ ID NO: 3829
  CDS (1)..(1659)

SEQ ID NO: 6581 - protein, 552 aa, Clostridium tetani; identical to SEQ ID NO: 3830

SEQ ID NO: 6582 - DNA, 1674 bp, Bacteroides thetaiotaomicron; identical to SEQ ID NO: 3831
  CDS (1)..(1674)

SEQ ID NO: 6583 - protein, 557 aa, Bacteroides thetaiotaomicron; identical to SEQ ID NO: 3832

SEQ ID NO: 6584 - DNA, 618 bp, Bacteroides thetaiotaomicron; identical to SEQ ID NO: 3833
  CDS (1)..(618)

SEQ ID NO: 6585 - protein, 205 aa, Bacteroides thetaiotaomicron; identical to SEQ ID NO: 3834

SEQ ID NO: 6586 - DNA, 630 bp, Streptococcus agalactiae; identical to SEQ ID NO: 3835
  CDS (1)..(630)

SEQ ID NO: 6587 - protein, 209 aa, Streptococcus agalactiae; identical to SEQ ID NO: 3836

SEQ ID NO: 6588 - DNA, 1524 bp, Galdieria sulphuraria; identical to SEQ ID NO: 3837
  CDS (77)..(1423)

SEQ ID NO: 6589 - protein, 448 aa, Galdieria sulphuraria; identical to SEQ ID NO: 3838

SEQ ID NO: 6590 - DNA, 1005 bp, Synechococcus vulcanus; identical to SEQ ID NO: 3839
  CDS (1)..(1005)

SEQ ID NO: 6591 - protein, 334 aa, Synechococcus vulcanus; identical to SEQ ID NO: 3840

SEQ ID NO: 6592 - DNA, 1831 bp, Arabidopsis thaliana; identical to SEQ ID NO: 3841
  CDS (116)..(1525)

SEQ ID NO: 6593 - protein, 469 aa, Arabidopsis thaliana; identical to SEQ ID NO: 3842

SEQ ID NO: 6594 - DNA, 1875 bp, Homo sapiens; identical to SEQ ID NO: 3843
  CDS (14)..(1273)

SEQ ID NO: 6595 - protein, 419 aa, Homo sapiens; identical to SEQ ID NO: 3844

SEQ ID NO: 6596 - DNA, 1644 bp, Thermoanaerobacter tengcongensis; identical to SEQ ID NO: 3845
  CDS (1)..(1644)

SEQ ID NO: 6597 - protein, 547 aa, Thermoanaerobacter tengcongensis; identical to SEQ ID NO: 3846

SEQ ID NO: 6598 - DNA, 1665 bp, Clostridium perfringens; identical to SEQ ID NO: 3847
  CDS (1)..(1665)

SEQ ID NO: 6599 - protein, 554 aa, Clostridium perfringens; identical to SEQ ID NO: 3848

SEQ ID NO: 6600 - DNA, 1258 bp, Odontella sinensis; identical to SEQ ID NO: 3849
  CDS (23)..(1213)

SEQ ID NO: 6601 - protein, 396 aa, Odontella sinensis; identical to SEQ ID NO: 3850

SEQ ID NO: 6602 - DNA, 606 bp, Homo sapiens; identical to SEQ ID NO: 3851
  CDS (1)..(606)

SEQ ID NO: 6603 - protein, 201 aa, Homo sapiens [sequence omitted]

SEQ ID NO: 6604 - DNA, 1299 bp, Vaucheria litorea; identical to SEQ ID NO: 3853
  CDS (8)..(1225)

SEQ ID NO: 6605 - protein, 405 aa, Vaucheria litorea; identical to SEQ ID NO: 3854

SEQ ID NO: 6606 - DNA, 1711 bp, Cryptosporidium parvum; identical to SEQ ID NO: 3855
  CDS (290)..(1549)

SEQ ID NO: 6607 - protein, 419 aa, Cryptosporidium parvum; identical to SEQ ID NO: 3856

SEQ ID NO: 6608 - DNA, 1492 bp, Arabidopsis thaliana; identical to SEQ ID NO: 3857
  CDS (1)..(1461)

SEQ ID NO: 6609 - protein, 486 aa, Arabidopsis thaliana; identical to SEQ ID NO: 3858

SEQ ID NO: 6610 - DNA, 1480 bp, Dictyostelium discoideum; identical to SEQ ID NO: 3859
  CDS (1)..(1479)

SEQ ID NO: 6611 - protein, 492 aa, Dictyostelium discoideum; identical to SEQ ID NO: 3860

SEQ ID NO: 6612 - DNA, 1545 bp, Synechococcus sp; identical to SEQ ID NO: 3861
  CDS (267)..(1268)

SEQ ID NO: 6613 - protein, 333 aa, Synechococcus sp; identical to SEQ ID NO: 3862

SEQ ID NO: 6614 - DNA, 1452 bp, Arabidopsis thaliana; identical to SEQ ID NO: 3863
  CDS (1)..(1452)

SEQ ID NO: 6615 - protein, 483 aa, Arabidopsis thaliana; identical to SEQ ID NO: 3864

SEQ ID NO: 6616 - DNA, 1398 bp, Arabidopsis thaliana; identical to SEQ ID NO: 3865
  CDS (1)..(1398)

SEQ ID NO: 6617 - protein, 465 aa, Arabidopsis thaliana; identical to SEQ ID NO: 3866

SEQ ID NO: 6618 - DNA, 1856 bp, Drosophila melanogaster; identical to SEQ ID NO: 3867
  CDS (77)..(1762)

SEQ ID NO: 6619 - protein, 561 aa, Drosophila melanogaster; identical to SEQ ID NO: 3868

SEQ ID NO: 6620 - DNA, 1869 bp, Synechocystis sp; identical to SEQ ID NO: 3869
  CDS (233)..(1231)

SEQ ID NO: 6621 - protein, 332 aa, Synechocystis sp; identical to SEQ ID NO: 3870

SEQ ID NO: 6622 - DNA, 834 bp, Mus musculus; identical to SEQ ID NO: 3871
  CDS (1)..(834)

SEQ ID NO: 6623 - protein, 277 aa, Mus musculus; identical to SEQ ID NO: 3872

SEQ ID NO: 6624 - DNA, 1200 bp, Homo sapiens; identical to SEQ ID NO: 3873
  CDS (180)..(965)

SEQ ID NO: 6625 - protein, 261 aa, Homo sapiens; identical to SEQ ID NO: 3874

SEQ ID NO: 6626 - DNA, 822 bp, Drosophila melanogaster; identical to SEQ ID NO: 3875
  CDS (40)..(822)

SEQ ID NO: 6627 - protein, 260 aa, Drosophila melanogaster; identical to SEQ ID NO: 3876

SEQ ID NO: 6628 - DNA, 1823 bp, Mus musculus; identical to SEQ ID NO: 3877
  CDS (6)..(1652)

SEQ ID NO: 6629 - protein, 548 aa, Mus musculus; identical to SEQ ID NO: 3878

SEQ ID NO: 6630 - DNA, 627 bp, Clostridium perfringens; identical to SEQ ID NO: 3879
  CDS (1)..(627)

SEQ ID NO: 6631 - protein, 208 aa, Clostridium perfringens; identical to SEQ ID NO: 3880

SEQ ID NO: 6632 - DNA, 630 bp, Clostridium tetani; identical to SEQ ID NO: 3881
  CDS (1)..(630)

SEQ ID NO: 6633 - protein, 209 aa, Clostridium tetani; identical to SEQ ID NO: 3882

SEQ ID NO: 6634 - DNA, 678 bp, Halobacterium sp; identical to SEQ ID NO: 3883
  CDS (1)..(678)

SEQ ID NO: 6635 - protein, 225 aa, Halobacterium sp; identical to SEQ ID NO: 3884

SEQ ID NO: 6636 - DNA, 630 bp, Lactobacillus plantarum; identical to SEQ ID NO: 3885
  CDS (1)..(630)

SEQ ID NO: 6637 - protein, 209 aa, Lactobacillus plantarum; identical to SEQ ID NO: 3886

SEQ ID NO: 6638 - DNA, 633 bp, Oceanobacillus iheyensis; identical to SEQ ID NO: 3887
  CDS (1)..(633)

SEQ ID NO: 6639 - protein, 210 aa, Oceanobacillus iheyensis; identical to SEQ ID NO: 3888

SEQ ID NO: 6640 - DNA, 651 bp, Pasteurella multocida; identical to SEQ ID NO: 3889
  CDS (1)..(651)

SEQ ID NO: 6641 - protein, 216 aa, Pasteurella multocida; identical to SEQ ID NO: 3890

SEQ ID NO: 6642 - DNA, 639 bp, Shewanella oneidensis; identical to SEQ ID NO: 3891
  CDS (1)..(639)

SEQ ID NO: 6643 - protein, 212 aa, Shewanella oneidensis; identical to SEQ ID NO: 3892

SEQ ID NO: 6644 - DNA, 624 bp, Staphylococcus epidermidis; identical to SEQ ID NO: 3893
  CDS (1)..(624)

SEQ ID NO: 6645 - protein, 207 aa, Staphylococcus epidermidis; identical to SEQ ID NO: 3894

SEQ ID NO: 6646 - DNA, 627 bp, Streptococcus pyogenes; identical to SEQ ID NO: 3895
  CDS (1)..(627)

SEQ ID NO: 6647 - protein, 208 aa, Streptococcus pyogenes; identical to SEQ ID NO: 3896

SEQ ID NO: 6648 - DNA, 642 bp, Vibrio cholerae; identical to SEQ ID NO: 3897
  CDS (1)..(642)

SEQ ID NO: 6649 - protein, 213 aa, Vibrio cholerae; identical to SEQ ID NO: 3898

SEQ ID NO: 6650 - DNA, 642 bp, Vibrio parahaemolyticus; identical to SEQ ID NO: 3899
  CDS (1)..(642)

SEQ ID NO: 6651 - protein, 213 aa, Vibrio parahaemolyticus; identical to SEQ ID NO: 3900

SEQ ID NO: 6652 - DNA, 816 bp, Xenopus laevis; identical to SEQ ID NO: 3901
  CDS (1)..(816)

SEQ ID NO: 6653 - protein, 271 aa, Xenopus laevis; identical to SEQ ID NO: 3902

SEQ ID NO: 6654 - DNA, 21 bp, artificial sequence
  primer
atggcgcttcgtcgccccctt

SEQ ID NO: 6655 - DNA, 27 bp, artificial sequence
  primer
ttattcaaagaactgacttattttcgc

SEQ ID NO: 6656 - DNA, 2374 bp, Escherichia coli K12; identical to SEQ ID NO: 1805
  CDS (86)..(2281)

SEQ ID NO: 6657 - protein, 731 aa, Escherichia coli K12; identical to SEQ ID NO: 1806

SEQ ID NO: 6658 - DNA, 2961 bp, Hafnia alvei; identical to SEQ ID NO: 1807
  CDS (185)..(2404)

SEQ ID NO: 6659 - protein, 739 aa, Hafnia alvei; identical to SEQ ID NO: 1808

SEQ ID NO: 6660 - DNA, 4341 bp, Escherichia coli; identical to SEQ ID NO: 1809
  CDS (660)..(2858)

SEQ ID NO: 6661 - protein, 732 aa, Escherichia coli; identical to SEQ ID NO: 1810

SEQ ID NO: 6662 - DNA, 1850 bp, Bacillus subtilis; identical to SEQ ID NO: 1811
  CDS (312)..(1784)

SEQ ID NO: 6663 - protein, 490 aa, Bacillus subtilis; identical to SEQ ID NO: 1812

SEQ ID NO: 6664 - DNA, 3091 bp, Lactobacillus sp; identical to SEQ ID NO: 1813
  CDS (572)..(2767)

SEQ ID NO: 6665 - protein, 731 aa, Lactobacillus sp; identical to SEQ ID NO: 1814

SEQ ID NO: 6666 - DNA, 1449 bp, Bacillus halodurans; identical to SEQ ID NO: 1815
  CDS (1)..(1449)

SEQ ID NO: 6667 - protein, 482 aa, Bacillus halodurans; identical to SEQ ID NO: 1816

SEQ ID NO: 6668 - DNA, 2196 bp, Sinorhizobium meliloti; identical to SEQ ID NO: 1817
  CDS (1)..(2196)

SEQ ID NO: 6669 - protein, 731 aa, Sinorhizobium meliloti; identical to SEQ ID NO: 1818

SEQ ID NO: 6670 - DNA, 1380 bp, Listeria innocua; identical to SEQ ID NO: 1819
  CDS (1)..(1380)

SEQ ID NO: 6671 - protein, 459 aa, Listeria innocua; identical to SEQ ID NO: 1820

SEQ ID NO: 6672 - DNA, 2307 bp, Yersinia pestis; identical to SEQ ID NO: 1821
  CDS (1)..(2307)

SEQ ID NO: 6673 - protein, 768 aa, Yersinia pestis; identical to SEQ ID NO: 1822

SEQ ID NO: 6674 - DNA, 2145 bp, Salmonella enterica subsp. enterica serovar Typhi; identical to SEQ ID NO: 1823
  CDS (1)..(2145)

SEQ ID NO: 6675 - protein, 714 aa, Salmonella enterica subsp. enterica serovar Typhi; identical to SEQ ID NO: 1824

SEQ ID NO: 6676 - DNA, 1467 bp, Nostoc sp. PCC 7120; identical to SEQ ID NO: 1825
  CDS (1)..(1467)

SEQ ID NO: 6677 - protein, 488 aa, Nostoc sp. PCC 7120; identical to SEQ ID NO: 1826

SEQ ID NO: 6678 - DNA, 2163 bp, Yersinia pestis; identical to SEQ ID NO: 1827
  CDS (1)..(2163)

SEQ ID NO: 6679 - protein, 720 aa, Yersinia pestis; identical to SEQ ID NO: 1828

SEQ ID NO: 6680 - DNA, 2271 bp, Salmonella enterica subsp. enterica serovar Typhi; identical to SEQ ID NO: 1829
  CDS (1)..(2271)

SEQ ID NO: 6681 - protein, 756 aa, Salmonella enterica subsp. enterica serovar Typhi; identical to SEQ ID NO: 1830

SEQ ID NO: 6682 - DNA, 2148 bp, Escherichia coli; identical to SEQ ID NO: 1831
  CDS (1)..(2148)

SEQ ID NO: 6683 - protein, 715 aa, Escherichia coli; identical to SEQ ID NO: 1832

SEQ ID NO: 6684 - DNA, 2835 bp, Escherichia coli; identical to SEQ ID NO: 1833
  CDS (571)..(2712)

SEQ ID NO: 6685 - protein, 713 aa, Escherichia coli; identical to SEQ ID NO: 1834

SEQ ID NO: 6686 - DNA, 1446 bp, Clostridium acetobutylicum; identical to SEQ ID NO: 1835
  CDS (1)..(1446)

SEQ ID NO: 6687 - protein, 481 aa, Clostridium acetobutylicum; identical to SEQ ID NO: 1836

SEQ ID NO: 6688 - DNA, 1464 bp, Clostridium acetobutylicum; identical to SEQ ID NO: 1837
  CDS (1)..(1464)

SEQ ID NO: 6689 - protein, 487 aa, Clostridium acetobutylicum; identical to SEQ ID NO: 1838

SEQ ID NO: 6690 - DNA, 2256 bp, Pseudomonas aeruginosa; identical to SEQ ID NO: 1839
  CDS (1)..(2256)

SEQ ID NO: 6691 - protein, 751 aa, Pseudomonas aeruginosa; identical to SEQ ID NO: 1840

SEQ ID NO: 6692 - DNA, 2853 bp, Mycobacterium leprae; identical to SEQ ID NO: 1841
  CDS (1)..(2853)

SEQ ID NO: 6693 - protein, 950 aa, Mycobacterium leprae; identical to SEQ ID NO: 1842

SEQ ID NO: 6694 - DNA, 2202 bp, Vibrio cholerae; identical to SEQ ID NO: 1843
  CDS (1)..(2202)

SEQ ID NO: 6695 - protein, 733 aa, Vibrio cholerae; identical to SEQ ID NO: 1844

SEQ ID NO: 6696 - DNA, 2163 bp, Vibrio cholerae; identical to SEQ ID NO: 1845
  CDS (1)..(2163)

SEQ ID NO: 6697 - protein, 720 aa, Vibrio cholerae; identical to SEQ ID NO: 1846

SEQ ID NO: 6698 - DNA, 2163 bp, Haemophilus influenzae; identical to SEQ ID NO: 1847
  CDS (1)..(2163)

SEQ ID NO: 6699 - protein, 720 aa, Haemophilus influenzae; identical to SEQ ID NO: 1848

SEQ ID NO: 6700 - DNA, 2844 bp, Mycobacterium tuberculosis; identical to SEQ ID NO: 1849
  CDS (1)..(2844)

SEQ ID NO: 6701 - protein, 947 aa, Mycobacterium tuberculosis; identical to SEQ ID NO: 1850

SEQ ID NO: 6702 - DNA, 1476 bp, Streptococcus pneumoniae; identical to SEQ ID NO: 1851
  CDS (1)..(1476)

SEQ ID NO: 6703 - protein, 491 aa, Streptococcus pneumoniae; identical to SEQ ID NO: 1852

SEQ ID NO: 6704 - DNA, 1476 bp, Bacillus halodurans; identical to SEQ ID NO: 1853
  CDS (1)..(1476)

SEQ ID NO: 6705 - protein, 491 aa, Bacillus halodurans; identical to SEQ ID NO: 1854

SEQ ID NO: 6706 - DNA, 2349 bp, Sinorhizobium meliloti; identical to SEQ ID NO: 1855
  CDS (1)..(2349)

SEQ ID NO: 6707 - protein, 782 aa, Sinorhizobium meliloti; identical to SEQ ID NO: 1856

SEQ ID NO: 6708 - DNA, 1476 bp, Streptococcus pneumoniae; identical to SEQ ID NO: 1857
  CDS (1)..(1476)

SEQ ID NO: 6709 - protein, 491 aa, Streptococcus pneumoniae; identical to SEQ ID NO: 1858

SEQ ID NO: 6710 - DNA, 2271 bp, Escherichia coli; identical to SEQ ID NO: 1859
  CDS (1)..(2271)

SEQ ID NO: 6711 - protein, 756 aa, Escherichia coli; identical to SEQ ID NO: 1860

SEQ ID NO: 6712 - DNA, 1443 bp, Bacillus subtilis; identical to SEQ ID NO: 1861
  CDS (1)..(1443)

SEQ ID NO: 6713 - protein, 480 aa, Bacillus subtilis; identical to SEQ ID NO: 1862

SEQ ID NO: 6714 - DNA, 1452 bp, Synechocystis sp; identical to SEQ ID NO: 1863
  CDS (1)..(1452)

SEQ ID NO: 6715 - protein, 483 aa, Synechocystis sp; identical to SEQ ID NO: 1864

SEQ ID NO: 6716 - DNA, 2307 bp, Yersinia pseudotuberculosis IP 32953; identical to SEQ ID NO: 1865
  CDS (1)..(2307)

SEQ ID NO: 6717 - protein, 768 aa, Yersinia pseudotuberculosis IP 32953; identical to SEQ ID NO: 1866

SEQ ID NO: 6718 - DNA, 1467 bp, Symbiobacterium thermophilum; identical to SEQ ID NO: 1867
  CDS (1)..(1467)

SEQ ID NO: 6719 - protein, 488 aa, Symbiobacterium thermophilum; identical to SEQ ID NO: 1868

SEQ ID NO: 6720 - DNA, 1410 bp, Symbiobacterium thermophilum; identical to SEQ ID NO: 1869
  CDS (1)..(1410)

SEQ ID NO: 6721 - protein, 469 aa, Symbiobacterium thermophilum; identical to SEQ ID NO: 1870

SEQ ID NO: 6722 - DNA, 2154 bp, Erwinia carotovora; identical to SEQ ID NO: 1871
  CDS (1)..(2154)

SEQ ID NO: 6723 - protein, 717 aa, Erwinia carotovora; identical to SEQ ID NO: 1872

SEQ ID NO: 6724 - DNA, 2790 bp, Acinetobacter sp; identical to SEQ ID NO: 1873
  CDS (1)..(2790)

SEQ ID NO: 6725 - protein, 929 aa, Acinetobacter sp; identical to SEQ ID NO: 1874

SEQ ID NO: 6726 - DNA, 1482 bp, Bacillus thuringiensis; identical to SEQ ID NO: 1875
  CDS (1)..(1482)

SEQ ID NO: 6727 - protein, 493 aa, Bacillus thuringiensis; identical to SEQ ID NO: 1876

SEQ ID NO: 6728 - DNA, 1422 bp, Bacillus thuringiensis; identical to SEQ ID NO: 1877
  CDS (1)..(1422)

SEQ ID NO: 6729 - protein, 473 aa, Bacillus thuringiensis; identical to SEQ ID NO: 1878

SEQ ID NO: 6730 - DNA, 2358 bp, Rhodopseudomonas palustris; identical to SEQ ID NO: 1879
  CDS (1)..(2358)

SEQ ID NO: 6731 - protein, 785 aa, Rhodopseudomonas palustris; identical to SEQ ID NO: 1880

SEQ ID NO: 6732 - DNA, 2837 bp, Shigella boydii; identical to SEQ ID NO: 1881
  CDS (165)..(2435)

SEQ ID NO: 6733 - protein, 756 aa, Shigella boydii; identical to SEQ ID NO: 1882

SEQ ID NO: 6734 - DNA, 1380 bp, Listeria monocytogenes; identical to SEQ ID NO: 1883
  CDS (1)..(1380)

SEQ ID NO: 6735 - protein, 459 aa, Listeria monocytogenes; identical to SEQ ID NO: 1884

SEQ ID NO: 6736 - DNA, 1482 bp, Bacillus cereus; identical to SEQ ID NO: 1885
  CDS (1)..(1482)

SEQ ID NO: 6737 - protein, 493 aa, Bacillus cereus; identical to SEQ ID NO: 1886

SEQ ID NO: 6738 - DNA, 1422 bp, Bacillus cereus; identical to SEQ ID NO: 1887
  CDS (1)..(1422)

SEQ ID NO: 6739 - protein, 473 aa, Bacillus cereus; identical to SEQ ID NO: 1888

SEQ ID NO: 6740 - DNA, 1458 bp, Mycobacterium paratuberculosis; identical to SEQ ID NO: 1889
  CDS (1)..(1458)

SEQ ID NO: 6741 - protein, 485 aa, Mycobacterium paratuberculosis; identical to SEQ ID NO: 1890

SEQ ID NO: 6742 - DNA, 2853 bp, Mycobacterium paratuberculosis; identical to SEQ ID NO: 1891
  CDS (1)..(2853)

SEQ ID NO: 6743 - protein, 950 aa, Mycobacterium paratuberculosis; identical to SEQ ID NO: 1892

SEQ ID NO: 6744 - DNA, 2100 bp, Lactobacillus johnsonii; identical to SEQ ID NO: 1893
  CDS (1)..(2100)

SEQ ID NO: 6745 - protein, 699 aa, Lactobacillus johnsonii; identical to SEQ ID NO: 1894

SEQ ID NO: 6746 - DNA, 3625 bp, Vibrio parahaemolyticus; identical to SEQ ID NO: 1895
  CDS (1451)..(3625)

SEQ ID NO: 6747 - protein, 724 aa, Vibrio parahaemolyticus; identical to SEQ ID NO: 1896

SEQ ID NO: 6748 - DNA, 2142 bp, Shigella flexneri; identical to SEQ ID NO: 1897
  CDS (1)..(2142)

SEQ ID NO: 6749 - protein, 713 aa, Shigella flexneri; identical to SEQ ID NO: 1898

SEQ ID NO: 6750 - DNA, 2181 bp, Vibrio vulnificus; identical to SEQ ID NO: 1899
  CDS (1)..(2181)

SEQ ID NO: 6751 - protein, 726 aa, Vibrio vulnificus; identical to SEQ ID NO: 1900

SEQ ID NO: 6752 - DNA, 2307 bp, Photorhabdus luminescens; identical to SEQ ID NO: 1901
  CDS (1)..(2307)

SEQ ID NO: 6753 - protein, 768 aa, Photorhabdus luminescens; identical to SEQ ID NO: 1902

SEQ ID NO: 6754 - DNA, 1404 bp, Gloeobacter violaceus; identical to SEQ ID NO: 1903
  CDS (1)..(1404)

SEQ ID NO: 6755 - protein, 467 aa, Gloeobacter violaceus; identical to SEQ ID NO: 1904

SEQ ID NO: 6756 - DNA, 2259 bp, Chromobacterium violaceum; identical to SEQ ID NO: 1905
  CDS (1)..(2259)

SEQ ID NO: 6757 - protein, 752 aa, Chromobacterium violaceum; identical to SEQ ID NO: 1906

SEQ ID NO: 6758 - DNA, 1251 bp, Chromobacterium violaceum; identical to SEQ ID NO: 1907
  CDS (1)..(1251)

SEQ ID NO: 6759 - protein, 416 aa, Chromobacterium violaceum; identical to SEQ ID NO: 1908

SEQ ID NO: 6760 - DNA, 2352 bp, Fusobacterium nucleatum subsp; identical to SEQ ID NO: 1909
  CDS (1)..(2352)

SEQ ID NO: 6761 - protein, 783 aa, Fusobacterium nucleatum subsp; identical to SEQ ID NO: 1910

SEQ ID NO: 6762 - DNA, 2196 bp, Shigella flexneri; identical to SEQ ID NO: 1911
  CDS (1)..(2196)

SEQ ID NO: 6763 - protein, 731 aa, Shigella flexneri; identical to SEQ ID NO: 1912

SEQ ID NO: 6764 - DNA, 2271 bp, Bordetella pertussis; identical to SEQ ID NO: 1913
  CDS (1)..(2271)

SEQ ID NO: 6765 - protein, 756 aa, Bordetella pertussis; identical to SEQ ID NO: 1914

SEQ ID NO: 6766 - DNA, 2271 bp, Bordetella parapertussis; identical to SEQ ID NO: 1915
  CDS (1)..(2271)

SEQ ID NO: 6767 - protein, 756 aa, Bordetella parapertussis; identical to SEQ ID NO: 1916

SEQ ID NO: 6768 - DNA, 1422 bp, Bacillus cereus; identical to SEQ ID NO: 1917
  CDS (1)..(1422)

SEQ ID NO: 6769 - protein, 473 aa, Bacillus cereus; identical to SEQ ID NO: 1918

SEQ ID NO: 6770 - DNA, 1422 bp, Bacillus anthracis; identical to SEQ ID NO: 1919
  CDS (1)..(1422)

SEQ ID NO: 6771 - protein, 473 aa, Bacillus anthracis; identical to SEQ ID NO: 1920

SEQ ID NO: 6772 - DNA, 2271 bp, Shigella flexneri; identical to SEQ ID NO: 1921
  CDS (1)..(2271)

SEQ ID NO: 6773 - protein, 756 aa, Shigella flexneri; identical to SEQ ID NO: 1922

SEQ ID NO: 6774 - DNA, 2136 bp, Shigella flexneri; identical to SEQ ID NO: 1923
  CDS (1)..(2136)

SEQ ID NO: 6775 - protein, 711 aa, Shigella flexneri; identical to SEQ ID NO: 1924

SEQ ID NO: 6776 - DNA, 2127 bp, Escherichia coli; identical to SEQ ID NO: 1925
  CDS (1)..(2127)

SEQ ID NO: 6777 - protein, 708 aa, Escherichia coli; identical to SEQ ID NO: 1926

SEQ ID NO: 6778 - DNA, 1563 bp, Oryza sativa; identical to SEQ ID NO: 1927
  CDS (1)..(1563)

SEQ ID NO: 6779 - protein, 520 aa, Oryza sativa; identical to SEQ ID NO: 1928

SEQ ID NO: 6780 - DNA, 2181 bp, Vibrio parahaemolyticus; identical to SEQ ID NO: 1929
  CDS (1)..(2181)

SEQ ID NO: 6781 - protein, 726 aa, Vibrio parahaemolyticus; identical to SEQ ID NO: 1930

SEQ ID NO: 6782 - DNA, 4026 bp, Vibrio parahaemolyticus; identical to SEQ ID NO: 1931
  CDS (1779)..(3914)

SEQ ID NO: 6783 - protein, 711 aa, Vibrio parahaemolyticus; identical to SEQ ID NO: 1932

SEQ ID NO: 6784 - DNA, 1461 bp, Clostridium tetani; identical to SEQ ID NO: 1933
  CDS (1)..(1461)

SEQ ID NO: 6785 - protein, 486 aa, Clostridium tetani; identical to SEQ ID NO: 1934

SEQ ID NO: 6786 - DNA, 1416 bp, Clostridium tetani; identical to SEQ ID NO: 1935
  CDS (1)..(1416)

SEQ ID NO: 6787 - protein, 471 aa, Clostridium tetani; identical to SEQ ID NO: 1936

SEQ ID NO: 6788 - DNA, 2766 bp, Bradyrhizobium japonicum; identical to SEQ ID NO: 1937
  CDS (1)..(2766)

SEQ ID NO: 6789 - protein, 921 aa, Bradyrhizobium japonicum; identical to SEQ ID NO: 1938

SEQ ID NO: 6790 - DNA, 2517 bp, Bradyrhizobium japonicum; identical to SEQ ID NO: 1939
  CDS (1)..(2517)

SEQ ID NO: 6791 - protein, 838 aa, Bradyrhizobium japonicum; identical to SEQ ID NO: 1940

SEQ ID NO: 6792 - DNA, 2181 bp, Vibrio vulnificus; identical to SEQ ID NO: 1941
  CDS (1)..(2181)

SEQ ID NO: 6793 - protein, 726 aa, Vibrio vulnificus; identical to SEQ ID NO: 1942

SEQ ID NO: 6794 - DNA, 2109 bp, Vibrio vulnificus; identical to SEQ ID NO: 1943
  CDS (1)..(2109)

SEQ ID NO: 6795 - protein, 702 aa, Vibrio vulnificus; identical to SEQ ID NO: 1944

SEQ ID NO: 6796 - DNA, 2163 bp, Shewanella oneidensis; identical to SEQ ID NO: 1945
  CDS (1)..(2163)

SEQ ID NO: 6797 - protein, 720 aa, Shewanella oneidensis; identical to SEQ ID NO: 1946

SEQ ID NO: 6798 - DNA, 1419 bp, Oceanobacillus iheyensis; identical to SEQ ID NO: 1947
  CDS (1)..(1419)

SEQ ID NO: 6799 - protein, 472 aa, Oceanobacillus iheyensis; identical to SEQ ID NO: 1948

SEQ ID NO: 6800 - DNA, 2154 bp, Escherichia coli O6; identical to SEQ ID NO: 1949
  CDS (1)..(2154)

SEQ ID NO: 6801 - protein, 717 aa, Escherichia coli O6; identical to SEQ ID NO: 1950

SEQ ID NO: 6802 - DNA, 2271 bp, Escherichia coli O6; identical to SEQ ID NO: 1951
  CDS (1)..(2271)

SEQ ID NO: 6803 - protein, 756 aa, Escherichia coli O6; identical to SEQ ID NO: 1952

SEQ ID NO: 6804 - DNA, 2370 bp, Escherichia coli O6; identical to SEQ ID NO: 1953
  CDS (1)..(2370)

SEQ ID NO: 6805 - protein, 789 aa, Escherichia coli O6; identical to SEQ ID NO: 1954

SEQ ID NO: 6806 - DNA, 2136 bp, Escherichia coli O6; identical to SEQ ID NO: 1955
  CDS (1)..(2136)

SEQ ID NO: 6807 - protein, 711 aa, Escherichia coli O6; identical to SEQ ID NO: 1956

SEQ ID NO: 6808 - DNA, 2208 bp, Escherichia coli O6; identical to SEQ ID NO: 1957
  CDS (1)..(2208)

SEQ ID NO: 6809 - protein, 735 aa, Escherichia coli O6; identical to SEQ ID NO: 1958

SEQ ID NO: 6810 - DNA, 2142 bp, Escherichia coli O6; identical to SEQ ID NO: 1959
  CDS (1)..(2142)

SEQ ID NO: 6811 - protein, 713 aa, Escherichia coli O6; identical to SEQ ID NO: 1960

SEQ ID NO: 6812 - DNA, 1488 bp, Thermoanaerobacter tengcongensis; identical to SEQ ID NO: 1961
  CDS (1)..(1488)

SEQ ID NO: 6813 - protein, 495 aa, Thermoanaerobacter tengcongensis; identical to SEQ ID NO: 1962

SEQ ID NO: 6814 - DNA, 1419 bp, Thermoanaerobacter tengcongensis; identical to SEQ ID NO: 1963
  CDS (1)..(1419)

SEQ ID NO: 6815 - protein, 472 aa, Thermoanaerobacter tengcongensis; identical to SEQ ID NO: 1964

SEQ ID NO: 6816 - DNA, 2352 bp, Fusobacterium nucleatum; identical to SEQ ID NO: 1965
  CDS (1)..(2352)

SEQ ID NO: 6817 - protein, 783 aa, Fusobacterium nucleatum; identical to SEQ ID NO: 1966

SEQ ID NO: 6818 - DNA, 1431 bp, Clostridium perfringens; identical to SEQ ID NO: 1967
  CDS (1)..(1431)

SEQ ID NO: 6819 - protein, 476 aa, Clostridium perfringens; identical to SEQ ID NO: 1968

SEQ ID NO: 6820 - DNA, 1455 bp, Clostridium perfringens; identical to SEQ ID NO: 1969
  CDS (1)..(1455)

SEQ ID NO: 6821 - protein, 484 aa, Clostridium perfringens; identical to SEQ ID NO: 1970

SEQ ID NO: 6822 - DNA, 2280 bp, Ralstonia solanacearum; identical to SEQ ID NO: 1971
  CDS (1)..(2280)

SEQ ID NO: 6823 - protein, 759 aa, Ralstonia solanacearum; identical to SEQ ID NO: 1972

SEQ ID NO: 6824 - DNA, 2271 bp, Salmonella typhimurium; identical to SEQ ID NO: 1973
  CDS (1)..(2271)

SEQ ID NO: 6825 - protein, 756 aa, Salmonella typhimurium; identical to SEQ ID NO: 1974

SEQ ID NO: 6826 - DNA, 2136 bp, Salmonella typhimurium; identical to SEQ ID NO: 1975
  CDS (1)..(2136)

SEQ ID NO: 6827 - protein, 711 aa, Salmonella typhimurium; identical to SEQ ID NO: 1976

SEQ ID NO: 6828 - DNA, 2199 bp, Salmonella typhimurium; identical to SEQ ID NO: 1977
  CDS (1)..(2199)

SEQ ID NO: 6829 - protein, 732 aa, Salmonella typhimurium; identical to SEQ ID NO: 1978

SEQ ID NO: 6830 - DNA, 2142 bp, Salmonella typhimurium; identical to SEQ ID NO: 1979
  CDS (1)..(2142)

SEQ ID NO: 6831 - protein, 713 aa, Salmonella typhimurium; identical to SEQ ID NO: 1980

SEQ ID NO: 6832 - DNA, 2136 bp, Vibrio vulnificus; identical to SEQ ID NO: 1981
  CDS (1)..(2136)

SEQ ID NO: 6833 - protein, 711 aa, Vibrio vulnificus; identical to SEQ ID NO: 1982

SEQ ID NO: 6834 - DNA, 2163 bp, Pasteurella multocida; identical to SEQ ID NO: 1983
  CDS (1)..(2163)

SEQ ID NO: 6835 - protein, 720 aa, Pasteurella multocida; identical to SEQ ID NO: 1984

SEQ ID NO: 6836 - DNA, 2139 bp, Moritella japonica; identical to SEQ ID NO: 1985
  CDS (1)..(2139)

SEQ ID NO: 6837 - protein, 712 aa, Moritella japonica; identical to SEQ ID NO: 1986

SEQ ID NO: 6838 - DNA, 1479 bp, Streptomyces coelicolor; identical to SEQ ID NO: 1987
  CDS (1)..(1479)

SEQ ID NO: 6839 - protein, 492 aa, Streptomyces coelicolor; identical to SEQ ID NO: 1988

SEQ ID NO: 6840 - DNA, 2130 bp, Eikenella corrodens; identical to SEQ ID NO: 1989
  CDS (1)..(2130)

SEQ ID NO: 6841 - protein, 709 aa, Eikenella corrodens; identical to SEQ ID NO: 1990

SEQ ID NO: 6842 - DNA, 2271 bp, Escherichia coli; identical to SEQ ID NO: 1859
  CDS (4)..(2271)

SEQ ID NO: 6843 - protein, 755 aa, Escherichia coli; identical to SEQ ID NO: 1992

SEQ ID NO: 6844 - DNA, 2196 bp, Lactobacillus sp; identical to SEQ ID NO: 1993
  CDS (1)..(2196)

SEQ ID NO: 6845 - protein, 731 aa, Lactobacillus sp; identical to SEQ ID NO: 1814

SEQ ID NO: 6846 - DNA, 1482 bp, Bacillus anthracis; identical to SEQ ID NO: 1995
  CDS (1)..(1482)

SEQ ID NO: 6847 - protein, 493 aa, Bacillus anthracis; identical to SEQ ID NO: 1996

SEQ ID NO: 6848 - DNA, 1383 bp, Bacillus cereus; identical to SEQ ID NO: 1997
  CDS (1)..(1383)

SEQ ID NO: 6849 - protein, 460 aa, Bacillus cereus; identical to SEQ ID NO: 1998

SEQ ID NO: 6850 - DNA, 20 bp, artificial sequence
  primer
atggggcagggttttccacc

SEQ ID NO: 6851 - DNA, 25 bp, artificial sequence
  primer
ttacttcaacacataaccgtacaac

SEQ ID NO: 6852 - DNA, 930 bp, Escherichia coli K12
  CDS (1)..(930)
atgaccacgaagaaagctgattacatttggttcaatggggagatggttcgctgggaagacgcgaaggtgcatgtgatgtcgcacgcgctgcactatggcacctcggtttttgaaggcatccgttgctacgactcgcacaaaggaccggttgtattccgccatcgtgagcatatgcagcgtctgcatgactccgccaaaatctatcgcttcccggtttcgcagagcattgatgagctgatggaagcttgtcgtgacgtgatccgcaaaaacaatctcaccagcgcctatatccgtccgctgatcttcgttggtgatgttggcatgggcgtaaacccgccagcgggatactcaaccgacgtgattatcgccgctttcccgtggggagcgtatctgggcgcagaagcgctggagcaggggatcgatgcgatggtttcctcctggaaccgcgcagcaccaaacaccatcccgacggcggcaaaagccggtggtaactacctctcttccctgctggtgggtagcgaagcgcgccgccacggttatcaggaaggtatcgcgttggatgtgaatggttacatctctgaaggcgcaggcgaaaacctgtttgaagtgaaagacggcgtgctgttcaccccaccgttcacctcatccgcgctgccgggtattacccgtgatgccatcatcaaactggcaaaagagctgggaattgaagtgcgtgagcaggtgctgtcgcgcgaatccctgtacctggcggatgaagtgtttatgtccggtacggcggcagaaatcacgccagtgcgcagcgtagacggtattcaggttggcgaaggccgttgtggcccggttaccaaacgcattcagcaagccttcttcggcctcttcactggcgaaaccgaagataaatggggctggttagatcaagttaatcaataa

SEQ ID NO: 6853 - protein, 309 aa, Escherichia coli K12
MTTKKADYIWFNGEMVRWEDAKVHVMSHALHYGTSVFEGIRCYDSHKGPVVFRHREHMQRLHDSAKIYRFPVSQSIDELMEACRDVIRKNNLTSAYIRPLIFVGDVGMGVNPPAGYSTDVIIAAFPWGAYLGAEALEQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDQVNQ

SEQ ID NO: 6854 - DNA, 1032 bp, Haemophilus influenzae
  CDS (1)..(1032)
atgaaagacttagactggaataaccttggttttagttatattaaaacagattaccgcttcatcgctcactggaaagatggcaaatgggacgaaggaaaactcactacagatagcacattacatattcacgaaggttcaaccgctcttcactacggtcagcaatgttttgaaggattaaaggcttaccgttgcaaagatggttcaatcaacttattccgcccgcaagcaaatgcagagcgtatgcaacgtaccgcagaccgtcttttaatgccacgcgtaccaactgaattattcgtgcgtgcatgtaaagaagtggttaaagctaaccaagattggttgggtccttacggttctggtgcaaccttatacttacgtccattcttaattggcgtgggcgaaaatatcggcgtgaaaacggcaccagagtttattttctctgttttttgttgcccagtgggtgcttacttcaaaggtggtttggctccatcaaactttatcacgaccgattatgaccgtgctgcaccaatgggcactggtggtgtgaaagtgggtgggaactacgcagcaagcttacttccacacgaattagccgcagaacaaggtacgccagaacgtaaatttgcggatgcaatctatttagatccaaaaactcacaccaaaattgaagaagtcggtgcggcaaacttctttgggatcacaaaagacaataaattcatcacaccaaaatcagaatctattttaccaagtatcactaaatactctcttttacatatcgcaaaagagcgtttaggtatggaagctattgaaggcgatgtgtatatcgatcaactcgatcaattcgtagaagctggtgcgtgcggtacagcggcggtgattaccccagtgggcggcattcaacacaacggaaaattccacgtattcgattcagaaactgaagtaggccctgttacccgtcgtctttatgatgaattaacaggcattcaattcggtgatatcgaagcacctgaaggctggattgtgaaagtagaataa

SEQ ID NO: 6855 - protein, 343 aa, Haemophilus influenzae
MKDLDWNNLGFSYIKTDYRFIAHWKDGKWDEGKLTTDSTLHIHEGSTALHYGQQCFEGLKAYRCKDGSINLFRPQANAERMQRTADRLLMPRVPTELFVRACKEVVKANQDWLGPYGSGATLYLRPFLIGVGENIGVKTAPEFIFSVFCCPVGAYFKGGLAPSNFITTDYDRAAPMGTGGVKVGGNYAASLLPHELAAEQGTPERKFADAIYLDPKTHTKIEEVGAANFFGITKDNKFITPKSESILPSITKYSLLHIAKERLGMEAIEGDVYIDQLDQFVEAGACGTAAVITPVGGIQHNGKFHVFDSETEVGPVTRRLYDELTGIQFGDIEAPEGWIVKVE

SEQ ID NO: 6856 - DNA, 1089 bp, Xylella fastidiosa
  CDS (1)..(1089)
atgtccatttcgttcgatattgcccgctcattgtctaccacttctgatgaagcgctctctatgatcctgcaagcgccagggtttggtgttcatttcactgatcatatgattgctatcgcctgggataaggacaatggttggcacgacgcccaggtacgcgcctatgggccattgttgctggatcctgccgctgctgtgctgcactacgggcaagagattttcgaaggaatcaaagcatatcgccatgctgatggttcgatctggacgttccgcccagaggccaacgctcgccgcttgcagcgttcggccaaacgattagtgttgccagagttgccggtggaactgtttacagaatcgttgcgtcaactcattgcagtggatgcccgctgggttccttcagcaccagaagccagcctgtattttcgtcccttcatgattgccacagaagcgtacttaggcgtgcgggctgcgcagcacgccgcttactacctgatcgccagccctgctggcccgtatttcgctaaaggtgttgctcccgtgtcgatctggttgtcgacagactgtgcccgtgctgccctagggggcacgggtgcggtgaagtgcggcggcaattatgccgcctcgttgctgccgcaacaggtggcgcaggcccagggatgctctcaggtactgttccttgatccggttgagggcaaatatctggaggagctgggagggatgaatgtgtttctcgtctacacagacggcaccttggtcacaccagcgttgtctggcagcatcctcgaaggtatcacccgcgagagtatcttgcagcttgctcgtgatcgagggatgtgtgttgaggaacgtaaggtagcaattgaggagtggaaagagggcgtagtttccggtgcgatcagcgaggtattcgcttgtggtacggctgctgtgatcactccaattggtgaattgaaagcggagggtttttcggtcggaaacatcaacgcaccacctggcgaagttactctgtcgttgcgcaaggaactgaccgacatccagtacggccgtttgccagaccgttatgggtggatgacgtatttgaaggaataa

SEQ ID NO: 6857 - protein, 362 aa, Xylella fastidiosa
MSISFDIARSLSTTSDEALSMILQAPGFGVHFTDHMIAIAWDKDNGWHDAQVRAYGPLLLDPAAAVLHYGQEIFEGIKAYRHADGSIWTFRPEANARRLQRSAKRLVLPELPVELFTESLRQLIAVDARWVPSAPEASLYFRPFMIATEAYLGVRAAQHAAYYLIASPAGPYFAKGVAPVSIWLSTDCARAALGGTGAVKCGGNYAASLLPQQVAQAQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTYLKE

SEQ ID NO: 6858 - DNA, 924 bp, Pseudomonas aeruginosa
  CDS (1)..(924)
atgtcgatggccgatcgtgatggcgtgatctggtatgacggtgaactggtgcagtggcgcgacgcgaccacgcacgtgctgacccataccctgcactatggaatgggcgtgttcgagggcgtgcgcgcctacgacaccccgcagggcacggcgatcttccgcctgcaggcgcataccgaccggctgttcgactccgcgcacatcatgaacatgcagatcccgtacagccgcgacgagatcaacgaggcgacccgcgccgccgtgcgcgagaacaacctggaaagcgcctatatccgcccgatggtgttctacggaagcgaaggcatgggcctgcgcgccagcggcctgaaggtccatgtgatcatcgccgcctggagctggggcgcctacatgggcgaggaagccctgcagcaaggcatcaaggtgcgcaccagttccttcacccgccaccacgtcaacatctcgatgacccgcgccaagtccaacggcgcctacatcaactcgatgctggccctccaggaagcgatctccggcggcgccgacgaggccatgatgctcgatccggaaggctacgtggccgaaggctccggcgagaacatcttcatcatcaaggatggcgtgatctacaccccggaagtcaccgcctgcctgaacggcatcactcgtaacactatcctgaccctggccgccgaacacggttttaaactggtcgagaagcgcatcacccgcgacgaggtgtacatcgccgacgaggccttcttcactggcactgccgcggaagtcacgccgatccgcgaagtggacggtcgcaagatcggcgccggccgccgtggcccggtcaccgaaaagctgcagaaagcctatttcgacctggtcagcggcaagaccgaggcccacgccgagtggcgtaccctggtcaagtaa

SEQ ID NO: 6859 - protein, 307 aa, Pseudomonas aeruginosa
MSMADRDGVIWYDGELVQWRDATTHVLTHTLHYGMGVFEGVRAYDTPQGTAIFRLQAHTDRLFDSAHIMNMQIPYSRDEINEATRAAVRENNLESAYIRPMVFYGSEGMGLRASGLKVHVIIAAWSWGAYMGEEALQQGIKVRTSSFTRHHVNISMTRAKSNGAYINSMLALQEAISGGADEAMMLDPEGYVAEGSGENIFIIKDGVIYTPEVTACLNGITRNTILTLAAEHGFKLVEKRITRDEVYIADEAFFTGTAAEVTPIREVDGRKIGAGRRGPVTEKLQKAYFDLVSGKTEAHAEWRTLVK

SEQ ID NO: 6860 - DNA, 882 bp, Brucella melitensis
  CDS (1)..(882)
atggccgcttcagcagcagaacttgaaaaccgcatcgtatatgtcaacggcgaatacgtcgccgcccgcgatgcccgcatctccattttcgaccgtggctttctcttcggcgacggcatttacgaagtaactgccgttctggaaggcaagcttgtcaatagcgaaccgcatatgcaacgcttgcgccgctcgaccggcgaaatcggcattgcgatgccgatgagcgaagacgagatcgtcaccatcgaacgcgagctgatccgccgcaacaagctgaccgaaggtctggtctatctacaggtgacacgcggcaacggaggcgaccgcgattttgtgccagccgcaaacatgaagccttcggtggttctcttcacgcaggaagccaacctgctcgacaagccagcactcaagaccggcgcgcatgtgctttcactggacgatctgcgctggaagcgccgtgacatcaagacagtctgcctgctgccgcaggcgctcaccaaggaaattgccaagaatgccggttgcgacgaggcatggatgatcgaagacggttatgtgaccgaaggcgcatcttccacggcctatatcgtaaccagggacgatgttatcgtcacccggcccaacagcaatttcaccctgcccggttgcacgcggctttcgcttttgcaactgattacagagaccggcatgaagctggaagaacgcctcttcaccatcgatgaggcctatgcggcaaaagaagcctttcttacaagtgcgggaactttcgtcacgccgatcaccgttattgatggaaaaaccatcggcgacggaaagcccggcccgattgcccggcgcctgcgcgaagtctatctcgaccacgcccgccgcacggcaatctga

SEQ ID NO: 6861 - protein, 293 aa, Brucella melitensis
MAASAAELENRIVYVNGEYVAARDARISIFDRGFLFGDGIYEVTAVLEGKLVNSEPHMQRLRRSTGEIGIAMPMSEDEIVTIERELIRRNKLTEGLVYLQVTRGNGGDRDFVPAANMKPSVVLFTQEANLLDKPALKTGAHVLSLDDLRWKRRDIKTVCLLPQALTKEIAKNAGCDEAWMIEDGYVTEGASSTAYIVTRDDVIVTRPNSNFTLPGCTRLSLLQLITETGMKLEERLFTIDEAYAAKEAFLTSAGTFVTPITVIDGKTIGDGKPGPIARRLREVYLDHARRTAI

SEQ ID NO: 6862 - DNA, 870 bp, Listeria monocytogenes
  CDS (1)..(870)
atgaaagtattagtaaataaccatttagttgaaagagaagatgccacagttgacattgaagaccgcggatatcagtttggtgatggtgtatatgaagtagttcgtctatataatggaaaattctttacttataatgaacacattgatcgcttatatgctagtgcagcaaaaattgacttagttattccttattccaaagaagagctacgtgaattacttgaaaaattagttgccgaaaataatatcaatacagggaatgtctatttacaagtgactcgtggtgttcaaaacccacgtaatcatgtaatccctgatgatttccctctagaaggcgttttaacagcagcagctcgtgaagtacctagaaacgagcgtcaattcgttgaaggtggaacggcgattacagaagaagatgtgcgctggttacgctgtgatattaagagcttaaaccttttaggaaatattctagcaaaaaataaagcacatcaacaaaatgctttggaagctattttacatcgcggggaacaagtaacggaatgttctgcttcaaacgtttctattattaaagatggtgtattatggacgcatgcggcagataacttaatcttaaatggtatcactcgtcaagttatcattgatgttgcgaaaaagaatggcattcctgttaaagaagcggatttcactttaacagaccttcgtgaagcggatgaagtgttcatttcaagtacaactattgaaattacacctattacgcatattgacggagttcaagtagctgacggaaaacgtggaccaattacagcgcaacttcatcaatattttgtagaagaaatcactcgtgcatgtggcgaattagtgtttgcaaaataa

SEQ ID NO: 6863 - protein, 289 aa, Listeria monocytogenes
MKVLVNNHLVEREDATVDIEDRGYQFGDGVYEVVRLYNGKFFTYNEHIDRLYASAAKIDLVIPYSKEELRELLEKLVAENNINTGNVYLQVTRGVQNPRNHVIPDDFPLEGVLTAAAREVPRNERQFVEGGTAITEEDVRWLRCDIKSLNLLGNILAKNKAHQQNALEAILHRGEQVTECSASNVSIIKDGVLWTHAADNLILNGITRQVIIDVAKKNGIPVKEADFTLTDLREADEVFISSTTIEITPITHIDGVQVADGKRGPITAQLHQYFVEEITRACGELVFAK

SEQ ID NO: 6864 - DNA, 870 bp, Listeria innocua
  CDS (1)..(870)
atgaaagtactagtaaatgaccgtttagtagaaagaaatgatgctacagttgacgtagaagaccgtggataccaatttggtgatggagtatatgaagttgttcgtttatataatggtaaattttttacttataacgagcatatcgatcgtttatacgctagtgcagcaaaaattgacttagttattccttattccaaagaaacattacgagcgttattagacaaattagtagctgaaaataatatcaataccggaaatgtatatttacaagtaacaagaggagttcaaaatcctcgtaatcacgttcttccagatgatttccccttagaaggagtattaactgcagcagctcgtgaagtaccaagaaatgagcgtcaattcatagaaggcggctcagcaattaccgaagaagatgtacgctggttacgttgtgatattaaaagcttaaacttacttggaaatattttagcgaaaaacaaagcacatcaacaaaacgcgcttgaagctattttacatcgcggggagcaagttaccgagtgttctgcttctaacgtatccattattaaagatggggttttatggacacatgctgccgacaacctaattttaaatggtattactcgtcaagttattattgatgtagcgaaaaagaacggtattcctgtaaaagaagccgatttcactttaacagatttacgagaagcagatgaagtgtttatttccagtactacaattgaaatcacaccaattactcacattgatggagtacaagttgctgatggaaaacgtggtccaattaccgctcaacttcataattactttgtagaagaaatcgttcgcgcttgtggcgaattagaatatgcaaaataa

SEQ ID NO: 6865 - protein, 289 aa, Listeria innocua
MKVLVNDRLVERNDATVDVEDRGYQFGDGVYEVVRLYNGKFFTYNEHIDRLYASAAKIDLVIPYSKETLRALLDKLVAENNINTGNVYLQVTRGVQNPRNHVLPDDFPLEGVLTAAAREVPRNERQFIEGGSAITEEDVRWLRCDIKSLNLLGNILAKNKAHQQNALEAILHRGEQVTECSASNVSIIKDGVLWTHAADNLILNGITRQVIIDVAKKNGIPVKEADFTLTDLREADEVFISSTTIEITPITHIDGVQVADGKRGPITAQLHNYFVEEIVRACGELEYAK

SEQ ID NO: 6866 - DNA, 882 bp, Agrobacterium tumefaciens
  CDS (1)..(882)
atgagcgtcgataccgcaccccgatcaaccacctggacctatgttgacggtcaatggctgcccggcaatccgccgctcatcggcccgacctcgcatgccatgtggctggcctccacggtatttgacggcgcacgctggtttgatggcgtggcacccgatctcgatctgcattgccagcgtgtcaatcgctcagccaccaacatgggcatgaagccgaccatgacggcggaagagatcgagacgcttgcgcttgagggtgtgaggaaattcgacggcaggatggcgatctacatcaagccgatgtattgggccgaacacggcatgcccggcagcgttgtcgcgccggatgccagctccacccgttttgcgctctgcctgttcgaagcgccgatggacgccggcaagccgctgacgctcaccgtctcgccgctgcgtcgtccgtcgccggaaaccgcgatgaccgacgccaaggctggcagtctttatcccaatagcggccgcgccattctggaagcccgcgcacgcggtttcgacaatgccctgatgcgcgacatgaacggcaatgtcgccgaatccgcctcggccaacatcttcatggtcaaggacggtgtcgtcttcacgccggtgcccaaccgcacctttcttgccggcatcacccgttcgcgtgtgatcggtcttctgcgtcaggccggtttcgacgttcgggaagccacgctgtcggtcgaggatttcaacgaggctgatgaaatcttctgctcgggcaactattccaaggtttcgcctgtcgtgaagctggatgaccgcgaattgcaggcgggcccggtcgcgcgcaaggcgcttgatctctatatggattgggcacgtctcggcgcagacgtctga

SEQ ID NO: 6867 - protein, 293 aa, Agrobacterium tumefaciens
MSVDTAPRSTTWTYVDGQWLPGNPPLIGPTSHAMWLASTVFDGARWFDGVAPDLDLHCQRVNRSATNMGMKPTMTAEEIETLALEGVRKFDGRMAIYIKPMYWAEHGMPGSVVAPDASSTRFALCLFEAPMDAGKPLTLTVSPLRRPSPETAMTDAKAGSLYPNSGRAILEARARGFDNALMRDMNGNVAESASANIFMVKDGVVFTPVPNRTFLAGITRSRVIGLLRQAGFDVREATLSVEDFNEADEIFCSGNYSKVSPVVKLDDRELQAGPVARKALDLYMDWARLGADV

SEQ ID NO: 6868 - DNA, 1020 bp, Listeria innocua
  CDS (1)..(1020)
atgagtaaagatattgactggagtaatttagggtttagttatattaaaacggacaagcgttatatttcacattggaaagacggagcgtgggatgaaggtactttgacggaagataatacacttcatattagtgaaggttctactgcacttcattatggccaacaatgttttgaaggtttgaaagcatatcgttgtaaggatggttccattaacctttttcgtccagatcgtaatgctgctcgtattcaaaaaagttgtgaacgtttattaatgcctcatattccaacagaaaaatttattgatgcttgtatgcaagttgttcgtgcaaatgaagaatttgttccaccttatggtactggagcaactctttatttacgaccgtttgtaattggcgtaggtgataatattggcgttcatgcagctccagagtatattttctctgttttctgttcaccagttggtccttatttcaaaggcggaatggcaccaactaactttatcgtttctgactttgaccgtgccgctccaaatggaacaggtgcagcaaaagtaggcggtaactatgcagcaagtttacttccagggcaaaacgcaaaagatcgtaattttggggattgtatctacttggacccagctactcatacaaaaattgaagaagttggctcggctaatttctttggtattacaaaagacgataaatttattacgccgtattctccttctattttgccaagtatcacgaagtattcattactttatttggcagaacaccgtttaggtttaaaagcagaagaaggcgatgtatttattgataagttagatgaatttaaggaagcaggcgcatgtggaaccgccgcagttatcacaccaattggcggtattcaaacaaaagatgacttccatgtattttacagtgaaacagaagtagggccagtaacaaaacgcctatttgatgaactatgtggaattcaatttggagatgtagaagctccagaaggttggatttataaagtgaaataa

SEQ ID NO: 6869 - protein, 339 aa, Listeria innocua
MSKDIDWSNLGFSYIKTDKRYISHWKDGAWDEGTLTEDNTLHISEGSTALHYGQQCFEGLKAYRCKDGSINLFRPDRNAARIQKSCERLLMPHIPTEKFIDACMQVVRANEEFVPPYGTGATLYLRPFVIGVGDNIGVHAAPEYIFSVFCSPVGPYFKGGMAPTNFIVSDFDRAAPNGTGAAKVGGNYAASLLPGQNAKDRNFGDCIYLDPATHTKIEEVGSANFFGITKDDKFITPYSPSILPSITKYSLLYLAEHRLGLKAEEGDVFIDKLDEFKEAGACGTAAVITPIGGIQTKDDFHVFYSETEVGPVTKRLFDELCGIQFGDVEAPEGWIYKVK

SEQ ID NO: 6870 - DNA, 927 bp, Yersinia pestis
  CDS (1)..(927)
atgacgaagaaagcggattacatttggtttaacggcgaaatggttccatgggcagaagctaaagttcatgtgatgtctcacgcgttacactacggaacgtcagtcttcgaaggtgtccgttgctacgaatcccataaagggccggtagttttccgtcaccgtgagcatatgcagcgtttgcatgattccgccaaaatttatcgtatgcccgtctcccagtcagtggatgaactgatggaagcttgccgtgccacgctgcgcaaaaataatctgaccagtgcttatattcgcccgttagtctttattggtgatgtcggcatgggcgtgaatccaccggagggttataacactgacgtgatcattgccgctttcccatggggtgcttatctgggtgcagaagccttggagcaaggcattgatgctatggtgtcatcatggaaccgtgttgcacccaataccatcccaacggcggcgaaagcaggcggtaactacctttcatccttgctggtgggcagtgaagcacgtcgccacggctatcaggaagggattgcgctggatgttcatggttacctgtctgaaggtgccggtgagaacctgttcgaagtgaaagatggcatcctgttcacaccaccatttacctcgtctgccctgccgggtatcacccgtgatgccattatcaagctggcgaaagatatggggctggaagtgcgtgagcaagtgttgtcacgtgagtctctgtatctggccgatgaagtgtttatgtccggtactgcagcggaaattaccccagtacgcagcgtggatggtattcaggttggtattggcaagcgcggcccggtcacagccaaaattcaacaagcgttcttcggcttgtttaccggtgaaaccgaggacaaatggggctggctggatcaggttaatccataa

SEQ ID NO: 6871 - protein, 308 aa, Yersinia pestis
MTKKADYIWFNGEMVPWAEAKVHVMSHALHYGTSVFEGVRCYESHKGPVVFRHREHMQRLHDSAKIYRMPVSQSVDELMEACRATLRKNNLTSAYIRPLVFIGDVGMGVNPPEGYNTDVIIAAFPWGAYLGAEALEQGIDAMVSSWNRVAPNTIPTAAKAGGNYLSSLLVGSEARRHGYQEGIALDVHGYLSEGAGENLFEVKDGILFTPPFTSSALPGITRDAIIKLAKDMGLEVREQVLSRESLYLADEVFMSGTAAEITPVRSVDGIQVGIGKRGPVTAKIQQAFFGLFTGETEDKWGWLDQVNP

SEQ ID NO: 6872 - DNA, 927 bp, Halobacterium sp. NRC-1
  CDS (1)..(927)
atgcccagtttcagtgagatggacgtcgacaccatctggatggacggcgagttcgtcgactgggaggacgcacaagtacacgtcctcacccacgcactccactacgggtccggcatcttcgagggggtccgtgtctacgacaccgacaacggccccgcgatcttccggtgggacgaccacctccagcggttctacgaatcggcgaaaccctacgacctcgacatcgagttcacgcccgacgaactcaccgacgccaccgtcgagctcatccagcgccaagacctcgggtcctgttacatccgcccgctggcgtactacggctacgaatcactcggcgtctcccccggcgactgcccgaccgacgtcgccatcgccgcctggccgtggggcgcgtacctcggcgacgacgccctcgaaaacggcgtcgacgtgatggtgtcgacgtggcgcaagcacgcctccagccagatcccgacgaacgccaaaaccaccggcctctacgtcaacagcatgctcgccggcgaggaagcccggcgcaacggcttcaccgaagccatcgtcctcaacaaagagggcaacgtcgcggaaggccccggcgagaacatcttcctcgtgcgcgacggcgaactcttcacgcccggcctctccgagagcatcctcgacggcatcacccgcgacaccgtcatcacgctcgccgaggagcgcggctacaccgtccacgacgacgtctcgatctcgcgtggcgaactccacaccgccgacgagctcttcttcaccggctccgccgccgaagtcacgccgatcaagcaagtcgacaacgtcgaaatcggctccggaacccgcggcccggtcaccgaagagctccagaccgcgttcttcgacctcgtggaggccggcgaccgcgaggagtggttccactacgtctga

SEQ ID NO: 6873 - protein, 308 aa, Halobacterium sp. NRC-1
MPSFSEMDVDTIWMDGEFVDWEDAQVHVLTHALHYGSGIFEGVRVYDTDNGPAIFRWDDHLQRFYESAKPYDLDIEFTPDELTDATVELIQRQDLGSCYIRPLAYYGYESLGVSPGDCPTDVAIAAWPWGAYLGDDALENGVDVMVSTWRKHASSQIPTNAKTTGLYVNSMLAGEEARRNGFTEAIVLNKEGNVAEGPGENIFLVRDGELFTPGLSESILDGITRDTVITLAEERGYTVHDDVSISRGELHTADELFFTGSAAEVTPIKQVDNVEIGSGTRGPVTEELQTAFFDLVEAGDREEWFHYV

SEQ ID NO: 6874 - DNA, 849 bp, Staphylococcus aureus
  CDS (1)..(849)
atggaaaaaatttttttaaatggtgagtttgtaagtccaagtgaagcaaaggtttcatacaacgacagaggatacgtatttggcgatggtatttatgaatacattcgagtatataatggtaagttatttacagtaacagaacattatgaaagatttttacgtagtgccaatgagattggtttagatttaaattattctgtagaagaattaattgaactatctcgtaaattagttgatatgaatcaaattgaaactggggcaatttatattcaagcaacgcgtggtgtagctgaaaggaatcatagcttcccgacacctgaagtagaaccagcaattgttgcttatacaaagagttatgatcgtccttatgatcatttagaaaatggtgtgaatggtgttaccgttgaagatatccgatggttacgttgcgacattaaaagcttgaacttattaggaaatgtattagcaaaagaatatgctgtgaaatataatgcagttgaagcaattcaacatcgaggtgaaactgtaactgaaggatcttcaagtaatgcttatgcaattaaagacggtgtgatttatacacatccgattaacaactatattcttaatggtattacacgaattgtaattaaaaaaattgccgaagactataacatcccatttaaagaagaaacgtttactgtagatttcttgaaaaacgcagatgaagttattgtttcaagtacttcagctgaggttacacctgttattaaattagatggtgaaccaattaatgatggtaaagttggcccaattacacgtcaactacaagaaggatttgaaaagtatatagagtcacacagtatttaa

SEQ ID NO: 6875 - protein, 282 aa, Staphylococcus aureus
MEKIFLNGEFVSPSEAKVSYNDRGYVFGDGIYEYIRVYNGKLFTVTEHYERFLRSANEIGLDLNYSVEELIELSRKLVDMNQIETGAIYIQATRGVAERNHSFPTPEVEPAIVAYTKSYDRPYDHLENGVNGVTVEDIRWLRCDIKSLNLLGNVLAKEYAVKYNAVEAIQHRGETVTEGSSSNAYAIKDGVIYTHPINNYILNGITRIVIKKIAEDYNIPFKEETFTVDFLKNADEVIVSSTSAEVTPVIKLDGEPINDGKVGPITRQLQEGFEKYIESHSI

SEQ ID NO: 6876 - DNA, 936 bp, Aquifex aeolicus
  CDS (1)..(936)
atgctaaaatctttttccatggatttcgctttcttcgaaggcaaaatagtgcccgtggaagaggcaaaaataagcataatgaccaattccttccactacggcacggccatctttgaagggataagggcgtactggaacgaagaagaggaacaactctacatcctctttgcaaaggaacactacgaaagactcctcactaacgcaaggtgtctgtttatggaattaaactactctgctgaggaactcgttgaaattactaaagagatattaagaaaatctgagataagggaggacgtttacataagacctatagcttactttaaggacttgaaattaactcctaagttaatagactacacacccgaaatagcgatatacctctacaggttcggcaggtacctagacacttcaaagggtataagggcaaaggtttcttcttggaggaggaacgacgacaactcaataccatcccgctggaaggttgcgggggcctacgtgaacagtgcacttgcaaagactgaagccctcatgtctggatacgacgaggctatacttctcaactctcagggctacgttgcggaaggttcgggagaaaatatctttataataaaaaacggaaaggccataacaccttctcccaacgaacacatacttgaaggcataacgaggaacgcggtaataactcttttgaaaaaggaactagttgtggaggtggaggaaagaccaatagcgaggagtgagctttacaccgcggacgaggtgtttttgacggggacagctgccgaagtgactcccgtggtagagatagacaacaggaagataggaaacggagagataggtcctataacaaaacagcttcaggagttttactttaacgcagtaagggggaaaatccagaggtacaaaaagtggttaacgcccgtttatgataagtga

SEQ ID NO: 6877 - protein, 311 aa, Aquifex aeolicus
MLKSFSMDFAFFEGKIVPVEEAKISIMTNSFHYGTAIFEGIRAYWNEEEEQLYILFAKEHYERLLTNARCLFMELNYSAEELVEITKEILRKSEIREDVYIRPIAYFKDLKLTPKLIDYTPEIAIYLYRFGRYLDTSKGIRAKVSSWRRNDDNSIPSRWKVAGAYVNSALAKTEALMSGYDEAILLNSQGYVAEGSGENIFIIKNGKAITPSPNEHILEGITRNAVITLLKKELVVEVEERPIARSELYTADEVFLTGTAAEVTPVVEIDNRKIGNGEIGPITKQLQEFYFNAVRGKIQRYKKWLTPVYDK

SEQ ID NO: 6878 - DNA, 873 bp, Rickettsia prowazekii
  CDS (1)..(873)
atgacaatgataaaactagatcaaatttatgggtatatttggattaatggtgatttaatcccttatcaatttgcaaggattcatgttttaactcatagtctacattattcaggatcggtatttgagggtgagagagcttataacggaaaagtttttaaattaaaggaacataccgaaagattaatacaatcagcagaatcactaggtttgaaagtgccttatagtgtagatgagataataaaagctcatgaacttttaataatacaaaataatattaaggatgcgtatataagaccgcttatttggtgtggagatgagtcactaaatattactaatcctgatttgtctactaattttttgattgcaagtatttcatcaatgccaagatcttgcgaacaaagtgtgcatttgcatgtaagtagatggcgtaaagcaatgcctaatagcacaccggtacaatctaaatctgctgctcaatataatatggcaataacaagtaaaaaagaagctaaagctcttggctatgatgatgcattattactagattatgaagggtttattgctgaatgtactacaacaaatattttttttgttaaagataaaacattatatactcctattgctgataggtttttaaacggtatcacgcgcaagactattattgaaattgcaaaaagtttatgtctagaagtaaaagaagagcgtttaaaattagcgcaaatagaacattttactgggtgttttgtaacaggtacagcaattgaggtgcaaaatattagttctatagatcttggaaataaaaagattctttttgaagataataaaattgcagatctgttaaaaagagagtattggcgtattgttagaggatag

SEQ ID NO: 6879 - protein, 290 aa, Rickettsia prowazekii
MTMIKLDQIYGYIWINGDLIPYQFARIHVLTHSLHYSGSVFEGERAYNGKVFKLKEHTERLIQSAESLGLKVPYSVDEIIKAHELLIIQNNIKDAYIRPLIWCGDESLNITNPDLSTNFLIASISSMPRSCEQSVHLHVSRWRKAMPNSTPVQSKSAAQYNMAITSKKEAKALGYDDALLLDYEGFIAECTTTNIFFVKDKTLYTPIADRFLNGITRKTIIEIAKSLCLEVKEERLKLAQIEHFTGCFVTGTAIEVQNISSIDLGNKKILFEDNKIADLLKREYWRIVRG

SEQ ID NO: 6880 - DNA, 822 bp, Thermotoga maritima
  CDS (1)..(822)
atgctgatatggtggaggggaaagttccggcgcgcggatgaaatttcactggatttctctctgtttgaaaagtcgctccagggagcggtgtatgaaactctgagaacttacagtagggccccgtttgcggcttacaaacattacactaggctgaaaagatctgccgatttctttaatcttcctctttctctgagcttcgatgaattcacaaaggtgctgaaggcgggagctgatgagttcaaacaagaagtgagaatcaaagtctatcttttccctgattccggggaggttctctttgtgttctcaccgctcaatataccagacctggagacaggagtcgaggtgaaaatatcgaacgttcgaaggataccggatctttctactccaccagctctaaaaataactggacgcaccgacatagtgcttgcaagaagggaaatagtggactgctacgatgtgattttgctcggtttgaacgggcaggtctgtgagggaagtttcagcaatgtgtttctggtgaaagaaggcaaattgattacaccatcgcttgacagcggtattctggatggcatcacacgggaaaacgttataaagctcgcaaaaagtctcgagatacctgttgaagaaagagtagtgtgggtgtgggaactgttcgaagcggatgaaatgtttctcacacacacaagtgcgggagtggttcctgtcagaaggttgaacgagcactcgtttttcgaggaagagccaggacctgtgacagcgactttgatggaaaactttgagccttttgtcttaaatctggaggaaaactgggtgggaatatga

SEQ ID NO: 6881 - protein, 273 aa, Thermotoga maritima
MLIWWRGKFRRADEISLDFSLFEKSLQGAVYETLRTYSRAPFAAYKHYTRLKRSADFFNLPLSLSFDEFTKVLKAGADEFKQEVRIKVYLFPDSGEVLFVFSPLNIPDLETGVEVKISNVRRIPDLSTPPALKITGRTDIVLARREIVDCYDVILLGLNGQVCEGSFSNVFLVKEGKLITPSLDSGILDGITRENVIKLAKSLEIPVEERVVWVWELFEADEMFLTHTSAGVVPVRRLNEHSFFEEEPGPVTATLMENFEPFVLNLEENWVGI

SEQ ID NO: 6882 - DNA, 1077 bp, Deinococcus radiodurans
  CDS (1)..(1077)
atgcgccttacaatcctgggcatgaccgcgcacgacagccgccccgagcaggccaagaagctggccgacatcgactggagcaccctcggtttttcttacatccgtaccgacctgcgctacctcgcgcactggaaagacggcgagtgggacgcgggcacgctcaccgaggacaaccagattcatctggcggaaggctcgacggcgctgcactacggccagcagtgcttcgaggggctcaaggcgtaccgctgcgccgacggcagcatcaacctctttcgccccgaccagaacgcggcccggatgcggatgagctgccgccgcctgctgatgcccgaactcagcgacgagcagttcatcgacgcctgcttgcaagtcgtgcgcgccaacgagcattttttgccgccctacggcacgggcggaagcctctacctgcgccccttcgtcatcggcgtgggcgacaacatcggcgtgcgaacggcgcccgagttcattttcagcgtcttttgcgtgccggtcggcccctacttcaagggcgggctgacccccaccaacttcatcacctcggactatgaccgcgccgcgccgcacggcaccggggcggcgaaggtgggcggcaactacgccgcgagcctgctgcccggctacgaggccaaaaagcgcgactttgccgacgtgatttatctcgaccccgccacccacaccacaatcgaggaggcgggcgcggccaacttcttcgccatcacccaggacggccagaagttcgtgacgccgcagtcgccgtccattctgccgagcatcaccaagtacagcctgctgtggctcgccgagcaccggctcgggctggaagtcgaggaaggcgacattcgcatcgacgagctgggcaagttcagcgaggcgggcgcgtgcggcacggcggcggtcatcacgcccatcggcggcattcagcacggcgacgactttcacgtcttttattccgaaagcgagccggggccggtcacgcgccgcctgtacgacgaactggtcggcattcagtacggggataaggaagcgccggaaggctggattgtgaaggtgtag

SEQ ID NO: 6883 - protein, 358 aa, Deinococcus radiodurans
MRLTILGMTAHDSRPEQAKKLADIDWSTLGFSYIRTDLRYLAHWKDGEWDAGTLTEDNQIHLAEGSTALHYGQQCFEGLKAYRCADGSINLFRPDQNAARMRMSCRRLLMPELSDEQFIDACLQVVRANEHFLPPYGTGGSLYLRPFVIGVGDNIGVRTAPEFIFSVFCVPVGPYFKGGLTPTNFITSDYDRAAPHGTGAAKVGGNYAASLLPGYEAKKRDFADVIYLDPATHTTIEEAGAANFFAITQDGQKFVTPQSPSILPSITKYSLLWLAEHRLGLEVEEGDIRIDELGKFSEAGACGTAAVITPIGGIQHGDDFHVFYSESEPGPVTRRLYDELVGIQYGDKEAPEGWIVKV

SEQ ID NO: 6884 - DNA, 852 bp, Bacillus halodurans
  CDS (1)..(852)
atggattattgcctttaccaagaccagcttgttccacgtgagcaactaaaaattgatccagaggatagaggctatcattttggtgacggtatttacgaagtggtccacgtataccacgggaaagcttttgccttatctgatcatttaactcgctttaaagaaagtgccgaaaaacttgatctacctatgctctattccacagacaaactaggggagcttgttcagcaacttattgaaaaaaacaagctggagcatggaatggtctactttcagatgacccgggggatcagtccgcgaaaccatttgtacacgcgtaatgaaacacccgtccttaccggtttttcaaaaccattacctgatgaaaagagggaatccgttcgtctttatttgaccgatgatattcgctggcttcgttgcgacattaaaaccattaacttattaggaaatgtcttggccaagcgtgaagcaaccgatcatcaatgcgacgaagcgctcctccaccgtgacggaacagtgactgaaggctcgtcatcgaatgtgttccttattaaaaatgaaacactctacacacatccagcaacaaatctcatcttgaacgggattacacgacaaatcaccatccggctagccaaagcaaaagggtataccgtcgtggaagagccgttccctaaagaagtgataaaggatgctgatgaagcgttcattacgagcacgatccatgaaatcacaccagtaaccgaagtcatcggtgatgaaacggcacattttcctgttggacctgtcacgaaaatgttgcaacaggcatttgcagaagaaattgccaaacactctcaaacagcgatgaagcagtga

SEQ ID NO: 6885 - protein, 283 aa, Bacillus halodurans
MDYCLYQDQLVPREQLKIDPEDRGYHFGDGIYEVVHVYHGKAFALSDHLTRFKESAEKLDLPMLYSTDKLGELVQQLIEKNKLEHGMVYFQMTRGISPRNHLYTRNETPVLTGFSKPLPDEKRESVRLYLTDDIRWLRCDIKTINLLGNVLAKREATDHQCDEALLHRDGTVTEGSSSNVFLIKNETLYTHPATNLILNGITRQITIRLAKAKGYTVVEEPFPKEVIKDADEAFITSTIHEITPVTEVIGDETAHFPVGPVTKMLQQAFAEEIAKHSQTAMKQ

SEQ ID NO: 6886 - DNA, 1104 bp, Arabidopsis thaliana (mouse-ear cress)
  CDS (1)..(1104)
atggctccttctgtgcacccttcttcatcacctctttttacaagtaaagccgatgaaaagtatgcgaatgtaaaatgggatgagctcggattcgcactggttccaacagattatatgtatgtggcgaaatgcaaacaaggagagagcttttcaacaggagagattgttccttatggggatatttctataagcccttgtgctgggattctcaattatggccagggactatttgaaggtctcaaggcttacaggacagaagacggtcggatcacactcttccgacctgaccaaaacgctattcgtatgcaaacaggtgcagataggctttgtatgacacctccttccccggagcaattcgttgaagcagttaagcaaactgtgcttgccaacaacaaatgggtacctcctccggggaaaggagctttgtatattaggcctctactcataggtactggtgctgtccttggagtagcttcagctcctgaatatacgttcctcatttacacatctcccgtgggaaattatcacaaggcaagctcaggcttgaacctcaaagttgatcataaccatcgccgagcccacttcggtggaacagggggtgtgaagagctgcacaaattattctccagttgtaaaatcgttgatcgaagcaaagtcttcgggtttctctgatgtcttgttcctggatgcggcaactggtaaaaacatcgaagaggtttctacttgtaacatcttcattctaaagggaaacattgtatccactcccccaacttcaggaaccattttaccaggaatcacaaggaagagcatatgtgagctagcccgtgacattggctatgaggttcaagaacgtgatctttctgtggatgagctattagaggcagaggaagttttttgcacggggacggcagtggtcattaaagctgttgaaaccgtgacattccatgacaaaagggtaaaatatagaacaggagaagaagcattctctacgaagcttcacttgatattaactaatattcaaatgggagttgtcgaagataagaagggttggatgatggagatcgatcatttggttggaacagattcgtttcctgatgaaacataa

SEQ ID NO: 6887 - protein, 367 aa, Arabidopsis thaliana (mouse-ear cress)
MAPSVHPSSSPLFTSKADEKYANVKWDELGFALVPTDYMYVAKCKQGESFSTGEIVPYGDISISPCAGILNYGQGLFEGLKAYRTEDGRITLFRPDQNAIRMQTGADRLCMTPPSPEQFVEAVKQTVLANNKWVPPPGKGALYIRPLLIGTGAVLGVASAPEYTFLIYTSPVGNYHKASSGLNLKVDHNHRRAHFGGTGGVKSCTNYSPVVKSLIEAKSSGFSDVLFLDAATGKNIEEVSTCNIFILKGNIVSTPPTSGTILPGITRKSICELARDIGYEVQERDLSVDELLEAEEVFCTGTAVVIKAVETVTFHDKRVKYRTGEEAFSTKLHLILTNIQMGVVEDKKGWMMEIDHLVGTDSFPDET

SEQ ID NO: 6888 - DNA, 1092 bp, Helicobacter pylori
  CDS (28)..(1050)
tgaaactatccatttaaaggtgtgaaaatggcaaatttagaaaatttagactggaaaaatttaggctttagctacattaaaacggattttcgcttcatcgccacttataaaaacggctcttggtcgcaaggcggattggtgagcgaaaacatgttacaactcagcgaaggctcgccggtcttgcactacgggcaggcttgttttgaaggcttgaaggcttaccgctctcaaaaggggaaagctttactctttcgccctttagaaaacgccaaacgcttgcaaacttcatgcgaaagactgctcatgcccaaagtgagcgaagagctgtttttaagggcatgcgctgaagtggtgaaagcgaatcaaaaatggctcgctccttataaaagcggggcgagtttgtatttgcgcccttttgtcataggcgtaggggataatttgggggtgaagccggctaatgaatacctttttatcgtgttttgtgcgcctgtgggggcgtattttaaggggggtatagaaaaagggggggctaggtttatcactacgatttttgatagggccgcgcctaaaggcaccggtggggtgaaagtgggagggaattacgctgcaagcctgttagcccataaaatggccacagagcaaggctatgatgattgcatttatttagaccctactacgcacactaaaattgaagaagtgggggcggcgaatttttttggcatcacgcatgatgatgcctttatcaccccgcattcgccaagcattctgccaagcattaccaaaaaaagcttgatggttttggctaaagaatatttgaacctcaaagtagaagagagggaaatcctaatggatgagttggatgcgtttaaagaagctggagcgtgcgggacagctgcgatcattacgcccattaaagaaatcgtgcacaacaacaagtcttatttttttgaagcgccgggccatattactaaacgactctatgatttgcttttatccatccaacaaggcgaacaagaagcccccaaagattggatttttgaagttggctaaaaggttaaaatttatagctgtatgccgcataaaataagggcg

SEQ ID NO: 6889 - protein, 340 aa, Helicobacter pylori
MANLENLDWKNLGFSYIKTDFRFIATYKNGSWSQGGLVSENMLQLSEGSPVLHYGQACFEGLKAYRSQKGKALLFRPLENAKRLQTSCERLLMPKVSEELFLRACAEVVKANQKWLAPYKSGASLYLRPFVIGVGDNLGVKPANEYLFIVFCAPVGAYFKGGIEKGGARFITTIFDRAAPKGTGGVKVGGNYAASLLAHKMATEQGYDDCIYLDPTTHTKIEEVGAANFFGITHDDAFITPHSPSILPSITKKSLMVLAKEYLNLKVEEREILMDELDAFKEAGACGTAAIITPIKEIVHNNKSYFFEAPGHITKRLYDLLLSIQQGEQEAPKDWIFEVG

SEQ ID NO: 6890 - DNA, 1023 bp, Helicobacter pylori
  CDS (1)..(1023)
atgccaaatttagaaaatttagactggaaaaatctaggctttagctacattaaaacggattttcgcttcatcgctacttataaaaacggctcgtggtcgcaaggcgaattggttagcgaaaatgcgttacagctcagcgaaggctcaccggtcttgcattatgggcaggcttgttttgaaggcttgaaggcttaccgctctcaaaaggggaaagctcttctttttcgccctttagaaaacgccaaacgcttgcaaacttcatgcgaaagactgctcatgcccaaagtgagcgaagagctgtttttaaaggcatgcgctgaagtgattaaagcgaatcaaaaatggctcgctccttacaaaagtggggcgagtttgtatttgcgcccttttgtcataggcgtgggggataatttgggggtaaagccggccagtgaatacctttttatcgtgttttgcgcgcctgtgggggcgtattttaaggggggcatagaaaaagggggggctaggtttatcactacggcgtttgatagagccgcgcctaaaggcaccggtggggtgaaagtgggggggaattatgccgcaagcctgttagcccataaaatagccacagagcaaggctatgatgattgcatttatttagaccccaccacgcacactaaaattgaagaagtgggggcggcgaatttttttggcatcacgcatgatgatgcctttatcaccccgcattcgccaagcattctgccaagcgttaccagaaaaagcttgatggttttggctaaagaacacttgaaactcaaagtagaagagagggaaattttaattgatgagttgggcgcgtttaaagaagccggagcgtgcgggacagccgcaatcattacgcccattaaagaaatcgcgcacaacaacaagtcttattcttttgaagcgccgggcaatattactaaacaactctatgatttgcttttatccatccagcaaggcgaacaagaagcccctaaagattggatttttgaagttggctaa

SEQ ID NO: 6891 - protein, 340 aa, Helicobacter pylori
MPNLENLDWKNLGFSYIKTDFRFIATYKNGSWSQGELVSENALQLSEGSPVLHYGQACFEGLKAYRSQKGKALLFRPLENAKRLQTSCERLLMPKVSEELFLKACAEVIKANQKWLAPYKSGASLYLRPFVIGVGDNLGVKPASEYLFIVFCAPVGAYFKGGIEKGGARFITTAFDRAAPKGTGGVKVGGNYAASLLAHKIATEQGYDDCIYLDPTTHTKIEEVGAANFFGITHDDAFITPHSPSILPSVTRKSLMVLAKEHLKLKVEEREILIDELGAFKEAGACGTAAIITPIKEIAHNNKSYSFEAPGNITKQLYDLLLSIQQGEQEAPKDWIFEVG

SEQ ID NO: 6892 - DNA, 999 bp, Neisseria meningitidis
  CDS (1)..(999)
atgagcagacccgtacccgccgtattcggcagcgtttttcacagtcaaatgcccgtcctcgcctaccgcgaaggcaaatggcagccgaccgaatggcaatcttcccaagacctctccctcgcaccgggcgcgcacgccctgcactacggcagcgaatgtttcgagggactgaaagccttccgtcaggcagacggcaaaatcgtgctgttccgtccgactgccaatatcgcgcgtatgcggcaaagtgcggacattttgcacctgccgcgccccgaaaccgaagcttatcttgacgcgctaatcaaattggtcaaacgtgccgccgatgaaattcccgatgcgcctgccgccctgtacctgcgtccgaccttaatcggtaccgatcccgttatcggcaaggccggttctccttccgaaaccgccctgctgtatattttggcttcccccgtcggcgactatttcaaagtcggatcgcccgtcaaaattttggtggaaaccgaacacatccgctgcgccccgcatatgggccgcgtcaaatgcggcggcaactacgcttccgccatgcactgggtgctgaaggcgaaagccgaatatggcgcaaatcaagtcctgttctgcccgaacggcgacgtgcaggaaaccggcgcgtccaactttatcctgattaacggcgatgaaatcattaccaaaccgctgaccgacgagtttttgcacggcgtaacccgcgattccgtactgacggttgccaaagatttgggctataccgtcagcgaacgcaatttcacggttgacgaactcaaagctgcggtggaaaacggtgcggaagccattttgaccggtacggcagccgtcatctcgcccgttacttccttcgtcatcggcggcaaagaaatcgaagtgaaaagccaagaacgcggctatgccatccgtaaggcgattaccgacatccagtatggtttggcggaagacaaatacggctggctggttgaagtgtgctga

SEQ ID NO: 6893 - protein, 332 aa, Neisseria meningitidis
MSRPVPAVFGSVFHSQMPVLAYREGKWQPTEWQSSQDLSLAPGAHALHYGSECFEGLKAFRQADGKIVLFRPTANIARMRQSADILHLPRPETEAYLDALIKLVKRAADEIPDAPAALYLRPTLIGTDPVIGKAGSPSETALLYILASPVGDYFKVGSPVKILVETEHIRCAPHMGRVKCGGNYASAMHWVLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKSQERGYAIRKAITDIQYGLAEDKYGWLVEVC

SEQ ID NO: 6894 - DNA, 915 bp, Campylobacter jejuni
  CDS (1)..(915)
atgatctcagcagataaaatttggatggatggaaaattagttgattttaaagatgcaactttgcactttttaacccattctttgcattatggcaatgctgtttttgaaggaactagagcctataaaacagataaaggcttagcaattttcagacttgaagatcacaccaaaagacttttagagtctgcaaaaattactcttttaaattgtcctttttctcaaaaagagcttgaaaatgcacaaattgaactcttaaaagcaaacaattttaaaagcaatgtctatatccgccctttgattttcttaggcgatggagttatgggactttatcatataaaagctcctgtaagagttgggattgcagcttgggaatggggtgcttaccttggagaagaaggtttagaaaaaggtataaaagtaaaaatttcgtcttttgcaagaaatagtgttaaatcatgcatgggaaaagctaaagcaagtgcgaattatcttaactctcaaattgcaaaatttgaagctattgaagcaggctatgaagaagctttgatgcttgatgaagaaggttttatcgcagaaggaacaggagaatgtttctttattgtaaaagatggggttttaatcacacctccaaatgatttttctttaaaaagcattactcaagatacagtgcttaaaatcgctcatgatcttggtattactgtgcttcgccaaagaatttcaagagatgaagtttatactgctgatgaagcattttttaccggaacagccgctgaaatcacacctattaataatattgatgcaagaataataggaaatggtttaagaggatctgtaactaaaaaacttcaagatgcttattttgatgtagtttatggacgcaatgaaaaatacgcatctatgctaacttatatttaa

SEQ ID NO: 6895 - protein, 304 aa, Campylobacter jejuni
MISADKIWMDGKLVDFKDATLHFLTHSLHYGNAVFEGTRAYKTDKGLAIFRLEDHTKRLLESAKITLLNCPFSQKELENAQIELLKANNFKSNVYIRPLIFLGDGVMGLYHIKAPVRVGIAAWEWGAYLGEEGLEKGIKVKISSFARNSVKSCMGKAKASANYLNSQIAKFEAIEAGYEEALMLDEEGFIAEGTGECFFIVKDGVLITPPNDFSLKSITQDTVLKIAHDLGITVLRQRISRDEVYTADEAFFTGTAAEITPINNIDARIIGNGLRGSVTKKLQDAYFDVVYGRNEKYASMLTYI

SEQ ID NO: 6896 - DNA, 999 bp, Neisseria meningitidis
  CDS (1)..(999)
atgagcagacccgtacccgccgtattcggcagcgtttttcacagtcaaatgcccgtcctcgcctaccgcgaaggcaaatggcagccgaccgaatggcaatcttcccaagacctctccctcgtaccgggtgcgcacgccctgcactacggcagcgaatgtttcgagggactgaaagccttccgtcaggcagacggtaaaatcgtactgttccgtccgactgccaatatcgcgcgtatgcggcaaagtgcggacattttgcacctgccccgccccgaaacccaagcctatctcgatgctttggtcgaactggtcaaacgtgccgccgacgaaattcccgatgcgcctgccgccctgtacctgcgcccgaccttaatcggtaccgatcccgtcatcggcaaggccggttctccttccgaaaccgccctgctgtatattttggcttcccccgtcggcgactatttcaaagtcggctcgcccgtcaaaattttagtggaaaccgaacacatccgctgcgccccgcatatgggccgcgtcaaatgcggcggcaactacgcttccgccatgcactgggtgctgaaggcgaaagccgaatacggcgcaaaccaagtcctcttctgcccgaacggcgacgtgcaggaaaccggcgcgtccaactttatcctgattaacggcgatgaaatcattaccaaaccgctgaccgacgaatttttgcacggcgtaacccgcgattccgtactgacggttgccaaagatttgggctataccgtcagcgaacgcaatttcacggttgacgaactcaaagctgcggtggaaaacggtgcggaggcgattctgaccggtacggcagccgtcatctcgcccgttacttccttcgtcatcggcggcaaagaaatcgaagtgaaaagccaagaacgcggctatgccatccgtaaggcgattaccgacatccagtatggtttggcggaagacaaatacggctggctggttgaagtgtgctga

SEQ ID NO: 6897 - protein, 332 aa, Neisseria meningitidis
MSRPVPAVFGSVFHSQMPVLAYREGKWQPTEWQSSQDLSLVPGAHALHYGSECFEGLKAFRQADGKIVLFRPTANIARMRQSADILHLPRPETQAYLDALVELVKRAADEIPDAPAALYLRPTLIGTDPVIGKAGSPSETALLYILASPVGDYFKVGSPVKILVETEHIRCAPHMGRVKCGGNYASAMHWVLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKSQERGYAIRKAITDIQYGLAEDKYGWLVEVC

SEQ ID NO: 6898 - DNA, 888 bp, Bacillus halodurans
  CDS (1)..(888)
atgtacatgtacgttaatgacaaacttgtcaaggaagaggaggcgatcatctcgcctttcgatcacggttacatgtatggtctcggtctttttgaaacgtttcgactttatgaaggtcatccatttttattggatgaccattttgtccgtttagaggaggggctacgcgcccttgcgattgattggacgtataatcggtctcacgttttacaccagcttgccacgctttgtaataaaaatggtgtgagaaatgcttatattcgctggaacgtctctgctggtccgggtccgattgggctgtacacggacacttataaagagccgacagtcatcatctacatgaagtcattgccacaagggctatcgacgcgaaaaacggggacattgctggagctaagaaggaatacacctgaaggagatcgacgacttaagtcacaccactttctgaacaacgttcttggaaagcgtgaggtggcaaaggacccacaaacggaagggatctttttaacagaggatggcgtgttagcggaagggctgacttcgaacgtgttttgggtaaaaaacggggtcgtgtacacgccttctgttgatacaggaatcttgaatggcatcactcggcaatttgttctcaccttatgtgataaggaagggattccgtggcgggaagggcgctaccctaaagaagcattactgaaagcggatggggcgtttattacaaattccattcaagaaatcgtgactctcacttccgttggacaagctgaatttaaccaagatgaagcggtgattatgagtttgagaaaaagctatcagaaatactgcacaaaactatggtccaagaacgagataaaggagggaaaacaggatgtcaacaacacttgcaaataa

SEQ ID NO: 6899 - protein, 295 aa, Bacillus halodurans
MYMYVNDKLVKEEEAIISPFDHGYMYGLGLFETFRLYEGHPFLLDDHFVRLEEGLRALAIDWTYNRSHVLHQLATLCNKNGVRNAYIRWNVSAGPGPIGLYTDTYKEPTVIIYMKSLPQGLSTRKTGTLLELRRNTPEGDRRLKSHHFLNNVLGKREVAKDPQTEGIFLTEDGVLAEGLTSNVFWVKNGVVYTPSVDTGILNGITRQFVLTLCDKEGIPWREGRYPKEALLKADGAFITNSIQEIVTLTSVGQAEFNQDEAVIMSLRKSYQKYCTKLWSKNEIKEGKQDVNNTCK

SEQ ID NO: 6900 - DNA, 1077 bp, Bacillus halodurans
  CDS (1)..(1077)
atgattgatacggggcttcggatcgaacgatcaagtaatccaaagcaaaaaccagatccagagcagctgagttttggaaaagtatttaccgatcacatgtttgtgatggattatacagaggaaaaagggtggcacgacccaagaattgtcccatacggatcgattacgcttgatcccgccgcgatggtgttccattatggacaaacggtgtttgaagggttgaaggcttatcgtacaaacgatgatcgcattttgttgtttcgcccagaaaaaaacatccagcgtttgaatcgctcctgtcatcgtattagcatcccgcaaattccagaagaggcagccatcgactatttagtgaagcttctccaagttgatcgcgattgggttccgtccgctgaaggtacctcgctttatattcgtccgttcgtctttgcgaatgaaatcaacttatcagcggttccgtcaaccgaatacacctttatgattattttgtcaccggttggttcctattataaagaaggcattcaacctgtaaacatctacgtagaagatgagtttacgagagccgtgcgcggaggaacaggaacggccaagaccggaggaaattattcagcttcgtacatcgctcaagaaaaagcggcggaaaaaggatatgcacaagtaatgtggcttgatgggattgagaaaaagtacattgaagaagttggcagcatgaacgttttctttaaaattgatggtgaaattgtgacgccaattttaaacggcagcattttagagggtgtcacgcgtatgtcgatcatcgaactgcttcgtgattggggctatcctgttgcggaacgtaaaatctcgatggaagaattgtttgcagcctacgaaaaagggaagcttgaggaagcttttggtacaggaaccgccgctgttgtttcgccgattggccagcttaattggaaagagcatcagatggtgattaatgataaacgtattggcgagttatcgaaaaagttgtacgatacgttgacaggtattcaacgcggtcagctacctgatccgtttaattggaaccgagaagtgaacgaatag

SEQ ID NO: 6901 - protein, 358 aa, Bacillus halodurans
MIDTGLRIERSSNPKQKPDPEQLSFGKVFTDHMFVMDYTEEKGWHDPRIVPYGSITLDPAAMVFHYGQTVFEGLKAYRTNDDRILLFRPEKNIQRLNRSCHRISIPQIPEEAAIDYLVKLLQVDRDWVPSAEGTSLYIRPFVFANEINLSAVPSTEYTFMIILSPVGSYYKEGIQPVNIYVEDEFTRAVRGGTGTAKTGGNYSASYIAQEKAAEKGYAQVMWLDGIEKKYIEEVGSMNVFFKIDGEIVTPILNGSILEGVTRMSIIELLRDWGYPVAERKISMEELFAAYEKGKLEEAFGTGTAAVVSPIGQLNWKEHQMVINDKRIGELSKKLYDTLTGIQRGQLPDPFNWNREVNE

SEQ ID NO: 6902 - DNA, 858 bp, Halobacterium sp. NRC-1
  CDS (1)..(858)
atgcgataccacgtaaacggcgcgctcgtggacgccgccgacgcaaccgtcagcgtccgcgaccgcggcttccagtacggcgacgcagcgttcgaaaccatgcgcgcgtacggcggccagacgttcgcctggaccgcccactaccgccgcctgcaggccacctgtgactcgctgggcatcgaccacggcctctcggaggcggcgctgcgggggcgcgtccacgagacgctcgccgccaacgacctcgcggacgcctacgtccggctgtcgatcacccggggcgtccaggacggccggctcaccccgcgggacacgaccgatccgaccgtcgtcgtggtggtcgacgcgctcccccgcggcggcgtcgacggcgacccggtctggtcgatgcccgccaccgtcgaaaccacgacggtcacccaacaccgcgacaccaccatccccagcaccgcgaaaacccacaactacctgcccggcgtgctcgcccgccgcgacatcgccgccgacgccgacgaagcgctgttcgtcacgcccgacggccacctcacggagggcgctgcgagcaacctctttttcgtcgccgacggcaccctctacacgcccagcggcgatctcgacgtgttgcccgggatcacgcggtgggcggtcgccgaactcgccgccgagcacgggctcacggtgcacacgggcgcgtacacgccgtctcggctctacgacgccgacgaggcgttcctcacgaacaccacctgggaggtgcgccccatcgcgcgtgtcgacgacgccacgtacgacacgtgccggatcggggccgccctcgccagcgcgtacaacgccgagatcgaacgccgccactactag

SEQ ID NO: 6903 - protein, 285 aa, Halobacterium sp. NRC-1
MRYHVNGALVDAADATVSVRDRGFQYGDAAFETMRAYGGQTFAWTAHYRRLQATCDSLGIDHGLSEAALRGRVHETLAANDLADAYVRLSITRGVQDGRLTPRDTTDPTVVVVVDALPRGGVDGDPVWSMPATVETTTVTQHRDTTIPSTAKTHNYLPGVLARRDIAADADEALFVTPDGHLTEGAASNLFFVADGTLYTPSGDLDVLPGITRWAVAELAAEHGLTVHTGAYTPSRLYDADEAFLTNTTWEVRPIARVDDATYDTCRIGAALASAYNAEIERRHY

SEQ ID NO: 6904 - DNA, 1077 bp, Staphylococcus aureus
  CDS (1)..(1077)
atgtcacaagcagttaaagttgaacgacgagaaacattaaaacaaaaaccaaatacatctcaactaggttttggtaaatattttactgattatatgttgagttatgattatgatgcagataaaggatggcatgatttgaagatagtaccttatggtcctattgaaatttcacctgctgcacaaggtgttcattatggtcaatcggtattcgaaggattaaaagcatataaaagagatggggaagttgcacttttccgtcctgaagaaaattttaagcgtcttaataactcgttagcacgattagaaatgcctcaagtagacgaagcagaattgttagaggggctaaaacaattagttgatattgaaagagattggattcctgaaggggaaggtcaatcattatatattcgtccatttgtttttgcaacagaaggggcacttggcgttggtgcatcacatcagtataaattattaattattttatctccttcaggtgcatattatggtggtgaaactttaaaaccaactaaaatctatgtagaagatgaatatgtgcgtgctgttcgtggcggtgtaggctttgcaaaagttgcaggtaactatgcggcaagtttattagcacaaactaatgcaaataaattaggttatgaccaagtattatggcttgatggtgttgaacagaaatatatcgaagaagttggtagcatgaacattttcttcgttgaaaatggcaaagtaattacaccagagttgaatggcagtattttacctggtattacacgtaaatctattatcgaattagctaaaaacttaggatatgaagtcgaagagcgccgcgtttcaatcgatgaattattcgaatcatatgataaaggtgagttaacagaagtatttggtagtggtactgcagcagttatttcacctgtgggtacattgagatacgaagatcgtgaaatcgttattaataataatgagactggtgaaattactcaaaaattatacgacgtctatactggtattcaaaatggtactttagaagataaaaatggttggagagtcgttgtaccaaaatattag

SEQ ID NO: 6905 - protein, 358 aa, Staphylococcus aureus
MSQAVKVERRETLKQKPNTSQLGFGKYFTDYMLSYDYDADKGWHDLKIVPYGPIEISPAAQGVHYGQSVFEGLKAYKRDGEVALFRPEENFKRLNNSLARLEMPQVDEAELLEGLKQLVDIERDWIPEGEGQSLYIRPFVFATEGALGVGASHQYKLLIILSPSGAYYGGETLKPTKIYVEDEYVRAVRGGVGFAKVAGNYAASLLAQTNANKLGYDQVLWLDGVEQKYIEEVGSMNIFFVENGKVITPELNGSILPGITRKSIIELAKNLGYEVEERRVSIDELFESYDKGELTEVFGSGTAAVISPVGTLRYEDREIVINNNETGEITQKLYDVYTGIQNGTLEDKNGWRVVVPKY

SEQ ID NO: 6906 - DNA, 1196 bp, Arabidopsis thaliana (mouse-ear cress)
  CDS (9)..(1079)
ctccatagatggctccttcttcatcacctcttcgtactacaagtgaaacagatgaaaaatatgcgaatgtcaaatgggaagagcttggattcgctctgactccaatagattatatgtatgtagccaaatgcagacaaggagagagctttacacaagggaagattgttccttatggcgacatttcaattagcccttgttctccgattctcaattacggccagggactatttgaaggtctcaaagcttacagaacagaagacgaccggattaggattttccggcctgaccaaaacgctcttcgcatgcaaactggtgcggagaggctttgtatgacacctcctactctagaacaatttgtcgaggcagttaagcaaactgtgcttgccaacaagaaatgggttcctcctccgggtaaaggaactctgtatataaggcctctgctactagggagtggtgctacccttggagtagctccagcacctgaatacacttttctcatatatgcatctcccgtaggagattaccataaggtaagctcaggcttgaacctcaaagttgatcataagtatcaccgagcccattcaggtggaacggggggtgtcaagagctgcacaaactattctccagttgtgaaatcgttactcgaagcaaagtcagcgggtttctctgatgtcctgttcctggatgcagcaactggtagaaacatcgaagagcttactgcttgtaacatcttcattgtcaagggaaacattgtatccaccccaccaacttcaggaaccattttacctggagtcacgaggaaaagcataagtgagctggctcatgatattggctaccaggtcgaagaacgcgatgtatctgtggatgagctactagaggcagaagaagttttctgcacagggactgcagtggtcgttaaagctgttgaaactgtgaccttccatgacaaaaaggtaaaatacaggacaggagaagcagcattgtctacgaagcttcactcgatgttgaccaatattcagatgggagttgttgaagataagaaaggttggatggtggacattgatccttgtcaaggttgaaagaagaagtttagaaagctgatgattctatgtactcaaacgtgtatctttcttctcatgtgttggtttttattaggattcttctttttttatcatgggacttgtaataaataatgg

SEQ ID NO: 6907 - protein, 356 aa, Arabidopsis thaliana (mouse-ear cress)
MAPSSSPLRTTSETDEKYANVKWEELGFALTPIDYMYVAKCRQGESFTQGKIVPYGDISISPCSPILNYGQGLFEGLKAYRTEDDRIRIFRPDQNALRMQTGAERLCMTPPTLEQFVEAVKQTVLANKKWVPPPGKGTLYIRPLLLGSGATLGVAPAPEYTFLIYASPVGDYHKVSSGLNLKVDHKYHRAHSGGTGGVKSCTNYSPVVKSLLEAKSAGFSDVLFLDAATGRNIEELTACNIFIVKGNIVSTPPTSGTILPGVTRKSISELAHDIGYQVEERDVSVDELLEAEEVFCTGTAVVVKAVETVTFHDKKVKYRTGEAALSTKLHSMLTNIQMGVVEDKKGWMVDIDPCQG

SEQ ID NO: 6908 - DNA, 1026 bp, Clostridium acetobutylicum
  CDS (1)..(1026)
atggaaaagaaaaatatagattgggctaatctaggctttggatacgttaaaacagataaaagattcgtatctaactataaagatggaaaatgggatgatggtgcattagtttcagatgctaccattgctattagtgaatgtgcaggtgtacttcaatactctcaagcatgctttgaaggtatgaaagcttacacaactgaggatggacatattgttaccttccgtcctgacttaaatgcacagcgtatggaagattcatgtaaaagattagaaatgcctgcatttccaaaggaaagctttgtagatgctgttgtaaaaactatagaggcaaattctgaatgggtacctccatatggaagtggtgctacactttatattcgtccatttatgtttgcttctggaccagttattggagttaaaccagcagatgaatatcaattcagagtatttgctacaccagttggtccatactttaaaggaggagttaagcctttaactttacgtgttagtgattttgatcgtgctgctccaaatggtactggacacatcaaagctgggcttaattatgctatgagtcttcatgcaattgttactgcacatgaagaaggctttgatgaaaatatgtatttagacgcagctactagaacaaaggttgaagaaactggtggagctaacttcctatttgtaactaaagataataaggttgttacaccgaaatcaaatactattcttccttcaatcacacgtcgttctttaatgacagttgcaaaagattaccttggactagaaattgaggagagaactgtttaccttgatgaagtaaaagattttgcagaatgcggtctttgtggaacagctgctgttatctcaccagtaggaaagatagtagatcatggcaaagaaatttgttttccaagcggaatgtcagatatgggacctatcactaaaaaattacgtgatacattgacaggtattcaaatgggtcatattgaagcacctaagggatggcttaaaataatcaaataa

SEQ ID NO: 6909 - protein, 341 aa, Clostridium acetobutylicum
MEKKNIDWANLGFGYVKTDKRFVSNYKDGKWDDGALVSDATIAISECAGVLQYSQACFEGMKAYTTEDGHIVTFRPDLNAQRMEDSCKRLEMPAFPKESFVDAVVKTIEANSEWVPPYGSGATLYIRPFMFASGPVIGVKPADEYQFRVFATPVGPYFKGGVKPLTLRVSDFDRAAPNGTGHIKAGLNYAMSLHAIVTAHEEGFDENMYLDAATRTKVEETGGANFLFVTKDNKVVTPKSNTILPSITRRSLMTVAKDYLGLEIEERTVYLDEVKDFAECGLCGTAAVISPVGKIVDHGKEICFPSGMSDMGPITKKLRDTLTGIQMGHIEAPKGWLKIIK

SEQ ID NO: 6910 - DNA, 873 bp, Archaeoglobus fulgidus
  CDS (1)..(873)
atgctgtacgtttatatggatggtgagttcgtaccggaaaatgaagcgaaggtgagcatcttcgaccacggctttctttacggggatggcgtttttgaggggataagggcctacaacgggagagtcttcaggttaaaagagcacatagaccggctttacgattcggcaaaggccatcgacctcgaaataccaataacaaaggaggagttcatggagataatcctggaaacgctcaggaaaaacaacctcagagatgcttacatcagaccaatagtgacgagggggattggagacctcgggcttgatccgagaaagtgccagaatccgtcgataatagtcataacaaagccgtgggggaagctctacggggacctctacgagaaggggcttacggcgatcaccgttgccgtgagaaggaactccttcgacgcgctcccgccaaacataaagtcgctcaactacctgaacaacattctggcaaagatagaggcaaacgctaagggaggggacgaggccatattcctcgacagaaacggctacgtttcggaggggagcggagacaacattttcgtggtgaaaaatggagctatcacaaccccaccgacgataaacaacctgaggggaattacgagggaagctgtgatagagataataaacaggttaggaatacccttcaaggagacgaacataggcctctacgacctctacacggcagacgaggttttcgtaaccggcaccgctgctgaaattgcgcctattgttgttatcgacggcagaaaaatcggagacggaaagcccggagagattacgagaaagctaatggaggagttcagcaagctcaccgaaagcgaaggcgtaccaatatatgagtga

SEQ ID NO: 6911 - protein, 290 aa, Archaeoglobus fulgidus
MLYVYMDGEFVPENEAKVSIFDHGFLYGDGVFEGIRAYNGRVFRLKEHIDRLYDSAKAIDLEIPITKEEFMEIILETLRKNNLRDAYIRPIVTRGIGDLGLDPRKCQNPSIIVITKPWGKLYGDLYEKGLTAITVAVRRNSFDALPPNIKSLNYLNNILAKIEANAKGGDEAIFLDRNGYVSEGSGDNIFVVKNGAITTPPTINNLRGITREAVIEIINRLGIPFKETNIGLYDLYTADEVFVTGTAAEIAPIVVIDGRKIGDGKPGEITRKLMEEFSKLTESEGVPIYE

SEQ ID NO: 6912 - DNA, 849 bp, Bacillus subtilis
  CDS (1)..(849)
atgaaggttttagtcaatggccggctgattgggcgcagtgaagcatcaatcgatttggaagatcgcggttatcagtttggtgacggcatctatgaagtgatcagggtgtacaaaggagtattgttcggcttacgtgagcatgcagagcgttttttcagaagtgctgctgaaatcggaatttcactgccattcagtatagaagatctcgagtgggacctgcaaaagcttgtacaggaaaatgcggtcagtgagggagcggtatacattcagacaacaagaggtgtggccccgcgaaaacaccagtatgaagccggcctcgagccgcagactactgcctatacgtttacggtgaaaaaaccggagcaagagcaggcatacggagtggcggccattacagatgaggatcttcgctggttaagatgtgatatcaaaagtctgaatttactgtataatgtcatgacgaagcaaagggcctatgaagccggagcatttgaagccattttacttagggacggcgttgttacggagggtacatcctctaacgtttatgccgttatcaacggcacagtgcgaacacatccggctaatcggctcattctcaatggaattacacggatgaatattttaggactgattgagaagaatgggatcaaactggatgagactcctgtcagtgaagaagagttgaaacaggcggaagagatctttatttcgtcaacgacggcagaaattattccggtcgtgacgctcgatggacaatcgatcggaagcgggaaacccggaccggtgaccaaacagcttcaggctgcttttcaagaaagcattcaacaggctgctagcatttcataa

SEQ ID NO: 6913 - protein, 282 aa, Bacillus subtilis
MKVLVNGRLIGRSEASIDLEDRGYQFGDGIYEVIRVYKGVLFGLREHAERFFRSAAEIGISLPFSIEDLEWDLQKLVQENAVSEGAVYIQTTRGVAPRKHQYEAGLEPQTTAYTFTVKKPEQEQAYGVAAITDEDLRWLRCDIKSLNLLYNVMTKQRAYEAGAFEAILLRDGVVTEGTSSNVYAVINGTVRTHPANRLILNGITRMNILGLIEKNGIKLDETPVSEEELKQAEEIFISSTTAEIIPVVTLDGQSIGSGKPGPVTKQLQAAFQESIQQAASIS

SEQ ID NO: 6914 - DNA, 1023 bp, Streptococcus pneumoniae
  CDS (1)..(1023)
atgacagtaacgattgattgggaaaacctcggtttttcctatatgaaattaccttatcgctatcttgctcatttcaaaaatggacaatgggatcaaggagagcttacagaggatgcaactttgcatatttcagagtcttctccaagtcttcactatggacaacaagcatttgaaggtttgaaagcttatcgtactaaggatggcagtgttcaactgttccgtcctgatgaaaatgctaaacgcctgcaacgtacatgtgaccgtctcttgatgccacaagttccgacagacatgtttgtagaagcttgtaaagcagttgtccgtgcgaatgaagaatacgtaccactatacggaataggtggaaccttatatcttcgccctcttttgattggtgtcggagatattatcggggtaaaaccggcagaagagtacattttcaccatctttgctatgccagttggaaattactttaaaggtggtttggtcccaaccaacttcttgattcaggatgagtacgaccgtgcagcaccaaatggtacaggtgcggctaaggttggtggaaactatgctgcaagtctcttaccaggaaaaatggccaagtcacgccatttctcagatgttatctatctggacccatcaactcatacaaagattgaagaagtcggatcagctaatttctttggaattacagctgataatgaatttgtaacaccattgagtccatctatcttgccatctattaccaagtattccttgctttatttggcagaacatcgcttgggattaactcctattgagggtgatgttccaattgataatcttgaccgttttgtagaggcaggtgcctgtggtacagcagcggttatttctccaattggaggtattcaacatggtgatgatttccatgtattctatagtgaaacagaagtaggtcctgtgacgcgtaaattatataatgaattgacgggtattcagtttggcgatattgaagcgccagaaggttggattgtaaaagtagattaa

SEQ ID NO: 6915 - protein, 340 aa, Streptococcus pneumoniae
MTVTIDWENLGFSYMKLPYRYLAHFKNGQWDQGELTEDATLHISESSPSLHYGQQAFEGLKAYRTKDGSVQLFRPDENAKRLQRTCDRLLMPQVPTDMFVEACKAVVRANEEYVPLYGIGGTLYLRPLLIGVGDIIGVKPAEEYIFTIFAMPVGNYFKGGLVPTNFLIQDEYDRAAPNGTGAAKVGGNYAASLLPGKMAKSRHFSDVIYLDPSTHTKIEEVGSANFFGITADNEFVTPLSPSILPSITKYSLLYLAEHRLGLTPIEGDVPIDNLDRFVEAGACGTAAVISPIGGIQHGDDFHVFYSETEVGPVTRKLYNELTGIQFGDIEAPEGWIVKVD

SEQ ID NO: 6916 - DNA, 867 bp, Methanococcus jannaschii
  CDS (1)..(867)
atgaaaatctacttaaacggaaagtttgttgatgaaaaagatgcaaaggtttctgtgtttgaccacggtttattatatggagatggagtttttgaaggaattagggcttatgatggcgttgtttttatgttgaaggagcatatagacagattgtatgattcagcaaaatctctctgtatagatatcccactaacaaaagaagagatgattgatgttgttttagagacattgagagttaataatctgagagatgcatatataagattagttgttacaagaggagttggtgatttagggttagacccaagaaagtgtggaaagccaactattttctgtatagcaattcctatgcctcctttattaggggaggatggaatcagggctataaccgtttcagttagaagactgccagtagatgttttgaatccagcagttaaatccctcaactacttaaacagcgtcttagcaaagattcaggcaaactatgctggagttgatgaggcatttttattggatgataaaggttttgttgttgaaggaactggagataacatatttatagttaaaaatggagttttaaaaactcccccagtttatcagagtatcttaaaaggaatcacaagggatgttgtcataaaattagctaaggaagaaggaatagaggttgttgaagaacctttaactttacatgacttatacactgccgatgaactatttatcactggaacagctgctgaaatagtccctgtttttgagatagatggtagagtaataaataataaacaagttggagaaatcactaaaaaattaaaagagaagtttaaagatattagaaccaaatggggaataaaggtttatgatgaataa

SEQ ID NO: 6917 - protein, 288 aa, Methanococcus jannaschii
MKIYLNGKFVDEKDAKVSVFDHGLLYGDGVFEGIRAYDGVVFMLKEHIDRLYDSAKSLCIDIPLTKEEMIDVVLETLRVNNLRDAYIRLVVTRGVGDLGLDPRKCGKPTIFCIAIPMPPLLGEDGIRAITVSVRRLPVDVLNPAVKSLNYLNSVLAKIQANYAGVDEAFLLDDKGFVVEGTGDNIFIVKNGVLKTPPVYQSILKGITRDVVIKLAKEEGIEVVEEPLTLHDLYTADELFITGTAAEIVPVFEIDGRVINNKQVGEITKKLKEKFKDIRTKWGIKVYDE

SEQ ID NO: 6918 - DNA, 960 bp, Vibrio cholerae
  CDS (1)..(960)
atgcgcataaggaaggcaatcatggcaacaaaaactgctgattatatttggttcaatggcgagatgatcccatgggcgaatgcgaccgttcacgtactcacccatgcaatgcactacggcacttcggtgtttgaaggtgttcgctgctacaacaccccaaaaggccctatcatcttccgccatcgcgaacacgcgcagcgcctgcttgattcagccaaaatctaccgctttccaatcccttattcgatcgagaccatcatggaagcgacgcgcgaaaccttacgcgtcaacaaactcgataacgcttacattcgcccattggcgtatgtgggtaacgtgggtcttggcgtgtgcccgccagtcggcactgaaatggatctgatgattgccgctttcccttggggggcttacctcggtgaagaagcgctagaaaatggcgtggatgccatggtttcaagctggcatcgtgcggcaccgaacaccattccaaccgcggcaaaagctggcggtaattacctatcttctctactggttggtggcgaagcacgtcgccacggttacgcggaaggcattgcgctgagtgtggatggttatctctctgaaggcgcaggcgaaaacattttcgtggtgaaaaacggcgtgatcctgaccccaccgaccaccagctctatcctgccgggtatcacccgtgattcgatcatgacgctggcacgcgacatgggttatgaagtgcgcgaagccaacatctcccgtgaagcgctctatctggccgatgaaattttcatgacaggtaccgccgccgaagtggttcccgtgcgtagcgtggataagattaccgtaggcgcaggcaagcgcggccccatcaccaaggtagtacaagatgcttactttggtctgttcaaaggcaccacagaagataagtggggctggttggattacgtttacccagcagcgaagtaa

SEQ ID NO: 6919 - protein, 319 aa, Vibrio cholerae
MRIRKAIMATKTADYIWFNGEMIPWANATVHVLTHAMHYGTSVFEGVRCYNTPKGPIIFRHREHAQRLLDSAKIYRFPIPYSIETIMEATRETLRVNKLDNAYIRPLAYVGNVGLGVCPPVGTEMDLMIAAFPWGAYLGEEALENGVDAMVSSWHRAAPNTIPTAAKAGGNYLSSLLVGGEARRHGYAEGIALSVDGYLSEGAGENIFVVKNGVILTPPTTSSILPGITRDSIMTLARDMGYEVREANISREALYLADEIFMTGTAAEVVPVRSVDKITVGAGKRGPITKVVQDAYFGLFKGTTEDKWGWLDYVYPAAK

SEQ ID NO: 6920 - DNA, 891 bp, Caulobacter crescentus
  CDS (1)..(891)
atgtctctggttcccttcgatgatcgcgacggttggatctggcttgacgggcaatttgtgccctggcgcgaagcgaaggtgcatgttttgacccatggcctgcactatgcgtcgtcggtgttcgaaggcgagcgcatgtacggcggcgaaatcttcaaactgaccgagcataccgagcgcctgttcaagtcggccgagatcctcgattttgagatcccctacacggtggccgagatcgacgaggcctgcaaggcgacggcggccaagaacggtctgaaggactgctatgtgcgtccgatcgcctggcgcggcagcgaaatgatcggtgtttcggcgcagcagtccaagatccacgtggccatcgccgtctgggagtggcccagctacttcgatccggccaccaaggccaagggcatccgcctgacctgggccaagtaccagcgtcccgaccccaagaccgccccgatcgcggccaaggccgccggcctctacatgatctgcaccatctccaagcacgccgccgagaaggacggctatgccgacgcgatgatgctggactatcgcggctatgtcgccgaggcgaccggcgccaacgtgttcttcgtcaaggacggcgtgctgcacacgcccaagcccgactgcttcctggacggcatcacccgccgcacggtgatcgacctggccaaggccaaggggatcgaggtggtcgagcgccacatccagaaggaagaactggccaccttcaccgagtgcttcatcgtcggcaccgccgccgaggtgaccccagtctcggaagtgggcgagttcaagttcacgcccgccaagctgtcgctggatctgatggacacctacgccgccctggtgcgcggcgaggcgatggcgacggcctga

SEQ ID NO: 6921 - protein, 296 aa, Caulobacter crescentus
MSLVPFDDRDGWIWLDGQFVPWREAKVHVLTHGLHYASSVFEGERMYGGEIFKLTEHTERLFKSAEILDFEIPYTVAEIDEACKATAAKNGLKDCYVRPIAWRGSEMIGVSAQQSKIHVAIAVWEWPSYFDPATKAKGIRLTWAKYQRPDPKTAPIAAKAAGLYMICTISKHAAEKDGYADAMMLDYRGYVAEATGANVFFVKDGVLHTPKPDCFLDGITRRTVIDLAKAKGIEVVERHIQKEELATFTECFIVGTAAEVTPVSEVGEFKFTPAKLSLDLMDTYAALVRGEAMATA

SEQ ID NO: 6922 - DNA, 1071 bp, Bacillus subtilis
  CDS (1)..(1071)
atgaataagcttattgaacgagaaaaaactgtatattataaggaaaagcccgacccgtcttccttggggtttggacaatattttacagattatatgtttgtgatggactacgaagaggggattggatggcatcatccgagaattgcgccgtacgcaccgcttacgcttgatccgtcttcatctgtttttcattacggccaggctgtttttgaaggattaaaagcatacagaacagacgacggcagggtgctgctgttccgtccggatcaaaatatcaaacggctgaacagatcgtgtgagcgcatgagcatgccccctttagacgaagagctggtgcttgaggcattgacgcaattagttgagctggagaaagattgggttccaaaggaaaaaggaacgtcactgtatattcgtccttttgtcattgccacagaaccgagtctcggtgtgaaggcatccaggagctatacatttatgatcgtgctttcgcctgtcggctcctattatggcgacgatcagctgaagccggttagaatctatgtcgaagatgagtatgtgagggcggtcaacggaggagtcgggtttgcaaaaacggctggaaactatgccgccagtcttcaggcacagcggaaagcgaatgaactgggctatgaccaggtactgtggctggacgccatcgaaaagaaatatgtggaagaagtagggagcatgaacatctttttcgtcataaacggggaagctgtcacacctgctttaagcggaagcattttaagcggggttacacgtgcgtctgcgattgaattgattcgaagctggggcattccggttcgtgaagagagaatatcgattgatgaggtgtatgcggcctctgcacgcggagaattgacagaggtctttggcacaggcacggcagcagtcgttacgcctgtcggtgaactcaacatccatggaaaaacggtgattgtaggcgacgggcaaatcggggacctctcgaaaaagctgtatgaaacgataacagatattcagcttggcaaggtaaaaggcccgtttaactggacagtggaagtgtga

SEQ ID NO: 6923 - protein, 356 aa, Bacillus subtilis
MNKLIEREKTVYYKEKPDPSSLGFGQYFTDYMFVMDYEEGIGWHHPRIAPYAPLTLDPSSSVFHYGQAVFEGLKAYRTDDGRVLLFRPDQNIKRLNRSCERMSMPPLDEELVLEALTQLVELEKDWVPKEKGTSLYIRPFVIATEPSLGVKASRSYTFMIVLSPVGSYYGDDQLKPVRIYVEDEYVRAVNGGVGFAKTAGNYAASLQAQRKANELGYDQVLWLDAIEKKYVEEVGSMNIFFVINGEAVTPALSGSILSGVTRASAIELIRSWGIPVREERISIDEVYAASARGELTEVFGTGTAAVVTPVGELNIHGKTVIVGDGQIGDLSKKLYETITDIQLGKVKGPFNWTVEV

SEQ ID NO: 6924 - DNA, 1182 bp, Saccharomyces cerevisiae
  CDS (1)..(1182)
atgttgcagagacattccttgaagttggggaaattctccatcagaacactcgctactggtgccccattagatgcatccaaactaaaaattactagaaacccaaatccatccaagccaagaccaaatgaagaattagtgttcggccagacattcaccgatcatatgttgaccattccttggtcagccaaagaagggtggggcactccacacatcaagccttacggtaatctttctcttgacccatctgcttgtgtattccattatgcatttgaattatttgaaggtttgaaagcctacagaactcctcaaaatactatcaccatgttccgtccggataagaacatggcccgtatgaacaagtctgccgctagaatttgtttgccaactttcgaatctgaagaattgatcaaacttaccgggaaattgatcgaacaagataaacacttggttcctcaaggtaatggttactcattatacatcagaccaacaatgattggtacatccaagggtttaggtgttggcactccctccgaggctcttctttatgttattacttctccagtcggtccttattataagactggtttcaaagccgtacgtcttgaagcaacagactatgctacaagagcttggccaggtggtgttggcgacaaaaaattgggtgctaactatgccccatgcatcttacctcaactacaagctgccaaaagagggtaccaacaaaatctatggttgttcggcccagaaaagaacatcactgaggttggtactatgaacgtgttcttcgttttcctcaacaaagtcactggcaagaaggaattggttaccgctccattagatggtaccattttagaaggtgttaccagagactctgttttaacattggctcgtgacaaactagatcctcaagaatgggacatcaacgagcgttattacactattactgaagtcgccactagagcaaaacaaggtgaactattagaagccttcggttctggtactgctgctgtcgtttcacctatcaaggaaattggctggaacaacgaagatattcatgttccactattgcctggtgaacaatgtggtgcattgaccaagcaagttgctcaatggattgctgatatccaatacggtagagtcaattatggtaactggtcaaaaactgttgccgacttgaactaa

SEQ ID NO: 6925 - protein, 393 aa, Saccharomyces cerevisiae
MLQRHSLKLGKFSIRTLATGAPLDASKLKITRNPNPSKPRPNEELVFGQTFTDHMLTIPWSAKEGWGTPHIKPYGNLSLDPSACVFHYAFELFEGLKAYRTPQNTITMFRPDKNMARMNKSAARICLPTFESEELIKLTGKLIEQDKHLVPQGNGYSLYIRPTMIGTSKGLGVGTPSEALLYVITSPVGPYYKTGFKAVRLEATDYATRAWPGGVGDKKLGANYAPCILPQLQAAKRGYQQNLWLFGPEKNITEVGTMNVFFVFLNKVTGKKELVTAPLDGTILEGVTRDSVLTLARDKLDPQEWDINERYYTITEVATRAKQGELLEAFGSGTAAVVSPIKEIGWNNEDIHVPLLPGEQCGALTKQVAQWIADIQYGRVNYGNWSKTVADLN

SEQ ID NO: 6926 - DNA, 1131 bp, Saccharomyces cerevisiae
  CDS (1)..(1131)
atgaccttggcacccctagacgcctccaaagttaagataactaccacacaacatgcatctaagccaaaaccgaacagtgagttagtgtttggcaagagcttcacggaccacatgttaactgcggaatggacagctgaaaaagggtggggtaccccagagattaaaccttatcaaaatctgtctttagacccttccgcggtggttttccattatgcttttgagctattcgaagggatgaaggcttacagaacggtggacaacaaaattacaatgtttcgtccagatatgaatatgaagcgcatgaataagtctgctcagagaatctgtttgccaacgttcgacccagaagagttgattaccctaattgggaaactgatccagcaagataagtgcttagttcctgaaggaaaaggttactctttatatatcaggcctacattaatcggcactacggccggtttaggggtttccacgcctgatagagccttgctatatgtcatttgctgccctgtgggtccttattacaaaactggatttaaggcggtcagactggaagccactgattatgccacaagagcttggccaggaggctgtggtgacaagaaactaggtgcaaactacgccccctgcgtcctgccacaattgcaagctgcttcaaggggttaccaacaaaatttatggctatttggtccaaataacaacattactgaagtcggcaccatgaatgcttttttcgtgtttaaagatagtaaaacgggcaagaaggaactagttactgctccactagacggtaccattttggaaggtgttactagggattccattttaaatcttgctaaagaaagactcgaaccaagtgaatggaccattagtgaacgctacttcactataggcgaagttactgagagatccaagaacggtgaactacttgaagcctttggttctggtactgctgcgattgtttctcccattaaggaaatcggctggaaaggcgaacaaattaatattccgttgttgcccggcgaacaaaccggtccattggccaaagaagttgcacaatggattaatggaatccaatatggcgagactgagcatggcaattggtcaagggttgttactgatttgaactga

SEQ ID NO: 6927 - protein, 376 aa, Saccharomyces cerevisiae
MTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLIGTTAGLGVSTPDRALLYVICCPVGPYYKTGFKAVRLEATDYATRAWPGGCGDKKLGANYAPCVLPQLQAASRGYQQNLWLFGPNNNITEVGTMNAFFVFKDSKTGKKELVTAPLDGTILEGVTRDSILNLAKERLEPSEWTISERYFTIGEVTERSKNGELLEAFGSGTAAIVSPIKEIGWKGEQINIPLLPGEQTGPLAKEVAQWINGIQYGETEHGNWSRVVTDLN

SEQ ID NO: 6928 - DNA, 1092 bp, Bacillus subtilis
  CDS (1)..(1092)
atgactaaacaaacaattcgcgttgaattgacatcaacaaaaaaaccgaaaccagacccaaatcagctttcgttcggaagagtgtttacagaccacatgtttgtaatggactatgccgcagataaaggttggtacgatccaagaatcattccttatcaacccttatcaatggatccaactgcaatggtctatcactacggccaaaccgtgtttgaagggttaaaggcttacgtgtcagaggatgaccatgttctgcttttcagaccggaaaaaaatatggaacgcctgaatcaatcaaacgaccgcctctgcatcccgcaaattgatgaagaacaggttcttgaaggcttaaagcagcttgtcgcaattgataaagactggattccaaatgcggagggcacgtccctttacatccgtccgttcatcatcgcaaccgagcctttccttggtgttgcggcatctcatacgtataagctcttgatcattctttctccggtcggctcttattacaaagaaggcattaagccggtcaaaatcgctgttgaaagtgaatttgtccgtgcggtaaaaggcggaacaggaaatgccaaaaccgcaggaaactatgcttcaagcttaaaagcgcagcaggtagccgaagagaaaggattttctcaagtactctggctggacggcattgagaagaaatacatcgaagaagtcggaagcatgaacatcttcttcaaaatcaacggtgaaatcgtaacaccgatgctgaacgggagcatcctggaaggcattacgcgcaattcagtcatcgccttgcttaagcattggggccttcaagtttcagaacgaaaaattgcgatcgatgaggtcatccaagcccataaagacggcatcctggaagaagccttcggaacaggtacagcagctgttatttccccagtcggcgagctgatctggcaggatgaaacactttcgatcaacaacggtgaaacaggagaaatcgcaaaaaaactatatgacacgattacaggcattcaaaaaggcgctgtcgcagacgaattcggatggacgaccgaagtcgcagcgctgactgaaagcaagtaa

SEQ ID NO: 6929 - protein, 363 aa, Bacillus subtilis
MTKQTIRVELTSTKKPKPDPNQLSFGRVFTDHMFVMDYAADKGWYDPRIIPYQPLSMDPTAMVYHYGQTVFEGLKAYVSEDDHVLLFRPEKNMERLNQSNDRLCIPQIDEEQVLEGLKQLVAIDKDWIPNAEGTSLYIRPFIIATEPFLGVAASHTYKLLIILSPVGSYYKEGIKPVKIAVESEFVRAVKGGTGNAKTAGNYASSLKAQQVAEEKGFSQVLWLDGIEKKYIEEVGSMNIFFKINGEIVTPMLNGSILEGITRNSVIALLKHWGLQVSERKIAIDEVIQAHKDGILEEAFGTGTAAVISPVGELIWQDETLSINNGETGEIAKKLYDTITGIQKGAVADEFGWTTEVAALTESK

SEQ ID NO: 6930 - DNA, 918 bp, Synechocystis sp
  CDS (1)..(918)
atgcacaagtttttgccgatcgcctactttgaagataagtttgtcccgtttgaggatgccaaaatttccgttgctacccatgccctccactatgggacggcggcctttgggggtttgcggggtattcccgacccggaagatccgggcaccattctactattccgtctggaccgccatggcgatcgcctgagtaagagtgccaagtttttgcactacgacatcagtgcagaaaaaatcaaggaagttattgttgattttgttaagaaaaatcagcccgataaatccttttacatccgtccattggtgtacagttccggtttgggcattgccccccgtttgcacaatctggagaaggatttcctggtttatggcttggaaatgggggattacctcgccgccgacggagttagctgccgtatcagttcctggtatcgccaagaagaccggagttttcccctaaggggcaaaatcagcgccgcctacattacctctgctttggctaaaacggaagcggtggaatcgggctttgatgaggctattttgatgaattcccaaggtaaggtctgtgaagccaccggcatgaatgttttcatggtacggaatgggcaaattgttacccccggcaatgagcaggacatcctcgaagggattactagggatagtattctcaccattgcagcggatttgggcattcccacctgccaacgccccatcgataaatcggaattgatgattgccgacgaggtatttttgagtggtactgcggccaaaatcaccccggttaaaaggattgagaactttaccctgggcggcgatcgcccgattacagaaaagttacgctccgtgttgacagcggtgacggaaaaccgggaacccaaatatcaagattgggtatttaaaattcctttgaatggctaa

SEQ ID NO: 6931 - protein, 305 aa, Synechocystis sp
MHKFLPIAYFEDKFVPFEDAKISVATHALHYGTAAFGGLRGIPDPEDPGTILLFRLDRHGDRLSKSAKFLHYDISAEKIKEVIVDFVKKNQPDKSFYIRPLVYSSGLGIAPRLHNLEKDFLVYGLEMGDYLAADGVSCRISSWYRQEDRSFPLRGKISAAYITSALAKTEAVESGFDEAILMNSQGKVCEATGMNVFMVRNGQIVTPGNEQDILEGITRDSILTIAADLGIPTCQRPIDKSELMIADEVFLSGTAAKITPVKRIENFTLGGDRPITEKLRSVLTAVTENREPKYQDWVFKIPLNG

SEQ ID NO: 6932 - DNA, 1155 bp, Arabidopsis thaliana (mouse-ear cress)
  CDS (1)..(1155)
atggctcttcgtcgctgcttacctcaatattcaacaacttcatcttatctctccaagatctggggatttcgtatgcatgggaccaaggcagcagcttctgttgtagaagaacatgtctcgggggcagaacgtgaggatgaagaatatgctgatgtagattgggacaaccttggattcagtcttgtacggacagatttcatgttcgccaccaaaagttgcagagacggaaacttcgaacagggttaccttagccgttacggcaacatcgagctcaaccctgctgctggaattctcaactatggccagggactaatagaggggatgaaagcgtacagaggagaagacggtagggttcttctcttccgtccagagctaaacgcgatgcgtatgaagataggagctgagagaatgtgtatgcattctccttctgttcatcagtttattgaaggtgttaagcagaccgttcttgcaaacaggcgttgggttcctcctccgggcaaaggctcgttgtatctcagaccgttgttgttcggaagtggagcaagcttgggtgtggctgcagcatcagagtacacgtttcttgtgtttggctctcctgttcaaaactacttcaaggaaggcacagcggcgttgaacctgtatgtggaggaggtgattccacgcgcttatcttggaggaactggtggtgtaaaggcaatatccaattacggtccagtgcttgaagtgatgagaagagcaaaatcaagagggttttcggatgttttgtatcttgatgcagatactgggaagaacatagaagaagtctctgctgctaatatattccttgtgaagggcaatacaatagtgacaccagctacgagcggaacgattctcggagggatcacacgtaagagcataatcgaaatcgcccttgatcttggttacaaagtggaagaacgaagtgttccggtagaagaactgaaggaagctgaagaagttttctgcactggaactgccgctggagttgcttctgttggaagcatcacttttaagaacacaaggactgagtacaaagttggagatgggattgttacacagcaacttcgatctattcttgtcggaatacaaactggttctatccaagacactaaagattgggttttgcagattgcctaa

SEQ ID NO: 6933 - protein, 384 aa, Arabidopsis thaliana (mouse-ear cress)
MALRRCLPQYSTTSSYLSKIWGFRMHGTKAAASVVEEHVSGAEREDEEYADVDWDNLGFSLVRTDFMFATKSCRDGNFEQGYLSRYGNIELNPAAGILNYGQGLIEGMKAYRGEDGRVLLFRPELNAMRMKIGAERMCMHSPSVHQFIEGVKQTVLANRRWVPPPGKGSLYLRPLLFGSGASLGVAAASEYTFLVFGSPVQNYFKEGTAALNLYVEEVIPRAYLGGTGGVKAISNYGPVLEVMRRAKSRGFSDVLYLDADTGKNIEEVSAANIFLVKGNTIVTPATSGTILGGITRKSIIEIALDLGYKVEERSVPVEELKEAEEVFCTGTAAGVASVGSITFKNTRTEYKVGDGIVTQQLRSILVGIQTGSIQDTKDWVLQIA

SEQ ID NO: 6934 - DNA, 1167 bp, Arabidopsis thaliana (mouse-ear cress)
  CDS (211)..(1167)
atgatcaaaacaatcacatctctacgcaaaactctggttctacctcttcatttacatattcgtacgctacaaactttcgccaagtacaacgcacaagctgcatcggctttgcgagaagagcgtaagaaacctctttatcaaaatggagatgatgtatatgcggatttggattgggataatctcgggtttggtctaaatccagctgattacatgtatgtcatgaaatgctcaaaagacggcgaattcactcaaggagaacttagtccctatgggaatattcagctaagtccttctgctggagtcttaaactatggacaggcgatatacgaaggtacaaaagcatacaggaaagaaaatgggaagcttcttttgtttcgtccggatcacaacgctatccggatgaagcttggcgctgaacggatgctcatgccttctccttcggttgatcagtttgttaatgcagttaaacaaaccgctcttgcaaacaaacgttgggttcctcctgcagggaaagggactttgtacattaggcctttgttgatgggaagtggtccaatacttggtttaggtcctgcacctgaatatacattcattgtctatgcatctccagttggtaactacttcaaggaagggatggctgctcttaacctctatgttgaggaagaatatgtccgagcggctcctggtggagctggaggcgtcaagagcatcacaaattatgcgccagttttgaaagcactgagcagagccaagagtcgggggttttcagacgttctttatctcgactctgtcaagaagaagtacttagaggaggcttcttcttgcaacgtctttgttgtcaagggtcggacaatctcaactcctgcaactaatggaacaattcttgaagggattacgcggaaaagtgtgatggagatcgcaagtgatcaaggttatcaggtagtagagaaggcagttcatgtggatgaagtaatggatgcagatgaagttttttgcaccggaactgctgtagtagttgctcccgtgggcactatcacatatcaggaaaaaagagtagagtataaaaccggggatgaatctgtctgccagaaactgcgttcagtcctcgtaggtatccagacaggattgattgaagataacaagggatgggtcacagatatcaactga

SEQ ID NO: 6935 - protein, 318 aa, Arabidopsis thaliana (mouse-ear cress)
MYVMKCSKDGEFTQGELSPYGNIQLSPSAGVLNYGQAIYEGTKAYRKENGKLLLFRPDHNAIRMKLGAERMLMPSPSVDQFVNAVKQTALANKRWVPPAGKGTLYIRPLLMGSGPILGLGPAPEYTFIVYASPVGNYFKEGMAALNLYVEEEYVRAAPGGAGGVKSITNYAPVLKALSRAKSRGFSDVLYLDSVKKKYLEEASSCNVFVVKGRTISTPATNGTILEGITRKSVMEIASDQGYQVVEKAVHVDEVMDADEVFCTGTAVVVAPVGTITYQEKRVEYKTGDESVCQKLRSVLVGIQTGLIEDNKGWVTDIN

SEQ ID NO: 6936 - DNA, 4266 bp, Arabidopsis thaliana (mouse-ear cress)
  CDS (1)..(4266)
atggcaacttcttctcgttcggagcgatttccgataacgccgagtacggcggctactaatagattgacgattacgcctaattctagggttttgaaaagccctctcactgaagaaatcatgtggaagcggctcaaagatgctgggtttgatgaacaatcgatcaagaatagggataaagctgccttaatcgcttacatcgccaagctagaatctgaggtttatgattaccaacacaacatgggtcttctccttttggagaaaaacgaattgtcttcgcagtatgaagagattaaggcctctgtggatgagtctgacctaacacatatgcgagagaaatcagcatatgtctcggctctagctgaagcaaagaaacgagaagagagtttgaagaaggatgtagggattgcgaaggagtgcatttctagtttggagaagactctgcatgagatgcgcgcagaatgtgccgaaacaaaagtttctgctgggagtactatgtcggaagcacatgttatgatcgaggatgcgctgaagaaacttgcagatgctgaagcaaaaatgcgcgcagcagaggctttacaagcagaagctaaccggtatcaccgaattgcagagagaaagttgaaagaagttgaaagtcgtgaagatgatcttactcggcgtcttgcatctttcaagtctgagtgtgaaacgaaagagaacgaaatggttattgagcgacagactttaaatgagaggcggaagagcttgcagcaagagcatgaaagattattggatgcacaagtttcactaaatcaaagagaagatcacatttttgctagatcccaagaattagctgaacttgaaaaggggttagatactgcaaagaccacatttgaggaggaacgcaaagccttcgaagacaaaaaatccaacttggagattgcgttagccttgtgtgctaaaagagaagaggtttgtttttattcacacaattctctgttatttttggttttgcattataggtcatcaaaaaaatttctgggagacaagatagctgtctctgaaagggaatcttcgctacttaagaaggagcaagaactgcttgttgctgaagaaaaaattgccagcaaggaatctgaactaattcagaacgtcttagcgaatcaagaagttatcctgaggaaaagaaaatctgatgtggaagctgaattggaatgtaagagcaaatcggtggaagttgaaattgagagcaagagacgggcttgggaattaagggaggttgatatcaagcagagggaagacctagttggtgaaaaagaacatgacttggaagttcaatcaagagcattggcagagaaagaaaaagatataacagagaagtcttttaaccttgatgagaaagagaagaatttggttgctacagaggaagatattaaccgtaagactactatgctggaggatgagaaggaacggcttagaaaattggacctggagctgcagcagtctttgacgtcattagaagacaagagaaaacgggttgattctgcaacacaaaaacttgaagccttgaagagtgagacaagcgaattatctactctggagatgaaacttaaggaggaattagatgatttgagggcccaaaagcttgaaatgctggctgaagctgatagattgaaggtggagaaagctaaatttgaggctgagtgggaacacattgatgtgaaaagggaagagttaagaaaagaagcagagtatataactcggcaaagagaggctttttcaatgtatctcaaggacgagcgtgataacatcaaagaggaaagagatgcattgagaaatcagcacaaaaacgatgtggagtcgctaaaccgagagcgtgaagaattcatgaataagatggtggaggaacattctgaatggcttagcaagatacagcgtgagcgtgctgacttcttgttgggcattgagatgcagaaacgagagttggagtattgcatcgaaaacaaacgagaagaattggaaaattcttcaagggatagagaaaaggcttttgagcaagagaagaagttagaagaggagcgtatacagtcgcttaaggaaatggcagagaaagagttagaacatgtccaagtggaactaaagaggttggatgctgagaggttggagatcaaattggatcgtgaaagaagagagagggagtgggcagagttaaaggattcggttgaggagctaaaggtgcaacgagaaaaactagagacgcaaaggcatatgcttcgtgctgaaagagatgaaatccgacatgagattgaagaactgaagaaattagagaatctgaaagttgcattagatgatatgtccatggctaaaatgcagctgtccaatttagagcgtagctgggaaaaggtttctgctttgaagcagaaggttgtgtctcgggatgatgaacttgacctgcaaaatggagtcagcactgtgagtaatagcgaagatggctacaactcttcaatggaaagacagaacggcttaaccccttcatctgccactccattttcatggataaaacgatgtactaatctgattttcaagacttctccagagaaatccaccctaatgcatcattatgaagaagaaggaggagtgccttcagaaaagttgaagctagaatcgtcgagaagagaagaaaaggcttacactgagggactgtctattgcggttgaaagacttgaagcaggaaggaaaagaagaggtaacacatctggagatgagactagcgaaccaagcaataacaaaaagaggaaacatgatgttacccaaaaatattctgatgaagctgatacccagagtgtcatatcaagcccgcaaaatgtgcctgaggacaaacatgaactaccatcaagccaaacccagacgccaagtggtatggtagtcatcagtgaaaccgttaagatcacaagagtaacgtgtgagacagaggtgaccaacaaagtcacaacccttgactgctcagaaagtccttcggaagcagggagaaagatgggagaggagacagaagatggtgattgcaatcagactgggataaacgcgtctgaaacagtgattcataatgaagctgcaacagaagatatatcacataagaaactctatgaatccttttgggcttggtttctagagaagataagggtattgagtgagagagaggctacagtgctccacattgacatcaacaaggttgaagaagaacaacatcattcaacatcagcatcacgaatattttcgagtcatggagagaagcgccgttgcctcagcaccaccgatgtgactgaattagccgaaattgattgggacaagattgattttgggcttaaaccaacggattacatgtacgccatgaaatgtagccgtgatggtgaattctctcaaggtcaattgcaaccttttggtaacattgacattaacccagcagctggtgttctcaactatggacaaggtttgtttgaaggtctaaaagcttacagaaaacaagatgggaatattctactcttccgtcctgaggagaatgcgatccgaatgagaaatggcgctgaaagaatgtgtatgccttctccaaccgttgaacagtttgttgaggctgtgaaaactactgtattagctaacaaacgctgggtaatttggataaggcttttgaatttgtttcttttatgtattccacctccaggtaaaggatcattatacataaggccattgctaatgggaactggagctgttcttggtcttgctcctgctcctgaatacactttccttatctttgtttcacctgtcgggaactacttcaaggaaggtgttgcgccgatcaacttaattgttgaaactgaattccatcgtgcaactcccggcggtactggaggtgttaaaaccatcggtaattatgctgcagtcttgaaggctcagtcgattgcgaaagctaaagggtattctgatgttttataccttgattgccttcacaaaagatatcttgaggaggtttcatcgtgcaatattttcattgtgaaggataatgtgatatctactcctgaaattaaaggaaccatcttgcctggaattacccggaagagtatcatcgaagtagctcgtagccaaggtttcaaggtggaggaacgaaatgtgacagttgatgaattggtagaagcagacgaggttttctgcacaggaaccgccgttgttttatctccggttggaagcatcacttacaaaagccaaaggtacaagaccttttcttttaccagttaa

SEQ ID NO: 6937 - protein, 1421 aa, Arabidopsis thaliana (mouse-ear cress)
MATSSRSERFPITPSTAATNRLTITPNSRVLKSPLTEEIMWKRLKDAGFDEQSIKNRDKAALIAYIAKLESEVYDYQHNMGLLLLEKNELSSQYEEIKASVDESDLTHMREKSAYVSALAEAKKREESLKKDVGIAKECISSLEKTLHEMRAECAETKVSAGSTMSEAHVMIEDALKKLADAEAKMRAAEALQAEANRYHRIAERKLKEVESREDDLTRRLASFKSECETKENEMVIERQTLNERRKSLQQEHERLLDAQVSLNQREDHIFARSQELAELEKGLDTAKTTFEEERKAFEDKKSNLEIALALCAKREEVCFYSHNSLLFLVLHYRSSKKFLGDKIAVSERESSLLKKEQELLVAEEKIASKESELIQNVLANQEVILRKRKSDVEAELECKSKSVEVEIESKRRAWELREVDIKQREDLVGEKEHDLEVQSRALAEKEKDITEKSFNLDEKEKNLVATEEDINRKTTMLEDEKERLRKLDLELQQSLTSLEDKRKRVDSATQKLEALKSETSELSTLEMKLKEELDDLRAQKLEMLAEADRLKVEKAKFEAEWEHIDVKREELRKEAEYITRQREAFSMYLKDERDNIKEERDALRNQHKNDVESLNREREEFMNKMVEEHSEWLSKIQRERADFLLGIEMQKRELEYCIENKREELENSSRDREKAFEQEKKLEEERIQSLKEMAEKELEHVQVELKRLDAERLEIKLDRERREREWAELKDSVEELKVQREKLETQRHMLRAERDEIRHEIEELKKLENLKVALDDMSMAKMQLSNLERSWEKVSALKQKVVSRDDELDLQNGVSTVSNSEDGYNSSMERQNGLTPSSATPFSWIKRCTNLIFKTSPEKSTLMHHYEEEGGVPSEKLKLESSRREEKAYTEGLSIAVERLEAGRKRRGNTSGDETSEPSNNKKRKHDVTQKYSDEADTQSVISSPQNVPEDKHELPSSQTQTPSGMVVISETVKITRVTCETEVTNKVTTLDCSESPSEAGRKMGEETEDGDCNQTGINASETVIHNEAATEDISHKKLYESFWAWFLEKIRVLSEREATVLHIDINKVEEEQHHSTSASRIFSSHGEKRRCLSTTDVTELAEIDWDKIDFGLKPTDYMYAMKCSRDGEFSQGQLQPFGNIDINPAAGVLNYGQGLFEGLKAYRKQDGNILLFRPEENAIRMRNGAERMCMPSPTVEQFVEAVKTTVLANKRWVIWIRLLNLFLLCIPPPGKGSLYIRPLLMGTGAVLGLAPAPEYTFLIFVSPVGNYFKEGVAPINLIVETEFHRATPGGTGGVKTIGNYAAVLKAQSIAKAKGYSDVLYLDCLHKRYLEEVSSCNIFIVKDNVISTPEIKGTILPGITRKSIIEVARSQGFKVEERNVTVDELVEADEVFCTGTAVVLSPVGSITYKSQRYKTFSFTS

SEQ ID NO: 6938 - DNA, 1182 bp, Caenorhabditis elegans
  CDS (1)..(1182)
atgcagaaaatatcgtctggtcttctgaaaagatctttcatctcttcatccctcagatgtactcacagcttccaatatgcaaatttggtggtcgaaaaaagcaccaaaaagcaacgaattcctagtgatccagcaaaacttggattcggtcgctacttttccgaccatatgattgatattgattgggatgtgaaagagggatggattgctccaaagatctgcccatttcaaaatttctccattcatccggcggctaaagttcttcattatgcgattgagatatttgaaggcatgaaagcatatcacggggtcgatggcaagatccgtctatttcgcccggagctgaatatggagcgaatgagaagatctgctcgtcgttcctcgctcccagattttgatgctcgtcaggcatgtctactcatcgatgaactcattcgaatcgatgcagacattgttccgaaaaccgatcaagcctccttgtacattcgccccatgatgtttgcaactgaacaacatatcggagtttcggaaagtacacaagccaaatgggcgtgttttacatcgatcactggtagttatttcaattatgagaaaggtattcgtctgttggcagatcctgaaatggtacgctcgtggaaaggaggtgtcggacaatacaaaatggggtgcaactatgcaccaactatttttgttggaaagatggctgcgttgcacggatgtgatcaagctatgtggctttctggagataatcgcctgatcactgaagccggcgcgatgaatgtgttcatgctttggacaaatgaagacaatgaattggagctcataactccacctacagattctggtcttcttcttcccgggataactagacagtctatcgtagagttggcacaggaaatgaacctgatgaaagtctccgagaagaacttcacaatggcgcaactgtcacgcgcagttcacgagaaacgagttcacgaattctttgtatcaggtactgctgccaacgttggaccagtctctgaaattgtgtactgcgataaagaactggacgttatggagaacttgcagattcccacattgagtagcaaaatgcagttgcacacgagactcaacaagacgctttctgacattcactttgggcgtatcgagaaaaaggaatggcagcatattgtggaactgtaa

SEQ ID NO: 6939 - protein, 393 aa, Caenorhabditis elegans
MQKISSGLLKRSFISSSLRCTHSFQYANLVVEKSTKKQRIPSDPAKLGFGRYFSDHMIDIDWDVKEGWIAPKICPFQNFSIHPAAKVLHYAIEIFEGMKAYHGVDGKIRLFRPELNMERMRRSARRSSLPDFDARQACLLIDELIRIDADIVPKTDQASLYIRPMMFATEQHIGVSESTQAKWACFTSITGSYFNYEKGIRLLADPEMVRSWKGGVGQYKMGCNYAPTIFVGKMAALHGCDQAMWLSGDNRLITEAGAMNVFMLWTNEDNELELITPPTDSGLLLPGITRQSIVELAQEMNLMKVSEKNFTMAQLSRAVHEKRVHEFFVSGTAANVGPVSEIVYCDKELDVMENLQIPTLSSKMQLHTRLNKTLSDIHFGRIEKKEWQHIVEL

SEQ ID NO: 6940 - DNA, 1089 bp, Streptomyces coelicolor
  CDS (1)..(1089)
atgacgacgcccacgatcgagctcaagccctctgcccacccgctctcggactccgagcgcgcggcgattctggccaaccccgggttcggccgccacttcaccgaccacatggtgacgatcaagtggaccgagggccgcggctggcacgacggccagctggtgccgtacgccccgctctccctcgacccggccaccatggtcctgcactacgcgcaggagatcttcgagggcctgaaggcctaccggcggcccgacggctccgtcgccaccttccgcccggagaagaacggcgcccgcttccaggcgtcctcgcgccgcctgggcatgcccgagcttcccgtggacaccttcatcgaggcctgcgacgcgctggtcgcgcaggacgagaagtgggtgccggcgcacggcggcgaggagtccctgtacctgcgccccttcatgatcgcgaccgaggtcggcctgggcgtcaggccggccaacgagtacctcttcatcgtcatcgcctccccggccggcgcctacttcccgggcggggtcaagccggtctccatctgggtctccgaggaccgcgtccgcgccgtccccggcggcatgggcgacgccaagaccggcggcaactacgcggcctccctgctcgcccaggccgaggccgccgccaagggctgcgaccaggtctgctacctcgacgccatcgagcgcaagtgggtcgaggaactgggcggcatgaacctgtacttcgtgtacggcaacaagatcgtcacgccctccctcaccggctccatcctggagggcgtcacccgcgactccctgctcaccgtcgcccgcgacctcggttacgaggccgaggagggccgcgtctcggtcgaccagtggcagcgcgactcggagaacggcaccctcaccgaggtcttcgcctgcggcaccgcggccgtgatcacccccgtcggcacggtcaagcgggccggcgcgcagtggcagcagagcgggggcgagacgggtgaggtgacgcagcggctgcgggacgcgctgctcgacattcagcgcgggacggtcgccgacccgcacgggtggatgcacacgctggcctga

SEQ ID NO: 6941 - protein, 362 aa, Streptomyces coelicolor
MTTPTIELKPSAHPLSDSERAAILANPGFGRHFTDHMVTIKWTEGRGWHDGQLVPYAPLSLDPATMVLHYAQEIFEGLKAYRRPDGSVATFRPEKNGARFQASSRRLGMPELPVDTFIEACDALVAQDEKWVPAHGGEESLYLRPFMIATEVGLGVRPANEYLFIVIASPAGAYFPGGVKPVSIWVSEDRVRAVPGGMGDAKTGGNYAASLLAQAEAAAKGCDQVCYLDAIERKWVEELGGMNLYFVYGNKIVTPSLTGSILEGVTRDSLLTVARDLGYEAEEGRVSVDQWQRDSENGTLTEVFACGTAAVITPVGTVKRAGAQWQQSGGETGEVTQRLRDALLDIQRGTVADPHGWMHTLA

SEQ ID NO: 6942 - DNA, 1143 bp, Schizosaccharomyces pombe
  CDS (1)..(1143)
atggttcaaactgctgctctccatggcccaaagcccatggatagctcccatataaaagttactaatgttaaggagcttaaacctttgcccgaatggaagagtttgaagtttggtgagaattttactgatcatatgcttattatgaaatggaacagagaaaagggttggagtactcctgagatcgttccatttggtaaactttgctttcaccctgcttcctccgttttccattatggttttgagtgctttgaaggcatgaaagctttccgtgacgaaaagggtgtcccacgtcttttccgtcccatcaagaatgctgagcgtatgctttcaactggtactcgtatatctcttccttccttcgaccctgctgagcttgctgaaattatcagaaagttcgtcgctcacgaaaaccgttgggtccctgatcagcgtggttactctttgtacattcgtcctactttcattggtactgatgaagccttaggtgtccaccattgtgacaacgctatgctttatgttattgcctctcccgttggcccctactacagctctggtttcaaggccgttaagctttgttgctccgaagaatccgttcgtgcttggcctggcggtactggtcactacaagcttggtggtaactatgctcctagtgttttgcctcaaaaagaggctgccaagaaggggtatgctcagattctctggctttatggagacgaggactacattactgaggttggtactatgaactgctttactgtttggattaacaagaatggcgaaaaagaaatcattactgcccctcttgacggtatgatcttacctggtgtcactcgtgattctattttggaaatttgccgtgaacgtctcgcacctaaaggctggaagattactgagggcaagtattccatgaaagaggttgctcaagcttctaaggaaggtcgccttttggaagtctttggagctggtactgctgcccttgtttcccccgtcaaggctattaactacaagggtactgagtatgaaattcccatgcctgagggtcaggaagctggtcccatcacttctgaaatcagcaaatggattttggatatccaatacggcaaggaacctaacaacccttggagcgttcctgctttgccttaa

SEQ ID NO: 6943 - protein, 380 aa, Schizosaccharomyces pombe
MVQTAALHGPKPMDSSHIKVTNVKELKPLPEWKSLKFGENFTDHMLIMKWNREKGWSTPEIVPFGKLCFHPASSVFHYGFECFEGMKAFRDEKGVPRLFRPIKNAERMLSTGTRISLPSFDPAELAEIIRKFVAHENRWVPDQRGYSLYIRPTFIGTDEALGVHHCDNAMLYVIASPVGPYYSSGFKAVKLCCSEESVRAWPGGTGHYKLGGNYAPSVLPQKEAAKKGYAQILWLYGDEDYITEVGTMNCFTVWINKNGEKEIITAPLDGMILPGVTRDSILEICRERLAPKGWKITEGKYSMKEVAQASKEGRLLEVFGAGTAALVSPVKAINYKGTEYEIPMPEGQEAGPITSEISKWILDIQYGKEPNNPWSVPALP

SEQ ID NO: 6944 - DNA, 1107 bp, Mycobacterium leprae
  CDS (1)..(1107)
atgaccagcggcttcctcgagttcacggtgtcactctcggcccatccggtgactgatgcggaacgtgaatcgatcctggctgagccgggcttcggtaagtaccacactgaccacatggtgtcgatcgattacattgatggccgaggttggcacgatgcgcgggtcattccctacggcccgattcagctggatccgtccgcgatagtgctgcactacgcgcaggaagtttttgagggactcaaggcttaccgctgggcggacgggtcgatcgtgtcttttcgccctgatgctaacgcggccaggttgcgttcgtcggcgcggagaatcgcgattcccgagctgcccgacgagttattcattgactctctgtgtcagctcatcgctgtcgacaatgcttgggtgccccgggtcggcggtgaagaggcgctttatctgcggcccttcatcttcgcgaccgagccggggctgggggtacggccagccaagcagtatcggtacctgttgatcgcctcgccggtcggggcgtatttcaaaggcggcatcaaccctgtcacggtctgggtgtcgatggagtacgtgcgagctagcccgggcggcaccggtgcggccaaatttggcggcaactacgctgcgtcgctgctggctcagaccgaagccgcagccaacgggtgcgaccaggtggtgtggctagacgccgtcgagcgccgcttcgtcgaagaaatgggcgggatgaacatcttctttgtgctcggcagcggcgggtcggcacgcctggtcaccccggagctgtctggctcactgctgcccggggtcacacgcgcttcgttgctgcagttggctattgatgccggattcagtgtcgaagaacgtaagatcgatatcgacgagtggcagaagaaagctgctgctggcgagatcaccgaggtgtttgcctgcggcactgccgccttcattaccccggtctcgcgggtgaaatacggtgataccgagtttaccatcgccggtggcgcaccaggtgaggtgactatggcgttgcgcgacacgctaactggaatccagcgcggtacttttgccgacacccacggctggatggcccggctgggatag

SEQ ID NO: 6945 - protein, 368 aa, Mycobacterium leprae
MTSGFLEFTVSLSAHPVTDAERESILAEPGFGKYHTDHMVSIDYIDGRGWHDARVIPYGPIQLDPSAIVLHYAQEVFEGLKAYRWADGSIVSFRPDANAARLRSSARRIAIPELPDELFIDSLCQLIAVDNAWVPRVGGEEALYLRPFIFATEPGLGVRPAKQYRYLLIASPVGAYFKGGINPVTVWVSMEYVRASPGGTGAAKFGGNYAASLLAQTEAAANGCDQVVWLDAVERRFVEEMGGMNIFFVLGSGGSARLVTPELSGSLLPGVTRASLLQLAIDAGFSVEERKIDIDEWQKKAAAGEITEVFACGTAAFITPVSRVKYGDTEFTIAGGAPGEVTMALRDTLTGIQRGTFADTHGWMARLG

SEQ ID NO: 6946 - DNA, 1065 bp, Arabidopsis thaliana (mouse-ear cress)
  CDS (1)..(1065)
atggctccttctgcgcaacctcttcctgtgagtgtttcggatgaaaaatatgcgaatgtcaagtgggaagagttggcattcaagtttgttcgtacggattatatgtatgttgcgaagtgcaatcatggagagagttttcaagaggggaagattcttccttttgctgatttgcaacttaacccttgcgctgctgttcttcagtatggccagggtttatatgaaggactgaaagcttacaggacagaagatggtcggattctgctattccgaccagaccaaaacggtctccgccttcaagccggagctgacagactctatatgccttatccttcggtcgatcaattcgtctccgccatcaaacaagttgctcttgccaacaagaaatggattcctcctccggggaaaggaacattgtatattaggcctatcttgtttgggagtggtccgattcttggttcatttcccattcctgagaccaccttcacagcttttgcctgtcctgttggacgttatcataaggataactctggtttgaatctgaaaatcgaagatcagtttcgtcgagcttttcctagtggaactggtggtgtgaagagcatcacaaactattgtcctgtttggataccattggcagaggcgaaaaaacaaggtttctctgatattttgtttttggatgctgcaactggcaaaaacattgaagaacttttcgcagctaatgtttttatgctcaagggcaatgttgtatcgacaccaacaattgcaggaactattttgcccggagtcactcgaaactgcgtaatggaattgtgtcgtgatttcggctaccaggtcgaggaacgtacgattcctctagtggactttctcgatgcggacgaagctttctgtactggcactgcttccattgtgactagtattgcatccgtaacctttaaagacaaaaagaccggattcaaaacaggggaagaaacattggctgcgaagctatacgagacgttaagtgatatccagacgggtcgggtcgaggataccaagggatggacggtggagattgaccgccagggctga

SEQ ID NO: 6947 - protein, 354 aa, Arabidopsis thaliana (mouse-ear cress)
MAPSAQPLPVSVSDEKYANVKWEELAFKFVRTDYMYVAKCNHGESFQEGKILPFADLQLNPCAAVLQYGQGLYEGLKAYRTEDGRILLFRPDQNGLRLQAGADRLYMPYPSVDQFVSAIKQVALANKKWIPPPGKGTLYIRPILFGSGPILGSFPIPETTFTAFACPVGRYHKDNSGLNLKIEDQFRRAFPSGTGGVKSITNYCPVWIPLAEAKKQGFSDILFLDAATGKNIEELFAANVFMLKGNVVSTPTIAGTILPGVTRNCVMELCRDFGYQVEERTIPLVDFLDADEAFCTGTASIVTSIASVTFKDKKTGFKTGEETLAAKLYETLSDIQTGRVEDTKGWTVEIDRQG

SEQ ID NO: 6948 - DNA, 1062 bp, Mus musculus
  CDS (1)..(1062)
atgaccaaagaaccacagaagaagccagcccctagccaggcattgctgtttgggaagaccttcacagaccacatgctgatggtagagtggaataacaaggctggatggggccctccaaggatccagcccttccagaacctcacgctacacccagcctgctctggtctgcactactctctgcagctctttgagggcttgaaagcatacaaaggtggagaccagcaggtacgcctcttccggccctggctcaacatggacaggatgctacgttctgctaggcgcctctgcctgccagactttgacaagcaggagctgttggagtgtatccgccagctcattgaagtagacaaagactgggttcccgatggcaacggaacgagcctctacgtgcggcccgtgctgatcgggaatgagccctcgctgggtgttggtatggtcacacaagccctcctgtacgtcattctgtgccctgtgggctcctacttccctggagactccatgacacctgtctccctcctggcggacccttcattcgtcagagcctggataggcggagtcggtgactgcaagttgggggggaactatggacccactgtggctgtgcagcgagaagcccagaagagaggctgcgagcaggtcctctggctgtacgggccagaccaccagctcactgaggtgggcaccatgaacatctttgtctactggacccatgaagacggagtactggagctggtaacccccccactgaatggcgtcatcttgcctggagtagttcgacaaagtctgctggatctggccaggacttggggtgagttccgggtggcagaacgcaaggtcactatgaaggaattgaagcgggcgctggaggaaggccgagtgcgagaagtcttcggctcaggcactgcttgtcaggtctgcccggtgcaccaaatcctgtatgaaggcaagcaactccacatacctaccatggagaacggcccagagctcatcctgcgcttccagaaggaactgaaggctattcagtacggagccagtgcccacgattggatgtttcgggtgtga

SEQ ID NO: 6949 - protein, 353 aa, Mus musculus
MTKEPQKKPAPSQALLFGKTFTDHMLMVEWNNKAGWGPPRIQPFQNLTLHPACSGLHYSLQLFEGLKAYKGGDQQVRLFRPWLNMDRMLRSARRLCLPDFDKQELLECIRQLIEVDKDWVPDGNGTSLYVRPVLIGNEPSLGVGMVTQALLYVILCPVGSYFPGDSMTPVSLLADPSFVRAWIGGVGDCKLGGNYGPTVAVQREAQKRGCEQVLWLYGPDHQLTEVGTMNIFVYWTHEDGVLELVTPPLNGVILPGVVRQSLLDLARTWGEFRVAERKVTMKELKRALEEGRVREVFGSGTACQVCPVHQILYEGKQLHIPTMENGPELILRFQKELKAIQYGASAHDWMFRV

SEQ ID NO: 6950 - DNA, 876 bp, Symbiobacterium thermophilum
  CDS (1)..(876)
atgtccatccaggtctacgtggacggcgagtggtactcccgggacgaggccaaggtgtccgtgtttgaccacggcttcctgtacggcgacggcgtcttcgagggcatccgggcctacggcgggcgggtcttccggctgaccgagcacctggaccggctgtacgactccgccagggcgatctggctggagatcccgctgtcgtggcgggagatggagggggtcgtgctggagacgctgcgccgctcgaacctgcgcgatgcctacatccggctggtggtgtcccggggccggggcgacctggggctggatccccgcaagtgcccccggccgacggtggtctgcatcgccgactccatcgccctctacccggaggaggtctacacccgggggatgcaggtgatctccgtctccacccggcggaacccgccggatacggtctggccgcaggtgaagagcctcaactacctgaccagcatcatcgccaagatcagcgccgccacccaggggtatcccgaggtcatcatgctgaacaaggaaggctacgtctgcgagggcaccggcgacaacatcttcatcgtgaagaagggccggctgatcaccccggcggtccatctgggcatcctgcccggcatcacccgggcggcggtgatggagtacgcccgggacctgggctacgcggtggaggagggcaccttcaccctatacgacctgtacaccgcggacgagtgcttcctcacgggcaccgcggcggagatcgtgccggtggtggagtgcgatgcccggaagatcggctcgggccagcccggcgagatcaccaggcagctcatcgccgagttccgccggcgggtgcaggtcgaaggcacgccgatcggctga

SEQ ID NO: 6951 - protein, 291 aa, Symbiobacterium thermophilum
MSIQVYVDGEWYSRDEAKVSVFDHGFLYGDGVFEGIRAYGGRVFRLTEHLDRLYDSARAIWLEIPLSWREMEGVVLETLRRSNLRDAYIRLVVSRGRGDLGLDPRKCPRPTVVCIADSIALYPEEVYTRGMQVISVSTRRNPPDTVWPQVKSLNYLTSIIAKISAATQGYPEVIMLNKEGYVCEGTGDNIFIVKKGRLITPAVHLGILPGITRAAVMEYARDLGYAVEEGTFTLYDLYTADECFLTGTAAEIVPVVECDARKIGSGQPGEITRQLIAEFRRRVQVEGTPIG

SEQ ID NO: 6952 - DNA, 846 bp, Symbiobacterium thermophilum
  CDS (1)..(846)
atgtacctgaacggtcagtacgtcccgtatgaagaggcgaagatcccggtggaggaccgggccttcctgttcgccgacggcatctacgaggtggtgcgggtctacggcggccggccgttcgacctggagccgcacctccggcggctcgcccgcagcgcccgggagctccgtctgcctgagcccgacctggaggggctgacccgggtgacccacgagctcatccgccgcaacggcgtggatgaggggaccgtctactaccagatcagccggggcgtgcacgccccccgtgcccacgcctttcctggccagccggtggaaccgacggtgctcgtgctcacccacccgctgacgcccgaggcggtggcggcgggcgagcggcgtcggcaggaaggggtcacggccatcacggtgcctgagcagcggtgggcccggtgcgacatcaagagcgtttcgctcctgcccaacgtcctggccaagcagcaggccgccgagcagggggcctacgaggcgctcttcgtccgggacggcttcgtcatcgagggcagcagcagcaacgtgttcgcggtcatcgacggggccatcgtcacctatccggcctgcaactatatcctgaacggcatcgcccgccagcgggtcatccgggacgcccggtcgctggggtacaccgtgctggagcaggggattccgctggcggccctggatcgctgccaggaactgttcgtgacctcgaccacatccgaagtgacgccggtggtcgccgtggacggcaggcccatcggcgacggcaaggtggggccggtggtgcgggccctgcagcaggcctaccgcgccgcggcgcgggggtaa

SEQ ID NO: 6953 - protein, 281 aa, Symbiobacterium thermophilum
MYLNGQYVPYEEAKIPVEDRAFLFADGIYEVVRVYGGRPFDLEPHLRRLARSARELRLPEPDLEGLTRVTHELIRRNGVDEGTVYYQISRGVHAPRAHAFPGQPVEPTVLVLTHPLTPEAVAAGERRRQEGVTAITVPEQRWARCDIKSVSLLPNVLAKQQAAEQGAYEALFVRDGFVIEGSSSNVFAVIDGAIVTYPACNYILNGIARQRVIRDARSLGYTVLEQGIPLAALDRCQELFVTSTTSEVTPVVAVDGRPIGDGKVGPVVRALQQAYRAAARG

SEQ ID NO: 6954 - DNA, 1092 bp, Propionibacterium acnes
  CDS (1)..(1092)
atgagtttgcgctttgcttctgctgacgatctgacgtggtcctccgacgagcggatcgcgctggaacatgccaatccacgatttggtgcggtccttgccgaccatatggctgttgctacctggcaggccggtgaaggctggggagacgacgccgtggtcaactaccacggacttgatatcaatcctggcagcgctgtgctgcattatgcccaggagattttcgagggcctgaaggcttaccgccacgctgacggttctatctggctcttccgccctgatcagagcggtgagcgttttgttcggtcggccgagcgtctcgccctgcccacgctgcgagtcgaagacttcgttactgcttgtatgcgcttggttgaggtcgactcccgttgggtccctgagcccggtgagggtggagagaagtccctctacctgcggccgttcatgatcgcctaccaggatttcctcggtcttgccgcggcaagtaccgtgctgttttccgttattggttctcccgttggcgcttactttgtcagcggggtgaaaccgctgcggctcctcgtcgagcgtcgtcaagctcgaacggcccccggcggtaccggtgaggcgaagtgcggtggcaattacgcagcttcgctgcgttcccagatcgatgccaagacccgtggctgcaacgaggtgctctttgtcgatgcagttgaacatcgctggatcgaggaactgggtggtatgaacttcatggccatcagcaaggacggtcagctcgtcacccccgagttagctggcaccatcctacgtggcgtgactcgcagatccattctggaagttgcccccgacctcggtcttgaaccagtggagcgcaagatcgatgttgacgagctccttgatggcgttcgctctggcgagttcccggaagtcttcgcctgcggtaccgccgcggttgtcacaccgatcggctctttcctagatggagataccgacgtgaaggtctctgagcccaccggaaagaccacgatggagatccgtcgccgtctgctggatatccagttcggacgcgctgaggacacccgtggctggttgaagcgagtctgctga

SEQ ID NO: 6955 - protein, 363 aa, Propionibacterium acnes
MSLRFASADDLTWSSDERIALEHANPRFGAVLADHMAVATWQAGEGWGDDAVVNYHGLDINPGSAVLHYAQEIFEGLKAYRHADGSIWLFRPDQSGERFVRSAERLALPTLRVEDFVTACMRLVEVDSRWVPEPGEGGEKSLYLRPFMIAYQDFLGLAAASTVLFSVIGSPVGAYFVSGVKPLRLLVERRQARTAPGGTGEAKCGGNYAASLRSQIDAKTRGCNEVLFVDAVEHRWIEELGGMNFMAISKDGQLVTPELAGTILRGVTRRSILEVAPDLGLEPVERKIDVDELLDGVRSGEFPEVFACGTAAVVTPIGSFLDGDTDVKVSEPTGKTTMEIRRRLLDIQFGRAEDTRGWLKRVC

SEQ ID NO: 6956 - DNA, 1134 bp, Leifsonia xyli
  CDS (1)..(1134)
atgaacgcttcgaccagcatctccctcaccagcggccccaccgagacttccggcctgctctggaacgtcgccaggaacgaggcggcgcgcaccgctgctgagcgcgcggagatcctcgcggaccccggtttcggcaactacttcaccgatcacatggtcgatctgtgctggtccgcgaagggcggctggcaccggccgcgcgtctccccttacggacccatcccgctcgacccgtctgccgctgtgctgcactacgctcaggagatcttcgaggggctgaaggcgtaccgccacgaggacggttcgatctggagcttccgaccggaggccaatgcggcccgcatgcagcgttcgtcctaccggctcgcgctgccccagctgccagtcgagcacttcctcgactcgctcaagcagctcatcgcggtcgacggcgactgggttccggatacggaggagacgagcctgtacctgcggccgttcatgttcgccaaagaagccttcctgggggtgcgcccggcgaacaaggtggcgtattacctgatcgcgagcccggcggcagcctacttcccgtccggtgtcgctccggtttccatctggctctccgatcgctggtcgcgtgctgggaaaggcggaaccggagcggcgaagaccggcggcaactacgcatcgagtctcttgccgcaagccgaagcgcacgagcacgggtgcgcccaggtgcttttcctcgattcggtggagtctacgtacatcgaggagctcggcgggatgaacgtggtgctcgtgtacaaggacggcaccctcgtgacccccgactccgacagcatcctcgaaggcatcaccctcgactcggtgctccagctcgcccgcgaccgcggccaccgggtggagcgccggcgcgtgaccatcggcgaatggcgggacggtgtggagtccggcgacatcgtcgaggtgttcgcctgcggcacagccgccgtcatcaccccgatcggcgaactcaagtcggacacgttcgcggtcggcgacatcaccgcagcgccgggtgcgctcaccctgtctctgcgcaaggaactgaccgacatccagtacggccgcgagcgcgaccgccacggctggatgtaccgcctcgatgcctga

SEQ ID NO: 6957 - protein, 377 aa, Leifsonia xyli
MNASTSISLTSGPTETSGLLWNVARNEAARTAAERAEILADPGFGNYFTDHMVDLCWSAKGGWHRPRVSPYGPIPLDPSAAVLHYAQEIFEGLKAYRHEDGSIWSFRPEANAARMQRSSYRLALPQLPVEHFLDSLKQLIAVDGDWVPDTEETSLYLRPFMFAKEAFLGVRPANKVAYYLIASPAAAYFPSGVAPVSIWLSDRWSRAGKGGTGAAKTGGNYASSLLPQAEAHEHGCAQVLFLDSVESTYIEELGGMNVVLVYKDGTLVTPDSDSILEGITLDSVLQLARDRGHRVERRRVTIGEWRDGVESGDIVEVFACGTAAVITPIGELKSDTFAVGDITAAPGALTLSLRKELTDIQYGRERDRHGWMYRLDA

SEQ ID NO: 6958 - DNA, 1083 bp, Desulfotalea psychrophila
  CDS (1)..(1083)
atgtgggaaaatcttgatgttgcacttgaaaaagtatctgtcgaaaatttaaaggaaaaaccttcaagtgagaacctttgttttggtagtgactttaccgatcacatgtttgcgatgacatggagcagagagaacgggtggcatgacgcaaaaatttgtccatatcataatttggtccttgatcctgcggcaatggtcttccattacggccaggcaatttttgaggggatgaagggctataagggtaaggatgggcagacctatatgtttcgtccgacggataaccttgagcggatgaatcaatctgcagtacgtctctgtatgccccgcctgcccgtggacaaggtgttgaagagcttgaaggcccttctctatctcgaaaaggattggattcccgaggcccccggttcatctctctatattcgtccgaccatgattgcggtagagcccagtcttggtgtccgtccttccgagaagtactacttctttgttattatgagtcccgtgggcgcatactataaggagggttgtaaccctaccaagatctacgtaagtgatgagcaggcccgtgcagttcccggtggcgttggcaatattaagactgccggaaattatgcagcatctctctatactgctgagattgcaaggaaaaaaggttgtagccaagtcctctggctcgatgcgaaagagtttaagtatgtggaagaggtgggcaccagtaatatcttcttccgtattggcgatgagcttatcactcctccgcttggaggttcaattcttggcggtatcaccagagattctattttgaaacttgccagaagctggggcctcaatgtctccgagcgcaagatcaccatagaggaagttttacgggcaagtgaagacggtactctgctggaatcctttggcacaggaacggctgctgtaatctcccctgtaggtgaaattgtctataaggataagagctatatcattaatgctggtaaggctggagaactctcgcagagactctatgccgagcttcagggtattcagtatggcgagctggaagatccattcaaatgggttgagcgtgtgggttag

SEQ ID NO: 6959 - protein, 360 aa, Desulfotalea psychrophila
MWENLDVALEKVSVENLKEKPSSENLCFGSDFTDHMFAMTWSRENGWHDAKICPYHNLVLDPAAMVFHYGQAIFEGMKGYKGKDGQTYMFRPTDNLERMNQSAVRLCMPRLPVDKVLKSLKALLYLEKDWIPEAPGSSLYIRPTMIAVEPSLGVRPSEKYYFFVIMSPVGAYYKEGCNPTKIYVSDEQARAVPGGVGNIKTAGNYAASLYTAEIARKKGCSQVLWLDAKEFKYVEEVGTSNIFFRIGDELITPPLGGSILGGITRDSILKLARSWGLNVSERKITIEEVLRASEDGTLLESFGTGTAAVISPVGEIVYKDKSYIINAGKAGELSQRLYAELQGIQYGELEDPFKWVERVG

SEQ ID NO: 6960 - DNA, 852 bp, Desulfotalea psychrophila
  CDS (1)..(852)
atgaggaacaagaagatgagcatatactgcctagacgggaatttcattgctgaagagaaggccacaatttcggtacatgacctctccctgctccgcggctatggcgtttttgatttcctccgcagttataatggtcatcccttccaactacaggcccatatagatcgccttgcccgatctgcgcagctcgtaggccttagcctcccggtctcctgtgaagagatcttccgactcaccatggagaccatcgcccacaataaccatcaggagtatcagatccgccttgtcatcaccggcggagagagccttggtggatttctcccggaaaggggtgcggcaaggcttatcattatggtcagccccctacacccgttacctgagcagtggtacagcaatggggttaaggtgaccacctgtagaaccagccgttttcttcccggggcaaagaccaccaactacatcccggccatcctggccatgcaggaggccacggcccggggggcagttgagtccatctacctcgacgcgggaggctttctccaagagggaacaacctcaaatttctttgccttttttggctcgacccttgttaccccaccaagtagccgcatactccctggaatcaccagggaagcggtacttgatctggcccaaggagagttcaatatcgaaattcgtcccatccatcaggatgaaatccgccttatggacgaggccgtgatcacggcctccaacaaggagatattacccgtctgcgccataaactccgagcaaatctcacagaaagtcggcctgcacagcaaaaagctcatgcagctctttaagagtttcactcgtaaataccagggttag

SEQ ID NO: 6961 - protein, 283 aa, Desulfotalea psychrophila
MRNKKMSIYCLDGNFIAEEKATISVHDLSLLRGYGVFDFLRSYNGHPFQLQAHIDRLARSAQLVGLSLPVSCEEIFRLTMETIAHNNHQEYQIRLVITGGESLGGFLPERGAARLIIMVSPLHPLPEQWYSNGVKVTTCRTSRFLPGAKTTNYIPAILAMQEATARGAVESIYLDAGGFLQEGTTSNFFAFFGSTLVTPPSSRILPGITREAVLDLAQGEFNIEIRPIHQDEIRLMDEAVITASNKEILPVCAINSEQISQKVGLHSKKLMQLFKSFTRKYQG

SEQ ID NO: 6962 - DNA, 1104 bp, Debaryomyces hansenii CBS767
  CDS (1)..(1104)
atgtcattagattcaacgaaattagaaatcactaaaactaccacaccaaaggaaaaattgccaaatgatcaattgatatttggtaaaactttcactgaccatatgttggaaattgaatggactcaagaaaatggatggggcgtaccaaagatttcaccttaccataacttttcgtttgatccatcaaccgtagtcttccactatgcgttcgaattgttcgaaggtatgaaggcatatcgtgataccaacaaccagattagaacattcagatctgataagaatatgataagaatgaaccaatctgcggaaagaattgctttgccaactttcgatggggaagaactcatgaagttgattgacaagtttttgattactgacgaaagttttgttcctcaaggtgctggttactcattatacttgagaccaaccttgataggtaccactgcctcgttaggtgttggaaccccagacaaggccttattatatgttattgcttctccagtcggtccatactacggtaccggtttcaagccggtttcattagaagctactgactacgctgtcagagcttggccaggtggtgttggtaaccgtaaattaggtgccaactacgccccatgtattttacctcaattagaagcagctcaaagaggctaccaacaaaacttgtggttattcggtgacgaaggttatgtcaccgaagtcggaaccatgaatgttttctttgctttcaaggattctgagggaaagaaggaattagtcactgccccattagatggtaccattttagaaggtgtcaccagagattccatcttgcagttatgtaaggaaagattaccttccgaatggactgttgtcgaacgtaaatttacaatccacgaaattgaagaaagagccgcaaagggtgaattaatcgaagctttcggtgctggtaccgctgctgtcgtttctccaatcgagagaattggttggaagggtaaggatatctcagttccaattactgctggtgatgctggtgaattaactacacaggttgctgaatggattagaaagattcaatacggtgaagaagaatacaaaaactggtcaagagttgctaaatag

SEQ ID NO: 6963 - protein, 367 aa, Debaryomyces hansenii CBS767
MSLDSTKLEITKTTTPKEKLPNDQLIFGKTFTDHMLEIEWTQENGWGVPKISPYHNFSFDPSTVVFHYAFELFEGMKAYRDTNNQIRTFRSDKNMIRMNQSAERIALPTFDGEELMKLIDKFLITDESFVPQGAGYSLYLRPTLIGTTASLGVGTPDKALLYVIASPVGPYYGTGFKPVSLEATDYAVRAWPGGVGNRKLGANYAPCILPQLEAAQRGYQQNLWLFGDEGYVTEVGTMNVFFAFKDSEGKKELVTAPLDGTILEGVTRDSILQLCKERLPSEWTVVERKFTIHEIEERAAKGELIEAFGAGTAAVVSPIERIGWKGKDISVPITAGDAGELTTQVAEWIRKIQYGEEEYKNWSRVAK

SEQ ID NO: 6964 - DNA, 1167 bp, Yarrowia lipolytica CLIB99
  CDS (1)..(1167)
atgcttcgaaacaacttgagatcgctttcgcgggccttcagcacctcctccatgcgtctgggcgccggaatggacgcctccaagctccagatcaccaagaccaagtcccccaaggaaaagcaggcccccaaggatctcattttcggccataccttcaccgaccacatgctgactgtcgagtggactgccaaggacggctgggctgctccccagatcaccccctacggtcctcttgagctggatccctccgccgtcgtcctgcactatgcctttgagtgtttcgagggcctcaaggcttacaaggacgagtctggaaacgtgcgtctgttccgagtcgacaagaacatgcaccgaatgaacacatcggccgagcgaatctgcctgcccgagtttgatggcgccgaggctgccaagctgattggccaattggccaagcttgattccgcttggatccccgagggacgaggctactccatgtacctccgaccttctctgattggaaccaccgccgctctcggcgtcggaacccccgataaggcgctcttttacgtcattgcatcccccgtcggcccctactaccctaccggattcaaggccgtcaagctggaggctactgactacgctgtccgagcctggcctggaggagtcggaaacaagaagctgggagccaactacgctccctgtatcaagcctcagcagcaggccgcttctcgaggctaccagcagaacctgtggctgtttggcgacgagggcaacatcaccgaggtcggtaccatgaacgccttctttgtgtttgagcgaaacggcaagaaggagcttgtcactgctcctttggacggtactattctcgagggtgtcactcgagactccattctggagctggctcgagaacgattgccttctgctgactggatcgtttccgagcgatactgcactattaaagaggtcgcggaggctgccgagaagggcgagcttgttgaggcctttggagctggtactgccgctgttgtctcgcctatcaaggagattggatggggagagaagactattaacattcctctccagcctggcaaggaggccggtaagctgactgagactgttaatgagtggattggagatatccagtacggtaaggatgaatacaagggatggtctaaggtggtctaa

SEQ ID NO: 6965 - protein, 388 aa, Yarrowia lipolytica CLIB99
MLRNNLRSLSRAFSTSSMRLGAGMDASKLQITKTKSPKEKQAPKDLIFGHTFTDHMLTVEWTAKDGWAAPQITPYGPLELDPSAVVLHYAFECFEGLKAYKDESGNVRLFRVDKNMHRMNTSAERICLPEFDGAEAAKLIGQLAKLDSAWIPEGRGYSMYLRPSLIGTTAALGVGTPDKALFYVIASPVGPYYPTGFKAVKLEATDYAVRAWPGGVGNKKLGANYAPCIKPQQQAASRGYQQNLWLFGDEGNITEVGTMNAFFVFERNGKKELVTAPLDGTILEGVTRDSILELARERLPSADWIVSERYCTIKEVAEAAEKGELVEAFGAGTAAVVSPIKEIGWGEKTINIPLQPGKEAGKLTETVNEWIGDIQYGKDEYKGWSKVV

SEQ ID NO: 6966 - DNA, 918 bp, Erwinia carotovora
  CDS (1)..(918)
atgcaaccgacattatccaaccaaagcagtcaggcctatttgcaagatccgcgtaacaacgacgtacaggtgtatgtgaatggggaatttgttcatcgcgacaacgcggtggtgtcgatctttgattccggctacgtgtgcggtgacggcgtatgggaaggattgcgcttggttaacggccgcctgattgcgctggacgcccatctggatcgcctgttcgagggtgctgcatcaatccaactggatatcggccatagccgggaggcgctgaccgctattctctataacacgctagccatcaacgggatgaccgatggcgcacatattcgcctgatgattacccgtgggaaaaagcatacgccgaatcaggatcctcgcttcatcatcggcggtgcaaccatcgtgtgcgtggcggaatacaaggtcgtcgatacagcggcgaaaaagcgcgggctgacgttgtttacgtccacttatcgcaccagcacaccggacgtcttcgatctgcgactcaattcgcacagccgacttaatcttattcaagcgctactacaggcgttgcaggctggtgcagacgaagcgttgatgctggatccgcacggttttgtcgccagttgcaactccaccaacttttttatcgtccgccgcggtgaactgtggacgtcatcggggcgctactgcttcaacggcattactcgccagacccttatcgatctcgctcacgccaacggactcacggtcaagactcaggactttacgctggcagaagcgctcaccgccgatgaagcctttgtcaccggcacgctggcgggtatcaccccagtaaaagcattggatggccacccatttagcgccgaacatcgcccagttacagagcagcttagccagtggtatgaggcatatctaaacgcacagtga

SEQ ID NO: 6967 - protein, 305 aa, Erwinia carotovora
MQPTLSNQSSQAYLQDPRNNDVQVYVNGEFVHRDNAVVSIFDSGYVCGDGVWEGLRLVNGRLIALDAHLDRLFEGAASIQLDIGHSREALTAILYNTLAINGMTDGAHIRLMITRGKKHTPNQDPRFIIGGATIVCVAEYKVVDTAAKKRGLTLFTSTYRTSTPDVFDLRLNSHSRLNLIQALLQALQAGADEALMLDPHGFVASCNSTNFFIVRRGELWTSSGRYCFNGITRQTLIDLAHANGLTVKTQDFTLAEALTADEAFVTGTLAGITPVKALDGHPFSAEHRPVTEQLSQWYEAYLNAQ

SEQ ID NO: 6968 - DNA, 936 bp, Acinetobacter sp
  CDS (1)..(936)
atgtgtgccatgaatttggctgatcgtgatggttttatttggcaagatggacaattggttgactggcgtgatgcaaaaattcacgttttaactcatacgctacactacagtatgggtgtctttgaaggtgtccgtgcctatgaaactcctaaaggcactgcaatttttcgtctccaagatcacactaagcgtttgttaaactctgcaaaaatttatcaaatgaaagttccatttgatcaagcgacacttgagcaagctcaaattgatgtggttcgtgaaaataaattagcatcttgttacttgcgtccattgatctggatcggttctgaaaaattaggtattgctgccactgaaaatagtattcatgctgccgttgcggcatggggctggggtgcttaccttggtgaagaggcaatggcacgtggtattcgtgtaaaaacatcttcgtttacgcatcatcatccaaacgtgacgatgtgtaaggcaaaagcatgtggcaactatactgtgtcgatcttggcacatcaggaagtagcgcgttcaggttatgatgaagcgatgttgctagatccacaaggctttgtgtgtcaaggtgcaggcgagaacgtgttcttgattaaagatggcgtgttgcatacccctgatttggctggtggtgcattagaagggattacccgtcaaacagttattaccattgcaaaagatttaggatacgaagtggttgagcgtcgtattacccgtgatgaattctacattgcagatgaagcattctttactggtactgccgcagaagtgacgccaattcgtgaatacgatgaccgtgaaattggtgaaggatgccgtggcccaattaccacagaaatccagaaaacctttttcgatgcggttcagggcaaaaatgcaaaatatgaacactggttaacttacgtgaagtaa

SEQ ID NO: 6969 - protein, 311 aa, Acinetobacter sp
MCAMNLADRDGFIWQDGQLVDWRDAKIHVLTHTLHYSMGVFEGVRAYETPKGTAIFRLQDHTKRLLNSAKIYQMKVPFDQATLEQAQIDVVRENKLASCYLRPLIWIGSEKLGIAATENSIHAAVAAWGWGAYLGEEAMARGIRVKTSSFTHHHPNVTMCKAKACGNYTVSILAHQEVARSGYDEAMLLDPQGFVCQGAGENVFLIKDGVLHTPDLAGGALEGITRQTVITIAKDLGYEVVERRITRDEFYIADEAFFTGTAAEVTPIREYDDREIGEGCRGPITTEIQKTFFDAVQGKNAKYEHWLTYVK

SEQ ID NO: 6970 - DNA, 1116 bp, Candida glabrata CBS138
  CDS (1)..(1116)
atggacgcatcaaggttgaagatcacaaaagtttccactccaagtgaaagaaagccaaatgaccagctagtctttggtaagacttttaccgatcatatgctgaccattgaatggacctctgagaatggttgggacgctccggagatcaaaccatatggcaaattatgtcttgatccttcatcaattgtattccattatgccttcgagctgtttgaaggtatgaaagcatacagaacaaaggatggtaaaattgcaatgttcagacctgaaaaaaacatggaaagaatgaacaagtctgcagcaagaatttgcctgccaacatttgacggggaagaattgatcaaactgatcgggaagctgatcgaattagataagcacttgattcctgaaggtgagggatactctctctatattagacccactttgatcggtacatctgaaggccttggtgtaaaagagccagacagagccctactttttgtcatttgttctcctgttggcccttattataaaactggatttaaggcagttcgcttggatgctacagactatgcaacaagagcatggccaggtggcgtcggtgacaaaaaactgggcgctaattatgctccttgtgtattaccccagacgcaggctgccgctaagggtttccagcaaaatttgtggttatttggtccggagcactatgtcacggaagttggtacaatgaacgcattttttgcatttaattgtaaggaaaccggtaagaaagaattggtcactgcgccattagatggaactattttggaaggtgttactagagactccatcttaactcttgctagaaagtatttggatcctaatgaatgggagattaatgaaagatatttcactattcatgaggtccaagaaaaggctcataaaggtgaattattagaggcatttggaagtggtacagcagctattgtttcccctatcaaggagattggatggaaagacactattatcaatgttcctttgattcctggagaacaaagcggaccacttacaaaacaaatagcatcatggatgatggatatccaatatggtaaagtagaacttgataactggttaagaattgttgcagacattaattaa

SEQ ID NO: 6971 - protein, 371 aa, Candida glabrata CBS138
MDASRLKITKVSTPSERKPNDQLVFGKTFTDHMLTIEWTSENGWDAPEIKPYGKLCLDPSSIVFHYAFELFEGMKAYRTKDGKIAMFRPEKNMERMNKSAARICLPTFDGEELIKLIGKLIELDKHLIPEGEGYSLYIRPTLIGTSEGLGVKEPDRALLFVICSPVGPYYKTGFKAVRLDATDYATRAWPGGVGDKKLGANYAPCVLPQTQAAAKGFQQNLWLFGPEHYVTEVGTMNAFFAFNCKETGKKELVTAPLDGTILEGVTRDSILTLARKYLDPNEWEINERYFTIHEVQEKAHKGELLEAFGSGTAAIVSPIKEIGWKDTIINVPLIPGEQSGPLTKQIASWMMDIQYGKVELDNWLRIVADIN

SEQ ID NO: 6972 - DNA, 1188 bp, Candida glabrata CBS138
  CDS (1)..(1188)
atgatgctgaactctagactagcgtttgctagtataagcagaaatttcggccttgctagaaggtcaattgccagcttggatgcctctaaactgaaagttacaaagaaaacaccaccatcacaacccagacctaatgatgagcttgtttttggtcagacatttactgatcacatgcttacaattgaatggactaaagagaaaggttgggatatcccggaaatcaagccatatggaaacttgaccctagatccatcttcttgtgtattccactacgcctttgagctttttgaaggtttaaaagcttacaggaccccagacaataagattactatgtttagaccagatatgaatatgattcgtatgaacaaatctgcagctcgaatctgtttacctacatttgatagcgaagagttgatcaaattaatgggcaagctaattgaacaggacaaacatttggttccaactggaactggctactcattgtacatcagaccaactttgattggtaccacaaatggcctaggtgtcggtactccagacagagcattgctttttgtcataacctctccagttggtccttattataagactggtttcaaagctgtcaggctagaagctactgactacgcaaccagagcttggccaggtggtgttggtgacaagaagttgggtgcaaactatgctccatgtattcttccacaacttcaagcggcagaaagaggttatcaacaaaacctttggttattcggtcccgaaaaacatgtgacagaagtcggtactatgaatgtattctttgccttcaaaaattctgttaccggaaagaaagaacttgtgacggctccattagatggtactattttggaaggtgttacaagagactccatattgacacttacaagacaaaacttagatccaaacgaatgggaaattaatgaacgttactatagcattaatgaagttgctgaaagagctgcgaagggtgagctattagaagcttttggcgccggtaccgctgctgttgtttcaccaattaaggctatcggatggcaaggaaaagatattgatgtgccattgatacctggtgaacaatctggtccaataactaaacaagtggcccaatggattgctgatattcaatatggaagagtaaaacatggtaactggtcaagagtagtagctcaattatag

SEQ ID NO: 6973 - protein, 395 aa, Candida glabrata CBS138
MMLNSRLAFASISRNFGLARRSIASLDASKLKVTKKTPPSQPRPNDELVFGQTFTDHMLTIEWTKEKGWDIPEIKPYGNLTLDPSSCVFHYAFELFEGLKAYRTPDNKITMFRPDMNMIRMNKSAARICLPTFDSEELIKLMGKLIEQDKHLVPTGTGYSLYIRPTLIGTTNGLGVGTPDRALLFVITSPVGPYYKTGFKAVRLEATDYATRAWPGGVGDKKLGANYAPCILPQLQAAERGYQQNLWLFGPEKHVTEVGTMNVFFAFKNSVTGKKELVTAPLDGTILEGVTRDSILTLTRQNLDPNEWEINERYYSINEVAERAAKGELLEAFGAGTAAVVSPIKAIGWQGKDIDVPLIPGEQSGPITKQVAQWIADIQYGRVKHGNWSRVVAQL

SEQ ID NO: 6974 - DNA, 1107 bp, Bartonella henselae
  CDS (1)..(1107)
atgaaatctcctacatcatcaattccatttaaaatagaaaaacatccatcacctttatcagacgaagaacgtgagcatattctcaaaaatcctggttttggtcaattttttacagatcacatggtgatcattaaatggactaaagataaaggttggcataatgctgtcatctctcaatacaaatctttagaaattaatccagcaagtaccgttctgcattatgggcaagagatttttgaaggtttaaaagcgtatcgtgcaaaagatgggcgtattttgttatttcgtcctgatgccaatgcgcaacgttttatagaatcagcaagacgattagctatgcctgaattgccaaaggacatttttttagatgctgttcataaattggtaagaattgatcaaaattggatttctggaaatcccaatgctagcctttacatacgtccgtttatgtttggtaatgaaaactttttgggagttcgcccttctgaaaaatatattttctgtattatagcatctcctgttgaatcctattttaaaggagaagaaaaacctgtcagtgtatggcttgaaacagattacagccgtgctggtccaggcggaacaggtgtagcaaaatgtggtggtaactatgcagcaagtttacttgcacaaaagaatgcagaacaaaataattgtagtcaagtactcttccttgacatggttgaacataagtggattgaagaactcggcggtatgaatgtttgttttattatggaaaataatacgcttgtaacacccgcacttaatggcacaattcttgcaggaataacacgtcattcaattttgaagttggcccaaaaaatgggtttaaaaatagaagaacgcccttattcttttgaatcgcttcaggaagatgcaagaagtaatcacctgaaagaagtttttgcttgcggtactgctgctgttgtcacatcaatcggccgttttaaatataaaggtggtgaattcgttatcggaaatggaatgattggtgaggtcacgaaaaaacttcgcacacaacttgttgatcttcaaaaaggcaatagagaagataaaaatggctgggtccattctgttcagctctcataa

SEQ ID NO: 6975 - protein, 368 aa, Bartonella henselae
MKSPTSSIPFKIEKHPSPLSDEEREHILKNPGFGQFFTDHMVIIKWTKDKGWHNAVISQYKSLEINPASTVLHYGQEIFEGLKAYRAKDGRILLFRPDANAQRFIESARRLAMPELPKDIFLDAVHKLVRIDQNWISGNPNASLYIRPFMFGNENFLGVRPSEKYIFCIIASPVESYFKGEEKPVSVWLETDYSRAGPGGTGVAKCGGNYAASLLAQKNAEQNNCSQVLFLDMVEHKWIEELGGMNVCFIMENNTLVTPALNGTILAGITRHSILKLAQKMGLKIEERPYSFESLQEDARSNHLKEVFACGTAAVVTSIGRFKYKGGEFVIGNGMIGEVTKKLRTQLVDLQKGNREDKNGWVHSVQLS

SEQ ID NO: 6976 - DNA, 1077 bp, Staphylococcus aureus
  CDS (1)..(1077)
atgtcacaagcagttaaaattgaattacgcgaaacattaaaagaaaaaccagatacatctcaattaggatttggtaagtattttacagattatatgttgagttatgattatgatgcggataaaggatggcatgatttgaagattgtaccttatggtccaattgaaatttcgccagcagcacaaggtgttcactatggacaatcagtgttcgaaggtttaaaagcatataaaaaagatggagaggttgcacttttccgtccagatgaaaactttaagcgtcttaataactcgttagcacgcttagaaatgcctcaagtcaatgaaggtgaattgctagaaggacttaagcaattagttgatttagagagagaatgggttccggaaggtgaaggtcaatcattatatattcgtccttttgtttttgcgacagaaggggtacttggcgttggtgcatcacatcagtataaattattaattattttatctccttcaggtgcatattatggtggtgaaactttaaaaccaactaaaatctatgtagaagatgaatatgtacgtgctgttcgtggcggtgtaggctttgcgaaagttgcaggtaactatgcggcaagtttattagcacaaactaatgcaaataaattaggttatgaccaagtattatggcttgatggtgttgaacagaaatatatcgaagaagttggtagcatgaacattttcttcgttgaaaatggcaaagtaattacaccagagttgaatggcagtattctacctggtattacacgtaaatctattatcgaattagctaaaaacttaggatatgaagtcgaagagcgccgcgtttcaatcgatgaattattcgaatcatatgataaaggtgagttaacagaagtatttggtagtggtactgcagcagttatttcacctgtaggtacattgagatatgaagatcgtgaaatcgttattaataataatgagactggtgaaattactcaaaaattatacgacgtctatactggtattcaaaatggtactttagaagataaaaatggttggagagtcgttgtaccaaaatattaa

SEQ ID NO: 6977 - protein, 358 aa, Staphylococcus aureus
MSQAVKIELRETLKEKPDTSQLGFGKYFTDYMLSYDYDADKGWHDLKIVPYGPIEISPAAQGVHYGQSVFEGLKAYKKDGEVALFRPDENFKRLNNSLARLEMPQVNEGELLEGLKQLVDLEREWVPEGEGQSLYIRPFVFATEGVLGVGASHQYKLLIILSPSGAYYGGETLKPTKIYVEDEYVRAVRGGVGFAKVAGNYAASLLAQTNANKLGYDQVLWLDGVEQKYIEEVGSMNIFFVENGKVITPELNGSILPGITRKSIIELAKNLGYEVEERRVSIDELFESYDKGELTEVFGSGTAAVISPVGTLRYEDREIVINNNETGEITQKLYDVYTGIQNGTLEDKNGWRVVVPKY

SEQ ID NO: 6978 - DNA, 885 bp, Bacillus thuringiensis
  CDS (1)..(885)
atgggatcgaaattggcatatgaaagatttgtactttggaatgatgcagttattgatacaacgaaacaaaaaacatacatagaacttgaagaaagaggcttgcagtttggagatggtgtctacgaagttattcgtctatataaagggaactttcacttattagatccgcatatcacaagattatatcgctccatggaagaaatagaattaacactccctttctcaaaagcagaactgattaccctactttataaactaatcgaaaataataatttccacgaagatggaacgatttatttgcaagtatctcgtggtgtacaagctcgtacccatacgttctcatatgacgtccctccgacaatctatgcttatattacaaagaaagaaagaccagcgttatggattgaatatggtgtacgtgctatatcagaaccggatacacgctggctacgctgtgatatcaaatcattaaatttattaccaaatatattagctgctacgaaagcggaacgaaaaggttgtaaagaagcccttttcgtacgaaatggtactgtaactgagggaagtcactctaacttctttctcattaaaaacggaactctttacacacatccagctaatcaccttattttaaatggcattattcgtcaatatgtcctttctttagcgaaaacccttcgtattccagtacaagaagagcttttcagcattcgtgatgtttatcaagcggatgaatgtttctttacaggaacgacgattgaaattttgccgatgactcaccttgatggaaccgcaatccaagatggtcaagttggccctatcactaaaatgctgcaaagatcattttctcaaagtttgttacaatccaacatgtcatcctcttaa

SEQ ID NO: 6979 - protein, 294 aa, Bacillus thuringiensis
MGSKLAYERFVLWNDAVIDTTKQKTYIELEERGLQFGDGVYEVIRLYKGNFHLLDPHITRLYRSMEEIELTLPFSKAELITLLYKLIENNNFHEDGTIYLQVSRGVQARTHTFSYDVPPTIYAYITKKERPALWIEYGVRAISEPDTRWLRCDIKSLNLLPNILAATKAERKGCKEALFVRNGTVTEGSHSNFFLIKNGTLYTHPANHLILNGIIRQYVLSLAKTLRIPVQEELFSIRDVYQADECFFTGTTIEILPMTHLDGTAIQDGQVGPITKMLQRSFSQSLLQSNMSSS

SEQ ID NO: 6980 - DNA, 876 bp, Bacillus thuringiensis
  CDS (1)..(876)
atgaaagctactcataaagattggattttatttaacggaagaattgtaaatacgaaggaagaacaaccgatgattccattagaggagagaggctttcaatttggtgatggtatatacgaggtattcagactatatgatgggaagccacatttattagatttacatttagaacgattctttcattctatggaagaaataaaattaattccaccatttactaaggaagagttggcggaagagttacatcaaatgattgaaaaaaatcaatttcaagaagatgggaatgtatatttgcaaatatcaagaggcgcccaagcacgtaatcatgtatatgagtcaaatatgcaaccaacatattttgcaaatattgtttcgtttccacgaccaattgctactatggaacaaggaataaaagttactgtagaagaggatatacgctggaagttttgtcatataaaatctttaaatctgctacctaatattatgattaaaaataaaataaacgaacaaggctatcaagaagcgatattagtgcgagatggaattgtaacggaaggttgtcattcaaatttctttatggtgaaaaataataaattgattacacatccggctgacaatttcattctacacggcattacacgtcattatgttattacattagcgaaggagttacatattgaagtagaagaaagagaattttcacttcaagaagtatatgaggccgatgagtgcttcttcacagcgacaccacttgaaatattcccagtcgttcaaattggtgacgagcagtttggaaacggagaaagagggccaattacaaagagactccaagttgcatatgaagaaagtattcgtttgtttaaagttacgaactaa

SEQ ID NO: 6981 - protein, 291 aa, Bacillus thuringiensis
MKATHKDWILFNGRIVNTKEEQPMIPLEERGFQFGDGIYEVFRLYDGKPHLLDLHLERFFHSMEEIKLIPPFTKEELAEELHQMIEKNQFQEDGNVYLQISRGAQARNHVYESNMQPTYFANIVSFPRPIATMEQGIKVTVEEDIRWKFCHIKSLNLLPNIMIKNKINEQGYQEAILVRDGIVTEGCHSNFFMVKNNKLITHPADNFILHGITRHYVITLAKELHIEVEEREFSLQEVYEADECFFTATPLEIFPVVQIGDEQFGNGERGPITKRLQVAYEESIRLFKVTN

SEQ ID NO: 6982 - DNA, 873 bp, Bacillus thuringiensis
  CDS (1)..(873)
atgttaatttacgtaaacggtcagtatgtaaaagcgagtgaagcgagaatttcgccgtatgaccacggttatttatatggtcttggagtttttgagacgtttcgtatttataatggccatcctttcttattggatgatcattatgaccgtttaatagatgcgctggatacattgcaaataaaatggacaatgacaaaagatgaagtactgcttattttgaagaatttactcattaagaataaattagagaatgcgtatgtccgttttaatgtatcggcgggtatagatgaaattggattgcaaacggaaatgtatgaagagccgtctgttattgtttttataaaacctttagcagccccaggagaggtagcggaaaaagaaggggttgttttaaaacaagttcgaaatacaccagagggtgcggctcgtttgaagtctcatcattatttaaataacattttaggaaaacgtgaaattggaaatgttgtgaataaggaaggtatttttcttactgaaacaggttatgttgcagagggtattgtttcgaatctcttttttgtgaaaggtgatattttatatacaccttctctcgaaacagggattttaaatggtatcactcgtgcgtttattataaaagttgctgaagagctaggtataaaagtaaaggaaggtttctttacaaaagatgaattactttcagctgatgaagtcttcgtaacaaactcgattcaagaaattgttccgcttaatcgtatagaggaacgggatttcccgggtaaagtaggtatggttacaaaaagatttataaatctttatgaaatgcagagagagaaattgtggagcagaaatgaattgcgaagaggagatgtgtag

SEQ ID NO: 6983 - protein, 290 aa, Bacillus thuringiensis
MLIYVNGQYVKASEARISPYDHGYLYGLGVFETFRIYNGHPFLLDDHYDRLIDALDTLQIKWTMTKDEVLLILKNLLIKNKLENAYVRFNVSAGIDEIGLQTEMYEEPSVIVFIKPLAAPGEVAEKEGVVLKQVRNTPEGAARLKSHHYLNNILGKREIGNVVNKEGIFLTETGYVAEGIVSNLFFVKGDILYTPSLETGILNGITRAFIIKVAEELGIKVKEGFFTKDELLSADEVFVTNSIQEIVPLNRIEERDFPGKVGMVTKRFINLYEMQREKLWSRNELRRGDV

SEQ ID NO: 6984 - DNA, 939 bp, Photobacterium profundum
  CDS (1)..(939)
atggcaaacacagcagattacatttggtttaatggtgaaatggttccttgggctgaggcaaatgttcacgtattaactcatgctatgcactatggtacgtcggtttttgaaggtattcgctgctataacacccctaatggccccattgtttttcgtcataaagaacacatggatcgcttaaaaaattcagcaaagatttaccgcttcccaattccatactcatctgaagaattaatggaaatttgtcgtgagacgattcgcgtcaacgaactagaatctgcttatattcgtccattaggctatgtcggtaatgtcggtctaggtgtttgcccaccggttgatactgaaatggatcttatcgtcgcggcttttccttgggggtcataccttggtgaggaagcattagaaagtggtgtcgatgccatgatttcaagctggaatcgtgcagcacccaataccattccaaccgccgccaaagcgggcggtaactacctttcatcattattagtcggtagtgaagcacgccgccacggttatgccgaaggcatcgcactgagtgttgatggttacctctctgaaggcgctggcgagaatatttttgtggttcgtaatggaatattatctacaccaccagcaacgtgtgcaatcttacctggcatcacgcgtgattcaatcatggtgctagccaaagagatgggctatgaaattcgtgaagaaaatatcgcgcgtgaagcactctacctcgcagatgaagtcttcatgacaggcactgcggcagagattgtgcctgttcgtagtgttgaccaaatctcggtaggtgaaggtaaacgcggccctatcaccaaagaaattcaagcggcttactttggtctattcaatggaacaacagaagataagtggggctggttagattacgtttaccctaaatctgacaagtaa

SEQ ID NO: 6985 - protein, 312 aa, Photobacterium profundum
MANTADYIWFNGEMVPWAEANVHVLTHAMHYGTSVFEGIRCYNTPNGPIVFRHKEHMDRLKNSAKIYRFPIPYSSEELMEICRETIRVNELESAYIRPLGYVGNVGLGVCPPVDTEMDLIVAAFPWGSYLGEEALESGVDAMISSWNRAAPNTIPTAAKAGGNYLSSLLVGSEARRHGYAEGIALSVDGYLSEGAGENIFVVRNGILSTPPATCAILPGITRDSIMVLAKEMGYEIREENIAREALYLADEVFMTGTAAEIVPVRSVDQISVGEGKRGPITKEIQAAYFGLFNGTTEDKWGWLDYVYPKSDK

SEQ ID NO: 6986 - DNA, 864 bp, Methanococcus maripaludis
  CDS (1)..(864)
atgaaaatttatctcgatggaaacttcgtagagaaagaagatgcgaaagtatccgtatatgaccacgggttgctttatggtgacggggtttttgaaggaattagggcatatgatggagtagtatttaaattagaagagcatattgaacgtttatatgattcagcagactctatcgctatgaaaatccctgcttcaaaagtagaaatggaagaaattgttattgaaactttaaaatcaaacaacttaaaagacgcatacataagacttgtagttacaaggggagttggggatttaggacttgatccaagaaaatgtccaaaagcaacgattttctgtattgcagagaatatgaaaccacttcttggagaagatggaataaaggttataacctcatcaataagaagactgcctgtggatgttttaaatcctgctgtaaaatctttaaattatttaaacagtattttagcaaaaattcaggccaattacgcgggagtagacgaagcttttttactcgacagtgaaggatacgtcgcagaaggaactggtgacaatgtatttgttattaaaaatggtaaaataaaaacaccccctctttcatcaagtgttttaaagggaattacaagagacactgttgtagatcttgcaaaagaagcaggttatacaattatagaggaaaaaatgacgttacacgatttatttgttgcagatgagatatttatcacgggaaccgcggcagaattaatccatgttgttgaaatcgatggaagaataattaacaacggaaaattaggccctgttacaaaagatttaagcgatagattcaaagaaataaggtctaaaatcggtaaaaaatatatcgagtaa

SEQ ID NO: 6987 - protein, 287 aa, Methanococcus maripaludis
MKIYLDGNFVEKEDAKVSVYDHGLLYGDGVFEGIRAYDGVVFKLEEHIERLYDSADSIAMKIPASKVEMEEIVIETLKSNNLKDAYIRLVVTRGVGDLGLDPRKCPKATIFCIAENMKPLLGEDGIKVITSSIRRLPVDVLNPAVKSLNYLNSILAKIQANYAGVDEAFLLDSEGYVAEGTGDNVFVIKNGKIKTPPLSSSVLKGITRDTVVDLAKEAGYTIIEEKMTLHDLFVADEIFITGTAAELIHVVEIDGRIINNGKLGPVTKDLSDRFKEIRSKIGKKYIE

SEQ ID NO: 6988 - DNA, 975 bp, Bdellovibrio bacteriovorus
  CDS (1)..(975)
atgaatctacccattctttcttctgcggatgttcaggcccaacttttaaagcgacaataccaggctcaaggcagctatctggcgatgtacagcagctggtatggcggggtgattaaagacccggggctgatgatggtgccggtggatgatcaccttgtgcaccgcggggatggtgtctttgaggcgatcaaagtcgtggatggtcaggtgtttttgatgcaagagcatctggagcgtctgcagtcttccgcccagcagatcggtatcagtctgccgcacagcctggaagacatgaaaaagattattctcgaaaccacgcgcattgccggcgcgccttatgcagttttgcgcctgtatatttcccgtggtccggggtattttacgacaaatccttacgattccatcagctcgcagatgtatttgattgtgacttcgtttacgccgttaacagatgaaaagtacttgaagggcgtgaaggtcgggcgcagtcagattgttcccaaagacccgtggctggctcggattaagacctgcaattatttgccgaacgtaatgatgaaaaaagaaagtgtggaccgcaagatcgacttcaccatcggcattgatccgcaagggttcatcacggaaggcagcacggaaaacatcgttctgattgataaagacaaaaacctgcttcgcccaaaactgcgccaaattctgaaaggcacaaccatgatgcgcacctttgatctggctgaaagcctgttggcgtcgggggagttaaagtccatccaggaaaaggatctgaccgagcaggatattctcagcgcatctgaagccatgatgatcggaacaactttggatgtgttgccagtgaccgaatacgaaggtcagcagattggcgagggcaaacaaggagcgctcgcgtttaagcttttgcagctgctccgcgaggatatgaaaaaggggccgaaaacgacccctgtaaagttctaa

SEQ ID NO: 6989 - protein, 324 aa, Bdellovibrio bacteriovorus
MNLPILSSADVQAQLLKRQYQAQGSYLAMYSSWYGGVIKDPGLMMVPVDDHLVHRGDGVFEAIKVVDGQVFLMQEHLERLQSSAQQIGISLPHSLEDMKKIILETTRIAGAPYAVLRLYISRGPGYFTTNPYDSISSQMYLIVTSFTPLTDEKYLKGVKVGRSQIVPKDPWLARIKTCNYLPNVMMKKESVDRKIDFTIGIDPQGFITEGSTENIVLIDKDKNLLRPKLRQILKGTTMMRTFDLAESLLASGELKSIQEKDLTEQDILSASEAMMIGTTLDVLPVTEYEGQQIGEGKQGALAFKLLQLLREDMKKGPKTTPVKF

SEQ ID NO: 6990 - DNA, 1068 bp, Bdellovibrio bacteriovorus
  CDS (1)..(1068)
atgaccacaattacgaagaatctaaccaacactccgaaagcccttccaccctctgatcagcttggattcgggcagcatttttctgaccacatgtttgtggctaaatacactgaaggcaagggctggtctgaagccagcgtcgtcccttatgggccgctttctttggatcccggggcttcggtgtttcattatggtcaggctttgtttgaaggcatgaaggccttccgcaaagaaagcggcgaagtggtcttcttccgtcctgagttcaattatcaccgtttggctgaaggcgctgctcgtttgtgcctggaagctccgccaatggaccttttcatggaaggtctgcaccaggtggtggcggctgatgagcgctggattccaaaagggccgaacacgtctttgtatatccgtccgaccttgattgggtctgagccgttcctgggggttcgtccttcccgtgaaacgttgttctttattctgttgtctccggtgggttcttattattctgaaggcacaaaaccaatcaagatttggaccgaggaaaagtacctccgtgcagctccagggggcctgggtgcggtgaaggccggggcgaactatgcctcgagtttaaaggcggccttggaagccaagaagaagggctatgcccaagttctgtggctggatgtcgagcaccagggtattgaggaggtcggcacaatgaacgtgttcttcgtcttcgataatgaaatcgtcacgccggcattgaatggcagcattctttctggtggcacccgcgatgcgattctgcagttgttgcgctctaaaaatctgccagtggtggaaagacgtatcacgatcacggaagtggtggatcgtctggcaaaaggtgaattgaaagaagctttcggcacgggtacggcggcggtgatttccccagtgggtgttttgcactatcaggggaaagactggacaatcaacaacaacgaaaacggacctctgagcacacagttgtacaacgagataacggcgatccagcgtggcgctcaagccgataccttgaactggcttgttcctttgaagaagtaa

SEQ ID NO: 6991 - protein, 355 aa, Bdellovibrio bacteriovorus
MTTITKNLTNTPKALPPSDQLGFGQHFSDHMFVAKYTEGKGWSEASVVPYGPLSLDPGASVFHYGQALFEGMKAFRKESGEVVFFRPEFNYHRLAEGAARLCLEAPPMDLFMEGLHQVVAADERWIPKGPNTSLYIRPTLIGSEPFLGVRPSRETLFFILLSPVGSYYSEGTKPIKIWTEEKYLRAAPGGLGAVKAGANYASSLKAALEAKKKGYAQVLWLDVEHQGIEEVGTMNVFFVFDNEIVTPALNGSILSGGTRDAILQLLRSKNLPVVERRITITEVVDRLAKGELKEAFGTGTAAVISPVGVLHYQGKDWTINNNENGPLSTQLYNEITAIQRGAQADTLNWLVPLKK

SEQ ID NO: 6992 - DNA, 885 bp, Rhodopseudomonas palustris
  CDS (1)..(885)
atggatccgacgacgatgcccgctcctgcaccgatcaactactcccagacctggaccttcttcgagggcgagtggcatgacggcaacgtgccgatcatggggcctcgcacgcacgcagcgtggctcggctccatggtgttcgacggcgcgcgcgcattcgagggcgtgacgccggatctcgaccaacatttggcgcggatcaactggtcggcgaccaacttcaagctcaacgcactggtggacaaggcgacttggcttggcttggtacaggacggcctgaagcgattcgccggcaatgccgagctttacatccggccgatgtattgggcgcaaaacggcgttggcggcggcgtgctgttcgatccggacaccaccaattggtgcctgtgcatctatgaagcgccgatgccgaagccgaccggcctgtcgattacgctgtcgccgttccgccgcccgaccgccgaatgtgcgccggtggaagccaaagccggatgcctgtacccgaacaattcacgggccatgatggaagccaagagtcgcggcttcgacaactgcctgctgcgcgacatgctcgggcatatcgccgagctcggcaactccaatatcttcatggctaaagacggcgtggtctatacgccggcggccaacggcaccttcctgagcggcatcacccggcagcgggtgatcgagctgctgcgcggcgatggcatcaccgtgctcgaaacttcgctgagttatcgcgactttgagaccgccgacgagatcttcgccagcggcaatttcgccaaggtgcagccgatcatccggatcgacgaccgctcgctgcagccgggcccgttctacgccaaggcgcgcaagctgtattgggagttcgcacacggctga

SEQ ID NO: 6993 - protein, 294 aa, Rhodopseudomonas palustris
MDPTTMPAPAPINYSQTWTFFEGEWHDGNVPIMGPRTHAAWLGSMVFDGARAFEGVTPDLDQHLARINWSATNFKLNALVDKATWLGLVQDGLKRFAGNAELYIRPMYWAQNGVGGGVLFDPDTTNWCLCIYEAPMPKPTGLSITLSPFRRPTAECAPVEAKAGCLYPNNSRAMMEAKSRGFDNCLLRDMLGHIAELGNSNIFMAKDGVVYTPAANGTFLSGITRQRVIELLRGDGITVLETSLSYRDFETADEIFASGNFAKVQPIIRIDDRSLQPGPFYAKARKLYWEFAHG

SEQ ID NO: 6994 - DNA, 1113 bp, Rhodopseudomonas palustris
  CDS (1)..(1113)
atgggagtttcgttcgacaagatggacggctcgctctggctggatttcgacgtgcagcctaccgccagcccgacgccggacgccgatcgcgccgccaagctggaaaatccgggcttcggccgggtgtttaccgaccacatggccgtggtccgctatgaccagaccaatggctggcacgctgcgcgcgtcgaggctcgtgccaatttcccgctgcacaccgcgaccgccgtgctgcactacgcgcaggaaatcttcgagggcctgaaggcttacaagcgcgaggacggcggcgtgaacctgttccgccccgacgccaacgccaagcgcttccgcgactcggccgaccgcatggcgatggcgccgcttccggaagcggtgttcatcgaagcggtcgagcaggtcgtcaagatcgaccgcaactggattccgggcggcgaaggcagcctgtatctgcgcccgttcatgatcgccagcgaagtgttcctcggcgtcaagccgtcggcggaatacatcttcgcggtgatcgcctcgccggtcggctcgtacttcaagggcggcccggccccggtctcgatctgggtgtcggaaacctacacccgcgcggcgatcggcggcaccggcggcgtcaaatgcggcggcaactacgcggcgtcgttgcgcgcgcaggccgaggcgatcgagcgcggctgcgatcaggtggtgttcctcgacgcgatcgagcgccgctacgtcgaagagctcggcggcatgaacgtgttcttcgtgttcgaagacggttcgctgtcgacgccgccgctcggcaccatcctgcccggcatcacccgcgactcgatcatcgcgctggcccgcgaggccggccgcaaggtgcgcgaggaggcttacaccatcgatcagtggcgtgccgatgcggccagcggcaagctcaaggaagcgttcgcctgcggcaccgccgcggtgatctcgccgatcggcaaggtgtgctcgaaccacggcgacttcgtcatcaacggcggccaagccggcgaagtggcgatgggcctgcgcaagcagctcgtcgacatccaatacggccgcgccgccgacacccacggctggatcaagaaggtgttctga

SEQ ID NO: 6995 - protein, 370 aa, Rhodopseudomonas palustris
MGVSFDKMDGSLWLDFDVQPTASPTPDADRAAKLENPGFGRVFTDHMAVVRYDQTNGWHAARVEARANFPLHTATAVLHYAQEIFEGLKAYKREDGGVNLFRPDANAKRFRDSADRMAMAPLPEAVFIEAVEQVVKIDRNWIPGGEGSLYLRPFMIASEVFLGVKPSAEYIFAVIASPVGSYFKGGPAPVSIWVSETYTRAAIGGTGGVKCGGNYAASLRAQAEAIERGCDQVVFLDAIERRYVEELGGMNVFFVFEDGSLSTPPLGTILPGITRDSIIALAREAGRKVREEAYTIDQWRADAASGKLKEAFACGTAAVISPIGKVCSNHGDFVINGGQAGEVAMGLRKQLVDIQYGRAADTHGWIKKVF

SEQ ID NO: 6996 - DNA, 1116 bp, Corynebacterium diphtheriae
  CDS (1)..(1116)
atgaagtccatgagctctattacgtttaagaaaatcgatcatccgaacccaactccagcagacaaagtacaagaaattgttgccaaccccggctttggcaagtatttcaccgaccacatggtcactatcgattggaacgaaactgaaggctggcacaatgcacaggtacagccatatgcgccagtgtccttggaccctgctgcctcggtgttccactacggacaagcaattttcgaaggcctgaaagcctaccgccatgccgatggcaccatccgtaccttccgtccggaagcaaatgcggcgcgtttccagcgctccgctcagcgtttggctatgccagagcttcctatcgaggtctttatcgagtcaatccagcagcttgtctcagtagaccacgactgggttccagcagccggtggtgaggaatcgctctatctgcgcccattcatgatcgctaccgagaccacgttgggtgttcattcctcgaagtcttaccgctattttgttattgcttcgccagccggtgcctatttctctggtggcatcaagcctgtgtccgtatggctgtctgaagattacgttcgtgcagctcctggtggtactggtgcggctaagttcgcaggtaactacgcagcatcgctcatcgcacaaacccaggcagcagaaaaaggctgcgatcaggttgtatggctcgatgcaatcgagcacaactacatcgaagagatgggcggaatgaacctcttcttcgtcatgggcaaaggggatcaggctcacgtgattaccccgaagctgtccggttcactgcttcctggtgttacccgtgattctttgcttcaggttgctcgcgatcttggctacaccactgaagaacgcttggtgtctaagggcgagtgggaagaaaccgctacgagcggagctatgagcgaagcatttgcttgcggtactgcggccgtgattaccccagttggatctgtgaagtccacccatggtgagttcttggtaaacaacaacgaggcaggttcgatcaccatgcagcttcgtgaggcacttactggaatccagcgcggcagcgttgctgatactcacggatggatgcacactctcgtagaggcgtag

SEQ ID NO: 6997 - protein, 371 aa, Corynebacterium diphtheriae
MKSMSSITFKKIDHPNPTPADKVQEIVANPGFGKYFTDHMVTIDWNETEGWHNAQVQPYAPVSLDPAASVFHYGQAIFEGLKAYRHADGTIRTFRPEANAARFQRSAQRLAMPELPIEVFIESIQQLVSVDHDWVPAAGGEESLYLRPFMIATETTLGVHSSKSYRYFVIASPAGAYFSGGIKPVSVWLSEDYVRAAPGGTGAAKFAGNYAASLIAQTQAAEKGCDQVVWLDAIEHNYIEEMGGMNLFFVMGKGDQAHVITPKLSGSLLPGVTRDSLLQVARDLGYTTEERLVSKGEWEETATSGAMSEAFACGTAAVITPVGSVKSTHGEFLVNNNEAGSITMQLREALTGIQRGSVADTHGWMHTLVEA

SEQ ID NO: 6998 - DNA, 2014 bp, Brachydanio rerio
  CDS (20)..(1177)
cagacggcgcacattcatcatggcgagcgttgcatcagccacgagcgcaccatcatctcacaaggaaaacggcatggctgacagtgcctctagctttaaggctgcagacacagtgatacagttagcacaaacccataagccaaaacctgacccaaatggcctggtgtttgggtcagtcttcactgaccacatgttgaccattaagtggagtcttcaagaaggttggcagaagccacacatccagccttttgggaacctgtccatgcatccaggctgttctgccctgcattacgctatacagctttttgagggtatgaaggcatatcgggggccggacaacaaagtgcgtctcttcagacccatgttgaacatgaagcggatgttgaagtctgctcatcgggcctgtctgcctagttttgattgtgctgagttgatggagtgcatcaagaagttagtggacttggatcaggactgggttcctcactcagactctgccagtctctacattcgtcccacattactgggcacagaacccaccctcggtgtgaagaagccctccagtgcattgctgtttgtcattctcagtcctgtgggctcgtacttcagcacaggagctaaaccagtgtctctgtgggccgactccaaatacattagagcctggagaggaggaacaggagactgcaagatgggagggaactatggctcatctatctatgcccagtacgaggcggtggattttggctgtcaacaggttttgtggctttacggggatgatcatcagatcacagaggtcggcactatgaaccttttcctctactggatcaatgagaaaggagaggaggagcttgcaacaccacctctagatggtattattctgccaggtgttacacggcaaagcatcttagaacttgctcgccaatggagtgggtttaaagtgtcggagcgatatctgaccatgtctgacctgcggcgagctctggaggagaaccgagtaaaagagatgtttggttctggaacagcttgtgttgtcagtccagtcggcaggatcttatatcagggagaaaatctgcatattccatgcgagggaagctttcctccacttgcctccagactactaaaggagctcacagatattcagtatggacgaaccccaagtgactggtcttgcatcatataaaggatcctcactatcaccaacataaacaagttctccaaaaaagctttatttgtggcttcatggaaaaatgatcccgccacatttaagtatgttttgtttttatacgaagtttaccaactaactaaaacctagagtagcaataatgtgttgttcttttccgaacataaccacccagatgcctcttcattgtcacattttctcaaatattttaaaatataaccagattatcacagttcatcaccagctgtttcatgaacactaccagagatatctgaaatatttcctcagtgtatagtttgtttcaacgttcagtggaactataaatgcacttcattgttgataatatgaaaaaatgcagctaatgtcatattgcacaagctcttgaaacttctgaaagacatttatagatatttaagatagtttgttttttgccgtagagctttattttttaaagaatcgtaactgtttcaaacaattaacatttgaagaatactaactgataatagtgaataggtgttgttgttgctgctgttgtttttgaaatgctgccattccaagcacacaaagagggagaggggttatttaatagagatcatttttgcacccaacgggaaccattattgttattgtttgtaggtgtttgtatgatcgaacaaactgatccctgtgtacacctttgttgatataggaataagattttaacagttatgaaagcacaaagacatgaaatgatagagatttgtgtaacaatttagatactgtttattgcaaagatctgggtattttgtaaatgtgataacaggaataaaacagatgcaaaaaaaaaaaaaaaaaaaa

SEQ ID NO: 6999 - protein, 385 aa, Brachydanio rerio
MASVASATSAPSSHKENGMADSASSFKAADTVIQLAQTHKPKPDPNGLVFGSVFTDHMLTIKWSLQEGWQKPHIQPFGNLSMHPGCSALHYAIQLFEGMKAYRGPDNKVRLFRPMLNMKRMLKSAHRACLPSFDCAELMECIKKLVDLDQDWVPHSDSASLYIRPTLLGTEPTLGVKKPSSALLFVILSPVGSYFSTGAKPVSLWADSKYIRAWRGGTGDCKMGGNYGSSIYAQYEAVDFGCQQVLWLYGDDHQITEVGTMNLFLYWINEKGEEELATPPLDGIILPGVTRQSILELARQWSGFKVSERYLTMSDLRRALEENRVKEMFGSGTACVVSPVGRILYQGENLHIPCEGSFPPLASRLLKELTDIQYGRTPSDWSCII

SEQ ID NO: 7000 - DNA, 915 bp, uncultured crenarchaeote
  CDS (1)..(915)
atgaataataaaggcaaaatatggatggatggagagttcgttgagtggaataacgcgaaaattcacatcttgacacatgcgatgcattatggcactgcagtgtttgaagggatccgctgctatgatacgaaaaacggccctgctatctttcgattgaaagaccacgtcaggagacttgctaatagttgtaaaatgtatcatatgactatacaattttctgagaaagatcttgcagatgcgatcgttcagactgtcagagttaataatgtcaaggaatgctacatacgacctttatgctactatggatatggaaaaatgggagtcaatcctttacctaacaaagtatcagcatctattgccctgtgggattgggaggaccatataaaaactgaagaaaacaagggcatgagagttattgtttcttcgtggaccaggatagattcaagaagcttacctatgcatgcaaaggccacagcaaattatgcaaattccgctttggctagaattgaggctataaaatcaggggctgacgaagccatcatgctgaatatgagtggaatggtggtggaaggaaccgctgaaaatatttttttggtaagagacaacaccctcatcacaccgcctctttcatcaggcgcattggacggcataacccgctcaacggtactatctattgcacaggacttgggtgtcagatctcaaatttgcgacattacacgggatgaaatgtattatgcagatgaggtattcttgactggtacagctgctggaattaagtcaatcggagaaatcgataaaataataattgccaatggaaaggtcggaaaaattgctgcacaattacaagacagttactatcaaatagtacatggcgaaattgcaaaatttgacaaatggctcacgtacgtcaattga

SEQ ID NO: 7001 - protein, 304 aa, uncultured crenarchaeote
MNNKGKIWMDGEFVEWNNAKIHILTHAMHYGTAVFEGIRCYDTKNGPAIFRLKDHVRRLANSCKMYHMTIQFSEKDLADAIVQTVRVNNVKECYIRPLCYYGYGKMGVNPLPNKVSASIALWDWEDHIKTEENKGMRVIVSSWTRIDSRSLPMHAKATANYANSALARIEAIKSGADEAIMLNMSGMVVEGTAENIFLVRDNTLITPPLSSGALDGITRSTVLSIAQDLGVRSQICDITRDEMYYADEVFLTGTAAGIKSIGEIDKIIIANGKVGKIAAQLQDSYYQIVHGEIAKFDKWLTYVN

SEQ ID NO: 7002 - DNA, 1194 bp, Hordeum vulgare
  CDS (1)..(1194)
atggctgtgctgtcttctgcgaagcgcgtcctcccgtgcgcctcggccggcggggtcagcggcggcctccgagctctactcgggacggacggaggcggccgctctcttctcccgtcccggtggaagtcgtcgctgccgcagctggaccccgtcgacaggtccgacgaggagagcggcggcgacatcgactgggacaacctcggcttcgggctcacccggacggactacatgtacgtcatgcggtgctcgcgggaggagggcggcttctcccgcggcgagctcgcccgctacggcaacatcgagctcagcccctcctccggcgtcctcaactacggccaggggctgttcgaggggctgaaggcgtacaggcggtcggacggggccgggtacatgctgttccggccggaggagaacgcgcggcggatgcagcacggcgcgggccgcatgtgcatgccgtccccgtctgtcgagcagttcgtgcacgccgtcaagcagaccgtcctcgccaacaggcgctgggtgccgccgcaaggcaagggagcgctgtacatcaggccgctgctcatcgggagcggggcgatcctcgggctggcgccggcccccgagtacaccttcatgatctacgccgcgcctgtggggacatatttcaaggaaggcatggcggcgataaacctgctggtcgaggaggagatccaccgcgcgatgccgggcggcaccggcggggtcaagaccatctccaactacgcgccggtgctcaagccgcagatggacgcgaaaagcaaggggttcgcggacgtgctgtacctggacgcggtccacaagaggtacgtcgaggaggcctcctcctgcaacctcttcgtcgtcaagggcggcgccgtcgcgacgccggcgacgacggcagggaccatcctgccgggtgtcacgcgcaggagcatcatcgagctcgccagggatgacggctaccaggtcgaagagcgcctcgtctccatcgacgatctcgtcggcgcagacgaagtgttctgcacgggaacggccgtcggcgtcaccccggtgtcgaccatcacctaccaagggacaaggcacgagttcaggactggggaagacacgttgtcgaggaaattgtacacgactctcacatcgatccagatggggctggcagaggacaagaaaggatggacggtagcgattgattga

SEQ ID NO: 7003 - protein, 397 aa, Hordeum vulgare
MAVLSSAKRVLPCASAGGVSGGLRALLGTDGGGRSLLPSRWKSSLPQLDPVDRSDEESGGDIDWDNLGFGLTRTDYMYVMRCSREEGGFSRGELARYGNIELSPSSGVLNYGQGLFEGLKAYRRSDGAGYMLFRPEENARRMQHGAGRMCMPSPSVEQFVHAVKQTVLANRRWVPPQGKGALYIRPLLIGSGAILGLAPAPEYTFMIYAAPVGTYFKEGMAAINLLVEEEIHRAMPGGTGGVKTISNYAPVLKPQMDAKSKGFADVLYLDAVHKRYVEEASSCNLFVVKGGAVATPATTAGTILPGVTRRSIIELARDDGYQVEERLVSIDDLVGADEVFCTGTAVGVTPVSTITYQGTRHEFRTGEDTLSRKLYTTLTSIQMGLAEDKKGWTVAID

SEQ ID NO: 7004 - DNA, 870 bp, Listeria monocytogenes
  CDS (1)..(870)
atgaaagtattagtaaataaccatttagtggaaagagaagatgccacagttgacattgaagaccgcggatatcagtttggtgatggtgtatatgaagtagttcgtctatataatggaaaattcttcacttataatgaacacattgatcgtttatatgcgagtgcagcaaaaattgacttagttattccttattcgaaagaagagttacgagcgttacttgaaaaattagttgctgaaaataatattaatacaggaaatgtctatttacaagtgactcgaggtgttcaaaacccgcgtaatcacgttatgccagatgatttcccgctggaaggcgttttaacagcagcagctcgtgaagtaccaagaaatgaacaacaatttgtgcaaggtggaccagtaattacagaagaagatgttcgttggttacgctgtgacatcaagagtttgaatttacttggaaacattttagcaaaaaacaaagcacatcaacaaaatgcgttagaagctgttttacaccgcggagagcaagtaactgagtgttcagcttccaatatttctattattaaagacggtgtgttatggactcacgcggcagataatttaatcttaaatggtattactcgtcaagtaattattgctgttgcgaaaaagaatggtattccggtcaaagaagctgattttactttaacagatcttcgtgaagccgatgaagtattcatttcaagcacaacaatcgaaattaccccagttacccatatcgacggagtgcaagtagctgacggaaaacgcggacctattaccgcaaaacttcatcaatattttgtagaagaaatcgttcaagcatgtggcgaattagaatttgcaaaataa

SEQ ID NO: 7005 - protein, 289 aa, Listeria monocytogenes
MKVLVNNHLVEREDATVDIEDRGYQFGDGVYEVVRLYNGKFFTYNEHIDRLYASAAKIDLVIPYSKEELRALLEKLVAENNINTGNVYLQVTRGVQNPRNHVMPDDFPLEGVLTAAAREVPRNEQQFVQGGPVITEEDVRWLRCDIKSLNLLGNILAKNKAHQQNALEAVLHRGEQVTECSASNISIIKDGVLWTHAADNLILNGITRQVIIAVAKKNGIPVKEADFTLTDLREADEVFISSTTIEITPVTHIDGVQVADGKRGPITAKLHQYFVEEIVQACGELEFAK

SEQ ID NO: 7006 - DNA, 1020 bp, Listeria monocytogenes
  CDS (1)..(1020)
atgagtaaagatattgactggagtaatttaggatttagttatattaaaacggataagcgttacatttcttattggaaagacggggaatgggatgaaggtacgctaacagaagataatacgctacatattagtgagggttcaacagcgcttcattacggacaacaatgttttgaaggtttaaaagcatatcgttgtaaggacggttcaattaatcttttccgcccagatcggaatgctgctcgtattcaaaaaagctgtgagcgtttattaatgcctcacatcccaactgaaaaatttattgatgctgttatgcaagttgttcgtgccaatgaagaatttgtaccgccgtatggaacaggtgcaacactttatttacgtccatttgttattggtgtaggtgacaatattggtgttcatgcagccccagagtatattttctctgttttctgttcaccagtcggcccttacttcaaaggtggaatggcgccaactaactttattgtttccgattttgaccgtgctgctccaaatggtacgggtgccgcaaaagtaggcggaaactatgctgcaagtttacttccaggccaggctgcaaaagaacgcaattttggtgattgtatttatttagatccagctactcatacaaaaatagaagaagttggttctgctaatttctttggtattacaaaagatgataaatttgttacgccgtattctccttctattttgccaagtatcacgaagtattcgttactttatttggcagagcatcgtctaggtttagaagcattagaaggtgatgtatatattgataaattagatgagtttaaagaagctggagcatgtggaacggcagcggttattacaccaattggtggtattcaaaccaaagatgatttccatgtattccatagtgaaacagaagtggggccagtaacgaagcgtttattcgatgaactatgtggcattcaatttggagatgtagaagctccagaaggttggatttataaagtgaaataa

SEQ ID NO: 7007 - protein, 339 aa, Listeria monocytogenes
MSKDIDWSNLGFSYIKTDKRYISYWKDGEWDEGTLTEDNTLHISEGSTALHYGQQCFEGLKAYRCKDGSINLFRPDRNAARIQKSCERLLMPHIPTEKFIDAVMQVVRANEEFVPPYGTGATLYLRPFVIGVGDNIGVHAAPEYIFSVFCSPVGPYFKGGMAPTNFIVSDFDRAAPNGTGAAKVGGNYAASLLPGQAAKERNFGDCIYLDPATHTKIEEVGSANFFGITKDDKFVTPYSPSILPSITKYSLLYLAEHRLGLEALEGDVYIDKLDEFKEAGACGTAAVITPIGGIQTKDDFHVFHSETEVGPVTKRLFDELCGIQFGDVEAPEGWIYKVK

SEQ ID NO: 7008 - DNA, 930 bp, Desulfovibrio vulgaris
  CDS (1)..(930)
atgagcatggtccagaaatcggaaaccatctggttcgacggcaagcaggttccgtgggatgaggccaacgtgcatgtgctcacccacgccctgcactacggcgtgggtgtcttcgaaggcattcgcgcctaccgttgcgccgatggttcttcggccgtcttccgtctgcgcgaacacgtgcagcgcctgttctcgtcggccaagatcctgcgcatggagattcccttcaccgaagacgccatcttcgacgccatcgtggagacgctgcaacgcaacaggctcgccgaaggctacatccgtcccctttcgttcgtcggcgcaggggccatgggcgtctaccccggcgacaaccccgttcagaccatcatcgccgtatggccttggggtgcgtacctcggtgccgaggccctcgaaaagggcatccgcgtcaagaccagttcgttcgcccgccaccacgtcaatgccatgatgaccaaggccaaggcctcgggcaactatgtcaactcggtgctggccaagatggaggccaaggcggacggctacgacgaggccctgatgctggacgtgagcggcttcgtctccgaagccacgggcgagaacatcttcatggtccgcaacggcgtcatcaagaccacgccgctgacctccatcctcgacggcatcacccgcaacagcctcatgacgctggcacgcgacctcggctacgaagtggtcgaacagcagttcacccgcgacgaactctatgtcgccgacgaagcgttcttctgcggtaccgccgccgaggtgacgcccatccgcgaagtcgaccgccgcgtcatcggcaagggaagtgccgggcctgtcaccaagcatctccagcaggaatatttcaaggccgtcaagggcgacaaccccagctacgaccactggctgcaccgctacgcgctgtag

SEQ ID NO: 7009 - protein, 309 aa, Desulfovibrio vulgaris
MSMVQKSETIWFDGKQVPWDEANVHVLTHALHYGVGVFEGIRAYRCADGSSAVFRLREHVQRLFSSAKILRMEIPFTEDAIFDAIVETLQRNRLAEGYIRPLSFVGAGAMGVYPGDNPVQTIIAVWPWGAYLGAEALEKGIRVKTSSFARHHVNAMMTKAKASGNYVNSVLAKMEAKADGYDEALMLDVSGFVSEATGENIFMVRNGVIKTTPLTSILDGITRNSLMTLARDLGYEVVEQQFTRDELYVADEAFFCGTAAEVTPIREVDRRVIGKGSAGPVTKHLQQEYFKAVKGDNPSYDHWLHRYAL

SEQ ID NO: 7010 - DNA, 957 bp, Thermus thermophilus
  CDS (1)..(957)
atgaccaaggctgaggccaagggcggcgacgtgcagatcaaggccgggctcatctggatgaacggggcctttgtcccccaggaggaggccaagaccagcgtcctaagccacgccctccactacggcaccagcgtctttgaggggataagggcctacgagacccccaaaggccccgccgtcttccggctcaaggagcacgtgcggcgcttctacaactcggccaaggtgctccgcatggagatccccttcgccccggaggagctggaggaggccatcaaggaggtggtgcggagaaacggctacaggagctgctacatccgccctctggcctggatgggggcgaaggccctaggggtcaatcccctgcccaacaaccccgccgaggtgatggtggccgcctgggaatggggggcctacctgggggaggaggcggtgcgcaagggggccaggctcatcaccagctcctgggcccgcttccccgcgaacgtgatgcccggcaaggccaaggtgggcggcaactacgtgaactcggccctcgccaagatggaggcggtggccgccggggccgacgaggccctcctcctggacgaggaggggtacgtggccgaggggagcggggagaacctcttcttcgtgcgggacggggtgatctacgccctggagcactcggtgaacctcgagggcatcacccgcgactcggtgatccgcatcgccaaggacctcggctacgaggtccaggtggtgcgggccacccgcgaccagctctacatggcggacgaggtcttcatgaccgggaccgccgccgaggtgaccccggtgtccatgattgactggaggcccatcgggaagggcacggccgggcccgtggccttgaggctccgggaggtctacctcgaggccgtcaccgggcggcggccggagtacgagggctggctcacgtacgtgaatgggcaatag

SEQ ID NO: 7011 - protein, 318 aa, Thermus thermophilus
MTKAEAKGGDVQIKAGLIWMNGAFVPQEEAKTSVLSHALHYGTSVFEGIRAYETPKGPAVFRLKEHVRRFYNSAKVLRMEIPFAPEELEEAIKEVVRRNGYRSCYIRPLAWMGAKALGVNPLPNNPAEVMVAAWEWGAYLGEEAVRKGARLITSSWARFPANVMPGKAKVGGNYVNSALAKMEAVAAGADEALLLDEEGYVAEGSGENLFFVRDGVIYALEHSVNLEGITRDSVIRIAKDLGYEVQVVRATRDQLYMADEVFMTGTAAEVTPVSMIDWRPIGKGTAGPVALRLREVYLEAVTGRRPEYEGWLTYVNGQ

SEQ ID NO: 7012 - DNA, 957 bp, Leptospira interrogans
  CDS (1)..(957)
atggaattatatcacttatcaggttcctgttctatggcagaatccatcaagaaactatcctatttcgaaggaaaaatcgttcccgagtccgaagcgaaaattagcattcaaactcatgcgcttcaatatggaacaaccgtctttggtgggcttcgcggctactacgataaagacacggataatatttatctttttcgtatcttagatcattatcaaagattaatcaactcaactcgaatcatgcagttgaagttagataagataaaagaagagttgagagacataacgattgatttgatccgccagtgtggctacaaagaaaatatttatcttcgtcccttcgtttatacatcggcactgcagctttcacctcgttttcatgatgttccgacacaactcgcgatctacattcttcagttgaacgactacttagatacaaaacgaggattaaaaacgatggtatctagttggagaagatttgacgacgcagtaatcccaactctttccaaagtatccggaggatatgtaaattcagctcttgcaaaatcggaagcagttcaaaatggatttgatgaagcaatttttttagattcgagaggatttgtaagcgaaggttctgctgaaaatatttttttagttcgagatggaaagatcattacacccggaatcaactcctctttattagaaggaattactcgaagaagtgtacttcaaatcgcaaaagataatgggatcgaagtaatcgaaagagatatatccagaagcgaactttatattgctgacgaagttttcttttctggaactggggttcaaattgcttgggtttcagaaatcgatcatagaaaaatcggaaattcagctattggcccaattactcaaaagattcaaaacttattttttaatctagtgattaacaaagaagaaaaatacagacattggttaactccagtatattag

SEQ ID NO: 7013 - protein, 318 aa, Leptospira interrogans
MELYHLSGSCSMAESIKKLSYFEGKIVPESEAKISIQTHALQYGTTVFGGLRGYYDKDTDNIYLFRILDHYQRLINSTRIMQLKLDKIKEELRDITIDLIRQCGYKENIYLRPFVYTSALQLSPRFHDVPTQLAIYILQLNDYLDTKRGLKTMVSSWRRFDDAVIPTLSKVSGGYVNSALAKSEAVQNGFDEAIFLDSRGFVSEGSAENIFLVRDGKIITPGINSSLLEGITRRSVLQIAKDNGIEVIERDISRSELYIADEVFFSGTGVQIAWVSEIDHRKIGNSAIGPITQKIQNLFFNLVINKEEKYRHWLTPVY

SEQ ID NO: 7014 - DNA, 873 bp, Bacillus cereus
  CDS (1)..(873)
atggcatatgaaagatttgtactttggaatgatacagttattgatacaacgaaacagaaaacgtacatagaccttgaagagagaggcttgcagtttggggatggtgtctacgaggttattcgtctatataaagggaactttcacttattagatccgcatatcacaagattatatcgctccatggaagaaatagaattaacactccctttctcaaaagcggaactgattaccctactttataaactaatcgaaaataataatttccacgaagatggaacgatttatttacaagtatctcgtggtgtacaagctcgtacccatacgttctcatatgacgtccctccaacaatctatgcctatattacaaagaaagaaagaccagcgttatggattgaatatggtgtacgtgccatatcagaaccggatacgcgctggctacgctgtgatattaaatcattaaatttattaccgaatatattagctactacgaaagcggaacgaaaaggttgtaaagaggcccttttcgtacgaaatggtactgtaactgagggaagccactctaacttctttctaattaaaaacggaactctttacacacatccagctaatcaccttattttaaatggcattattcgtcaatatgttctttctttagcgaaaacccttcgtattccagtacaagaagagcttttcagcgttcgtgatgtttatcaagcggatgaatgcttttttacaggaacgacgattgaaattttgccgatgactcatcttgatggaaccgccatccaagatggtcaagttggccctatcactaaaatgctgcaacgatcattttctcagagtttgttacaatccaatatgtcatcttcttaa

SEQ ID NO: 7015 - protein, 290 aa, Bacillus cereus
MAYERFVLWNDTVIDTTKQKTYIDLEERGLQFGDGVYEVIRLYKGNFHLLDPHITRLYRSMEEIELTLPFSKAELITLLYKLIENNNFHEDGTIYLQVSRGVQARTHTFSYDVPPTIYAYITKKERPALWIEYGVRAISEPDTRWLRCDIKSLNLLPNILATTKAERKGCKEALFVRNGTVTEGSHSNFFLIKNGTLYTHPANHLILNGIIRQYVLSLAKTLRIPVQEELFSVRDVYQADECFFTGTTIEILPMTHLDGTAIQDGQVGPITKMLQRSFSQSLLQSNMSSS

SEQ ID NO: 7016 - DNA, 876 bp, Bacillus cereus
  CDS (1)..(876)
atgaaagctactcataaagattgggttttatttaacggaagaattgtaaatacgaaggaagaacagccgatgattccattagaggagagaggctttcaatttggtgatggtatatacgaggtattcagactatatgatgggaagccacatttattagatttacatttagaacgattctttcattctatggaagaaataaaattaattccaccgtttactaaggaagagttagtggaagagttatatcaaatgattgaaaaaaatcaatttcaagaagatggtaatgtatatttgcaaatatcaagaggtgctcaagcacgtaatcatgtatatgagtcaaatatgcaaccaacatattttgcaaacattgtttcttttccaaggccaatcacggctatggaacgaggaataaaagttactgtagaagaggatatacgctggaagttttgtcatataaaatccttaaatctgctacctaatattatgattaaaaataaaataaacgaacaaggctatcaagaagcgatattagtacgagaaggaattgtaacggaagggtgtcattcaaatttctttatggtgaaaaataataaattgattacacatccggctgacaatttcattctacacggcattacacgtcactacgttattacattagcgaaagagttacatattgaagtagaagaaagagaattttcacttcaagaagtgtatgaggccgatgaatgcttcttcacagcgacgccacttgaaatattcccagtcgttcaaattggtgacgagcagttcggaaaaggcgaaagaggaccgattacaaagaaactccaagttgcatatgaagaaagtattcgtttgtttaaagttacgaactaa

SEQ ID NO: 7017 - protein, 291 aa, Bacillus cereus
MKATHKDWVLFNGRIVNTKEEQPMIPLEERGFQFGDGIYEVFRLYDGKPHLLDLHLERFFHSMEEIKLIPPFTKEELVEELYQMIEKNQFQEDGNVYLQISRGAQARNHVYESNMQPTYFANIVSFPRPITAMERGIKVTVEEDIRWKFCHIKSLNLLPNIMIKNKINEQGYQEAILVREGIVTEGCHSNFFMVKNNKLITHPADNFILHGITRHYVITLAKELHIEVEEREFSLQEVYEADECFFTATPLEIFPVVQIGDEQFGKGERGPITKKLQVAYEESIRLFKVTN

SEQ ID NO: 7018 - DNA, 900 bp, Bacillus cereus
  CDS (1)..(900)
atgggaaatcagtacatttatatgaatggggaatttgtagaaaaagaaaaggcagttgtttcagtatatgatcacggttttttatacggagacggtgtatttgaagggattcgtagttacggtggaaatgtattttgtttaaaagaacatgtaaaacgattatatgaatcggcaaaatctattttacttacaatcccgctgacggttgacgaaatggaagaagcggttttacagacacttcaaaaaaatgagtatgcagatgcttatattcggttaattgtttcaagaggaaaaggggacttagggctcgatccgagaagttgtgtgaaaccgagcgttattatcattgcagaacaattaaagttattcccacaggaattttacgataatggattaagcgttgtatctgttgcatcaagacgtaatacaccagatgcattagacccacgcattaagtcgatgaactacttaaataacgtacttgtaaaaattgaagcggcacaagcaggagtgctagaggctcttatgttaaatcaacaaggatatgtttgtgaaggatctggagataatgttttcgttgtgaaagatggaaaagtattaaccccgccatcctatttaggagcattagaaggtattacaagaaatagtgttattgagctatgtgaacgactgaatattccgtgtgaggaaagaccattcactcgccatgacgtatatgtagcagatgaagtgtttttaacaggaacggcagcggagttaattccagttgtaaaagttgattcaagagaaattggagatgggaaaccaggaagtgtaacgaaacaattgaccgaagaatttaaaaaattaacgagagaaagaggagtacgtgtccccgggctgacggaaagcttagcataa

SEQ ID NO: 7019 - protein, 299 aa, Bacillus cereus
MGNQYIYMNGEFVEKEKAVVSVYDHGFLYGDGVFEGIRSYGGNVFCLKEHVKRLYESAKSILLTIPLTVDEMEEAVLQTLQKNEYADAYIRLIVSRGKGDLGLDPRSCVKPSVIIIAEQLKLFPQEFYDNGLSVVSVASRRNTPDALDPRIKSMNYLNNVLVKIEAAQAGVLEALMLNQQGYVCEGSGDNVFVVKDGKVLTPPSYLGALEGITRNSVIELCERLNIPCEERPFTRHDVYVADEVFLTGTAAELIPVVKVDSREIGDGKPGSVTKQLTEEFKKLTRERGVRVPGLTESLA

SEQ ID NO: 7020 - DNA, 897 bp, Bacillus cereus
  CDS (1)..(897)
atgaacgagcaatggattttcttaaatggagaatttgttccaaaagacgaggcaaaagtatcagtatatgatcatggttatttatatggagatggagtatttgaaggaattagagtctatagcggtaatgttttccgtttgagagagcatcttgtccggttatatgaatcagcaaaatccatcatgttagaaattccatattctttagatgaagtaacgaatattgttgttgagacgattcgacaaaataaattatctaatggatacattcgcctagttgtatcgagaggagcaggaaatcttgggttagatcctgattcttgtaaaaaaccgaatgtagtagtaattgcagagcaactatctttattcccgcaagaatattatgaaaaagggattccagttgtaacagttgcaacgcgccgaaaccgtccagatgtattgtcgcctcaagtaaaatctttaaattacttaaacaatattttagttcgcatcgaagcgaaattggctggagtacaagaagcgcttatgttaaatgatcaaggatacgtagctgaaggctcaggggataacgtatttattgtaaaaggaaataaattaattacaccaccaagttctgctggagcgttagaaggcattacacgaaacgctattttagaaattggtgaaaaacttggatatgacgttagagaagagttatttacaagacatgacgtatatgtagctgatgaagtatttttaacaggaacagcagctgaagtaattgctgttacgacagtagatggtagaacgattggtttagggcaaacgggtccacatacgaatcgtttactagaagaatttcgaaagttagttatagaagatggagagaaaatttacgaagaaaataaagttggataa

SEQ ID NO: 7021 - protein, 298 aa, Bacillus cereus
MNEQWIFLNGEFVPKDEAKVSVYDHGYLYGDGVFEGIRVYSGNVFRLREHLVRLYESAKSIMLEIPYSLDEVTNIVVETIRQNKLSNGYIRLVVSRGAGNLGLDPDSCKKPNVVVIAEQLSLFPQEYYEKGIPVVTVATRRNRPDVLSPQVKSLNYLNNILVRIEAKLAGVQEALMLNDQGYVAEGSGDNVFIVKGNKLITPPSSAGALEGITRNAILEIGEKLGYDVREELFTRHDVYVADEVFLTGTAAEVIAVTTVDGRTIGLGQTGPHTNRLLEEFRKLVIEDGEKIYEENKVG

SEQ ID NO: 7022 - DNA, 873 bp, Bacillus cereus
  CDS (1)..(873)
atgttaatttacgtaaatggtcagtatgtagaagcgagtgaagcgagaatttcgccgtatgaccacggttatttatatggacttggagttttcgagacgtttcgtatttataatggtcatcctttcttattggatgatcattatgaccgtttaatagatgcgctggatacgttgcaaattaaatggtcgatgacgaaagatgaagtaatgcttattttgaagaatttactcgttaagaacaaattagagcatgcgtatgtccgttttaatgtatcggcgggtatagatgaaattggattgcaaacagaaatgtatgaagagccgtctattattgtttttataaaacctttagcggccccgggagatgtagtggaaaaagaaggggttgtcttaaatcaagtgagaaatacaccagagggtgcatctcgcttgaagtctcaccattatttaaataacattttggggaaacgcgaaataggcaatgttgtgaataaggaaggtattttccttactgaaacaggttatgttgcagagggcattgtttcgaatctcttttttgtaaaaggtgatattttatatacaccttctttaaaaacggggattttaaatggtatcactcgtgcgtttattataaaggttgctgaaaagatgggtatagaagtaaaggaaggtctctttacaaaagatgaattactttcagccgatgaagtcttcgtaacaaactcgattcaagaaattgttccgcttaattgtatagaggggcgagatttcccgggtaaagtaggtgtggttacaaaaagatttatgaatctttatgaaatgcagagagagaaattgtggagcagaaatgaattacgaagaggagatgtgtag

SEQ ID NO: 7023 - protein, 290 aa, Bacillus cereus
MLIYVNGQYVEASEARISPYDHGYLYGLGVFETFRIYNGHPFLLDDHYDRLIDALDTLQIKWSMTKDEVMLILKNLLVKNKLEHAYVRFNVSAGIDEIGLQTEMYEEPSIIVFIKPLAAPGDVVEKEGVVLNQVRNTPEGASRLKSHHYLNNILGKREIGNVVNKEGIFLTETGYVAEGIVSNLFFVKGDILYTPSLKTGILNGITRAFIIKVAEKMGIEVKEGLFTKDELLSADEVFVTNSIQEIVPLNCIEGRDFPGKVGVVTKRFMNLYEMQREKLWSRNELRRGDV

SEQ ID NO: 7024 - DNA, 1116 bp, Mycobacterium paratuberculosis
  CDS (1)..(1116)
atgaccagtggctccctcgagttcacggtttcgcgctcgacacgtccggcgaccggcgccgaacgcgaaaccatcctggccgagccgggtttcggcaaatacttcaccgaccacatggtgtcgatcgagtacgacgagaccgaggccggacggggctggcatgacgcgcgcgtcatcccgtacggcccgatcgagctggacccgtcggcgatcgtgttgcactacgcgcaggagatcttcgaagggctcaaggcctaccgctgggcggacggctccatcgtgtcgtttcgcgcccaggccaacgccgcccggttgcggtcctcggcgcggcggctggcgattcccgagctgcccgaggagctgttcctggaatcgctgcgccagctgatcgccgtcgacaacgcctgggtgccggccgccggcggcgaagaggcgctgtacctgcggccgttcgtcatcgccaccgagcccgggctcggggtgcggccctccaagcaataccgctacctgctgatcgcctccccggccggcgcctacttcaagggcggcatcagtccggtcaccgtctgggtgtcgacggagtacgtgcgggccagcccgggcggcaccggggcggccaagttcggcggcaactacgcggcgtcgctgtccgcgcaagccgaggccgcggccaacgggtgcgaccaggtggtgtggctggacgccgtcgagcggcgctttgtcgaggagatgggcgggatgaacatcttcttcgtgttcggcagcggcggctcggcacggctggtcacccccgagctgtccggctcgctgctgcccggtatcacgcgagattcgttgctgcagttggcaattgacgccggcttcgccgtcgaggaacgcaagatcgacatcgacgagtggcagaagaaggccgccgccggtgagatcaccgaggtgttcgcctgcggcaccgccgccgtcatcacgccggtgtcgcacgtcaagtacggcgagacggagttcaccatcgccgacggccagcccggcgaagtgacgatggcattgcgcgacacgctcaccgggatccagcggggcaccttcgccgacacccacggctggatgacccggctcggctga

SEQ ID NO: 7025 - protein, 371 aa, Mycobacterium paratuberculosis
MTSGSLEFTVSRSTRPATGAERETILAEPGFGKYFTDHMVSIEYDETEAGRGWHDARVIPYGPIELDPSAIVLHYAQEIFEGLKAYRWADGSIVSFRAQANAARLRSSARRLAIPELPEELFLESLRQLIAVDNAWVPAAGGEEALYLRPFVIATEPGLGVRPSKQYRYLLIASPAGAYFKGGISPVTVWVSTEYVRASPGGTGAAKFGGNYAASLSAQAEAAANGCDQVVWLDAVERRFVEEMGGMNIFFVFGSGGSARLVTPELSGSLLPGITRDSLLQLAIDAGFAVEERKIDIDEWQKKAAAGEITEVFACGTAAVITPVSHVKYGETEFTIADGQPGEVTMALRDTLTGIQRGTFADTHGWMTRLG

SEQ ID NO: 7026 - DNA, 1074 bp, Geobacter sulfurreducens
  CDS (1)..(1074)
atggaaatcagagttgcaccacttcccgctgagcagaagaagcacaaggccactgacgaaacagctctaggctttggtcgtctttttaccgaccggatgcttgttgccgaatggaaagtcgggcagggctgggtcgatgcgcgaattgagccctatgctccgttttcgctggatcctgcctgtgcggtatttcactatgcccaggagatttttgaaggactcaaggcgtataagtgggcggatggttccatagcactctttcgccctgaaatgaatgcccgccgcttcaatcattcagcagagcgtctctgcatgcccgaggtgccggaagatcttttcatcggcggcatcgagcaactggtggcgctcgagcgcgactggataccggcctccgcggggacttccctgtatatccgccccgcaatgattgccgtggagccggctctcggcgtgaaacctgccgatcattactacttttttgtgattctttcaccggtgggcgcctattacgcctctggattcaatccggtgaaaatcatggtggaagaccagtatgtccgcgccgtgcccggcggcaccggtgaagccaagacaggcggcaattatgcttcgtcgctcagggccggccttgaggcaaaaaagaaggggtttgaccaggtcctctggcttgacggggtccaccgtcgctacatcgaggaggttggggctatgaatatgctgtttgcctacggcaagaccatagtcacctcgcctctcacgggcaccattctgaacggcgttacccgcgactcggttctgaaactggccgcgagccgcggttacaccattgaagagcggttgattgacgtgaacgatctcatggccgatattcgtgccggcaaggtgaccgaggctttcggcagtggcactgccgctgtcgtcagtcccgttggaatcctggcgtacaagggcgagagcgtgaccgtaggcgacggtggcgtagggccgatcacccgggaactctatgatacccttaccggcatccagacgggccggattcccgacaccttcggctggacccgcaaaattgcctga

SEQ ID NO: 7027 - protein, 357 aa, Geobacter sulfurreducens
MEIRVAPLPAEQKKHKATDETALGFGRLFTDRMLVAEWKVGQGWVDARIEPYAPFSLDPACAVFHYAQEIFEGLKAYKWADGSIALFRPEMNARRFNHSAERLCMPEVPEDLFIGGIEQLVALERDWIPASAGTSLYIRPAMIAVEPALGVKPADHYYFFVILSPVGAYYASGFNPVKIMVEDQYVRAVPGGTGEAKTGGNYASSLRAGLEAKKKGFDQVLWLDGVHRRYIEEVGAMNMLFAYGKTIVTSPLTGTILNGVTRDSVLKLAASRGYTIEERLIDVNDLMADIRAGKVTEAFGSGTAAVVSPVGILAYKGESVTVGDGGVGPITRELYDTLTGIQTGRIPDTFGWTRKIA

SEQ ID NO: 7028 - DNA, 897 bp, Nanoarchaeum equitans
  CDS (1)..(897)
atgctattgctctataatatgaaggtatggttcaatggccaaatcttagattacgaagatgtaagaataccaatagatacacatgctttacattatggctcttcagtattcgaaggaattaggtcctataaagcaaaaaagggagtagcagtatttagaaatgaagaccacgtaaaaaggtttttctattcgatgcaaactcttagaatgaaaataaaatttgacgaaaacactattagagaggctataaaagaagttgttagggtaaacaatttagaagattcatatataaggccaattgccttttattctaaaggaggaataggattagacccaagaaaaaatgaagtggatatagctatatttgctataccatggggcaaatatctaaaagaagaagcaagggtaacaattgtttcttatgctaggcctaatactttaataacaaatcccaaagccaaaattggcggtatgtatgttaattctattttagctactttagaagcaaaagaaagaggttttgacgaagctattatgttggatttaaatgggtttgtcgctgaaggccctggagaaaacatatttttaatatacaaagatagcaaaactgcggtaactccaatagaaggttctatattacctgggataactagagatacagtaaaacatttattgagagacctaggttataatgtaatagaaagaaatgttttagtcgatgaactatttatcgcagatgagttattttttgttggcactgcagcggaggttacaccaataaaagaattagatggacaaaccttcgatacaagttttggtaaaaaagtttatgaagaatatatgaaagttgttagaggagaaaacaaaaaatatgaatattggttagattatatataa

SEQ ID NO: 7029 - protein, 298 aa, Nanoarchaeum equitans
MLLLYNMKVWFNGQILDYEDVRIPIDTHALHYGSSVFEGIRSYKAKKGVAVFRNEDHVKRFFYSMQTLRMKIKFDENTIREAIKEVVRVNNLEDSYIRPIAFYSKGGIGLDPRKNEVDIAIFAIPWGKYLKEEARVTIVSYARPNTLITNPKAKIGGMYVNSILATLEAKERGFDEAIMLDLNGFVAEGPGENIFLIYKDSKTAVTPIEGSILPGITRDTVKHLLRDLGYNVIERNVLVDELFIADELFFVGTAAEVTPIKELDGQTFDTSFGKKVYEEYMKVVRGENKKYEYWLDYI

SEQ ID NO: 7030 - DNA, 1140 bp, Corynebacterium glutamicum
  CDS (1)..(1140)
atgtatctgtcaggtagcaggtgtaccttaaaatccatgacgtcattagagttcacagtaacccgtaccgaaaatccgacgtcacccgatcgtctgaaggaaattcttgccgcaccgaagttcggtaagttcttcaccgaccacatggtgaccattgactggaacgagtcggaaggctggcacaacgcccaattagtgccatacgcgccgattcctatggatcctgccaccaccgtattccactacggacaggcaatttttgagggaattaaggcctaccgccattcggacgaaaccatcaagactttccgtcctgatgaaaacgccgagcgtatgcagcgttcagcagctcgaatggcaatgccacagttgccaaccgaggactttattaaagcacttgaactgctggtagacgcggatcaggattgggttcctgagtacggcggagaagcttccctctacctgcgcccattcatgatctccaccgaaattggcttgggtgtcagcccagctgatgcctacaagttcctggtcatcgcatccccagtcggcgcttacttcaccggtggaatcaagcctgtttccgtctggctgagcgaagattacgtccgcgctgcacccggcggaactggtgacgccaaatttgctggcaactacgcggcttctttgcttgcccagtcccaggctgcggaaaagggctgtgaccaggtcgtatggttggatgccatcgagcacaagtacatcgaagaaatgggtggcatgaaccttgggttcatctaccgcaacggcgaccaagtcaagctagtcacccctgaactttccggctcactacttccaggcatcacccgcaagtcacttctacaagtagcacgcgacttgggatacgaagtagaagagcgaaagatcaccaccaccgagtgggaagaagacgcaaagtctggcgccatgaccgaggcatttgcttgcggtactgcagctgttatcacccctgttggcaccgtgaaatcagctcacggcaccttcgaagtgaacaacaatgaagtcggagaaatcacgatgaagcttcgtgaaaccctcaccggaattcagcaaggaaacgttgaagaccaaaacggatggctttacccactggttggctag

SEQ ID NO: 7031 - protein, 379 aa, Corynebacterium glutamicum
MYLSGSRCTLKSMTSLEFTVTRTENPTSPDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 7032 - DNA, 1300 bp, Lactococcus lactis
  CDS (154)..(1176)
ctcctttgttcagtaattttctaattcatttatagaaaattgactatatttgaaaaaattgtttgaaattttactgaatttcatgaatattttcttgttttatgttacagaaaataatataatctattataacaaaaaaatttggaggatgttatggcaattaatttagactgggaaaatttaggttttagttatcgaaacttaccttttcgttatatcgctcgttttaaagatggaaaatggagcgctggagagctgacaggagataatcagcttcatattagtgaatcttcacctgctttgcattatggtcaacaaggttttgaaggattgaaggcttatcggacaaaagatgggtcaatccaactttttcgtccagaccaaaatgctgctcgtttgcaaaaaacggctcgccgtctttgtatggcagaagtttcaactgaaatgtttattgacgcagttaaacaagtagttaaagccaataaagattttgttcctccttatggaacgggtgccacgctctatcttcgtccacttttgattggggttggtgatgttattggggttaaacctgcggatgaatatatttttaaagtttttgccatgcctgttggctcttattttaaaggtggattagcaccttcaaaatttgttatttcaagagagtatgatagagcggctcctcttggtaccggtggtgctaaagttggtgggaactatgcggcttctttgcaagcagaagttggagccaaagcctcaggttatgcggatgcaatttatctcgacccaagcacgcatactaaaattgaagaagttggggcagcgaatttctttggtatcactgcagataatgaatttattaccccattaagtccttctatcttaccttcaattactaaatattctttgttgtatttagctgaacatcgtttgggattaaaagcaatcgaaggtgaagtttatgctaaagatttaggtaaatttgttgaagcaggagcttgtgggacagcagcaattatctccccaattggacgaattgacgatggagaagattcttatatttttcattctgaaacagaagtgggaccaacggttaaacgtttatatgacgagttggtcggcattcaatttggtgatgttgaagctccagaaggctggattgttaaagttgattaatttaaaaagctaaagaatattctttagcttttttattttggaatgaatattttatcctttttaatccattcttggtctttggttcggattggccgaattacctggcaaggatttccggcggcaa

SEQ ID NO: 7033 - protein, 340 aa, Lactococcus lactis
MAINLDWENLGFSYRNLPFRYIARFKDGKWSAGELTGDNQLHISESSPALHYGQQGFEGLKAYRTKDGSIQLFRPDQNAARLQKTARRLCMAEVSTEMFIDAVKQVVKANKDFVPPYGTGATLYLRPLLIGVGDVIGVKPADEYIFKVFAMPVGSYFKGGLAPSKFVISREYDRAAPLGTGGAKVGGNYAASLQAEVGAKASGYADAIYLDPSTHTKIEEVGAANFFGITADNEFITPLSPSILPSITKYSLLYLAEHRLGLKAIEGEVYAKDLGKFVEAGACGTAAIISPIGRIDDGEDSYIFHSETEVGPTVKRLYDELVGIQFGDVEAPEGWIVKVD

SEQ ID NO: 7034 - DNA, 918 bp, Wolinella succinogenes
  CDS (1)..(918)
atgaaagaatcgcaatttatttggatggatgggaagcttatcccttggcatgaggccaaaatccatgtcctttcccacacccttcactacggaaacggcgtttttgagggcactcgagcctacaagacagacaaaggattggcgatttttcgcctccaagatcacaccaagcgacttctcaattccgctaaaattgtcgctatcgactgcccctacactcaagaggagctagagaaagcccaagtggagcttctgcgccacaatacctttgagggaaatgtctatcttcgccccatcatcttcctcggatatggcgtgatgggggtctaccataaaaaagctcccgtaaacgtggctattgccgcttgggagtggggcgcctatttaggcgatgagggattagagaagggaattagagtcaaaacctcctcgtttgtgcgaaactctatcaaatcaagctttggaaaggccaaggcgagtgccaactatctcaactcccagatggccaaatatgaggcgatctcttgtggatttgaagaggctttgctcgtggatgacaacggctttgtggccgagggaagcggggagtgcttcttcatcgtgcgcgatggcgtgatcatcactccgccccatgataactctctagagagcatcacccaagccacggtgatcgaacttgctcgaagccttggctacgaggtgattgagagaagaatcacacgagatgaggtctatatcgccgatgaagccttcttcactggcacggccgccgaggtcactcccgtgcgggaacttgacttccgaatcatcggagaaggaagacgagggcccctcacgaccctcttgcaaaaaacctattttgatgtggtgaacggacgagatccaaagttcgccaaatatctcgcctatatccaataa

SEQ ID NO: 7035 - protein, 305 aa, Wolinella succinogenes
MKESQFIWMDGKLIPWHEAKIHVLSHTLHYGNGVFEGTRAYKTDKGLAIFRLQDHTKRLLNSAKIVAIDCPYTQEELEKAQVELLRHNTFEGNVYLRPIIFLGYGVMGVYHKKAPVNVAIAAWEWGAYLGDEGLEKGIRVKTSSFVRNSIKSSFGKAKASANYLNSQMAKYEAISCGFEEALLVDDNGFVAEGSGECFFIVRDGVIITPPHDNSLESITQATVIELARSLGYEVIERRITRDEVYIADEAFFTGTAAEVTPVRELDFRIIGEGRRGPLTTLLQKTYFDVVNGRDPKFAKYLAYIQ

SEQ ID NO: 7036 - DNA, 939 bp, Vibrio vulnificus
  CDS (1)..(939)
atggcaacgaaaacagcagattatatctggtttaatggcaagatggttccctgggcagaagcgaatgtacacgttctgactcacgccatgcactacggcacctcggtatttgaaggggttcgctgttacaacacgccaaaagggccgattgtcttccgtcaccaagaacatgcgcagcgtctgaaagattctgccaaaatttaccgcttcccaatcccctattcagtagaagagatcatggaagcgactcgcgaaactctgcgtcaaaacaagctggataacgcctacattcgcccactggcgtttgttggcaacgtaggcttgggcgtttgtcctcccacagataccgaaatggatctgatcattgccgccttcccttggggctcttacttaggggaagaagcgttggaaaatggcgttgatgccatggtatccagctggaaccgcgctgcgccaaacacgattccaaccgcagcgaaagcaggcggtaactacctctcttctctattggttggtggtgaagcacgtcgacatggctatgccgaagggattgcattaagtgttgatggttacctttcagaaggtgccggtgaaaacatttttgtgatcaaaaatggcgtcatcacaaccccaccagcgacggctgcaattctccctggcatcactcgtgactcaatcatgacgctggcgcgagagatgggttatgaagtccgtgaagccaacatcgcacgtgaagccctctacttggcagacgaagtgtttatgacgggtactgccgcagaagtggttccggtacgtagtgtcgatcaaattcaagtgggcgcaggcaaacgcggcccaatcaccaaagcggtgcaagaagcgtactttggtttattcaatggcaccaccgaagataagtggggctggttagattacgtgtacccagagaagaagtag

SEQ ID NO: 7037 - protein, 312 aa, Vibrio vulnificus
MATKTADYIWFNGKMVPWAEANVHVLTHAMHYGTSVFEGVRCYNTPKGPIVFRHQEHAQRLKDSAKIYRFPIPYSVEEIMEATRETLRQNKLDNAYIRPLAFVGNVGLGVCPPTDTEMDLIIAAFPWGSYLGEEALENGVDAMVSSWNRAAPNTIPTAAKAGGNYLSSLLVGGEARRHGYAEGIALSVDGYLSEGAGENIFVIKNGVITTPPATAAILPGITRDSIMTLAREMGYEVREANIAREALYLADEVFMTGTAAEVVPVRSVDQIQVGAGKRGPITKAVQEAYFGLFNGTTEDKWGWLDYVYPEKK

SEQ ID NO: 7038 - DNA, 1020 bp, Porphyromonas gingivalis
  CDS (1)..(1020)
atggaaaatatcgattggtcatcgctctcattcggttataggaagaccgactacaacgtgcgctgttactatcgcaacggcaagtggggagagcttgaagtatcctcagaggaaacgatcacgatgcacatggctgccacttgtctccactacggacaggaagcattcgaagggatgaaggctttccgtggcaaagatggcaagatccgcctcttccgcatggatgagaatgccaagcgcatgaacagatcatgccaaggtgtggtaatggccgagctgccgcaggaaatcttcgaagcagctgtaatcaaggccgtaaagatgaacgagcgtttcgttcctccttacgaaagcggagcttctctttacatccgtccgcttgttatcggactgggtgcacaagtgggtgtgaagccggctcccgagtatctcttcatcgtctttgtaacgcccgtagggccgtatttcaaagaaggattcaaaccgaccaagatggccatcttccgcgactatgaccgtgcagctcctctgggtacgggtacgatcaaagtgggcggtaactatgcagccggtatgatccccacagtgaaagctcacgaaatgggctactctgcagctatcttcttggatgccaaagaaaagaagtacatagacgaagccggtccggccaacttcttcgccatcaagaacaatacttatatcactcccgaatccagctctatcctgccctctatcacaaacaagagtctgatgcaggtggctcaggatctgggtctgaaggtagagcgtcgtccggtagccgaagaagagcttgctactttcgaagaagcaggtgcttgtggtacggcagccgtgatcagccctatctccgagattgacgacttggagaacaacaaacagtacgtcatcagcaaggacggcaaaccgggtccgtggtgtgaaaagctctatcacgaacttcgtgccatccagtatggcgacaagcccgacattcatggttgggtgacaatcctcgactaa

SEQ ID NO: 7039 - protein, 339 aa, Porphyromonas gingivalis
MENIDWSSLSFGYRKTDYNVRCYYRNGKWGELEVSSEETITMHMAATCLHYGQEAFEGMKAFRGKDGKIRLFRMDENAKRMNRSCQGVVMAELPQEIFEAAVIKAVKMNERFVPPYESGASLYIRPLVIGLGAQVGVKPAPEYLFIVFVTPVGPYFKEGFKPTKMAIFRDYDRAAPLGTGTIKVGGNYAAGMIPTVKAHEMGYSAAIFLDAKEKKYIDEAGPANFFAIKNNTYITPESSSILPSITNKSLMQVAQDLGLKVERRPVAEEELATFEEAGACGTAAVISPISEIDDLENNKQYVISKDGKPGPWCEKLYHELRAIQYGDKPDIHGWVTILD

SEQ ID NO: 7040 - DNA, 927 bp, Photorhabdus luminescens
  CDS (1)..(927)
atgacgaagcaatccgattacatttggttcaatggtgagatggttccttgggcagatgctaaagttcacgtaatgtcccatgctttacattacggcacatctgtttttgagggaattcgctgctatgactctcataaagggccagtggtttttcgccatcgtgagcatatgcagcgtttacatgactctgcaaagatttatcgtatgccgttgaaccagagtgtcgatgaattaatggaggcgtgtcgggcaactcttcgtaaaaataatttagtcagtgcttatatacgtccattggtctttatcggtgatgttggcatgggggttaatccacctgctggttataaaactgatgtcattattgccgcctttccgtggggagcttatttgggagaaggcgcattggatcaaggaattgatgcgatggtttcttcatggaatcgtgcggcaccaaacacaatgccaactgcggctaaagccggtggtaactacctgtcttcgcttttagtcggtagtgaagctcgtcgtcgtgggtatcaggaaggtattgcactggatgtttctggttatatctctgagggtgcgggtgaaaatctatttgaagtaaaagatggcatattatttaccccaccatttacctctgctgcattaccaggaattactcgtgatgccattattaaactggcgaaagatttagggctggaagtgcgtgagcaggtattgtcgcgcgaatcattgtacctggctgatgaagtttttatgtctggcacagcggctgaaatcacacccgttcgtagtgttgatgatattcaggttggtatcggtagatgtggacctattaccaaaaaaattcaacaagctttctttggcttgtttgatggcacgacagatgataaatggggctggttagatccagtcaatccttaa

SEQ ID NO: 7041 - protein, 308 aa, Photorhabdus luminescens
MTKQSDYIWFNGEMVPWADAKVHVMSHALHYGTSVFEGIRCYDSHKGPVVFRHREHMQRLHDSAKIYRMPLNQSVDELMEACRATLRKNNLVSAYIRPLVFIGDVGMGVNPPAGYKTDVIIAAFPWGAYLGEGALDQGIDAMVSSWNRAAPNTMPTAAKAGGNYLSSLLVGSEARRRGYQEGIALDVSGYISEGAGENLFEVKDGILFTPPFTSAALPGITRDAIIKLAKDLGLEVREQVLSRESLYLADEVFMSGTAAEITPVRSVDDIQVGIGRCGPITKKIQQAFFGLFDGTTDDKWGWLDPVNP

SEQ ID NO: 7042 - DNA, 948 bp, Photorhabdus luminescens
  CDS (1)..(948)
atgacaaacaatatcgttagcccagttaataaagattggatcgtatttctagacggggaatatctcaattttagcaatgcgacctttcttgccaatacacaagctttaaattatggcaccggtacatttgaggggatccgggcttattgggatcaagacaataaccaacttaatctatttagagtgcatgagcactatgaacggttaattcaatcagctaaaacattaaaaattgaattaccctataccagtcaggagttaaccgatattactaaaaacatcattattaaaaatggtttcaagcaagatatttatatcaggccattagtgcttaaaaagtcgttaatgccgggtgagaaatttggcgttaagctaagtggtgtaaattcaaccctctgtattaacgctttacctatgggcgcttatgccaaaaaagcagagtttacatgtcttatttcaaaatggcgacgtgtatcaaatgcggcaattccatcatctgccaaaattaccggcacttatgttaattccgcacttgctcatgaagatgccaaagaaaacggatttgatgatgctatcatgttgaatgaacaaggcatgtgcgcagaagcaagtacatcaaatgtttttattgtaaaagataattgcgttattacaccatcgcttagcgctggcattcttaatggaataaccagacaatctgttttcgatatttgtcaattccgcaatattccttgtattgagtcagaaattcaacaaaaggatctctatgaagcagatggctgttttttaacaggcactggccttgaaatatcaatcgtttcacaaatagacgatgtgtcatatagacaaaaagaagattctatagccaatgttattgcccaagattaccaagaaataatcagaggcagagtagataagttctcacattggttaaatccggtttattag

SEQ ID NO: 7043 - protein, 315 aa, Photorhabdus luminescens
MTNNIVSPVNKDWIVFLDGEYLNFSNATFLANTQALNYGTGTFEGIRAYWDQDNNQLNLFRVHEHYERLIQSAKTLKIELPYTSQELTDITKNIIIKNGFKQDIYIRPLVLKKSLMPGEKFGVKLSGVNSTLCINALPMGAYAKKAEFTCLISKWRRVSNAAIPSSAKITGTYVNSALAHEDAKENGFDDAIMLNEQGMCAEASTSNVFIVKDNCVITPSLSAGILNGITRQSVFDICQFRNIPCIESEIQQKDLYEADGCFLTGTGLEISIVSQIDDVSYRQKEDSIANVIAQDYQEIIRGRVDKFSHWLNPVY

SEQ ID NO: 7044 - DNA, 876 bp, Gloeobacter violaceus
  CDS (1)..(876)
atgggtcttctggtgaacttcaacggcaccatcgcgccggaagccagagtttcggtcctcgaccgcggttttctctacggcgacggtgtctacgaggtcgtgcgcacgatcgggggaagacccttcgctttgcaggagcacctcgaccggctgcgtgcctccgcgaactatctctatctcgacattccctggagcgacgcgcagattgccgccgaagtcgagcgcaccctggccgccgccggcagcggcgacttttacattcgtatcgtcgtcagccgcggcgcggaagaagaaatcagcctgctgcccgggccgcaacttgtccccgatctggtgatcatcgtgcggtccatttcttcccaactggctttgaacgagcagggggtgcacctggcagtgctgccccgcttgcgcaacgacgcgcgggcgctctctccagccgccaagaccggcaattatctgaacaacatcttggcgctcatcgaagcgcgccgcctgggggccgacgacgccctgctgctcaacagccgcggcgaggtgaccgaggccaccaccagcaatctctggttggccaaaggcggcacagtttatacccctgctgtcgaagcgggcatcctgcacggcatcacccggcattttttgctgaagttgctgggtgattggcagattccttgcatcgagactgcacttaccaagacagatttgttcgctgtcgaagaagcctttttgagttcgtcggtgcgtctgatcgctccggtgcgccgcatcgatgattatgaactgccctactgtccgggggcgcttacccgccgactgttcgatgggttggtcgtgctgatgcaagatgccgtcgcagccccgaaggtgccagtgtag

SEQ ID NO: 7045 - protein, 291 aa, Gloeobacter violaceus
MGLLVNFNGTIAPEARVSVLDRGFLYGDGVYEVVRTIGGRPFALQEHLDRLRASANYLYLDIPWSDAQIAAEVERTLAAAGSGDFYIRIVVSRGAEEEISLLPGPQLVPDLVIIVRSISSQLALNEQGVHLAVLPRLRNDARALSPAAKTGNYLNNILALIEARRLGADDALLLNSRGEVTEATTSNLWLAKGGTVYTPAVEAGILHGITRHFLLKLLGDWQIPCIETALTKTDLFAVEEAFLSSSVRLIAPVRRIDDYELPYCPGALTRRLFDGLVVLMQDAVAAPKVPV

SEQ ID NO: 7046 - DNA, 960 bp, Gloeobacter violaceus
  CDS (1)..(960)
atgacccagccatcttccgaacccgtcatctacctgcgcggtcgcttcgtcccggacagcgaggcttctttgagcgtgcgcacccatgcttttttgtacggcaccgccgtcttcgagggcatcaaggcgtactgggcgcccgagcgcgagacgatgttcatctttcgcgccgaggagcattttcgcaggctggtgcaaagctgccgcatccttcgcctcaaggcacccctggatatccggcggatggtggagttgagtgcggagattgttgtgcgcaacggctgccgcgaggacacttacttgcgcccgattgtctacaaagccgaccggcgcatcggtccaatcctggagattcccgatacggtcgacgacttttgtctgtttaccgccccgatgagcgcctacctggatacgcacaaaggtctgcacgtctgcgtctcctcctggcgccgcatcgacgacaacatgatcccggcgcgcgccaagtgcaacggcgcctacgtcaacaccgcgctgatcaagaccgacgccgctctggccggtttcgacgacgccatcgccctatcggatgacggccacgtcgccgaaggcagtgcgatgaatttgttcctggtgcgcgacggccgactggtcaccccagcggtgagcaacaacatcctcgaagggatcacccgcgccacggtcatcgaactagcccggaaagaactggggatcccagtcgaatcgcggcaggtggaccgtactgaactctatgttgccgaggagatgttcctgtgcggcacggccaccgaggtggcggcggtcacccgcatcgaccaccgcgccatcggcgacggcaccgtgggaccgatcacccgggcgattcaagatctcttcgaccaggccatccacggccgtctgcccgactatatgcactggctgacccccgctggcaccccagtgctgagcagccaggactga

SEQ ID NO: 7047 - protein, 319 aa, Gloeobacter violaceus
MTQPSSEPVIYLRGRFVPDSEASLSVRTHAFLYGTAVFEGIKAYWAPERETMFIFRAEEHFRRLVQSCRILRLKAPLDIRRMVELSAEIVVRNGCREDTYLRPIVYKADRRIGPILEIPDTVDDFCLFTAPMSAYLDTHKGLHVCVSSWRRIDDNMIPARAKCNGAYVNTALIKTDAALAGFDDAIALSDDGHVAEGSAMNLFLVRDGRLVTPAVSNNILEGITRATVIELARKELGIPVESRQVDRTELYVAEEMFLCGTATEVAAVTRIDHRAIGDGTVGPITRAIQDLFDQAIHGRLPDYMHWLTPAGTPVLSSQD

SEQ ID NO: 7048 - DNA, 924 bp, Chromobacterium violaceum
  CDS (1)..(924)
atgtcgatggctgatcgcgacggatatatctggtatgacggcaagctggtggactggcgcgacgccaccactcatgtgctgacccacaccctgcactacggcatgggcgtgttcgaaggcgtgcgcgcctacgaaacgccgaagggtccggccatcttccgcctgcaggaccataccgagcgcctgttccgctccgccaagattctgggcatcgccctgcccttcactccggaagacatcaaccaggcccacctggacgtggtcaaggccaacggcctgaaatcctgctacttccgtccgatggccttctacggctccggcaagctgggcgtggcgccgatgaagaacgacgtgcgcgtgatcgtggctgcctggccctggggcgcctacctgggcgaagaaggcctggagaaaggcatccgcgtgaagaccagctccttcacccgccaccacgtcaacatcaccatgtgcaaggccaaggccaacggcaactacatgaactccatcctggccaacaacgaggccaccgccgacggctacgacgaggcgctgctgctggacgtggacggcttcgtcgccgaaggctcgggcgaaaacatcttcatcgtgcgcaagggcaagctttatactccggacctgaccagcgcgctggaaggcatcacccgcgacaccgtggtgcagatcgccaaggagatgggcctggagctgatcgagaagcgcatcacccgcgacgaggtctacagcgccgacgaggccttcttcaccggcaccgccgccgaggtgaccccgatccgcgagctggaccgccgcccgatcggcgccggcagccgcggcccgatcaccgcggaaatccagaagcgctacttcaatatcgtcaagggtctggacgccgaacacgaacactggctcacatacgtgaaataa

SEQ ID NO: 7049 - protein, 307 aa, Chromobacterium violaceum
MSMADRDGYIWYDGKLVDWRDATTHVLTHTLHYGMGVFEGVRAYETPKGPAIFRLQDHTERLFRSAKILGIALPFTPEDINQAHLDVVKANGLKSCYFRPMAFYGSGKLGVAPMKNDVRVIVAAWPWGAYLGEEGLEKGIRVKTSSFTRHHVNITMCKAKANGNYMNSILANNEATADGYDEALLLDVDGFVAEGSGENIFIVRKGKLYTPDLTSALEGITRDTVVQIAKEMGLELIEKRITRDEVYSADEAFFTGTAAEVTPIRELDRRPIGAGSRGPITAEIQKRYFNIVKGLDAEHEHWLTYVK

SEQ ID NO: 7050 - DNA, 1284 bp, Neurospora crassa
  CDS (1)..(1284)
atgttccgcacctccctccgcagggctgcggccttccagcccgcgaggccatgcttcggtgccttctccgccactgctgcccgccagtacagcgctgccactggcactgccgacatcaacccttccaagctcaaggtcgagaagaccacccagcccaagggcctcttgaagcccgaggagctcgtcttcggtcgcaacttcactggtactgtccaaaacctcccctccaaaaatgcgcaatcagctttgactaactttcgtgccacaccagaccacatgctcaccatcgaatggaccaaggagaacggctggaacgcgcccgagatcaagccctaccagaacctctcgctcgaccccgccacctgcgtcttccactacgcctttgagtgcttcgagggcatgaaggcctacaaggacaaggccggcaagatccgcctcttccgccccgacaagaacatggcgcgcttcaacaagtcggccgcccgcattgctctgcccaccttcgactcgcccgccctgatcgacctgatcgccaagctggtcaagctcgacagccgcttcatccccgagcagcgcggctactcgctgtacctgcgcccgaccatgatcggcacccaaaagacgcttggcgtcggccctcccggctccgccctgctctacgtcatcgcctcccccgtcggcccttactaccccacgggcttcaaggccgtctcgctcgaggcgaccgactacgccgtgcgcgcctggcccggcggtgtcggcgacaagaagctcggcgccaactacgccccctgcatcgtgccccaagtcgaggctatgagccgtggattccagcagaacctgtggctgtttggcgaggaggagtacgtcaccgaggtcggcaccatgaacttctttgtggccatcaaggacaagaagacgggccagaagaccctggtcactgcgccgctcgacggcaccatcctcgagggcgtcacgcgtgattccgtcctcgcgctggctcgcgagaagctggcgcctgagggctggaagatcgaggagcgcaagttcaccatgaaggagcttgccgaggcggcgaacgagggccgtctgattgaggctttcggcgccggtactgctgctattgtgagccccgtccgctccatcagctggaagggccagctcgtcaactgcggtcttaagcccgaggaggagtcgggtgagcttacgatgcaggtcaagaactggatggaggccaggcagtatggtgatgaggagcatgagtggagctatgtttgcgagtag

SEQ ID NO: 7051 - protein, 427 aa, Neurospora crassa
MFRTSLRRAAAFQPARPCFGAFSATAARQYSAATGTADINPSKLKVEKTTQPKGLLKPEELVFGRNFTGTVQNLPSKNAQSALTNFRATPDHMLTIEWTKENGWNAPEIKPYQNLSLDPATCVFHYAFECFEGMKAYKDKAGKIRLFRPDKNMARFNKSAARIALPTFDSPALIDLIAKLVKLDSRFIPEQRGYSLYLRPTMIGTQKTLGVGPPGSALLYVIASPVGPYYPTGFKAVSLEATDYAVRAWPGGVGDKKLGANYAPCIVPQVEAMSRGFQQNLWLFGEEEYVTEVGTMNFFVAIKDKKTGQKTLVTAPLDGTILEGVTRDSVLALAREKLAPEGWKIEERKFTMKELAEAANEGRLIEAFGAGTAAIVSPVRSISWKGQLVNCGLKPEEESGELTMQVKNWMEARQYGDEEHEWSYVCE

SEQ ID NO: 7052 - DNA, 1242 bp, Neurospora crassa
  CDS (1)..(1242)
atggcgaacttccctcctcctccggtcagcaccatcgactggtccaacgtcggattcaaggtccgcgaagtcaacggtcatatcgagtcttcctactccgtcaagacgggaaaatggtccccgctcaagttcgtcagcgacccctacttgcgcatgcacggtatggcgcccgccctcaactacggccagcaagcgtacgaagggctcaaggccttccgtcttcccggcaacgactcgattgccattttccgcgccgacaagaatgcgagccgcatgcagcactcggccgagtacatcagcattccgcccgtgccggtcgacttgttcattgacgccgtgaaagcggccgtggctctcaacgccgagttcgtcccaccccacgagacgggcgcggccctctacatccgccctcagatctttggaagctccgcgcagctcggtctcagcccgcctgaggagtatctcttctccgtctttgtcatccctacgggcgtgtaccatggtactcaccccgtcaaggcgctcatcctggaggagtttgatcgtgccgcgcccaacggtaccggtagcgccaaggttggtggcaactatgcgcctgtgctccgctggagcgacaaggcccgcaaggaagggtatgatatcaccctccatctggatagtgcgaggcacgaggaggtcgacgagtttagcaccagtgggttcattggcgttcttcgtggcgatgggggagaggatgacgttactgttgttgtgcccagctccaaggccgtgattgatagtgtcacgagcgacagtatccaggagattggcaggagctttggctggaaggttgagaagagaccgatcaagtactctgaactcccctccttctccgaggtcatggccgctggtaccgccgccgctctcgtccccattcgctcaatcactagacgcgttaagacgtcatctccccagtcactcgcttccagcactgctacccaagagcacgctcgtgtctccttcaacaaagaggccgaagaggagacagtcacatacctccccgataaccaggaggacgccggggacctttgcctcaagctgctctcccagcttaagggaattcagctcggaaagatcgaggataagctcggctggcgctttgcggttaccgaggaggatggaaagaaggcagagggtgcggagaaggctcgttctagtgagggtcagggcaaggaggcgcagaccgttgaccagatggattag

SEQ ID NO: 7053 - protein, 413 aa, Neurospora crassa
MANFPPPPVSTIDWSNVGFKVREVNGHIESSYSVKTGKWSPLKFVSDPYLRMHGMAPALNYGQQAYEGLKAFRLPGNDSIAIFRADKNASRMQHSAEYISIPPVPVDLFIDAVKAAVALNAEFVPPHETGAALYIRPQIFGSSAQLGLSPPEEYLFSVFVIPTGVYHGTHPVKALILEEFDRAAPNGTGSAKVGGNYAPVLRWSDKARKEGYDITLHLDSARHEEVDEFSTSGFIGVLRGDGGEDDVTVVVPSSKAVIDSVTSDSIQEIGRSFGWKVEKRPIKYSELPSFSEVMAAGTAAALVPIRSITRRVKTSSPQSLASSTATQEHARVSFNKEAEEETVTYLPDNQEDAGDLCLKLLSQLKGIQLGKIEDKLGWRFAVTEEDGKKAEGAEKARSSEGQGKEAQTVDQMD

SEQ ID NO: 7054 - DNA, 915 bp, Prochlorococcus marinus subsp
  CDS (1)..(915)
atgcaagaatttcttccatatgcctggtttgaaggtaagtgtataccctttaaagatgcaaaagtgtcaatagcaactcatgcacttcattatggaacagcagcctttggaggaatgagagctattccaaatccatctaataaggatgaatttcttttatttagaacagataaacacgtaaaaaggttatctcaaagtgcaagattgcttttaacagaaatatctgaagaatatatatttaatgcactaaaaacaatattaaaaaaaaataaaccttcaaaaccgatctacataaggccttttgtttatacaagtgatttaggtattgctccaagattacataatatagaaactgatttcttcatttattgtattgaactaggagactatttatctcccgatggtgtgtcttgtaggatgagtagttggacaagacaagaagatagatctctacctttaagaggtaagataagcggtgcttacattaccagttcattagccaaaacagaggctagtttatcaggatttgacgaagcattgctgttaaattctagtggtaaagtaagtgaagctagtggaatgaacttatttatagtaagaaatggtgaactgattactccaggagttgatcaagacatcctagaaggaattactagagctagtgttattgaattggcgaaatcgtttggtataaatgttattgaaagacctgttgataaaacagaattacttattgctgatgaagtatttctaactggtacagcagctaaaattacacctgtaaagcaaatagaatcaacaaatattaataattatcgtcccataatgacaaaattgaaaaataagcttatcgaaataacggaaggccgttcacaagactatgatgattggataacacgcattgatattagttaa

SEQ ID NO: 7055 - protein, 304 aa, Prochlorococcus marinus subsp
MQEFLPYAWFEGKCIPFKDAKVSIATHALHYGTAAFGGMRAIPNPSNKDEFLLFRTDKHVKRLSQSARLLLTEISEEYIFNALKTILKKNKPSKPIYIRPFVYTSDLGIAPRLHNIETDFFIYCIELGDYLSPDGVSCRMSSWTRQEDRSLPLRGKISGAYITSSLAKTEASLSGFDEALLLNSSGKVSEASGMNLFIVRNGELITPGVDQDILEGITRASVIELAKSFGINVIERPVDKTELLIADEVFLTGTAAKITPVKQIESTNINNYRPIMTKLKNKLIEITEGRSQDYDDWITRIDIS

SEQ ID NO: 7056 - DNA, 921 bp, Prochlorococcus marinus
  CDS (1)..(921)
atgcatcagttcctgccttatgcctggttccagggagcttgtgttccattcgaagaggccaagatttctgttgccacacatgctttgcactacggcacaggcgctttcggaggcatgcgtgccatacctgatccccaaaacagcaacaccatgttgctctttagggcagaccgtcatgccaaaagactcagtcaaagtgctcgattgttgctgacggaactcagcgagacaagaattctctcagcgcttgaagcaatgttgcaggcgaatcgaccaaccactcccatttatctacgacctttcgtctacacgagtgatctaggcattgcgcctcgactccacaatattgaaactgacttccttatctatggtctagaacttggcgactacctatctccagaaggcgtgagctgccggatcagtagctttacgcgccaagaggatcgctcactgccgctacgaggcaagatcagtggtgcttacatcacaagctctctcgcgaaaacggaagcggtcttaagtggattcggtgaagcattgttgctcaatagcagaggcaagatcagtgaagcaagtggcatgaacctattcctggtcagggatggtcagttgattacccccggtgttgatcaagacattttggaagggatcacgcgatccagtgtccttgaactggcacgggtgatgggcttatctgtgattgaacgccctgtggacaaaacggaactatttattgctgatgaggtgttccttaccggaacagctgcaaaaatcacgccaatacgtcagattgaatcaaccatattggctacagaacgaccgattatgaatgctcttcgagaccgtctaatcgagataactcaaggacgtgataaggattatgagcactggataacacgtatttgtatgactaatgactga

SEQ ID NO: 7057 - protein, 306 aa, Prochlorococcus marinus
MHQFLPYAWFQGACVPFEEAKISVATHALHYGTGAFGGMRAIPDPQNSNTMLLFRADRHAKRLSQSARLLLTELSETRILSALEAMLQANRPTTPIYLRPFVYTSDLGIAPRLHNIETDFLIYGLELGDYLSPEGVSCRISSFTRQEDRSLPLRGKISGAYITSSLAKTEAVLSGFGEALLLNSRGKISEASGMNLFLVRDGQLITPGVDQDILEGITRSSVLELARVMGLSVIERPVDKTELFIADEVFLTGTAAKITPIRQIESTILATERPIMNALRDRLIEITQGRDKDYEHWITRICMTND

SEQ ID NO: 7058 - DNA, 1107 bp, Mycobacterium bovis
  CDS (1)..(1107)
atgaccagcggctcccttcaattcacggtgttacgtgcggtcaatccggccaccgacgcgcagcgtgaatcgatgctgcgggcgccgggtttcggcaaataccacaccgaccatatggtgtcgatcgactatgccgagggccgtggttggcacaacgcgcgggtaatcccttatggcccgatcgagctggatccctcggcgatcgtgctgcactatgcgcaggaggtgttcgaagggctcaaagcctaccgctgggccgacgggtccatcgtgtcgtttcgcgccgacgccaacgccgccaggttgcgttcgtcggcgcggcggttggcgattcccgaactgcccgacgcggtgttcatcgaatccctgcgccagctaatcgctgtcgacaaagcttgggtgcccggtgccggcggtgaggaggcgctgtatctgcggccgttcatcttcgccaccgagccgggactgggcgtgcggcctgccacccaataccgttacctgttgatcgcctcgccggccggtgcgtacttcaagggcggcatcgcccctgtcagcgtctgggtttcgacggagtatgtacgggcctgtccgggcggcaccggtgcggccaagttcggcggcaactacgccgcctcgttgctggcgcaggccgaagccgccgagaacggatgcgaccaggtggtgtggctggacgctgtggaacgccgctatatcgaagagatgggtggcatgaacatcttcttcgtgctcggcagcggcggatcggcgcggctggtcaccccggagctgtccggttccctgctgcccgggatcacacgggattcgttgttgcagttggctattgatgccggatttgcggtcgaggaacgcaggattgatatcgacgagtggcagaagaaagccgccgccggcgagatcaccgaggtgtttgcgtgcggcaccgccgctgtcatcaccccggtcgcgcgggtgcggcacggtgccagcgagttcagaatcgccgacggtcagccgggtgaggtgaccatggcactacgcgatacgctgaccggcatccagcggggcaccttcgcggacacccacggctggatggcgcggctggggtag

SEQ ID NO: 7059 - protein, 368 aa, Mycobacterium bovis
MTSGSLQFTVLRAVNPATDAQRESMLRAPGFGKYHTDHMVSIDYAEGRGWHNARVIPYGPIELDPSAIVLHYAQEVFEGLKAYRWADGSIVSFRADANAARLRSSARRLAIPELPDAVFIESLRQLIAVDKAWVPGAGGEEALYLRPFIFATEPGLGVRPATQYRYLLIASPAGAYFKGGIAPVSVWVSTEYVRACPGGTGAAKFGGNYAASLLAQAEAAENGCDQVVWLDAVERRYIEEMGGMNIFFVLGSGGSARLVTPELSGSLLPGITRDSLLQLAIDAGFAVEERRIDIDEWQKKAAAGEITEVFACGTAAVITPVARVRHGASEFRIADGQPGEVTMALRDTLTGIQRGTFADTHGWMARLG

SEQ ID NO: 7060 - DNA, 915 bp, Synechococcus sp
  CDS (1)..(915)
atgcatcagttcctgccctacgcctggtttcagggtcagtgcgtgcctttcgaggaggccaggatctccatcgcaacccatgccctgcattacggcacaggtgcgttcggcggcatgcgcgccattcctgatccgcagagcagcggatcgatgctgttgtttcgtgccgatcgccatgcacggcggttgagccgaagcgcacggttgctgctcactgatctgagcgaagcaacgattctcgaagcgttgacggcgatgctgcaggcgaacaaaccgcagcaacccatttatctgcgaccgtttgtttacaccagtgatctcggcatcgcgccgcggttgcacgacatcgagaccgacttcctgatttacgggttgccgctgggggattacctctcaccggacggcgtcagttgccgcatcagcagttggacgcgacaggaggaccgttccctccccctgcgcggcaagatctcaggggcctacattaccagttctctggccaagaccgaggccgtccagagcggattcgacgaagctctgctgttgaacagtcgcggcaagatcagcgaagccagcggcatgaatctgttcctggttcgtgacggtcaactgatcacgccaggcgttgaccaggacattcttgagggcatcacccgggcaagcgtgatcgaactggccaaggccatgcagattcctgtagtggaacgccctgtggacaaaacagagctgttcatcgccgatgaggtcttcctcaccggcacggcagcgaagatcactccgatccgccagatcgaatcaacgcagatgaacacggatcgaccggtgatgaccgcactgaagacgcggttggtgtcgatcaccgaaggccgagatacggcctatgaacactgggtgacccgaattcctatcgcgtga

SEQ ID NO: 7061 - protein, 304 aa, Synechococcus sp
MHQFLPYAWFQGQCVPFEEARISIATHALHYGTGAFGGMRAIPDPQSSGSMLLFRADRHARRLSRSARLLLTDLSEATILEALTAMLQANKPQQPIYLRPFVYTSDLGIAPRLHDIETDFLIYGLPLGDYLSPDGVSCRISSWTRQEDRSLPLRGKISGAYITSSLAKTEAVQSGFDEALLLNSRGKISEASGMNLFLVRDGQLITPGVDQDILEGITRASVIELAKAMQIPVVERPVDKTELFIADEVFLTGTAAKITPIRQIESTQMNTDRPVMTALKTRLVSITEGRDTAYEHWVTRIPIA

SEQ ID NO: 7062 - DNA, 858 bp, Rhodopirellula baltica
  CDS (1)..(858)
atgacccaagccatctacatcaacggtgaatacttctcacgcgaagacgccaagatcagtgtctacgatcacggactgctgtacggcgacggcgtgttcgaagggatgcggatctactcgggcaaagtgttcgcactcgaagaccacatgacacggctctacgaaagcgctcgtgcgatcatgctggacattcccatcgcaatcgatgctttgacgactgcagtgaacgaaaccgttgcaaaaaatggtttgacagaaggctacattcgcttggtcgtcacccgtggtggcaaccaattggggctcaacccgttctcgtgtgaagatccccaagtgatcatcatcgcggatacgatctcgttgtaccctgagaagttctacaccgaaggtttggaactgatcaccgcgtcgacgatccgcaaccatcccgccgcgctcagcccccgcgtgaagtcgttgaactacctcaacaacatcatggcgaagatcgaagccattcgcgccgggtgcattgaagcggtgatgctgaacaccaaaggcgaagttgccgagtgcaccggcgacaacattttcatcgtccgtggcggccggttgatcaccccaccaatcgatgcaggaatccttgaagggatcacgcgtaacaccgtgattgatctcgctcgcgaaaatgggatcgaagtggccgaggaagccatgacccgtcacgacatctttgtcgccgatgaatgcttcctaaccggcagtgccgccgaagtcatccccgcggtcaaactcgatgggcgagtcattggcgatggcaaacccggcccaatgactcaaaagctcaacgcggccttccgtgcatttgtggctcgttag

SEQ ID NO: 7063 - protein, 285 aa, Rhodopirellula baltica
MTQAIYINGEYFSREDAKISVYDHGLLYGDGVFEGMRIYSGKVFALEDHMTRLYESARAIMLDIPIAIDALTTAVNETVAKNGLTEGYIRLVVTRGGNQLGLNPFSCEDPQVIIIADTISLYPEKFYTEGLELITASTIRNHPAALSPRVKSLNYLNNIMAKIEAIRAGCIEAVMLNTKGEVAECTGDNIFIVRGGRLITPPIDAGILEGITRNTVIDLARENGIEVAEEAMTRHDIFVADECFLTGSAAEVIPAVKLDGRVIGDGKPGPMTQKLNAAFRAFVAR

SEQ ID NO: 7064 - DNA, 915 bp, Prochlorococcus marinus
  CDS (1)..(915)
atgcatgattttctcccatatgcatggtttaaaggtaaatgtgttccttttgacgaagcaaaaatatctatagcaactcatgcacttcattatggaacagcagcttttggaggtatgagagctatacccgatccaagtgataatggtaattttttactcttcagagctgataagcatgcaaaaaggctcagccaaagtgcaaaacttctacttacagaactcagtgagcgctatattttacagagcatagaaacttggctcaaagccaataaacctagtaaaccaatttatataagaccttttgtttataccagtgatttaggcattgctccaaggctacataatatagaaactgactttttcatatacggactggaattaggtgattacttatctcccgaaggcgtttcatgtcgcataagtagctggaaacggcaagaagattgttctctcccactaaggggaaagattagtggtgcctatataacaagctcacttgctaaaacagaggccgttttaacaggctttgatgaagctttattattaaattcacaaggcaaagtaagtgaagctagtggtatgaacctattcattgtcagagatggaaatctaattactccggggaccgaccaagatattctagaaggaataactagagctagtgttatagaaatagctaattatctaggaattaatgtcattgaaaggccagtggataaaacagagttgtttatagcagatgaagtattccttactggaacagcggctaagataacaccaatcaaacagattgaatctaccctattaaatacagaactgcctataatgaataaactaagggattatctaatttcaataacagaaaataaggaagataaatttagtaactggataacctccataaaaataagttaa

SEQ ID NO: 7065 - protein, 304 aa, Prochlorococcus marinus
MHDFLPYAWFKGKCVPFDEAKISIATHALHYGTAAFGGMRAIPDPSDNGNFLLFRADKHAKRLSQSAKLLLTELSERYILQSIETWLKANKPSKPIYIRPFVYTSDLGIAPRLHNIETDFFIYGLELGDYLSPEGVSCRISSWKRQEDCSLPLRGKISGAYITSSLAKTEAVLTGFDEALLLNSQGKVSEASGMNLFIVRDGNLITPGTDQDILEGITRASVIEIANYLGINVIERPVDKTELFIADEVFLTGTAAKITPIKQIESTLLNTELPIMNKLRDYLISITENKEDKFSNWITSIKIS

SEQ ID NO: 7066 - DNA, 933 bp, Helicobacter hepaticus
  CDS (1)..(933)
atgaaagaagcgcaatttatttggaaagatggtgttcttgtgccgtgggctgaagctacgacacacgttttaagccatacattacattatggtaatgccttatttgaaggcacaagagcatatatgacaaaacaaggactagccatttttcgcttaaaggaccataccaaacgacttttagattctgctaaaattgtatgtattaagtctccttatacacaagaagaattagaaaaagcccaaatagagcttttgagggcaaataaaagtgattataatggcaatgtttatattcgtcctctcatatatttagggtatggtgtaatgggtgttagtcatattaatgcacctgtaaatgtagcgattgctgcgtgggaatggggtgcatatcttggcgaagagggcattaataatggcattaaagtgaaaacaagttcttttgtccgcaatcctgcaaaagcttttatgggtaaggcaaaggtagctgctaattatctcaactctcaaatggcaaagcacgaggcgctttcttgcggttgcgatgaggcgttgctccttgatgataatggttttgtagcggaagggagtggtgagtgcttttttatcgtgcgaaatggtaagcttattacaccaccacacgcaaatactttagaatctattactcaagcaacaaccatagaaattgctaaggatatgggaataccatttgaggagcgaaatattacacgcgatgaggtatatatcgctgatgaagctttttttacaggcacagcagcagagattacgcctgtgcgtgagcttgatgcgcgtgtcattggaaatggcacagcaggagagattacaaaatcacttcaaaaagcatattttgctattgtaaatggagagaatcctcgttatcaacactatttgacttatattgacaaggagaaataa

SEQ ID NO: 7067 - protein, 310 aa, Helicobacter hepaticus
MKEAQFIWKDGVLVPWAEATTHVLSHTLHYGNALFEGTRAYMTKQGLAIFRLKDHTKRLLDSAKIVCIKSPYTQEELEKAQIELLRANKSDYNGNVYIRPLIYLGYGVMGVSHINAPVNVAIAAWEWGAYLGEEGINNGIKVKTSSFVRNPAKAFMGKAKVAANYLNSQMAKHEALSCGCDEALLLDDNGFVAEGSGECFFIVRNGKLITPPHANTLESITQATTIEIAKDMGIPFEERNITRDEVYIADEAFFTGTAAEITPVRELDARVIGNGTAGEITKSLQKAYFAIVNGENPRYQHYLTYIDKEK

SEQ ID NO: 7068 - DNA, 924 bp, Candidatus Blochmannia floridanus
  CDS (1)..(924)
atgaaaaaatctgattttatttggtttaatggaaatatggtaccttgggataaagcaaaggtacatgttatgtctcatgcattgcattatggatcgtcagtttttgaaggaatgcgttgttatgattcttataaagggccagtgatatttagaggtcaagatcatattcaaagattgatgaattctgcaaagatttatcgtatacctgtttctagaagtaaattggagttaatgcaagcgtgtagaatgctaattcaaaaaaataatttggttaatgcatatattcgtcctttgatttttattggaaatgttggtggaatggagattaatcctattattgaatatactgctgacgttgttatagctgcttttttttggaaagcgtatttaggggaagattctttaaattctggagttgatgttgtagtatcttcttggcgtagagttccaacggatactattcctaatttagctaaggcaggtggtaattatttatcatctatgttaattagcaatgaagccaataggtatggttatcatgaaggtattgctttagatatatatggttatgtttcggaaggtgctggagagaatttatttgtgattaaagataatattgtattaactccacctattagcgcttctattttgtcaggtattactcgtgattctgttataaatttattgaaggatgttggattcgagataaaagaagaattattatctcgtgaatttttatatatagcagatgaaatatttatgtgtggaactgccgctgaaattactccaatacgtagtgtggatggtattaaaattgggtcaggatcaagaggtcctattactaaaaaattgcaagaattattttttaatttgtttacgggaaaaactgaagataaatggggttggttagatgcaatgatttga

SEQ ID NO: 7069 - protein, 307 aa, Candidatus Blochmannia floridanus
MKKSDFIWFNGNMVPWDKAKVHVMSHALHYGSSVFEGMRCYDSYKGPVIFRGQDHIQRLMNSAKIYRIPVSRSKLELMQACRMLIQKNNLVNAYIRPLIFIGNVGGMEINPIIEYTADVVIAAFFWKAYLGEDSLNSGVDVVVSSWRRVPTDTIPNLAKAGGNYLSSMLISNEANRYGYHEGIALDIYGYVSEGAGENLFVIKDNIVLTPPISASILSGITRDSVINLLKDVGFEIKEELLSREFLYIADEIFMCGTAAEITPIRSVDGIKIGSGSRGPITKKLQELFFNLFTGKTEDKWGWLDAMI

SEQ ID NO: 7070 - DNA, 921 bp, Bordetella parapertussis
  CDS (1)..(921)
atgtcgatgtcggaccgcgacggcttcatctggtatgacggcaagctggtgccttggcgcgaggccaccacgcacgtgctgacccactccctccactacggactgtccgtcttcgaaggcgtgcgcgcctacgaaaccgcggccggcaccgccatcttccggctgcaggaccacaccaaccgcctgttcaattcggcccacatctaccagatcccgctgccgtacgaccgcgacaccctcaacgaggcccagcgcgaagtggtgcgcgccaacggcctggcatcgtgttacctgcgcccgctggccttctatggctcggaaaaaatgggggtctcgcccaagggcgcccaggtgcacgtggccatcgccgcctggccctggggcgcctatctgggcgagaccgccctggcgcagggcatccgcgtcaaggtgtcctcgttcgcgcgccagcacgtcaacgtcaccatgccgcgcgccaaggtggccaccacgtacgccaattccatcatcgccaatgccgaagcgctgcaggatggctacgacgaggccctgctgctcgataccgagggtttcgtggccgaaggcgccggcgagaacattttcatcgtcaaggacggcgtgctgtgcgagcccgagatcgcctcggcgctgacgggcatcacccgctccaccatccatgcgctggccgccgacctcggcctgcgcgtcgtcaccaagcgcctcacacgcgatgacgtctacattgccgacgaagccttcttcactggcaccgcggccgaggtcacgccgatccgcgaggtcgacaaccggcagatcggcgccggccgccgcggcccggtcaccgagaagctgcagcaggccttcttcgacctggtcaacggccgcaaccccaaataccagcattggctgaccccggtatga

SEQ ID NO: 7071 - protein, 306 aa, Bordetella parapertussis
MSMSDRDGFIWYDGKLVPWREATTHVLTHSLHYGLSVFEGVRAYETAAGTAIFRLQDHTNRLFNSAHIYQIPLPYDRDTLNEAQREVVRANGLASCYLRPLAFYGSEKMGVSPKGAQVHVAIAAWPWGAYLGETALAQGIRVKVSSFARQHVNVTMPRAKVATTYANSIIANAEALQDGYDEALLLDTEGFVAEGAGENIFIVKDGVLCEPEIASALTGITRSTIHALAADLGLRVVTKRLTRDDVYIADEAFFTGTAAEVTPIREVDNRQIGAGRRGPVTEKLQQAFFDLVNGRNPKYQHWLTPV

SEQ ID NO: 7072 - DNA, 903 bp, Bordetella parapertussis
  CDS (1)..(903)
atgtcgcgcagcgcgtccaggcggcgctgtaggcgcaccccgatcaccaaggaagaccgcggtatggaagccctttactggtacgacggccaatggctgaccgagaatcccaagctgctcggcccgtccgaccacgcattctggatggccagcatggtgttcgacggcgcgcgcgccttcgccggcctgacgcccgacctcgacctgcattgccagcgcgtggtgcgctcggctgagaagatgctgatgaaaccggcgctgccgtggcaacgcatccaggaactatgcctggaagcggtggccaggttccctgccggcagcgagctctacatcaagccgatgttcttctgcgccgacggcttcctgctgcccgacgccgagcagacgcagttcgtgctgcacgtattcaaggtgcccctgcccggcgaacaaggcttctcggcctgcttctccagcttcgcgcgttcctggcccaacatggcgcccaccgacgccaaggcgtcgtgcctgtaccccaatggccagcgcgccatccgcgaggccaacctcaagggcttcgacaacgccatcatgctcgacggcgcgggccatgtcgcggaattcgccaccagcaacctgtggatcgcgcgcaacggccggatcgccacgccggtcgacaacggcacgttcctcaacggcattacgcgccagcgcgtgctggcgctgctgcacgccgatggggtgaccgtggacgagcgcgccctgacccgcgccgacgtcgaagaagcggacgaggtgttttctaccggcaactacggcaaggtcgtgcacgtcaaccgggtggaagcgcgcagcctgtcgtacgggccgctggcgcggcacgcctaccggctgtacatggactacgcggcgggcgggcgctga

SEQ ID NO: 7073 - protein, 300 aa, Bordetella parapertussis
MSRSASRRRCRRTPITKEDRGMEALYWYDGQWLTENPKLLGPSDHAFWMASMVFDGARAFAGLTPDLDLHCQRVVRSAEKMLMKPALPWQRIQELCLEAVARFPAGSELYIKPMFFCADGFLLPDAEQTQFVLHVFKVPLPGEQGFSACFSSFARSWPNMAPTDAKASCLYPNGQRAIREANLKGFDNAIMLDGAGHVAEFATSNLWIARNGRIATPVDNGTFLNGITRQRVLALLHADGVTVDERALTRADVEEADEVFSTGNYGKVVHVNRVEARSLSYGPLARHAYRLYMDYAAGGR

SEQ ID NO: 7074 - DNA, 945 bp, Bordetella bronchiseptica
  CDS (1)..(945)
atgaaagccgcgccgcaggcggcgcggcggcaccggcgggctgccatgcccgcccctatcctctccaaggagctccccatgattccgggcatgccgggcgacagccaggtatatctcaacggcgaattcacgcgcctcgacgaagccaagatttccgtgctcgaccgcggtttcatcttcggcgatggtatctatgaagtcgtgccggtctatgacggcaaggtgttccgcatgaccgaacacctgaatcgcctggatcgcagcctggcggcgctgcgcatcgccgcgccgatggaccgcgcgggatgggagtcggtgatcgccgggttgatcgcccgctcggcccagcccacctgcatcatctacctgcaggtcacgcgcggcgtctgcaagcgcgatcacgcctttcccaccgagccgatcacgcccacggtgttcggcatggccgcggccttcagtccgccgggggccgcgcagcgcacccagggcctgagcgcgattgccatcgacgacgagcgctggctgcattgcgagatcaagtcggtttcgctgctgggcaacgtgctggccaagcagcaggcggtggacgccggcgtggatgaagtggtgcagtttcgcgatggctggctgaccgagggctcgtcgaccaatatctgggtggtttccggcggcaagctgctggccccgcccaagaacaacctgatcctggaaggcatccgctacggcctgatgggcgagctggccgaggcggccggcctgccgttcgaggcacggcggatctcgcgcgaggaagtgctcgccgccgacgaattgatgctgacctcggccaccaaggaagtgctgcccatcgtgcgcctggacggcaaggcggtgggcgcgggcaagcccggccccgtttatgagcagttgcgcgcgggttatgatgcgcgtatcgccgccctgtag

SEQ ID NO: 7075 - protein, 314 aa, Bordetella bronchiseptica
MKAAPQAARRHRRAAMPAPILSKELPMIPGMPGDSQVYLNGEFTRLDEAKISVLDRGFIFGDGIYEVVPVYDGKVFRMTEHLNRLDRSLAALRIAAPMDRAGWESVIAGLIARSAQPTCIIYLQVTRGVCKRDHAFPTEPITPTVFGMAAAFSPPGAAQRTQGLSAIAIDDERWLHCEIKSVSLLGNVLAKQQAVDAGVDEVVQFRDGWLTEGSSTNIWVVSGGKLLAPPKNNLILEGIRYGLMGELAEAAGLPFEARRISREEVLAADELMLTSATKEVLPIVRLDGKAVGAGKPGPVYEQLRAGYDARIAAL

SEQ ID NO: 7076 - DNA, 1233 bp, Oryza sativa
  CDS (1)..(1233)
atggagctcctcccgcgtgtgggtgtggccgcccccggtcccggacgcggcggcgcgtcgccgtccccgacgcgccgtcatcgcgcgccctctcaccccattctgaagcgatcggcggcggtttgcggcgcagtcgccgtctgcagaggaggggctgtcgccaggaggagccggtggtcaactctggtgaccgcagcatattacacaggaactgctgaactggtcgactttaactgggaaactcttgggtttcaacccgtgccgactgactttatgtatgtgatgagatgttccgaggaaggggtgttcaccaagggtgaattggtgccatatgggccaatagaactgaacccagcagctggagtgttgaattatggtcagggtttacttgaaggtctgcgagcacatagaaaagaggatggatcagtccttctatttcgtcctgatgaaaatgctttacggatgagagtaggcgcagaccggttatgtatgcctgcaccaagtgtagagcagttcctagaagctataaagctaacaattttagcaaacaagcgctgggtaccccctactggcaaaggttctttatatatcagaccgctgctgattggaagtggggctatcctcggtgttgcaccagccccagagtacacatttgttgtctttgcttgcccagttgggcactattttaaggatggcttatctccaatcagcttgttaaccgaggaagaatatcagtgtgcggcaccaggtggaactggtgatataaagactatcggaaattatgcttcagccgtttatgctaaagaaagagctaaggagagaggtcattctgatgttctttacttggatccagtgcataaaaagtttgttgaggaactttcgtcctgtaatatattcatggtgaaggacaacattatttctactccactattaacgggaacagttcttcctggcatcacaagaagaagtataattgaatacgcccgtagccttggatttcaggttgaagagtgtcttattacaatagatgagttgcttgacgctgatgaagttttctgtactggaacttctgtggtactatcctctgttggttgcatagtgtaccaggggagaagagtggagtatgggaaccagaagttcagaactgtgtctcagcaactctattcagcacttacggctatccagaaaggcctcgtggaggacagtatgggatggactgtgcaactgaattag

SEQ ID NO: 7077 - protein, 410 aa, Oryza sativa
MELLPRVGVAAPGPGRGGASPSPTRRHRAPSHPILKRSAAVCGAVAVCRGGAVARRSRWSTLVTAAYYTGTAELVDFNWETLGFQPVPTDFMYVMRCSEEGVFTKGELVPYGPIELNPAAGVLNYGQGLLEGLRAHRKEDGSVLLFRPDENALRMRVGADRLCMPAPSVEQFLEAIKLTILANKRWVPPTGKGSLYIRPLLIGSGAILGVAPAPEYTFVVFACPVGHYFKDGLSPISLLTEEEYQCAAPGGTGDIKTIGNYASAVYAKERAKERGHSDVLYLDPVHKKFVEELSSCNIFMVKDNIISTPLLTGTVLPGITRRSIIEYARSLGFQVEECLITIDELLDADEVFCTGTSVVLSSVGCIVYQGRRVEYGNQKFRTVSQQLYSALTAIQKGLVEDSMGWTVQLN

SEQ ID NO: 7078 - DNA, 1104 bp, Trypanosoma brucei
  CDS (1)..(1104)
atgactttcctcgccaaaaaaatttttgttcaacgcgtggcaaatccaccgccacttccttcactgcagggagttatgtttggtactcttttcagcccacatatgttggtaattgatgcagatgggaatgggaaatggggcaaaccacgtattgttccctttgagaacctttcattgccgccgcagactgcttgcttacattatgccattcaatgcttcgagggcatgaaggcgtatcgcgacagtcacggcaatatccgactcttccgcccggatcgtaactgtcgacggctactggacagcacacgacgcttatgtctccctggatttgaccctgacgaactgcaaaagttaattgaggagtttgtgaaagtggaacgtgattacgtcccaagtgagcgtggttactctctatacttgagacccactgtaattgggactggaagcaaactctccgcagtggcaggttctgcagcgaagttattcgtgattgcttcacctgttggaccatattatccctctgggatgaaacctgtgagacttcatgtggaggaggagcggcgccgtgcctggcctggtggggtcggcaacgtgaagcttggcgcgaactacgctgcgcctatgctggtgcagcaggaagcgtctgagcttggctttcagcaagtgttatggctgggcgctggagaagaagtgcaagaagtgggagcaatgaatttcatgtgtctttggcgtccttctgcaaattcaaatgaagtggaacttgtaactgcgccgttggatggcacgatcctccccggtgtgacgcgagattccattttgtcgctggtgcggcagtggggtgaggcacgtgtatctgaacgctcctttaccattcacgagctcactgctgcgctacgggagaaacgtgtgcttgagtgctttggctgtgggacggctgctattgtgtcccctgtggaagcactgtcatataagggagagttgcttaatgttccatgcccggctccaggggcttcgctcacacatcgggttctaaaggcgattacagatattcaatatggtgatgtggaacatgagtggtcacgcattgttggtaccacttcttaa

SEQ ID NO: 7079 - protein, 367 aa, Trypanosoma brucei
MTFLAKKIFVQRVANPPPLPSLQGVMFGTLFSPHMLVIDADGNGKWGKPRIVPFENLSLPPQTACLHYAIQCFEGMKAYRDSHGNIRLFRPDRNCRRLLDSTRRLCLPGFDPDELQKLIEEFVKVERDYVPSERGYSLYLRPTVIGTGSKLSAVAGSAAKLFVIASPVGPYYPSGMKPVRLHVEEERRRAWPGGVGNVKLGANYAAPMLVQQEASELGFQQVLWLGAGEEVQEVGAMNFMCLWRPSANSNEVELVTAPLDGTILPGVTRDSILSLVRQWGEARVSERSFTIHELTAALREKRVLECFGCGTAAIVSPVEALSYKGELLNVPCPAPGASLTHRVLKAITDIQYGDVEHEWSRIVGTTS

SEQ ID NO: 7080 - DNA, 1104 bp, Trypanosoma brucei
  CDS (1)..(1104)
atgactttcctcgccaaggacctcactgttcaacgcgtggcaaatccaccgccacttccttcactgcagggagttatgtttggtactcttttcagcccacatatgttggtaattgatgcagatgggaatgggaaatggggcaaaccacgtattgttccctttgagaacctttcattgccgccgcagactgcttgcttacattatgccattcaatgcttcgagggcatgaaggcgtatcgcgacagtcacggcaatatccgactcttccgcccggatcgtaactgtcgacggctactggacagcacacgacgcttatgtctccctggatttgaccctgacgaactgcaaaagttaattgaggagtttgtgaaagtggaacgtgattacgtcccaagtgagcgtggttactctctatacttgagacccactgtaattgggactggaagcacactctccgcagtggcaggttctgcagcgaagttattcgtgattgcttcacctgttggaccatattatccctctgggatgaaacctgtgagacttcatgtggaggaggagcggcgccgtgcctggcctggtggggtcggcaacgtgaagcttggcgcgaactacgctgcgcctatgctggtgcagcgggaagcgtctgagcttggctttcagcaagtgttatggctgggcgctggagaagaagtgcaagaagtgggagcaatgaatttcatgtgtctttggcgtccttctgcaaattcaaatgaagtggaacttgtaactgcgccgttggatggcacgatcctccccggtgtgacgcgagattccattttgtcgctggtgcggcagtggggtgaggcacgtgtatctgaacgctcctttaccattcacgagctcactgctgcgctacgggagaaacgtgtgcttgagtgctttggctgtgggacggctgctattgtgtcccctgtggaagcactgtcatataagggagagttgcttaatgttccatgcccggctccaggggcttcgctcacacatcgggttctaaaggcgattacagatattcaatatggtgatgtggaacatgagtggtcacgcattgttggtaccacttcttaa

SEQ ID NO: 7081 - protein, 367 aa, Trypanosoma brucei
MTFLAKDLTVQRVANPPPLPSLQGVMFGTLFSPHMLVIDADGNGKWGKPRIVPFENLSLPPQTACLHYAIQCFEGMKAYRDSHGNIRLFRPDRNCRRLLDSTRRLCLPGFDPDELQKLIEEFVKVERDYVPSERGYSLYLRPTVIGTGSTLSAVAGSAAKLFVIASPVGPYYPSGMKPVRLHVEEERRRAWPGGVGNVKLGANYAAPMLVQREASELGFQQVLWLGAGEEVQEVGAMNFMCLWRPSANSNEVELVTAPLDGTILPGVTRDSILSLVRQWGEARVSERSFTIHELTAALREKRVLECFGCGTAAIVSPVEALSYKGELLNVPCPAPGASLTHRVLKAITDIQYGDVEHEWSRIVGTTS

SEQ ID NO: 7082 - DNA, 879 bp, Bacillus cereus
  CDS (1)..(879)
atgaatggggaatttgtagaaaaagaaaaggcagttgtttcagtatatgatcacggttttttatacggagacggtgtatttgaagggattcgtagttacggaggaaatgtattttgtttaaaagaacatgtgaaacgattgtatgaatcagcgaaatctattttactaacaattccaatgacggtagaagaaatggaagaagcagttttacatacactccaaaaaaacgaatatactgatgcttacattcgcttaattgtctcaagaggaaaaggtgacttagggctcgatccgagaagttgtgtgaagccgagcgtaattatcattgcagaacaattaaagttattcccacaagaattttatgataatgggctaagcgttgtatctgttgcatcaagacgtaatacgccagatgcgttagatccacgtattaagtcaatgaattatttaaataacgtacttgtaaaaattgaagcagcacaagcaggggtgttagaggctcttatgttaaatcaacaaggatatgtttgtgaaggttctggtgataatgttttcgttgtgaaagatggaaaagtattaaccccgccatcctatttaggagcattagaaggtattacgagaaatagtgttatcgagctatgtgagcgactgagtattccgtgtgaggaaagaccgttcactcgccatgatgtatatgtagcggatgaagtatttttaacaggaacagcagcggagttaattccagttgtaaaagttgattccagagaaattggagatgggaaaccaggaagtgtaacgaaacaattgaccgaagaatttaaaaaattaacgagagaaagaggagtacgtgttcccaggctgacggaaagcttagcataa

SEQ ID NO: 7083 - protein, 292 aa, Bacillus cereus
MNGEFVEKEKAVVSVYDHGFLYGDGVFEGIRSYGGNVFCLKEHVKRLYESAKSILLTIPMTVEEMEEAVLHTLQKNEYTDAYIRLIVSRGKGDLGLDPRSCVKPSVIIIAEQLKLFPQEFYDNGLSVVSVASRRNTPDALDPRIKSMNYLNNVLVKIEAAQAGVLEALMLNQQGYVCEGSGDNVFVVKDGKVLTPPSYLGALEGITRNSVIELCERLSIPCEERPFTRHDVYVADEVFLTGTAAELIPVVKVDSREIGDGKPGSVTKQLTEEFKKLTRERGVRVPRLTESLA

SEQ ID NO: 7084 - DNA, 873 bp, Bacillus cereus
  CDS (1)..(873)
atgttaatttacgtaaatggtcagtatgtagaagcaagtgaagcgagaatttctccttatgatcatggttatttatatggtcttggagtttttgaaacgtttcgtatttataatggtcatcctttcttattggatgatcattataaccgtttaatagaggcgctggatacattgcaaattaaatggacaatgacaaaaaatgatgtgatgcttattttgaaagatttactcgctaagaatgaattgaagcatgcatatgtacgttttaatgtatcggcgggtatagatgaaataggattacaaacggaaatgtatgaagagccttctgttattgtttttataaaacctttaacagctccaggggatgtagtggaaaaagaaggtgttattctaaaacaagtgcgaaatacaccggaagggacatttcgcctgaagtctcatcactatttaaataatattttagggaagcgtgaaattggaaatgttgtgagtaaggaaggtattttccttactgaagcaggttatgttgcagagggcattgtttcgaatctattttttgtgaaaggtgatgttttatatacaccttcgttagagacagggattttaaatggtatcactcgtgcgtttattataaagagtgctgaagaattaaatatagaagtaaaggaaggtttctttacaaaagatgagctactttcagcggatgaagtcttcgtaacaaactccattcaagaaattgttccgctttatcgtatagaagcgcaggatttcccgggtaaagtaggagtggttacaaaaagtttaatgtacctttatggaatgcaaagagagaaattatggagcagaaatgaactacgaagaggagatgtgtag

SEQ ID NO: 7085 - protein, 290 aa, Bacillus cereus
MLIYVNGQYVEASEARISPYDHGYLYGLGVFETFRIYNGHPFLLDDHYNRLIEALDTLQIKWTMTKNDVMLILKDLLAKNELKHAYVRFNVSAGIDEIGLQTEMYEEPSVIVFIKPLTAPGDVVEKEGVILKQVRNTPEGTFRLKSHHYLNNILGKREIGNVVSKEGIFLTEAGYVAEGIVSNLFFVKGDVLYTPSLETGILNGITRAFIIKSAEELNIEVKEGFFTKDELLSADEVFVTNSIQEIVPLYRIEAQDFPGKVGVVTKSLMYLYGMQREKLWSRNELRRGDV

SEQ ID NO: 7086 - DNA, 873 bp, Bacillus anthracis
  CDS (1)..(873)
atggcatatgaaagatttgtactttggaatgatgcaattattgatacaacgaagcaaaaaacgtacatagaacttgaagaaagaggcttgcagtttggagatggtgtctacgaggttattcgtctatataaagggaacttccacttattagatccccatatcacaagattatatcgcttcatggaagaaatagaattaacactccctttctcaaaagcagaactgattaccctactttataaactaatcgaaaataataatttccacgaagatggaacgatttatttgcaagtatctcgtggtgtacaagctcgtacccatacgttctcatatgacgtccctccgacaatctatgcttatattacaaagaaagaaagaccagcgctatggattgaatatggtgtacgtgctatatcagaaccggatacacgctggctacgctgtgatatcaaatcattaaatttattaccaaatatattagctgctacgaaagcggaacgaaaaggttgtaaagaagcccttttcgtacgaaatggtactgtaactgagggaagtcactctaacttctttctcattaaaaacggaactctttacacacatccagctaatcaccttattttaaatggcattattcgtcaatatgtcctttctttagcgaaaacccttcgtattccagtacaagaagagcttttcagcattcgtgatgtttatcaagcggatgaatgtttctttacaggaacgacgattgaaattttgccgatgactcaccttgatggaaccgcaatccaagatggtcaagttggccctatcactaaaatgctgcaaagatcattttctcaaagtttgttacaatccaacatgtcatcctcttaa

SEQ ID NO: 7087 - protein, 290 aa, Bacillus anthracis
MAYERFVLWNDAIIDTTKQKTYIELEERGLQFGDGVYEVIRLYKGNFHLLDPHITRLYRFMEEIELTLPFSKAELITLLYKLIENNNFHEDGTIYLQVSRGVQARTHTFSYDVPPTIYAYITKKERPALWIEYGVRAISEPDTRWLRCDIKSLNLLPNILAATKAERKGCKEALFVRNGTVTEGSHSNFFLIKNGTLYTHPANHLILNGIIRQYVLSLAKTLRIPVQEELFSIRDVYQADECFFTGTTIEILPMTHLDGTAIQDGQVGPITKMLQRSFSQSLLQSNMSSS

SEQ ID NO: 7088 - DNA, 822 bp, Streptomyces avermitilis
  CDS (1)..(822)
atgaagatctggctcgacggcgggctgcaggactccgagaccgcccgcgtctccgtcttcgaccacgggctgaccgtgggtgacggcatcttcgagaccgtcaaggcggccgaggggcggccgttcgcgctgacccgccacctcgaccggctggcgcgttcggcgcggggcctcgggctgcccgagcccgacctggacgaggtacgccgcgcctgcgccgccgtcctggacgccaatccgatgccgctcggccggctgcgcatcacgtacaccggcggctacggtccgctcggctccgaccgcggcgagaaggggccgaccctggtcgtcgccgtcggcgagtccgcccgccgccccgattccaccgccgtgatcaccgtgccgtggacgcgcaacgagcgcggcgcgctcaccggtctcaagaccacctcgtacgccgagaacgtcgtcgccctcgcccgcgcgcgcgaacagggcgcgtccgaggcgctgttcgccaacacggtcggccggctgtgcgagggcaccgggtcgaacgtcttcgtcgtgctcgacggcgagatccacaccccgccggtcgactccggctgcctcgcgggcatcacccgcgcgctcaccgtcgagtggaccggcgccaaggagaccgacctgcccctcgacgtcctggacagcgccgaggaggtgttcctcacgtccacgctgcgcgatgtgcagggcgtgcaccgggtcgactcccgcgaactcccgggcgcgccgggcccggtgaccgccaaggccatgcggctcttcgacgagcaggccggggacgacctcgacccgtag

SEQ ID NO: 7089 - protein, 273 aa, Streptomyces avermitilis
MKIWLDGGLQDSETARVSVFDHGLTVGDGIFETVKAAEGRPFALTRHLDRLARSARGLGLPEPDLDEVRRACAAVLDANPMPLGRLRITYTGGYGPLGSDRGEKGPTLVVAVGESARRPDSTAVITVPWTRNERGALTGLKTTSYAENVVALARAREQGASEALFANTVGRLCEGTGSNVFVVLDGEIHTPPVDSGCLAGITRALTVEWTGAKETDLPLDVLDSAEEVFLTSTLRDVQGVHRVDSRELPGAPGPVTAKAMRLFDEQAGDDLDP

SEQ ID NO: 7090 - DNA, 1089 bp, Streptomyces avermitilis
  CDS (1)..(1089)
atgacgacgcccacgatcgagctcaagccctccgccagtccgctctccgacgcggagcgcgaggcgatcctggccagccccggattcggccgccacttcaccgaccacatggtgacgatcaagtggacggagggacgcggctggcacgacggccagctcgttccgtacgccccgctctccctcgacccggccaccatggtcctgcactacgcgcaggagatcttcgagggcctgaaggcgtaccgccagcccgacggctcggtggcctccttccgccccgacatgaacgccaagcgcttccaggcctcggcccgccgcctcggaatgccggagctgccggtcgagacgttcatcgaggcgtgcgacgtgctggtccagcaggacgcgtcgtgggtgccggcgcacggcggcgaggaatccctctatctgcgcccgttcatgatcgcgaccgaggtcggcctgggcgtgaagcccgccaacgagtacctcttcctcgtcatcgcgtccccggcgggcgcgtacttcccgggcggcgtgaagccggtctcgatctggctctccgaggaccgcgtgcgcgccgtccccggcggcatgggtgacgccaagaccggcggcaactacgccgcgtcgctgctcgcgcaggccgaggccgccgagaagggctgcgcccaggtcgcgtacctcgacgcggtcgagcacaagtgggtggaggagctcggcggcatgaacctgtacttcgtgtacgggaacaagatcatcacgcccgccctgaccggctccctcctcgcgggcgtcacccgcgactccctgctctcggtcgcccgtgacctgggctacgagtccgaggagggccgcgtctccatcgaccagtggcaggccgacaccgagaacggcacgctgaccgaggtcttcgcctgcggtacggccgcggtcatcacgccggtcggcacggtcaagcgcagcagcgccgagtggcagcactcgggcggtgagccgggcgaggtcaccctgaagctgcgcgaggccctcctcgacatccagcgcggcatcggcgaggacaagcacggctggatgcacccgctgggctag

SEQ ID NO: 7091 - protein, 362 aa, Streptomyces avermitilis
MTTPTIELKPSASPLSDAEREAILASPGFGRHFTDHMVTIKWTEGRGWHDGQLVPYAPLSLDPATMVLHYAQEIFEGLKAYRQPDGSVASFRPDMNAKRFQASARRLGMPELPVETFIEACDVLVQQDASWVPAHGGEESLYLRPFMIATEVGLGVKPANEYLFLVIASPAGAYFPGGVKPVSIWLSEDRVRAVPGGMGDAKTGGNYAASLLAQAEAAEKGCAQVAYLDAVEHKWVEELGGMNLYFVYGNKIITPALTGSLLAGVTRDSLLSVARDLGYESEEGRVSIDQWQADTENGTLTEVFACGTAAVITPVGTVKRSSAEWQHSGGEPGEVTLKLREALLDIQRGIGEDKHGWMHPLG

SEQ ID NO: 7092 - DNA, 924 bp, Nitrosomonas europaea
  CDS (1)..(924)
atgtcgatggcggaccgtgacggggttatctggtatgacggagagatggttccgtggcgcaatgccacgacccacgtacttacccataccctgcattatggaatgggtgtattcgaagggttgcgcgcctatcagacacccggggggccggccattttccgtctgcccgagcatacggaacgtctgttctactcggcacatgtcttcagaatgaaaatcccttttgatcagcccacgctgatacaggcacagctggatgtcgtccggcagaacaggttaacctccggctatattcgtccaatcgtcttctacgggtcggaagccatgggattatccgccaagaacctgtccgtccacgtcgccatcgctgcctggtcatggggaacctacctgggcgcagatgcgctggaaaacgggattcgcgtcaaaacctcctcgttcacccgccaccacgtcaatatcaacatgtgccgtgccaagtcggtcgccacttataccaactcgatcctggcgcatcaggaagttgcacaggacggctatgaggaagccttgctgctggacgtggatggttatgtcgcggaaggttccggtgaaaacattttcatcatcaaaaaaggcaagatttacacacctgatctgacagcctgtctggaaggcatcacgcgtgcatcggtcattcaactggcgcaagaagccggtatcgaggtcattcagaaacggattacccgtgatgaagtctactgcgcggatgaagccttttttaccggtacggcagcagaaatcacgccgatccgtgaactggattgtcgtatgattggtaacggtaaacgcggtcctgtcaccgaacaactgcaaaccgcattttttgactgcgtcaacggcaaatcagacaaacatgcagattggctgcattacgccgattag

SEQ ID NO: 7093 - protein, 307 aa, Nitrosomonas europaea
MSMADRDGVIWYDGEMVPWRNATTHVLTHTLHYGMGVFEGLRAYQTPGGPAIFRLPEHTERLFYSAHVFRMKIPFDQPTLIQAQLDVVRQNRLTSGYIRPIVFYGSEAMGLSAKNLSVHVAIAAWSWGTYLGADALENGIRVKTSSFTRHHVNINMCRAKSVATYTNSILAHQEVAQDGYEEALLLDVDGYVAEGSGENIFIIKKGKIYTPDLTACLEGITRASVIQLAQEAGIEVIQKRITRDEVYCADEAFFTGTAAEITPIRELDCRMIGNGKRGPVTEQLQTAFFDCVNGKSDKHADWLHYAD

SEQ ID NO: 7094 - DNA, 861 bp, Nitrosomonas europaea
  CDS (1)..(861)
atgatttacctcaatggcaaatttctgccgatggaacaggctaccgttccagtgctggatagaggcttcatcttcggtgatggtgtctatgaagtcataccggtttattcacgtaaaccgttccggctgggcgaacatctttcccggctgcagcacagtctggatggcatacgtctccagaatccgcacactgaagaacaatgggctggtctgatcgaacgcatcatcgagctgaatgaaggtgatgatcagtacctttacctgcacattacacgcggggtggcaaaacgtgaccatgcctttcctcgcgaagtaacgcccactgtcttcatcatgagcaacccgcttccggctccacctgcaaaattgctcgtttccggagtttcagcgattaccgccagggataatcgctgggggcgctgtgatatcaaagccatttcactgttgccaaatatcttattgcgccagcttgccgtggacgcacaagccatggaaacgatcctgttacgcgatggtctgttgaccgaaggggccgccagcaatattttcatcgtaaaagacgacctgctgctgaccccccccaaagatcaccgtatattgcctggcattacttatgatgtagtactggaactggctgaaacacatggtgttccacatgcgacaagagaaatatcagagcttgagttacgtactgcacgggaaatcatgctgacttcttccaccaaagaaattctcccgatcacacagctggatggacaaccgatcggtaatggcaccccagggccagtatttcagcaactggatcggctctatcaggcatataagctggaagtcatgcgcgggcatgctccacgccagtaa

SEQ ID NO: 7095 - protein, 286 aa, Nitrosomonas europaea
MIYLNGKFLPMEQATVPVLDRGFIFGDGVYEVIPVYSRKPFRLGEHLSRLQHSLDGIRLQNPHTEEQWAGLIERIIELNEGDDQYLYLHITRGVAKRDHAFPREVTPTVFIMSNPLPAPPAKLLVSGVSAITARDNRWGRCDIKAISLLPNILLRQLAVDAQAMETILLRDGLLTEGAASNIFIVKDDLLLTPPKDHRILPGITYDVVLELAETHGVPHATREISELELRTAREIMLTSSTKEILPITQLDGQPIGNGTPGPVFQQLDRLYQAYKLEVMRGHAPRQ

SEQ ID NO: 7096 - DNA, 1020 bp, Enterococcus faecalis
  CDS (1)..(1020)
atggaaaaagccaatcttgattggaataatttaggattttcttacattaaaacgccctttcgttatattagttattggcgagatggcaagtgggaagaaggcacgctaacagataacaatcagttaacgattagtgaaggttcgcctgctctacattatggccaacaatgttttgaaggattaaaagcgtatcaatgtgcagatggttctgtcaatttgtttcgtccagatgaaaatgccaaacggctacaaaaaagttgtgcgcgtctactgatgccacaagtgccagtagaaacctttgtttctgcatgccaagaagtggtgaaagccaaccttgcttatttaccgccatatggaacgggcggtacgttgtatcttcgcccttatatgattggtgtcggcgataatattggcgtagcacctgccaaagaatacattttttctattttttgcgtgccggttggttcgtattttaaaaatggtttagcaccaaccaactttatcgtttctgaatatgatcgagcagcgggtcgaggaactggggcagctaaagtggggggcaattatgcagctagtcttttaccaggtgcagaagcacatgagaaagaatttagtgattgcatttatttagatccgtatacgcatacgaaaattgaagaagttggtgcagccaatttctttggcataaccaaagatggtacttttattacgccgaaatcagcgtctattttgccaagtattactaaatattcattattgacgctagcaaaagaacgtttagggatgacggcgcttgaaggagacgtttacattgatcgattagcggacttctccgaagcgggtgcttgtggcacagcggcgattatttctcctattggtgggattcaaaacggcacagatttccatgtattttatagtgaaacggaagttggaccagtgactaagcaactatatgatgaactggttggcatacagtttggtgacaaagaagcgccagaaggctggattgtaaaagtttag

SEQ ID NO: 7097 - protein, 339 aa, Enterococcus faecalis
MEKANLDWNNLGFSYIKTPFRYISYWRDGKWEEGTLTDNNQLTISEGSPALHYGQQCFEGLKAYQCADGSVNLFRPDENAKRLQKSCARLLMPQVPVETFVSACQEVVKANLAYLPPYGTGGTLYLRPYMIGVGDNIGVAPAKEYIFSIFCVPVGSYFKNGLAPTNFIVSEYDRAAGRGTGAAKVGGNYAASLLPGAEAHEKEFSDCIYLDPYTHTKIEEVGAANFFGITKDGTFITPKSASILPSITKYSLLTLAKERLGMTALEGDVYIDRLADFSEAGACGTAAIISPIGGIQNGTDFHVFYSETEVGPVTKQLYDELVGIQFGDKEAPEGWIVKV

SEQ ID NO: 7098 - DNA, 846 bp, Coxiella burnetii
  CDS (1)..(846)
atgaaaattatttttaataaaaaaattctttctgctgatacacccatcatttattccaatgatcgaggttttttgtttggcgatggattatttgaaactatcaaagcggaaaaaaacgagttgctctttttcgctgaacattataaccgattggcgacttcggccaagaaattattcattccgcttaatttttccttgcttgaactcaaaactcaatgcgaaagcctattagaaataaataaactcgacgaagcagccgtacgaatcacattaactcgaggaagctcggaaagggggatcgccattgaatctgctgtctctcctaatttactgattacgactatcccctataaaaaacaagccgatatttatccaactctttgcatcactgctattagacgtaacgaatattcccccttgtctcaacttaaaacgcttaattttttagagcctattttaactagacaacaagccataaaaaatggatctgctgaaggcgttatgctaaatacgaaaggcgctgtaactgagacgagcgtcggtaacttatttgctgttattcatcagaaaatatttacaccaaaaattgaggatggtttattacccgggattgtgcgccagatagttatcgatatcgccaccaaaaccgacatacctattaaagaaaaaactttatctccagaagaccttttagaggccgacgaaatatttcacaccaatagcctcattgaaattcaatccttcgcgaaaattaatgaacgccctttagccaccggcgaacaagctttattaaccaggaaaattttagaaacctacgaatggtataaaaataaacgaaaaaaatga

SEQ ID NO: 7099 - protein, 281 aa, Coxiella burnetii
MKIIFNKKILSADTPIIYSNDRGFLFGDGLFETIKAEKNELLFFAEHYNRLATSAKKLFIPLNFSLLELKTQCESLLEINKLDEAAVRITLTRGSSERGIAIESAVSPNLLITTIPYKKQADIYPTLCITAIRRNEYSPLSQLKTLNFLEPILTRQQAIKNGSAEGVMLNTKGAVTETSVGNLFAVIHQKIFTPKIEDGLLPGIVRQIVIDIATKTDIPIKEKTLSPEDLLEADEIFHTNSLIEIQSFAKINERPLATGEQALLTRKILETYEWYKNKRKK

SEQ ID NO: 7100 - DNA, 1086 bp, Tropheryma whipplei
  CDS (1)..(1086)
atgagtgccaagaattataaaaaaacactgctagtaaaccccatttcgcaggatgaattacaaaagaggctttctgccccagggttcgggtctgttttttctgagcatatggtctccgcggattggcatcgcgatcttggttggcatgattatcgtgtcgaaccgtatggtccaattagtcttgccccctcggccatggtatttcattatggacaggaaattttcgaggggctgaaaatttttcgccattcacaggatagttctgtgcgcgcatttaggccactggaaaatgcaaagaggtttcaaaaatcctccgagagaatcgcgcttcccgttttaccggttgaggattttctgcaatcgcttcgtgagtgggtgatggttgacggccgctgggttccgaatgcaccgtcatgtgtttatgcaagaccatttatgatagcaaccgaggaggcgctcggtcttcgggcaacgtgcagcgccagatataccctaatttgctgtccggttggtgatttgtttggccaaataaggcccattagggtacgggtttcttctaagtattcgagggcgtccaggggtgggaccgggtccgttaaatttggtggtaattatgcggcatctattttgccccaggtcgaggctgggaatgatgggtttgaccaggttctttttttggactcggcatcttataaaaatattgaagagctgtccgcatcgaatatattctttgtactctccagtaagactttgattacgccgagtcttggtggaactattcttccgggtgttactcgtgacagtatcataagaatagccgaggatttggggtttgttgttgagcaaagacaaatcagtcttgacgaggtaacacatctatttagtcaggacaaagtaacggaaatgttttgctgcggaaccgcggcgtctgtaacccccattgggtccgtgtcttttgatggaggcaccctgggctcggggcaggcgggtcctgttacgatgctccttcgtgaatatctgcgggatatacagtttggtaatcgtccggataaatacaactggatggtcaatcttgaggatacttag

SEQ ID NO: 7101 - protein, 361 aa, Tropheryma whipplei
MSAKNYKKTLLVNPISQDELQKRLSAPGFGSVFSEHMVSADWHRDLGWHDYRVEPYGPISLAPSAMVFHYGQEIFEGLKIFRHSQDSSVRAFRPLENAKRFQKSSERIALPVLPVEDFLQSLREWVMVDGRWVPNAPSCVYARPFMIATEEALGLRATCSARYTLICCPVGDLFGQIRPIRVRVSSKYSRASRGGTGSVKFGGNYAASILPQVEAGNDGFDQVLFLDSASYKNIEELSASNIFFVLSSKTLITPSLGGTILPGVTRDSIIRIAEDLGFVVEQRQISLDEVTHLFSQDKVTEMFCCGTAASVTPIGSVSFDGGTLGSGQAGPVTMLLREYLRDIQFGNRPDKYNWMVNLEDT

SEQ ID NO: 7102 - DNA, 837 bp, Legionella pneumophila
  CDS (1)..(837)
atgagtatcgcatttgttaacggcaagtattgttgtcaatctgaagcaaaaatttcaatatttgatcgagggtttctttttggtgactcggtttatgaagtgctgcctgtttaccatgggcagccttactttgtagaccaacatcttgaccgattattctcaaatatgaaaaaaattaagatgattataccaaattatgattggcatggtttaattcatagactaatatcagaaaataatggcggtaatttacaagtatatatccaagtcacacgagggaatcaaggggtgcgcaagcatgatatccctacttccatcacaccttctgttatcgcattcactatgcataatccatttcccaccctcgaagataaggaacagggaatgtcagcaaaactggttgaagattttcggtggatgagatgtgatataaaaactacttctttaattgccaatatattactgaatgatgaggctgtatctgcaggattccacactgcaattcttgcccggaacggtctaattacagagggaagtagtaccaacgtatttattgtcgcacaggatggtgttattaagacaccacccatgaataatttctgtttaccaggaattactcggcaagttgttattgaaataattaaaaaattagatttaaagttcagagaaatagaaattagcatttcagagcttttttctgctcaggaagtttggataacaagtacgacaaaagaagtattccctattacaaagattaatgactctttgattaatggcggaaaagttggcgaatattggcggataattaatgattcctaccaacaactagtaaactag

SEQ ID NO: 7103 - protein, 278 aa, Legionella pneumophila
MSIAFVNGKYCCQSEAKISIFDRGFLFGDSVYEVLPVYHGQPYFVDQHLDRLFSNMKKIKMIIPNYDWHGLIHRLISENNGGNLQVYIQVTRGNQGVRKHDIPTSITPSVIAFTMHNPFPTLEDKEQGMSAKLVEDFRWMRCDIKTTSLIANILLNDEAVSAGFHTAILARNGLITEGSSTNVFIVAQDGVIKTPPMNNFCLPGITRQVVIEIIKKLDLKFREIEISISELFSAQEVWITSTTKEVFPITKINDSLINGGKVGEYWRIINDSYQQLVN

SEQ ID NO: 7104 - DNA, 921 bp, Bacillus cereus
  CDS (1)..(921)
atgaaagtttcacattacttacgtacttacgaaaggatgggatggaaattggcatacgaaaaatttgtactttggaatgatgaagttattgatacaacaaaacaacaaacgtacatagaacttgaagagagaggttcgcagttcggagatggtgtctacgaggttattcgcctatataaagggaactttcacttattagatccgcacataacgagattatatcgatccatggaagaagtagaattatcgctccctttctcaaaagctgagctcatcactttactttacaaattaattgaacgaaaccatttccacgaagatggcacaatttatttgcaagtatctcgtggtgtacaagctcgcacacatgtattttcgtatgacacccctccgacaatttatgcctatattacaaaaaaagaaagaccagccttatggattgaatatggtatacgcgctatatcagaacccgatactcgatggctacgctgtgacattaaatcattaaatttattaccaaacgtactagctgctacgaaagctgaacgaaaaggctgtaaagaggcacttctcgtaaggaatggtattgtaacggaaggaagccattccaacttctttttaattaaaaacggaactctttacacacatccagccaatcaccttattttaaatggcattattcgtcaatatgtcctttctttagcgaatactcttcacattcctgtacaggaagaacttttcagcgttcgtgacgtttatcaagcagatgaatgcttttttacaggcacaacaattgaaattttaccaatgacccaccttgatggaaccgcgattcaagatgggcaagttggagctatcaccaaaaaactgcaaaaatcttttaataaaatcttgttacaatccaatatgtcatcttcttaa

SEQ ID NO: 7105 - protein, 306 aa, Bacillus cereus
MKVSHYLRTYERMGWKLAYEKFVLWNDEVIDTTKQQTYIELEERGSQFGDGVYEVIRLYKGNFHLLDPHITRLYRSMEEVELSLPFSKAELITLLYKLIERNHFHEDGTIYLQVSRGVQARTHVFSYDTPPTIYAYITKKERPALWIEYGIRAISEPDTRWLRCDIKSLNLLPNVLAATKAERKGCKEALLVRNGIVTEGSHSNFFLIKNGTLYTHPANHLILNGIIRQYVLSLANTLHIPVQEELFSVRDVYQADECFFTGTTIEILPMTHLDGTAIQDGQVGAITKKLQKSFNKILLQSNMSSS

SEQ ID NO: 7106 - DNA, 897 bp, Bacillus cereus
  CDS (1)..(897)
atgaatgagcaatggattttcttaaatggagaatttgttccaaaagatgaggcaaaagtttcagtatatgatcatggctatttatatggcgatggagtgtttgaaggaattagagtttatagcggtaatgttttccgtttgagagagcatcttgtccggttgtatgaatcagcaaaatcaatccttttagaaattccatattcattagatgaagtaacaaatattgttgttgagacgattcgacacaataaattatctaatggatacattcgccttgttgtatcaagaggagcagggaatcttggattggatcccgattcatgtaggaagccgaatgtagtagtgattgcagtgcctatttctttattcccgcaagaatattatgagatagatattccagttgtaacagttgcaacgcgccgaaatcgtcccgatgttttatcccctcaagtaaaatctttaaattacttaaacaatattttagttcgtattgtagcgaaattggctggagtacaagaagcgcttatgttaaatgatcaaggatatgtagctgaaggatcaggagataacgtgtttattgttaaaggaaataaattaattacaccaccaagttctgctggagcgttagaaggtattacacgaaacgccattttagaaatcggcgaaaaacttgggtatgacgtaagagaagagttatttacaagacatgatgtatatgtagctgatgaagtgtttttaacaggaacagctgctgaagtgattgctgttacgacagtagatggtagaacgattggcttagggcaaacaggtccacatacgaaccgtttattagaagagtttcgtaagttagttgtagaagatggagagaaaatttacgaagaaaataaagttggataa

SEQ ID NO: 7107 - protein, 298 aa, Bacillus cereus
MNEQWIFLNGEFVPKDEAKVSVYDHGYLYGDGVFEGIRVYSGNVFRLREHLVRLYESAKSILLEIPYSLDEVTNIVVETIRHNKLSNGYIRLVVSRGAGNLGLDPDSCRKPNVVVIAVPISLFPQEYYEIDIPVVTVATRRNRPDVLSPQVKSLNYLNNILVRIVAKLAGVQEALMLNDQGYVAEGSGDNVFIVKGNKLITPPSSAGALEGITRNAILEIGEKLGYDVREELFTRHDVYVADEVFLTGTAAEVIAVTTVDGRTIGLGQTGPHTNRLLEEFRKLVVEDGEKIYEENKVG

SEQ ID NO: 7108 - DNA, 876 bp, Bacillus cereus
  CDS (1)..(876)
atgaaagctactcataaagattggatcttgtttaatgggagaatgattaatacgaaagaagaacagccgatggtagcattagaagagagaggcttccaatttggtgatgggatttatgaagtatttagactatacgatggcaagcctcatttattagatttacatttggaacgattctttaactctatggcagaaataaaactaattccaccatttacgaaggaagaattagtagaagagttatatcaaatgattgaaaaaaatcaatttcaagaagatgggaatgtatatttacaaatatcaagaggtgcacaacagcgcaatcatgtatatgaatcagatttacaaccgacatattttgcaaatcttgtttcgttcccaagaccagttgcttcaatggaggcagggattaaggtgacagtagaagaggacatcaggtggaagttttgccatataaaatctttaaatttgcttcctaatatcatgatcaaaaacaaaataaatgaacaagggtatcaagaagcaatattagtacgagatggtattgtgactgaagggtgtcattccaatttctttatcgtgaagaataataagttgattacacatccagcggatcatttcattttacatggtattacacgtcactatgtaattacattagcgaaagagttacatatcgatgtagaggaacgagagttttcattacaagaagtatatgacgctgaggagtgcttctttacagcgacgccacttgaaatattcccagtcgttcaaattggtgatgaacagttcggggctggtgaaagaggaccaattacgaaaaaactacaagctgcatacgaagagagtattcgtttgtttaaagtgacaaattaa

SEQ ID NO: 7109 - protein, 291 aa, Bacillus cereus
MKATHKDWILFNGRMINTKEEQPMVALEERGFQFGDGIYEVFRLYDGKPHLLDLHLERFFNSMAEIKLIPPFTKEELVEELYQMIEKNQFQEDGNVYLQISRGAQQRNHVYESDLQPTYFANLVSFPRPVASMEAGIKVTVEEDIRWKFCHIKSLNLLPNIMIKNKINEQGYQEAILVRDGIVTEGCHSNFFIVKNNKLITHPADHFILHGITRHYVITLAKELHIDVEEREFSLQEVYDAEECFFTATPLEIFPVVQIGDEQFGAGERGPITKKLQAAYEESIRLFKVTN

SEQ ID NO: 7110 - DNA, 900 bp, Bacillus cereus
  CDS (1)..(900)
atgggaaaccagtacatatacatgaatggggaatttgtagaaaaagaaaaggcagttgtttcagtatatgatcacggttttttatacggagacggtgtatttaaagggattcgtagttacggaggaaatgtattttgtataaaggaacatgtgaaacgattggatgaaatcagcgaaatctattttactaacaattccaatgacggcagaagaaatggaagaagcagtttacatacactccaaaaaaacgaatatactgatgcttacattcgcttaattgtctcaagaggaaaaggtgacttagggctcgatccgagaagttgtgtgaagccgagcgtaattatcattgcagaacaattaaagttattcccacaagaattttatgataatgggctaagcgttgtatctgttgcatcaagacgtaatacgccagatgcgttagatccacgtattaagtcaatgaattatttaaataacgtacttgtaaaaattgaagcagcacaagcaggggtgttagaggctcttatgttaaatcaacaaggatatgtttgtgaaggttctggtgataatgttttcgttgtgaaagatggaaaagtattagccccgccatcctatttaggagcattagaaggtattacgagaaatagtgttatcgagctatgtgagcgactgagtattccgtgtgaggaaagaccgttcactcgccatgatgtatatatagcggatgaagtatttttaacaggaacagcagcggagttaattccagttgtaaaagttgattccagagaaattggagatgggaaaccaggaagtgtaacgaaacaattgaccgaagaatttaaaaaattaacgagagaaagaggagtacgtgttcccaggctgacggaaagcttagcataa

SEQ ID NO: 7111 - protein, 299 aa, Bacillus cereus
MGNQYIYMNGEFVEKEKAVVSVYDHGFLYGDGVFKGIRSYGGNVFCIKEHVKRLDEISEIYFTNNSNDGRRNGRSSLHTLQKNEYTDAYIRLIVSRGKGDLGLDPRSCVKPSVIIIAEQLKLFPQEFYDNGLSVVSVASRRNTPDALDPRIKSMNYLNNVLVKIEAAQAGVLEALMLNQQGYVCEGSGDNVFVVKDGKVLAPPSYLGALEGITRNSVIELCERLSIPCEERPFTRHDVYIADEVFLTGTAAELIPVVKVDSREIGDGKPGSVTKQLTEEFKKLTRERGVRVPRLTESLA

SEQ ID NO: 7112 - DNA, 1861 bp, Cicer arietinum
  CDS (5)..(1660)
ggagatggaggtcgaggtgattcactcatggtctgctccaagatctcttagcacctctcttatgtattcattttctcagcgagatgatatagaagtgcttgatgaacctctttatgctaatttccttcgagaccctgcttttgatagaccctacagagatcaactactctctaaaatggaatctgatggaaacaaggttgttaatgatattatatacggtccaggatccaaaaagtatagattttgcaagcatatgtcaaaacataaggtgcataatttgcctgaggatctactcaagaaagggaaacatttcattttgataagaaatccacttgacatactgccatcctttgacaaggttcttcccccaacttcctttgagttgggtttggggcagcttgttggtatatatgatgaactctgtgatattggaaaaccaccgcctgttatagatgccaaagaacttcaaaaagatcccgagggtactttacgaggtctctgtaatgatttggagattccttttcaacctgcaatgctcagttgggaagcaggtccaaaaccaatagatggcttgtgggccccttggtggtacaaaaatgtacataaatctactagatttgaggtacaaagcaagaatcctgagccacttcccctttctcaatataatttgttggcgcgaactctgcctcactacaacatgctccggagccatgtaaagaagaagttatccattctgagctctccttcacctcctcccgaccttccagttcctgcaaatgagaaattggttgcttgggttggtgatgagattgtgacacgtgagagtgctaaggtttctgtgtttgactcagttgtccaaggaggtgactcagtttgggagggtcttcgagtgtatgataaaaagatatttaaacttgaggagcatctagataggatgtttgattcagctaaagcattggcttttgaaaatgtaccaactcgagatgagattaaggaagctattttcagaaccctaattaagaatggaatgtttgacaatgcgcacatccgactttctctgacacgaggaaagaaggttacttctgggatgagccccgcattaaatctgtatggatgcacattaattgtgcttgctgaatggaagccccctgtttatgataatgagcgcggtatagttcttgtaactgccacaacacgccgtaactcaccaaataatttggattcaaagattcatcacaataatctcctcaataacattctagcaaagatagaagccaataatgcaaaagcagacgatgcaatcatgcttgacaaagatggttatgtatctgaaaccaatgcaacaaatatcttcatggtaaagaaaggccgtgttttgacaccacatgctgattactgtcttcctggcattactcgagcaactgttatggatcttgtggtgaaagagcagtttattttagaagagcgaagaatcagcctgtcagaagtgcatactgcagacgaggtatggacaacaggaacaatgggagaactaagcccagtagtgaaggttgatggacgcacaattggtaatggaaaagtagggccaataactagaaaattgcaagttgcttataaaaagttgaccgaacagtctggtgtaccaatagagttggcctgagatctctaccttgagacttgaaagttggaacttggaagttagtgaaaatgactgatgtgccactgctaataatctcagcgtcttccttttctcaatctagaataaaatgtattgcttcgtattgtacctttcggtcccagatattagtgcatgagttcttagtttataaatgcaatttgaaacaaaaaaaaaaaaaaaaaa

SEQ ID NO: 7113 - protein, 551 aa, Cicer arietinum
MEVEVIHSWSAPRSLSTSLMYSFSQRDDIEVLDEPLYANFLRDPAFDRPYRDQLLSKMESDGNKVVNDIIYGPGSKKYRFCKHMSKHKVHNLPEDLLKKGKHFILIRNPLDILPSFDKVLPPTSFELGLGQLVGIYDELCDIGKPPPVIDAKELQKDPEGTLRGLCNDLEIPFQPAMLSWEAGPKPIDGLWAPWWYKNVHKSTRFEVQSKNPEPLPLSQYNLLARTLPHYNMLRSHVKKKLSILSSPSPPPDLPVPANEKLVAWVGDEIVTRESAKVSVFDSVVQGGDSVWEGLRVYDKKIFKLEEHLDRMFDSAKALAFENVPTRDEIKEAIFRTLIKNGMFDNAHIRLSLTRGKKVTSGMSPALNLYGCTLIVLAEWKPPVYDNERGIVLVTATTRRNSPNNLDSKIHHNNLLNNILAKIEANNAKADDAIMLDKDGYVSETNATNIFMVKKGRVLTPHADYCLPGITRATVMDLVVKEQFILEERRISLSEVHTADEVWTTGTMGELSPVVKVDGRTIGNGKVGPITRKLQVAYKKLTEQSGVPIELA

SEQ ID NO: 7114 - DNA, 1229 bp, Giardia lamblia
  CDS (72)..(1139)
tttaacgtagcaatcttgggggccgtccgttaaaatggtcagcatttttcttaagcaaaggagaatgaaaaatggctgtcgatccctccacgatagactggtctgcgctgaagttttcgtggctgcaaacgcgctcccacgttcgcagtgtctggagaaacggcgagtggagccctcttgagctggtaaacgagccgacattcaatatttcgattgcggcctctgcgcttcactacggccaggcagtcttcgagggtctcaaggtcttccgcactgttgacggcagagtcgctgccttcagaccagttgagaatgcccgcaggctcatcagctcgtgcgacggtctctgcatggagtccccgtcagagcagctcttcctcaatgctcttgcgatggttgtcagggataacgttgactatatcccgccatatggtacagggggctccctctatgtccgtcccctggttatcggtaccggagcccagcttggagttgcaccgtcgtccgaatacatgttcctcatgatggtcgcgcctgttggtccttattaccggggaggcctcaagagcgtgaacgcaatcgttatggacgaattcgacagggcagcaccctatggcgtcggcagcaagaagtgtgccggaaactacgccgcatctcttaaggcccagagcgttgctctgaaaaagagcttccccattcagctgtacctcgacgctgctacgcacacgtttgttgaggagttctccaccagcaacttctttgggattaaggacatccagagagatggggcgggcaagatcgtttcgtgcacttacgttactcctaagtctccttctattttgccctcgatcacgaacaagactctccgcgagcttatttcccagtacttcggctggaaggttgatgtgcgcgaggtcccgttcacagaggttaagacattccaagaatgcggagccacaggcacggccgtcgttgtgacgcccattgcttccatcacccgcggttccactgttatcgacttcctgcaatctgacgatcaggttggcgaagttaccaagctactatatgaaactgtccagggcatacagtacggggtgatcccagacagattcaactggaaccactacattgacgtgtaaactccagcaacaaggcagagatctggattcacttgggggaactagtcccagttgatgccgcatacgtctcgtatgaacgggctgatcaac

SEQ ID NO: 7115 - protein, 355 aa, Giardia lamblia
MAVDPSTIDWSALKFSWLQTRSHVRSVWRNGEWSPLELVNEPTFNISIAASALHYGQAVFEGLKVFRTVDGRVAAFRPVENARRLISSCDGLCMESPSEQLFLNALAMVVRDNVDYIPPYGTGGSLYVRPLVIGTGAQLGVAPSSEYMFLMMVAPVGPYYRGGLKSVNAIVMDEFDRAAPYGVGSKKCAGNYAASLKAQSVALKKSFPIQLYLDAATHTFVEEFSTSNFFGIKDIQRDGAGKIVSCTYVTPKSPSILPSITNKTLRELISQYFGWKVDVREVPFTEVKTFQECGATGTAVVVTPIASITRGSTVIDFLQSDDQVGEVTKLLYETVQGIQYGVIPDRFNWNHYIDV

SEQ ID NO: 7116 - DNA, 1089 bp, Xylella fastidiosa
  CDS (1)..(1089)
atgtccatttcgttcgatattgcccgctcattgtctaccacttctgatgaagagctctctatgatcctgcaagcgccagggttcggtgttcatttcactgatcatatgattgctatcgcctgggataaggacaatgattggcacgacgcccaggtgcgcgcctatgggccattgttgctagatcctgccgctgctgtgctgcactacgggcaagagattttcgaaggaatcaaagcatatcgccatgctgatggttcgatctggacgttccgcccggaggccaacgctcgccgcttgcagcgttcggccaaacgattagtgctgccagagttgccggtggaactgtttacagaatctttgcgtcaactcattgcagtggatgcccgctgggttccttcagcaccagaaaccagcctttattttcgtcccttcatgattgccacagaagcgtacttaggcgtgcgtgctgcgcagcacgcctcttactacctgatcgccagccctgctggcccgtatttcgctaaaggcgttactcccgtgtcgatctggttgtcgacagactgtgcccgtgctgccctagggggcacgggcgcggtgaagtgtggtggcaattatgccgcctccttgctgccgcaacaggtcgcgcagacccagggatgctctcaggtactgttccttgatccggttgagggcaaatacctggaggagctgggagggatgaatgtgtttctcgtctacacagacggcaccttggtcacaccagcgttgtctggcagcatcctcgaaggtatcacccgcgagagtatcttgcagcttgctcgtgatcgagggatgtgtgttgaggaacgtaaggtagcaattgaggagtggaaagagggcgtggtttccggtgcgatcagcgaggtattcgcttgcggtacggctgctgtgatcactccaattggtgaattgaaagcggagggtttttcggtcggaaacatcaacgcaccacctggcgaagttactctgtcgttgcgcaaggaactgaccgacatccagtacggccgtttgccagaccgttatgggtggatgacgtgtttgaaggaataa

SEQ ID NO: 7117 - protein, 362 aa, Xylella fastidiosa
MSISFDIARSLSTTSDEELSMILQAPGFGVHFTDHMIAIAWDKDNDWHDAQVRAYGPLLLDPAAAVLHYGQEIFEGIKAYRHADGSIWTFRPEANARRLQRSAKRLVLPELPVELFTESLRQLIAVDARWVPSAPETSLYFRPFMIATEAYLGVRAAQHASYYLIASPAGPYFAKGVTPVSIWLSTDCARAALGGTGAVKCGGNYAASLLPQQVAQTQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTCLKE

SEQ ID NO: 7118 - DNA, 939 bp, Vibrio parahaemolyticus
  CDS (1)..(939)
atggcaacgaaaactgcagatttcatttggtttaatggtgagatggttccatgggcagaggcgaacgtgcatgttctcactcacgccatgcattacggcacctcggtatttgaaggggtacgctgctacaacacaccaaaaggcccaattgtcttccgtcaccgtgaacatgcacagcgtttaaaagattccgccaaaatttaccgcttccctattccatactctgttgaagaaatcatggaagcaacgcgtgaaactctgcgtcaaaacaaactcgacagcgcttacattcgtccattgggatttgtgggcaatgtcggtttaggtgtgtgtcctccagtaggcgccgaaatggagctgatcatcgcggcgttcccatggggctcgtaccttggtgaagaagcactagaaaaaggcgtggatgcgatgatttcaagctggaatcgcgcggcacctaacaccatccctaccgcagcaaaagcgggtggtaactacctttcttcactactcgttggtggtgaagcacgtcgtcatggttacgacgaaggtattgcactgagtgttgacggttacttgtcagaaggcgcgggcgaaaacatctttgtcatcaaagatcgcgtgatcaccacaccaccagccaccagcgctatcctaccgggtatcactcgtgactcgatcatgaccattgctcgcgataaaggttacgaagtccgtgaagctaacattgctcgcgaagcgctataccttgcggatgaagtattcatgaccggtaccgcagcagaagttgtgcctgtagctaccatcgacaaaattgaagtgggcagcggtaaacgcggtccaattaccaaagaattgcaagaagcctactttggcctatttaacggcaccacagaagataagtggggctggttagactatgtgtacccagagcagcagtaa

SEQ ID NO: 7119 - protein, 312 aa, Vibrio parahaemolyticus
MATKTADFIWFNGEMVPWAEANVHVLTHAMHYGTSVFEGVRCYNTPKGPIVFRHREHAQRLKDSAKIYRFPIPYSVEEIMEATRETLRQNKLDSAYIRPLGFVGNVGLGVCPPVGAEMELIIAAFPWGSYLGEEALEKGVDAMISSWNRAAPNTIPTAAKAGGNYLSSLLVGGEARRHGYDEGIALSVDGYLSEGAGENIFVIKDRVITTPPATSAILPGITRDSIMTIARDKGYEVREANIAREALYLADEVFMTGTAAEVVPVATIDKIEVGSGKRGPITKELQEAYFGLFNGTTEDKWGWLDYVYPEQQ

SEQ ID NO: 7120 - DNA, 1035 bp, Pseudomonas syringae
  CDS (16)..(1035)
atgatagagggcgttatgagtcaagaaagcatcaactgggacactctgggttttgactatatcaagactgacaaacgctatctgtctcattggcgcgacggtgcctgggatcagggctcgctgactgaagacaacacgctgcacatcagcgaaggttcgaccgcgctgcattacggtcaacagtgctttgaaggcctgaaggcctatcgctgcaaggacggctcgatcaacctgttccgtcccgaccagaacgcacagcgtatgcagcgcagctgttcccgtctgctgatgccccatgtacccaccgacgtgttcatcgaggcctgcaagcaggtcgtcaaggccaacgagcgtttcatcccgccgtatggctccggcggcgcgctgtacctgcgcccgttcgtgatcggagtgggtgacaacatcggcgtgcggactgcgccagagtttatcttctcgatcttctgcattccggttggtgcttatttcaagggcggcctgaagccgaacaacttcgtgatctccggttacgaccgtgctgcgcccaacggcaccggtgctgccaaggtcggtggcaactatgccgccagcctgatgccgggttcggaagccaagaaacacagcttcgcggactgtatctacctcgacccgcagactcattccaaaatcgaggaagtgggttcggccaacttcttcgccatcaccagcgacgatgtgttcctgacgcctaaatcgccatcagtgttgccaggcattacccgcctgtcgctgatcgaactggcaaaaaaccgtttgggcctgacggtcgaggagggcgatgtgttcatcgaccagctcgacacattcaaggaagccggcgcgtgcggcaccgctgcagtgatcaccccgatcggcggcatttcctaccaggacaacctgcacgtgttctacagccagaccgacgtcggcccggttacccagcgtctgtacaaggaactgaccggtgtgcaatccggtgacatcgagccgcccgccggctggatcgtcaaggtctag

SEQ ID NO: 7121 - protein, 339 aa, Pseudomonas syringae
MSQESINWDTLGFDYIKTDKRYLSHWRDGAWDQGSLTEDNTLHISEGSTALHYGQQCFEGLKAYRCKDGSINLFRPDQNAQRMQRSCSRLLMPHVPTDVFIEACKQVVKANERFIPPYGSGGALYLRPFVIGVGDNIGVRTAPEFIFSIFCIPVGAYFKGGLKPNNFVISGYDRAAPNGTGAAKVGGNYAASLMPGSEAKKHSFADCIYLDPQTHSKIEEVGSANFFAITSDDVFLTPKSPSVLPGITRLSLIELAKNRLGLTVEEGDVFIDQLDTFKEAGACGTAAVITPIGGISYQDNLHVFYSQTDVGPVTQRLYKELTGVQSGDIEPPAGWIVKV

SEQ ID NO: 7122 - DNA, 1122 bp, Pseudomonas putida
  CDS (103)..(1122)
gtgactggccgttcccgatccgccaaggatgtattaaggtggcatggtgcgcatataacagcagcccgagcgatcgggcacttgcaagacaatgagggtgtcatgagcaacgaaagcattaattgggacaagctgggtttcgactacatcaagaccgacaaacgctacctgtccgtatggcgcaatggcgagtgggacaagggcaccctgaccgaagacaacgtactgcacatcagtgaaggctccacggccctgcactacggccagcagtgcttcgaaggcctgaaggcctaccgttgcaaggacggctcgatcaacctgttccgcccggaccagaacgcggcccgcatgcagcgcagctgcgcacgcctgctgatgccgcacgtgccgaccgatgtgttcatcgaagcgtgcaagcaagtggtcaaggccaacgaaaagttcgtgccaccgcacggcaaaggcgccctgtacctgcgcccgttcgtgatcggcaccggcgacaacattggcgtgcgcaccgcccccgagttcatcttctcggtgttcgccatcccggttggttcgtatttcaagggcggcatgaagccgcacaatttccagatttccagcttcgaccgtgctgccccgcagggcaccggagcggccaaggtcggtggcaactacgctgccagcctgcagccgggcgctgaagcgaagaaggccaacttcgccgacgccatctacctcgacccgctgacccacaccaagatcgaggaagtcggttcggccaacttcttcggcatcaccgccaacaacgagttcgtcaccccgaaatcggcctcggtactgccaggcatcacccgcctctcgctgatggaactggcgcaatcgcgcctgggcatgaccgtgatcgaaggcgatgtcgagatcagcaagctggaccgcttcgtcgaagccggtgcctgcggcaccgcggccgttatcaccccgatcggcggcatcgagtacaacggcaagctgcacgtgttccacgacctggaaaaggtcggcccggttacccagaagctctacaacgagctgaccggtatccagagcggcgatgtagaggcaccggcaggctggatcgtcaaggtcgcctag

SEQ ID NO: 7123 - protein, 339 aa, Pseudomonas putida
MSNESINWDKLGFDYIKTDKRYLSVWRNGEWDKGTLTEDNVLHISEGSTALHYGQQCFEGLKAYRCKDGSINLFRPDQNAARMQRSCARLLMPHVPTDVFIEACKQVVKANEKFVPPHGKGALYLRPFVIGTGDNIGVRTAPEFIFSVFAIPVGSYFKGGMKPHNFQISSFDRAAPQGTGAAKVGGNYAASLQPGAEAKKANFADAIYLDPLTHTKIEEVGSANFFGITANNEFVTPKSASVLPGITRLSLMELAQSRLGMTVIEGDVEISKLDRFVEAGACGTAAVITPIGGIEYNGKLHVFHDLEKVGPVTQKLYNELTGIQSGDVEAPAGWIVKVA

SEQ ID NO: 7124 - DNA, 1029 bp, Lactobacillus plantarum
  CDS (1)..(1029)
atggcagacgtacaattagactggaacaacttggggtttgaatatcggaatcttccgtaccgttatcgtgcgtattggaaagatggtgcttggtacaaaaaagaattaacgggagatgcaactttacatattagtgaaggctcaacagcattacactatggtcaacaagactttgaaggcttaaaagcttaccgcactaaagatggtagtgttcaattattccggccagatcgtaatgcagcccgaatgcagaccagctgtgaacggttattaatgccacaagtgccgacagacatgtttgtggacgctgttaaacaggttgttaaggctaatcaagattacgtgccaccgtatggaactggtgcgactttatacttacggccattgatgatcggggttgggggtaacattggtgttcatccagctcaggaatacatcttcacggtctttgccatgccagttggtagttatttcaaaggcgggatgacgccaaccaactttacgacgtccgaatatgatcgtgcggcccataaaggaaccggggcttataaagttggtgggaattatgcggctagcttattcccaggtcaagaagctcatgccaacggtttctccgactgtgtttatcttgacccggttgaacatcgtaagattgaagaagtaggttcagcgaacttcttcgggattactaaggatggcacttttgtgacacccaagtcaccatcaattctacctgccgttacgaaatattcattactctacttggcagaacataaatttgggatgaagactgaacaaggcgacgtctacattgatgatttagaccggtttgctgaagctggggcttgtgggacagctgcggttatttcaccaatcggtggcttggaacatcaaggcaagttacacgtgttctacagtgaaacggaagttggtccggtaacgaaaaaattatatgatgaattaactggaattcaatttggcgatcgggaagcgcctgaaggttgggtccagaaagttgaattagactaa

SEQ ID NO: 7125 - protein, 342 aa, Lactobacillus plantarum
MADVQLDWNNLGFEYRNLPYRYRAYWKDGAWYKKELTGDATLHISEGSTALHYGQQDFEGLKAYRTKDGSVQLFRPDRNAARMQTSCERLLMPQVPTDMFVDAVKQVVKANQDYVPPYGTGATLYLRPLMIGVGGNIGVHPAQEYIFTVFAMPVGSYFKGGMTPTNFTTSEYDRAAHKGTGAYKVGGNYAASLFPGQEAHANGFSDCVYLDPVEHRKIEEVGSANFFGITKDGTFVTPKSPSILPAVTKYSLLYLAEHKFGMKTEQGDVYIDDLDRFAEAGACGTAAVISPIGGLEHQGKLHVFYSETEVGPVTKKLYDELTGIQFGDREAPEGWVQKVELD

SEQ ID NO: 7126 - DNA, 822 bp, Clostridium tetani
  CDS (1)..(822)
atgaacatatttggaaaatactatatctttaataatgatatcaaagattctagagaatttaacgataatattataaagggagaaaaaaatatttatgaggtattaaaagttaaaaatagcgtgccactactactagaagaacacataaaaagacttaaaagcacttctaatttaactaacctaaaaatatggttgaaagaaagctttatagaggattctataaaaaaattaataaaaaaaaataaggtggaagaaggaagtttaaaatttattttaaactttgaggaaaaaaactttatatgttactttgaagaaacaatatttcccaataaagaagattttaaagaaggcatatctactgcattatacaatgaggaaagagaaaatcctaatgcaaaggttttaaagttagattttagaaaaagtttagataaatttataaaagataaaaatatatttgaagccatattagtagatagaaatggattcataactgagggaagtaaatccaatatatttatggtaaaagaccataaacttataactactccatcaaaggctgtattacctggaattactagaaaacaagttttagatatatgcaatgaattaaatatatctgtaatagaaaagtatataggtagtgaagaattagaagaaatagatggaatattcatatcaagcactccttttgacattttaccaataaaaactgtagatgacttaaaatttaaatcgtcaaaaaatcctttaattatatctattatggataaatacaataaaaagatatatgaatatataaaagataagaaagataattaa

SEQ ID NO: 7127 - protein, 273 aa, Clostridium tetani
MNIFGKYYIFNNDIKDSREFNDNIIKGEKNIYEVLKVKNSVPLLLEEHIKRLKSTSNLTNLKIWLKESFIEDSIKKLIKKNKVEEGSLKFILNFEEKNFICYFEETIFPNKEDFKEGISTALYNEERENPNAKVLKLDFRKSLDKFIKDKNIFEAILVDRNGFITEGSKSNIFMVKDHKLITTPSKAVLPGITRKQVLDICNELNISVIEKYIGSEELEEIDGIFISSTPFDILPIKTVDDLKFKSSKNPLIISIMDKYNKKIYEYIKDKKDN

SEQ ID NO: 7128 - DNA, 1083 bp, Bradyrhizobium japonicum
  CDS (1)..(1083)
atgagcatgaaattcgacatccagcccgcatccaatcctactccagaaaaggaccgcgtcgccaagctggtggaccccggcttcgggcgggtcttcaccgaccacatggcgatcgtccgttacaaccaggccaagggcggctggtacgaggcgcgcatcgaggcgcgcgccaacttccagctcgatccggccggcgccgtcctgcactacgcccaggaaattttcgagggcctcaaggcctacaagcgcgacgacggcggcgtgaacctgttccgccccgacgccaatgcgcggcgcttcagggactcggccgatcgcatggcgatggcgcagctgcccgaagacgtcttcatcgaggcggtcgagcaggtcgtgcgcatcgatcgcgcctggatgccgggcggcgagggcagcctttacctgcgccccttcatgatcgcgagcgagaccttcctcggcgtcaagccgtcgtccgaatacatcttcgcggtgatcgcctcaccggtcggctcctatttcaagggcggacctgcgccggtgtcgatctgggtctcggagaactacacgcgcgccgcggtcggcggcaccggcgccgtcaagtgcggtggcaattacgccgcgagtctgcgtgcgcaggcggaagccattcagcacggctgcgatcaggtggtcttcctcgatgcgatcgagcgccgctacgtcgaggagctcggcggcatgaacatcttcttcgtgttcgaggacggctcgttgtcgacgccgccgctcggcacgatcctgcccggcatcacccgcgactccatcatcgcgctggcgaaggatgccggcaagacggtgcgcgaggagccgtactcgctcgaccagtggcgcaaggatgcggccagcggcaagctgaaggaagcgttcgcctgcggcaccgcggcggtgatctcgccgatcggcaaggtgcgctcggtgagcggcgatttcgagatcagcggcggcgtcgccggcccggtcgccatgggcctgcgcaagcagctcgtcgacatccagtacggccgcaccaacgatccccacaactggatccgcaaggtgttttga

SEQ ID NO: 7129 - protein, 360 aa, Bradyrhizobium japonicum
MSMKFDIQPASNPTPEKDRVAKLVDPGFGRVFTDHMAIVRYNQAKGGWYEARIEARANFQLDPAGAVLHYAQEIFEGLKAYKRDDGGVNLFRPDANARRFRDSADRMAMAQLPEDVFIEAVEQVVRIDRAWMPGGEGSLYLRPFMIASETFLGVKPSSEYIFAVIASPVGSYFKGGPAPVSIWVSENYTRAAVGGTGAVKCGGNYAASLRAQAEAIQHGCDQVVFLDAIERRYVEELGGMNIFFVFEDGSLSTPPLGTILPGITRDSIIALAKDAGKTVREEPYSLDQWRKDAASGKLKEAFACGTAAVISPIGKVRSVSGDFEISGGVAGPVAMGLRKQLVDIQYGRTNDPHNWIRKVF

SEQ ID NO: 7130 - DNA, 888 bp, Bradyrhizobium japonicum
  CDS (1)..(888)
atggttcccgataccaattccatcagccattcgaggacatggacattcttccgaggccagtggcacgagggcaatgtgccgatcatggggccacgtactcatgggctctggctcgcctcgaccatcttcgatggtgcgcgcgctttcgaaggcgtcatgcccgacctcgatcgtcattgcgcccgcgtcaatcaatctgcggtcaacttcgggctcaaaccggtcgtcgatctcgacacgtggctcggactggtgcgcgaaggtatcgcccgtttcccggtcaatgccgaactctacatccgcccgatgtactggccgcagaacggcatcggcggcggtgtgctgttcgatccggaaacgacggactggtgcctttgcatctacgaatcgccgatcccggagcccgtcggcagcgcgattaccctgtcgccgttccgcagaccgaccgccgaatgcgcgccggccgatgtcaaggcctcctgtctttatccgaacagttcgcgtgcgctcagggaagccgcctcgcgcggcttccagaattgcctgatgctggacatgctcggtaacgtcacggagttcggcaattccaacgtgttcatggcgaaagacggcgttgtctttacgcctgcgccgaatggcacgttcctgaacggaatcacgcggcagcgcgtgatcgaacttttgcgcggtgacggcatcacggtgttggaggcaacgctgcgctactccgatttcgtcagtgcggacgagatcttttcgaccggcaatttcgcaaaagtcgcgcccgtgatccggatcgacgaccggcaactcaggccagggcgcttttatgcgcgggcacgaaagctgtattgggattttgcccacggaatgaagcttgctgcgtga

SEQ ID NO: 7131 - protein, 295 aa, Bradyrhizobium japonicum
MVPDTNSISHSRTWTFFRGQWHEGNVPIMGPRTHGLWLASTIFDGARAFEGVMPDLDRHCARVNQSAVNFGLKPVVDLDTWLGLVREGIARFPVNAELYIRPMYWPQNGIGGGVLFDPETTDWCLCIYESPIPEPVGSAITLSPFRRPTAECAPADVKASCLYPNSSRALREAASRGFQNCLMLDMLGNVTEFGNSNVFMAKDGVVFTPAPNGTFLNGITRQRVIELLRGDGITVLEATLRYSDFVSADEIFSTGNFAKVAPVIRIDDRQLRPGRFYARARKLYWDFAHGMKLAA

SEQ ID NO: 7132 - DNA, 1056 bp, Bradyrhizobium japonicum
  CDS (1)..(1056)
atggacggcattatatccggtttgctccccaatgttatttcaccgcgatgctcaccctccgtccagggggccctccaggggaggggggcattccccgcagggaatcatttagaaattgcccccaatagtcgtgccatattgcggcatcacgccaaggggaggccggtcatggccgagatcaagaaagccatcgaatattcgccgagttggaccttcttcgagggcaaatggcacgacggcaatgtgccgatcatgggcccgcgcacgcatgcggcctggctcggctcggtcgtgttcgacggcgcgcgcgcgttcgagggcgtcgcacccgatctcgaccgtcacatcgcccgtgccaatcagtccgcgatcaattttggcctgaagccggtggtcgatcccggcacctggctcacgctcgcaaacgaaggcatcgcgcgcttcgcgacgaatgccgagctgtatatccgtccgatgtactgggcggagaacgggtcgggcggcggcgtgctgttcgaccccgagaccaccaactggtgcctgtgcatctacgaggcgccgatgcccaaacccgtcggcaacgccatcacgctgtcgccgttccgcaggccgactgccgaatgcgcgccggtcgaggccaaggcggcctgcctctatcccaacaattcgcgcgcgctggcggaggccgcctcccgcggcttccagaacgcgctgatgctcgacatgctcggcaatgtcgccgagttcggcaattccaacgtgttcatggccagggacggcgtggtgttcacgccggtgccgaacggcaccttcctcaacggcatcacgcgccagcgcgtcatcggcctgcttcgcgccgacggcgtcaccgtggtcgagaagacgttgcgctatgccgacttcctcgccgccgacgagattttttcaaccggcaatttcgccaaggtcgcgcccgtgattcgcatcgacgagcgcgagctgaagccgggcccgctctacacaaaagcgcgcaagctctattgggactttgcgcatgcggtgaagctggcggcgtag

SEQ ID NO: 7133 - protein, 351 aa, Bradyrhizobium japonicum
MDGIISGLLPNVISPRCSPSVQGALQGRGAFPAGNHLEIAPNSRAILRHHAKGRPVMAEIKKAIEYSPSWTFFEGKWHDGNVPIMGPRTHAAWLGSVVFDGARAFEGVAPDLDRHIARANQSAINFGLKPVVDPGTWLTLANEGIARFATNAELYIRPMYWAENGSGGGVLFDPETTNWCLCIYEAPMPKPVGNAITLSPFRRPTAECAPVEAKAACLYPNNSRALAEAASRGFQNALMLDMLGNVAEFGNSNVFMARDGVVFTPVPNGTFLNGITRQRVIGLLRADGVTVVEKTLRYADFLAADEIFSTGNFAKVAPVIRIDERELKPGPLYTKARKLYWDFAHAVKLAA

SEQ ID NO: 7134 - DNA, 1020 bp, Bacteroides thetaiotaomicron
  CDS (1)..(1020)
atgaaagaaatagactgggcgaatctgtcgttcggatacatgaagacagattacaatgtgagaatcaatttccgtaacggcgcatggggcgaactggaagtcagcagtgatgaacatctcaatctgcacatggcagctacttgtctgcactatggtcaggaagcttttgaaggtttgaaggctttccgcggcaaagacggtaaagtacgtatcttccgtctggaagaaaatgcggcacgtctgcaatctacttgtcagggcattctgatggccgaactgccgaccgaacgtttcaaggaagcgattctgaaagttgtaaagctgaacgaacgtttcattccgccttatgaaaccggtgcttctctatacattcgtccgttactgatcggaacaagtgcccaggtaggcgtacatcctgccgaagaatatatgttcgtggtatttgtaactccggtagggccttacttcaaaggtggtttctctaccaatccgtatgtgattatccgcgagttcgaccgtgccgctcctcatggaactggtatctacaaggtaggcggtaactatgcggccagtctgcgtgccaacaagaaagcgcacgatctgggctattcctgcgagttctatctggatgcaaaagaaaagaaatatatcgacgagtgcggcgcagccaacttcttcggaattaaagataatacgtacattactccgaagtcatcttctatcctgccttcgatcaccaacaagagtctgatgcagctggcagaagacatgggcatcaaggtagaacgacgcccgataccggaagaagaactggaaacgttcgaagaagcgggtgcttgcggtacagctgcggtaatcagtccgattcagcgtatcgatgacctggagaacggaaaatcatacgttatctctaaagacggcaagccgggaccgatctgcacgaaactgtataataagttgcgtggcattcagtacggtgacgaaccggatacacatggttgggtgacgattgtagaataa

SEQ ID NO: 7135 - protein, 339 aa, Bacteroides thetaiotaomicron
MKEIDWANLSFGYMKTDYNVRINFRNGAWGELEVSSDEHLNLHMAATCLHYGQEAFEGLKAFRGKDGKVRIFRLEENAARLQSTCQGILMAELPTERFKEAILKVVKLNERFIPPYETGASLYIRPLLIGTSAQVGVHPAEEYMFVVFVTPVGPYFKGGFSTNPYVIIREFDRAAPHGTGIYKVGGNYAASLRANKKAHDLGYSCEFYLDAKEKKYIDECGAANFFGIKDNTYITPKSSSILPSITNKSLMQLAEDMGIKVERRPIPEEELETFEEAGACGTAAVISPIQRIDDLENGKSYVISKDGKPGPICTKLYNKLRGIQYGDEPDTHGWVTIVE

SEQ ID NO: 7136 - DNA, 867 bp, Oceanobacillus iheyensis
  CDS (1)..(867)
atgtctgtatatccaattattttaacgcaatctgaatttaaagataaggatagcctaaactacccatttgaagaacgtggtttgcaattcggagatggtatttatgaagttatccgtgtatatgaggggaaatactatttatttgaagaacatgtcgatcgattatatcgttctgcagaagcaattaaaattgaaatacctcaaagtaaaaaagaaatgaaagaattattgcttcaactaattacaaaaaatgaaatgactacagatggaaaagtgtatatgcaaatcacaagagggtctgctcctcgcgatcatatcttcccacaatctgtagaaccaaatatgtatgcctatgtacaggatatgccaagaaataaagaagctctacaacatggagtatcaacgattactcaacctgatattcgttgggaaaattgctatattaaaagtttaaacttacttcctaatgttctagcaaaacagacagctaaagaacaaggatgttatgaggctattctccatagagacggcaaagtcactgaatgcagtgcatccaatgtgtatttagttaaaaacgggaaagtatatactcacccaacaacaaacaatatactctacggttgtgtgcgcatggcagtggaaaggttcttaaaagctgcaaatattgaacttattgaagaagcgtttcaactagaagacatttctagtgcagatgaaatattcttatccagtagtacttctgaagttacgcccattgtacgtgtggatgataaagctattggagacggtaagccaggtacaatcaccaagcaattacagcgagcatatgaaacagaagcagctataaaagataaattaactgtgtaa

SEQ ID NO: 7137 - protein, 288 aa, Oceanobacillus iheyensis
MSVYPIILTQSEFKDKDSLNYPFEERGLQFGDGIYEVIRVYEGKYYLFEEHVDRLYRSAEAIKIEIPQSKKEMKELLLQLITKNEMTTDGKVYMQITRGSAPRDHIFPQSVEPNMYAYVQDMPRNKEALQHGVSTITQPDIRWENCYIKSLNLLPNVLAKQTAKEQGCYEAILHRDGKVTECSASNVYLVKNGKVYTHPTTNNILYGCVRMAVERFLKAANIELIEEAFQLEDISSADEIFLSSSTSEVTPIVRVDDKAIGDGKPGTITKQLQRAYETEAAIKDKLTV

SEQ ID NO: 7138 - DNA, 861 bp, Synechococcus elongatus
  CDS (1)..(861)
atgctgctgtgcaacttggatggggtaattacgccagaggcctccatttctgttttggatcgggggtttctctacggtgacagtgtttatgaggtgattcgtacgtaccgggggattccctttgccctgccagagcacctagcacgattgcgcgcctcagccgcctatctctacatgcgtctgccctggtccgatgagtacattacccaagaagtgcaacgcaccttagcggctgccccagccggagaatattacattcggattgtggtgacccgtgggggcgatcgccgcattggcctattgccagaaccgaccacccaaccgcggttattgattgtgttgatggggatcccccccgaaccaacgttgagtgaacagggaattcgccttgccattcctaagcggcaacgcaccagcactgctgcccttgatccggcggccaaaacgggcaattacctcaacaacatcttggccctattggaggcacagcaggcgggttttgaggacgccctgcttctcaatgcccaaggacagattaccgaggccacgaccagcaacttctggattgttcgtgggggtgtggtcgagacaccccccaccaccgttggcatgctccacggaattacgcgcgggacgctgttgcagatcgttgcagacttgggtattccccatcgggaagtgattctcaccccccaggatctcgcagaagccagtgaggggtttctcagttcctcggtgcgccttctaatgccgattcggcaagtgaatgaggtgatctttccggcctgtccgggacctgtgacccaacagctatggcgagaattattagcagtgatggaaaaggcggttgcagcagcctaa

SEQ ID NO: 7139 - protein, 286 aa, Synechococcus elongatus
MLLCNLDGVITPEASISVLDRGFLYGDSVYEVIRTYRGIPFALPEHLARLRASAAYLYMRLPWSDEYITQEVQRTLAAAPAGEYYIRIVVTRGGDRRIGLLPEPTTQPRLLIVLMGIPPEPTLSEQGIRLAIPKRQRTSTAALDPAAKTGNYLNNILALLEAQQAGFEDALLLNAQGQITEATTSNFWIVRGGVVETPPTTVGMLHGITRGTLLQIVADLGIPHREVILTPQDLAEASEGFLSSSVRLLMPIRQVNEVIFPACPGPVTQQLWRELLAVMEKAVAAA

SEQ ID NO: 7140 - DNA, 912 bp, Synechococcus elongatus
  CDS (1)..(912)
atgagtgactttcttccctacgcctacctcaacggtcaatttgtgccctttgaagaagccaaaatttccgtagctacccatgcccttcactacggaacagctgccctagggggcttgcggggtcttcccaatcccgctaatcctaaggaaatacttctgttccgccttgaggatcactgtcggcgccttagtcgcagtgcctattatctgggctatgaattgcccaccagtgagattaaagcaagaatcattgagtgggtgcagaaaaatcaacccagggtgcctttctatattcgacccttggtttacacttctgggctagggatcgcccctcggctccacgatattgaaaaggattttctcatttacggcctgccccttggagattatcttgcagcgaccggcgttacctgccgcattagttcttggcagcggcagtgcgatcgctcgtttcccctacggggcaagttgaccacctcctacattgtctccgctttggccaaaacagaggccgtttccagcggctttgatgaggcgattctcctcaacgagcaggggaaagtttgtgaagccaccgggatgaatctctttttggtgcgggaggggcaactgattacccccagtgtggatcaggatattctggagggcatcacccgccgcagtgtcattgaattggcccaagcagccggtgttaaggtgatggagcgacccgtggatcgcacggaactgttgattgccgatgaggtctttttgaccggtacggcggcgcgaattgtgcccgtcagtcgtattgagacctacactctgcccagcgatcgccccctgacactccaactgcaaaaacaattacaggcgatcgttgaaggccgagagccgcagtatcgccattgggttgatgtcattccgctctag

SEQ ID NO: 7141 - protein, 303 aa, Synechococcus elongatus
MSDFLPYAYLNGQFVPFEEAKISVATHALHYGTAALGGLRGLPNPANPKEILLFRLEDHCRRLSRSAYYLGYELPTSEIKARIIEWVQKNQPRVPFYIRPLVYTSGLGIAPRLHDIEKDFLIYGLPLGDYLAATGVTCRISSWQRQCDRSFPLRGKLTTSYIVSALAKTEAVSSGFDEAILLNEQGKVCEATGMNLFLVREGQLITPSVDQDILEGITRRSVIELAQAAGVKVMERPVDRTELLIADEVFLTGTAARIVPVSRIETYTLPSDRPLTLQLQKQLQAIVEGREPQYRHWVDVIPL

SEQ ID NO: 7142 - DNA, 1026 bp, Streptococcus mutans
  CDS (1)..(1026)
atgacagtagatttagattggaaaaatttaggatttgaatatcacaaacttccatttcgctatatttcttactacaaagatgggaaatgggatgacggtaaactgacagaagatgcgactctccacatttctgaaagctcaccagctcttcattatgggcaagaagcttttgaaggtttgaaagcctaccgtacaaaagatggctctgttcagcttttccgtcctaatatgaatgctgagcgcttacaacgtacagctgatcgtctcttgatgccgcaagtgccaactgacaaattcattgatgctgccaaacaagtcgttcgtgccaatgaagagtatgttccaccatatggtacaggggcaacgctttatcttcgcccacttttgattggtgtcggcgatgtgatcggtgttcatccagctgatgaatatatctttaccatctttgctatgccggtaggtaactactttaaaggtggtttggctccgacgaattttcttattcaagatgattatgaccgcgctgcgccacatggcacaggagctgccaaagttggcgggaactacgcggcgagtcttttgccaggtaaggttgcccatgaacgccagttttcagatgttatttatcttgacccagcaacacatactaagattgaagaagtcggttcagctaacttctttggtatcactaaagataatgagtttattacacctcttagtccgtccattcttccttctgttaccaaatattctctgctttatttagctgaacatcgtttcggcatgaaagccattgaaggcgatgtctgcgtagatgaattagataaatttgttgaagcaggagcctgcggtacagcagctgttatctcaccaatcggaggtgtacagcacggtgatgatttccatgtcttttacagtgaaacggaagttggtcctgtaacgcataaattgtatgatgagttaacaggtatccaattcggcgatgttaaagcaccagagggctggatatataaagttgatgactag

SEQ ID NO: 7143 - protein, 341 aa, Streptococcus mutans
MTVDLDWKNLGFEYHKLPFRYISYYKDGKWDDGKLTEDATLHISESSPALHYGQEAFEGLKAYRTKDGSVQLFRPNMNAERLQRTADRLLMPQVPTDKFIDAAKQVVRANEEYVPPYGTGATLYLRPLLIGVGDVIGVHPADEYIFTIFAMPVGNYFKGGLAPTNFLIQDDYDRAAPHGTGAAKVGGNYAASLLPGKVAHERQFSDVIYLDPATHTKIEEVGSANFFGITKDNEFITPLSPSILPSVTKYSLLYLAEHRFGMKAIEGDVCVDELDKFVEAGACGTAAVISPIGGVQHGDDFHVFYSETEVGPVTHKLYDELTGIQFGDVKAPEGWIYKVDD

SEQ ID NO: 7144 - DNA, 1023 bp, Streptococcus agalactiae
  CDS (1)..(1023)
atgacagtaaatttagattgggataatttaggttttgcttacagaaaattaccattccgatacatttcgcattttaaagatgggaaatgggatgatggcaagttgacagatgatgcaacgctacatatttcagaaagttcacctgctctccattatgggcaacaagcttttgaaggattgaaagcttatagaactaaagatggctctattcagttatttcgtccagatcaaaatgcagaacgacttcaaagaacagcagatcgtcttttaatgccacatgttccgacagacaaatttattgcagcggttaaatctgttgtacgcgctaatgaggagtttgttccaccgtatggtacaggggcaacattatacattcgtcccttattaattggtgtgggagatattattggagttaaacctgctgaagaatatatttttacggtatttgcaatgccagtaggtagttattttaaaggtggtttaacaccaactaactttattgtttccaaagaatatgatagagcagcaccgaatggtacaggagctgcaaaagttggtggtaactatgctgctagtcttcttcctgggaaatatgctcatgagaaacaattttcagatgttatctatcttgatccagcgacacatactaaaattgaagaggttggagcagctaatttctttggaattactaaagataatcagtttatcacccctttgagtccttcaattttaccttcaattactaaatattcattgctttaccttgctaaagaaaggtttggtatggaagcgattgaaggagatgtctttgtcgacgaattagataaattcacagaagctggcgcatgtggtacagccgcagttatttcaccaattggaggaattcaaaacggagatgacttccatgtcttctacagtgagacagaagttggtccagcgacacgcaaactatatgatgagttagtagggatccagtttggtgatgttgaagcaccagaagggtggatttataaagtagattag

SEQ ID NO: 7145 - protein, 340 aa, Streptococcus agalactiae
MTVNLDWDNLGFAYRKLPFRYISHFKDGKWDDGKLTDDATLHISESSPALHYGQQAFEGLKAYRTKDGSIQLFRPDQNAERLQRTADRLLMPHVPTDKFIAAVKSVVRANEEFVPPYGTGATLYIRPLLIGVGDIIGVKPAEEYIFTVFAMPVGSYFKGGLTPTNFIVSKEYDRAAPNGTGAAKVGGNYAASLLPGKYAHEKQFSDVIYLDPATHTKIEEVGAANFFGITKDNQFITPLSPSILPSITKYSLLYLAKERFGMEAIEGDVFVDELDKFTEAGACGTAAVISPIGGIQNGDDFHVFYSETEVGPATRKLYDELVGIQFGDVEAPEGWIYKVD

SEQ ID NO: 7146 - DNA, 1092 bp, Shewanella oneidensis
  CDS (1)..(1092)
atggaaataaaatacgatttaaaacctgcgtccgaacgccgtactgagcaattcaagcccgaaggaaatgtgggcttcggtagcctcagaaccgatcatatgtttttaatggattatcacgatggtgagtggcgcgatcctcgtattgtgccctatggcccatttgaaatggctccgggtgcaatggcgctgcactatggccagtcaatcttcgaaggtgcaaaagcctttatgcatgaagatggcgaaatttacacgttccgtattaataaaaacgctgagcgtatgaatcgttctgcggatattgtctgtattcctaatatcgatgagcagatgcaaatcgatgcgatcaacgccttgatcgatgtggatcgtctttggttcccgatgcaagaaggtgcctgtttatacattcgcccctttatttttgcgaccgaagaccgtctgtctgtaagcccaagttcgcgctacacattctgcgtggtgttaagcccaagtggtgcttactacgcggcgggtgtgaataaaggcattcgtctactgatcagcaagacttaccatcgcgctgtatcgggtggtactggcgcctctaaagcggcgggtaactatgccgcctcattacgtgcgggtaaagctgccgcacagtttggggcctcacaggtgttgtatttagatgccaacaatcagcagattgaagaagctggggctatgaaccacttccacattctcaaagatggcactgtgattatcccgacattcaccgacaccatcttaaaatcgattacctcgcaatctattatggaactcagtgagctactcggctgcgaagtgcgccaagagacggtgatgctcgataagtttattgccgatatcgaatccggtgagattatcgaggcgggtggttttggaactgccgccgtagtgtctgctgttggttcttatatttttgaagatggccgagtggtgactgttggcaacggcgaggtgggtgagcatattcaacgcatctacaaactgtataccgatatccaaaaaggtcatgttcaaggccctgagggatgggtcaaacgcgtcgagcgtgttgcgccttaa

SEQ ID NO: 7147 - protein, 363 aa, Shewanella oneidensis
MEIKYDLKPASERRTEQFKPEGNVGFGSLRTDHMFLMDYHDGEWRDPRIVPYGPFEMAPGAMALHYGQSIFEGAKAFMHEDGEIYTFRINKNAERMNRSADIVCIPNIDEQMQIDAINALIDVDRLWFPMQEGACLYIRPFIFATEDRLSVSPSSRYTFCVVLSPSGAYYAAGVNKGIRLLISKTYHRAVSGGTGASKAAGNYAASLRAGKAAAQFGASQVLYLDANNQQIEEAGAMNHFHILKDGTVIIPTFTDTILKSITSQSIMELSELLGCEVRQETVMLDKFIADIESGEIIEAGGFGTAAVVSAVGSYIFEDGRVVTVGNGEVGEHIQRIYKLYTDIQKGHVQGPEGWVKRVERVAP

SEQ ID NO: 7148 - DNA, 1095 bp, Oceanobacillus iheyensis
  CDS (1)..(1095)
atggaagaacaaacaattcgcgtacaacgaagtgaaacaaagaaagaaaaacctcagtctgatcagttgattttcggaagatcttttacggatcatatgtttgtcatggattactctgatcctttgggatggcataatgcgagtattgtaccatatcaaccattgtcgattgatccatcttcaatgattttccattatggtcaatctgtttttgaaggattaaaggcatttcgtactgagagcggagatattcaattattccgtgcggaaaaaaaccttgagcgtttaaatcgttcaaatgaccgtctatgtattccgcaaatcgatgaggagttcacactaaaagcaattaaacagttaatttccatcgaaaaagattgggtaccaagtgcagaaggaacatccctttatattcgtccttttattatttcaacagaggcttatattggggtcgcaccatcgatgaattataagttgatcgtcattttatctccagtaggtgcttactacaaagaaggaataaacccagtcaaaattgctgttgaagatcactatgtacgaacggtgaaaggtggtactggtgaagcaaaaactggtggaaactatgcatcaagtctaaaagcacaagaaattgtagcgaaacaaggatttgcacaagtgctttggttagatggtgtcgagaaaaagtatattgaagaagtcggcagtatgaatgtcttcttcaaaattaatggagaagttgttactcctcaattaaacggaagtattctttcaggagtaactcgtagctctgtcattgaattattaaaacattggggtgtacctgtatctgaaaagcgcatttccattcaggatttataccaagcttatttagatggtgagctagaagaagcttttggatccggtacagctgctgtaatttctccaattggtcaacttacttgggaaggcaaagatatgatcgtcaacaatggggaaactggtgaactctctaaacgcatatacgatacaattactggcattcaatatggtcatttagatgatccattccaatggattcaagggattgaagcaaagagtcccgtaaaacattga

SEQ ID NO: 7149 - protein, 364 aa, Oceanobacillus iheyensis
MEEQTIRVQRSETKKEKPQSDQLIFGRSFTDHMFVMDYSDPLGWHNASIVPYQPLSIDPSSMIFHYGQSVFEGLKAFRTESGDIQLFRAEKNLERLNRSNDRLCIPQIDEEFTLKAIKQLISIEKDWVPSAEGTSLYIRPFIISTEAYIGVAPSMNYKLIVILSPVGAYYKEGINPVKIAVEDHYVRTVKGGTGEAKTGGNYASSLKAQEIVAKQGFAQVLWLDGVEKKYIEEVGSMNVFFKINGEVVTPQLNGSILSGVTRSSVIELLKHWGVPVSEKRISIQDLYQAYLDGELEEAFGSGTAAVISPIGQLTWEGKDMIVNNGETGELSKRIYDTITGIQYGHLDDPFQWIQGIEAKSPVKH

SEQ ID NO: 7150 - DNA, 1236 bp, Corynebacterium efficiens
  CDS (1)..(1236)
atggcgcccccggatttctatgctcccagcctagccataatcccgttacctgagacgacaccgcctgtgaacccgcctgcattgagagaccatctgctgaagctagtcggcagccggtgtaacttaaacagcatgacgtctattgagttcactgtgacccgtaccgaaaacccgacgtcacccgatcgcctgaaggaaattcttaccgccccgaaattcggtaagttcttcaccgaccacatggtgaccatcgactggactgaggacggcggctggcacaacgcccaggtagttccctacgcccccatcccgatggatcccgcaaccacggtattccactacggacaggccatcttcgagggcatcaaggcctaccgccacgcagacggcaccatcaaaaccttccgcccggaggagaacgccctgcgtatgcagcgttccgccgctcgcatggccatgccggaactccccgtcgagacgttcatcaaatcccttgaactgctcgtcgacatcgaccaggactgggtcccggccgccggtggggaagcatccctctatctgcgtcccttcatgatctccaccgaggtgtccctgggtgtcagccccgcgaacgcctacaagttcatcgtcatcgcctccccggtggccgcgtacttctccggtggcatcaagccggtgtcggtctggctcagcgaggattatgtccgcgccgcccccggtggcaccggagccgcgaaattcgccggcaactacgccgcctccctcctcgcccaggcccaggcccaggagaaggggtgcgaccaggtggtctggctcgatgcgatcgaacaccgctacatcgaggagatgggcggcatgaacctcggtttcatctaccgcaacggtgacaacgtgaagttggtgaccccggaactgtccggatcgctgctgccgggcatcacccgtgattcactcctgcaggtcgcccgcgatctcggttatgaggttgaggaacgacgcatcagcaccaccgaatgggaggaggacgccacctccggtgccatggccgaggcattcgcctgcggcaccgcagccgtgatcaccccggtgggcaccgtcaagtccaaccacggcgaattcgtggtcaacaacaacgaggccggcgagatcaccatgaaactgcgtgaaaccctcaccggcatccagcagggcaaggtcgacgacacccacgactggttgtacacgctggtgaaatag

SEQ ID NO: 7151 - protein, 411 aa, Corynebacterium efficiens
MAPPDFYAPSLAIIPLPETTPPVNPPALRDHLLKLVGSRCNLNSMTSIEFTVTRTENPTSPDRLKEILTAPKFGKFFTDHMVTIDWTEDGGWHNAQVVPYAPIPMDPATTVFHYGQAIFEGIKAYRHADGTIKTFRPEENALRMQRSAARMAMPELPVETFIKSLELLVDIDQDWVPAAGGEASLYLRPFMISTEVSLGVSPANAYKFIVIASPVAAYFSGGIKPVSVWLSEDYVRAAPGGTGAAKFAGNYAASLLAQAQAQEKGCDQVVWLDAIEHRYIEEMGGMNLGFIYRNGDNVKLVTPELSGSLLPGITRDSLLQVARDLGYEVEERRISTTEWEEDATSGAMAEAFACGTAAVITPVGTVKSNHGEFVVNNNEAGEITMKLRETLTGIQQGKVDDTHDWLYTLVK

SEQ ID NO: 7152 - DNA, 1128 bp, Bifidobacterium longum
  CDS (1)..(1128)
atgactgaaaacacgcaccacgatccggcagcgctcgacaagctcgccgaaccgttcaccgtactgccgaacgacaaccccgcatccgatgagaagcgccagtccctcatcgacaagccggctttcggccaggtgttctccgacaacatgacccacatgacctggaccaagggcgaaggttggtccgaccgccgcgtcgaaccgtacgcaccgctcaagatggatccgggtgcttccgtgctgcactacgcacaggagtgcttcgagggcctcaaggcttaccgtcatgccgacggctccacctggctgttccgcccggatgcgaacgccgagcgtttccagaactccgccaagcgtctgtacctgcctgagctgccgattgacgacttcctcggttccgtggccgcgctggtcaagcgcgacgccaactgggtgccgtcccgccgcgagtacacgctgtacatgcgtccgttcatgttcgcttccgagccgttcctcggcgtgcgcgccccgcaggaagtcgactactgcgtgatcgcctccccgtccggcccgtacttcccgggcggcgtcaagccggtgagcatctgggttgaagacaagtggttccgcaccggccctggcggcactggtttcgccaagtgcggcggcaactacgccgcctccctgctcggcgagtacaagggggttgagaacggctgcgagcaggtgtgcttcgtggacgccgccaccaagacctacctcgaagagctcggtggcatgaacatgatggccgtgcacaaggatggccacgtggagaccccgtccctgaccggtaacattctgccgggtgtgacccgtcgctccctgattcagctgctgcaggacaagggccacgacgtagtcgagaccatgattgccctcgaccagctgctcgaggacatcaagtccggtgaggtcaccgaggtgttcgcttgcggcaccgcagccatcatcaccccgatcggtcgcttcaagtccgagaagttcgatgtcgccgtcgccgacggcggctccggcaagctcacctgcgaactgcgtgacgagctgctcggcatccagctcggcgaagtcgaggacccgcacaactggatgtggaaagtgtgctga

SEQ ID NO: 7153 - protein, 375 aa, Bifidobacterium longum
MTENTHHDPAALDKLAEPFTVLPNDNPASDEKRQSLIDKPAFGQVFSDNMTHMTWTKGEGWSDRRVEPYAPLKMDPGASVLHYAQECFEGLKAYRHADGSTWLFRPDANAERFQNSAKRLYLPELPIDDFLGSVAALVKRDANWVPSRREYTLYMRPFMFASEPFLGVRAPQEVDYCVIASPSGPYFPGGVKPVSIWVEDKWFRTGPGGTGFAKCGGNYAASLLGEYKGVENGCEQVCFVDAATKTYLEELGGMNMMAVHKDGHVETPSLTGNILPGVTRRSLIQLLQDKGHDVVETMIALDQLLEDIKSGEVTEVFACGTAAIITPIGRFKSEKFDVAVADGGSGKLTCELRDELLGIQLGEVEDPHNWMWKVC

SEQ ID NO: 7154 - DNA, 1248 bp, Oryza sativa
  CDS (1)..(1248)
atggctgctgctgctgctgctgcgtcgtccgcgaagcgcgcgctcctcccgtgggcacgcgacgcccaccacgcgctggccagggccctgcagggatgcggcggcggcggcggcctcggtctccgcggggcgctcccgacggccggaggcaggtggtctctgctccagtgccggtggaggtcgtcgctgccgcagctcgactccgccgacaggtccgatgaggaaagcggcggcgaaatcgactgggacaacctggggttcgggctgacgccgaccgactacatgtacgtcatgcggtgctcgctggaggacggcgtcttctcccgcggcgagctcagccgctacggcaacatcgagctcagcccctcctccggcgtcatcaactacggccaggggctcttcgagggtctgaaggcgtacagggcggcgaaccaacaggggtcgtacatgctgttccggccggaggagaacgcgcggcggatgcagcacggcgccgagcgcatgtgcatgccgtcgccgtcggtggagcagttcgtccacgccgtcaagcagaccgtcctcgccaaccgccgctgggtgccaccgcaaggaaagggggcgctgtacatcaggccgctgctcatcgggagcggaccgattctcgggctggctcccgccccggagtacacgttcctcatctacgccgcaccggttggaacgtacttcaaggagggtctagcgccgataaaccttgtcgtagaggactcgatacaccgggccatgccgggcggcaccggcggggtcaagacgatcaccaactacgcgccggtgctcaaggcgcagatggacgccaagagcagagggttcactgacgtgctgtacctcgacgcggtgcacaagacgtacctggaggaggcctcctcctgcaacctcttcatcgtcaaggacggcgtcgtcgccacgccggccaccgtgggaaccatcctgccggggatcacgcgcaagagcgtcatcgagctcgccagggaccgcggctatcaggttgaagaacggctcgtctccatcgacgatctggtcggcgcagacgaggtgttctgcaccggaacagcggtggtcgttgccccagtatcgagtgttacttaccatgggcaaaggtacgagttcaggactggacatgacacgttatcgcagacactgcacacgactctgacgtccatccagatgggcctggctgaggacaagaaaggatggacagtggcaatagattaa

SEQ ID NO: 7155 - protein, 415 aa, Oryza sativa
MAAAAAAASSAKRALLPWARDAHHALARALQGCGGGGGLGLRGALPTAGGRWSLLQCRWRSSLPQLDSADRSDEESGGEIDWDNLGFGLTPTDYMYVMRCSLEDGVFSRGELSRYGNIELSPSSGVINYGQGLFEGLKAYRAANQQGSYMLFRPEENARRMQHGAERMCMPSPSVEQFVHAVKQTVLANRRWVPPQGKGALYIRPLLIGSGPILGLAPAPEYTFLIYAAPVGTYFKEGLAPINLVVEDSIHRAMPGGTGGVKTITNYAPVLKAQMDAKSRGFTDVLYLDAVHKTYLEEASSCNLFIVKDGVVATPATVGTILPGITRKSVIELARDRGYQVEERLVSIDDLVGADEVFCTGTAVVVAPVSSVTYHGQRYEFRTGHDTLSQTLHTTLTSIQMGLAEDKKGWTVAID

SEQ ID NO: 7156 - DNA, 1472 bp, Oryza sativa
  CDS (60)..(1277)
attgccattgtcttcgccccccgccgccgcctgctcaaacccatcggagagcaaaccgaatggagctccacctcacctcccgcggcgccctcccgctgtctccgccgctcgccggccagcggcgtcctcacctctctctctccacgccgtcgcttccgatcaagaatcacacttattcagtgccacctcctttctccaaggctcactgcgcgataggatgccaagcttctctagcaactaactacatggaaacctctgcggtggctgatttggactgggagaacctcggttttggccttgtccagacagattttatgtatattgcaaaatgcgggccagatgggaacttttccaaaggagaaatggtaccatttggacctatagaactgagcccatctgctggagtcttaaattatggacagggcttgtttgagggcttaaaggcatatagaaaaacagatggatacattctgctgtttcgtccggaggagaatgccataaggatgagaaatggtgcagagaggatgtgtatgcctgcaccaactcttgaacaatttgtggatgcagtaaagcaaaccgttttggcaaataaaagatgggtgcccccaaccggtaaaggctccctgtatataaggccgctgcttatgggaagtggagctgtccttggtcttgcacctgctcctgagtatacctttatgatttttgtctcccctgttgggaactatttcaaggaaggtttagcccctattaacttgattatagaagaaaactttcaccgtgctgcccctggtggaactggcggagtgaaaaccattggaaactatgcctcggtattaaaagcacagaggattgcaaaacagaaaggatattcagatgtcctctatctagatgccgttcacaagaaatatctggaagaagtgtcttcgtgcaatatctttattgtgaaaggcaatgttatttctactccagcaataaaaggaaccatactgcctggtataacaaggaaaagtattcttgaagttgctcagagaaaaggcttcatggttgaggagcgccttgtgtcagtggatgagcttcttgaagctgatgaagttttctgcacgggaacagctgttgtggtgtcccctgtggggagcataacttatctggggcaaagggtggaatatggcaaccaaggagtgggcgtggtgtgtcagcagctgtatacttcacttacaagcctccagatgggtcatgtggacgattgtatgggctggactgtggaactaaaccagtgatcatgtacctcccttctcgctgtatacgttgggggtatttggcgcattgatccgataataatgcaaaataataaaaaatgttgttctttttatggtcagaacaaattccccatatactattagtcctgtgctcctgaagttctgatcacaagaacagtgtgctaatgtatcctgttatcacaaaatactagtatc

SEQ ID NO: 7157 - protein, 405 aa, Oryza sativa
MELHLTSRGALPLSPPLAGQRRPHLSLSTPSLPIKNHTYSVPPPFSKAHCAIGCQASLATNYMETSAVADLDWENLGFGLVQTDFMYIAKCGPDGNFSKGEMVPFGPIELSPSAGVLNYGQGLFEGLKAYRKTDGYILLFRPEENAIRMRNGAERMCMPAPTLEQFVDAVKQTVLANKRWVPPTGKGSLYIRPLLMGSGAVLGLAPAPEYTFMIFVSPVGNYFKEGLAPINLIIEENFHRAAPGGTGGVKTIGNYASVLKAQRIAKQKGYSDVLYLDAVHKKYLEEVSSCNIFIVKGNVISTPAIKGTILPGITRKSILEVAQRKGFMVEERLVSVDELLEADEVFCTGTAVVVSPVGSITYLGQRVEYGNQGVGVVCQQLYTSLTSLQMGHVDDCMGWTVELNQ

SEQ ID NO: 7158 - DNA, 912 bp, Chlorobium tepidum
  CDS (1)..(912)
atggataactcgcttaaaatatggatgaacggcgaactggtcggctggagtgacgccaaaatccacgtcatgtcccacgtcgtccactatggttcgtcaaccttcgagggcatccgctgttacgataccgtcaaaggctcggcgctgctcttcctcgacgaacatgtccgccgcctctgggaatcttcgaaaatctaccgcatagagattccctattcggaaaccgagatcaaggacgccattatctcgaccatcaaggccaacaaccacaaggcctgctacgtccgtccgctggttttccgtggtcagggcgcgcttggcgtcaatccgcaccgcgcctccatcgaggtcgccatcgcgacctgggagtggggcacctacctcggcgaggatgtgcttgaaaatggcgtggatgtcaaggtctcctcatggcaccgcctcgccccgaacaccctgccctcatgggccaaagcaggcggcaactacatgaactcgcagctcatcaaaatggaggcgctgtcggacggttacgccgaaggactggcgctcgaccacaacggctacgttgccgagggcagcggcgaaaacatctttgtcgtcaggaacaacatcatttacaccccgctggccgcgcagtcgatcctgccgggctttacccgtcacgctgtgatgcacatcgccagggagcttggctacgaggttcgcgaaacgcccattccgcgcgaggcgctttacatcgccgacgaaatcttcctgaccggcacggctgccgagatcaccccagtcagaagcgttgacagaatcccgattggcaacgaacaccgcggcccggtcaccgaagccttgcagcacgagtacctcaaaatcgtccattccggagaagacccatacaactggctgacctttatttga

SEQ ID NO: 7159 - protein, 303 aa, Chlorobium tepidum
MDNSLKIWMNGELVGWSDAKIHVMSHVVHYGSSTFEGIRCYDTVKGSALLFLDEHVRRLWESSKIYRIEIPYSETEIKDAIISTIKANNHKACYVRPLVFRGQGALGVNPHRASIEVAIATWEWGTYLGEDVLENGVDVKVSSWHRLAPNTLPSWAKAGGNYMNSQLIKMEALSDGYAEGLALDHNGYVAEGSGENIFVVRNNIIYTPLAAQSILPGFTRHAVMHIARELGYEVRETPIPREALYIADEIFLTGTAAEITPVRSVDRIPIGNEHRGPVTEALQHEYLKIVHSGEDPYNWLTFI

SEQ ID NO: 7160 - DNA, 960 bp, Rhizobium loti
  CDS (1)..(960)
atgacacttgccacgacagacgcgacggtgggagttccggaagtcgaaactacccataaggatacccggcgttatcctcacggtgtcgccttcatggacggacagtacctcccaatgtctgaagcgaagatctctgtccttgactggggtttcctgcactctgacgctacttacgataccgtgcacgtctgggaagggcgattcttcagactggaccttcatcttgatcgcttcttcagggggatggatcgtctccgaatgaagctgccctatcatcgccgagaggtcgaacgggttctttcaaactgcgtcgctctgtctggacataaatcagcctatgttgagatgatctgcacgcggggaggttcgccgacatttagccgcgatccgcgcgaggccgagaatcggttcattgcctttgctgtgccgtttggttcggttgccaacaaagaacagttggagcgtggtctccacgttggcgtaagcgaaactgtccgaattccgccgaagtcagtggatccgacgatcaagaattaccactggcttgacttggtcagaggtctttacgatgcttacgatgtgggggcggaaacggcgctcataatggacaccaacggcaatattgcggaaggtcccggctttaatgtcttcaccgttaagaaccgtcagctgaagacaccagcctttggggtgcttccaggaataacgcggcagtccgttttcgacctgtgtggggaagtgggacttgcggtgacggctgcagacctacctcgtcttgaactgggcgaagccgatgaggtgttcatcacctccaccgcaggggggatcatgcccgtgacgcgcgttgatggttcatccatcggcagcggtaaagttggcgtcgtgacccggcagctgatggacctctactggcaaaagcattccgatgatgcttggtctacccccgttaaatatgcgtaa

SEQ ID NO: 7161 - protein, 319 aa, Rhizobium loti
MTLATTDATVGVPEVETTHKDTRRYPHGVAFMDGQYLPMSEAKISVLDWGFLHSDATYDTVHVWEGRFFRLDLHLDRFFRGMDRLRMKLPYHRREVERVLSNCVALSGHKSAYVEMICTRGGSPTFSRDPREAENRFIAFAVPFGSVANKEQLERGLHVGVSETVRIPPKSVDPTIKNYHWLDLVRGLYDAYDVGAETALIMDTNGNIAEGPGFNVFTVKNRQLKTPAFGVLPGITRQSVFDLCGEVGLAVTAADLPRLELGEADEVFITSTAGGIMPVTRVDGSSIGSGKVGVVTRQLMDLYWQKHSDDAWSTPVKYA

SEQ ID NO: 7162 - DNA, 1023 bp, Streptococcus pyogenes
  CDS (1)..(1023)
atgacaatagcaattgattgggacaacctaggatttgaatatcataagttgccatttcgttacatttcttattacaaaaatggtcaatgggataaaggtcaattaacagaagatgccaccttacatatctcagaaagcgctccagcgcttcattatggacaacaagcttttgaaggtttaaaggcttatcgcaccaaagatggctctattcaactatttagaccagaccgtaatgcagcgcgtttacaagccacagcagaccgcttgttgatgccacaagtatcaacagagcaatttattgatgcagctaagcaagtggttaaagccaatgaagactttgtaccaccttacggaacaggtgcaacgctttacctgagaccgttattaattggagttggagatattattggggttaaaccagccgaagaatatattttcactatttttgccatgccagtaggaaactatttcaaaggtggacttgctccaactaattttattgtttctgaagcgtttgaccgcgccgctccttacggaacaggtgctgctaaggtgggaggaaactatgcaggaagtttgctaccaggtaaggccgctaaatcagcaggcttttctgatgtgatttacttagatccagcaacccatactaaaattgaagaagtcggagctgcaaacttttttggcattactgcaaataatgaatttgttacgccacttagtccatccatcttgccatctattacgaagtattcactcttacaactagctgaagaaagacttggtatgacagtaattgagggtgatgttccaattaatgaattggataaatttgtggaagcaggagcttgtggaacagcagctgttatctctccaattggcggtatccagtacaaggataacttacatgtcttttacagtgaaacagaagttggtcctgtgacacgccgtttatacgatgagttggtcggcattcaatttggggatattgaagcaccagaaggttggattgtaaaagtagattaa

SEQ ID NO: 7163 - protein, 340 aa, Streptococcus pyogenes
MTIAIDWDNLGFEYHKLPFRYISYYKNGQWDKGQLTEDATLHISESAPALHYGQQAFEGLKAYRTKDGSIQLFRPDRNAARLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEAGACGTAAVISPIGGIQYKDNLHVFYSETEVGPVTRRLYDELVGIQFGDIEAPEGWIVKVD

SEQ ID NO: 7164 - DNA, 1086 bp, Xanthomonas campestris
  CDS (1)..(1086)
atgtccgtgtccttcgcttccacccgctccccgtcgccgcgcagcgccgacgaactgtccgtgatcctggctgcgccggggttcggcctgcatttcaccgaccacatggtcgccatctcctggaccaacgagctcggttggcacgatgcgcaggtgcgtgcctacggcccgctgcagctggatccggccgcctcggtgctgcattacggccaggagatcttcgaaggtatcaaggcctaccggcatgccgacggctcgatctggaccttccgcccgcaggccaatggcgagcgcctgcagcgctccgcgcgccgcctggcgctgccggaactgccggtggacctgttcgtggagtcgctgcgccagttggtggccgtggatgccggctgggtgccgtcggcgccggaaaccagcctgtatttccgcccgttcatgatcgccgacgaggcgttcctgggcgtgcgcgcggcgcacaaggcctcgtactacgtgatcgccagcccggccggtccgtatttcgccaagggcgtggcgccggtgtcgatctggttgtccaccgagtacgcacgtgcagccaagggcggcaccggcgcggccaagtgcggcggcaactacgccgcttcgctgctgccgcagcagaaagcctacgcgcagggctgctcgcaggtgctgttcctggacccggtggaaggcaaatacattgaagaactgggcggcatgaacgtgttcctggtctacaaggacggcacgctggtgaccccagagctgtccggcagcatcctggaaggcatcacccgcgacagcatcctgcagctggcccgtgaccgcggcatgcaggtggtggagcgcaaggtgtccatcgacgagtggaaggacggcgtggcctccggcgagatcagcgaggtgttcgcctgcggcacggcggctgtggttaccccgatcggcgagctgaagggcgatggctttgcggtcggcgacctgtctgcaccggcgggcgaggtgacgatgtcgctgcgccaggagctgaccgacatccagtacgggcgcgtgccggaccgccacggttggctggtgcgtctgtcctaa

SEQ ID NO: 7165 - protein, 361 aa, Xanthomonas campestris
MSVSFASTRSPSPRSADELSVILAAPGFGLHFTDHMVAISWTNELGWHDAQVRAYGPLQLDPAASVLHYGQEIFEGIKAYRHADGSIWTFRPQANGERLQRSARRLALPELPVDLFVESLRQLVAVDAGWVPSAPETSLYFRPFMIADEAFLGVRAAHKASYYVIASPAGPYFAKGVAPVSIWLSTEYARAAKGGTGAAKCGGNYAASLLPQQKAYAQGCSQVLFLDPVEGKYIEELGGMNVFLVYKDGTLVTPELSGSILEGITRDSILQLARDRGMQVVERKVSIDEWKDGVASGEISEVFACGTAAVVTPIGELKGDGFAVGDLSAPAGEVTMSLRQELTDIQYGRVPDRHGWLVRLS

SEQ ID NO: 7166 - DNA, 1086 bp, Xanthomonas axonopodis
  CDS (1)..(1086)
atgtccgtgtccttcgcttccacccgttctccgtcgccgcgcagcgccgacgaattgtccgtgatcctggctgcgcccggtttcgggttgcatttcaccgaccacatggtcgccatctcctggaacaacgagcagggctggcacgacgcgcaagtgcgcgcgtacggcccgctgcagctggatccggcagcgtcggtgctgcattacgggcaggagatcttcgaaggcatcaaggcctaccggcacgccgacggctcgatctggaccttccgtccgcaagccaacggcgagcgcctgcagcggtcggcgcgccgtctggcgctgccggaattgccggtggacctgttcgtggaatcgctgcgccagctggtggccgtggatggcggctgggtgccgtcggcgccggagaccagcctgtatttccgcccgttcatgattgccgatgaggccttcctgggcgtgcgcgcggcgcacaaggcctcgtattacgtgatcgccagcccggccggcccgtacttcgccaagggcgtggcgccggtgtcgatctggctgtccaccgaatacgcacgtgcggccaagggcgggaccggcgcggccaaatgcggcggcaattacgccgcgtcgctgctgccgcagcagaaggcctatgcccagggctgctcgcaggtgttgttcctggacccggtggaaggcaagtacatcgaagaactcggcggcatgaacgtgttcctggtctacaaggacggcacgttggtgaccccggaactgtccggcagcatcctggaaggcatcacccgcgacagcatcctgcaactggcccgcgaccgtggcatgcaggtgatcgagcgcaaggtcgcgatcgacgaatggaagcagggcgtggcctccggcgagatcaccgaggtgttcgcctgcggtacggcggcggtggtgacccccatcggcgagctgaagggcgaggggttcgcggtgggcgatctgtccgcgccagcgggccaggtgaccatgtcgctgcgccaggaactgaccgatatccagtacggccgcgtgccggaccgccacgggtggttggtgcgtttgtcgtaa

SEQ ID NO: 7167 - protein, 361 aa, Xanthomonas axonopodis
MSVSFASTRSPSPRSADELSVILAAPGFGLHFTDHMVAISWNNEQGWHDAQVRAYGPLQLDPAASVLHYGQEIFEGIKAYRHADGSIWTFRPQANGERLQRSARRLALPELPVDLFVESLRQLVAVDGGWVPSAPETSLYFRPFMIADEAFLGVRAAHKASYYVIASPAGPYFAKGVAPVSIWLSTEYARAAKGGTGAAKCGGNYAASLLPQQKAYAQGCSQVLFLDPVEGKYIEELGGMNVFLVYKDGTLVTPELSGSILEGITRDSILQLARDRGMQVIERKVAIDEWKQGVASGEITEVFACGTAAVVTPIGELKGEGFAVGDLSAPAGQVTMSLRQELTDIQYGRVPDRHGWLVRLS

SEQ ID NO: 7168 - DNA, 885 bp, Methanosarcina mazei
  CDS (1)..(885)
atgcaaatgagtgagttacttatttatttagacgggaaatttgtcccgaaatccgaagccaaagtttcggtttatgatcacggttacctctatggggacggtgtgttcgaaggaataagggcatataacggacgtgttttcaagttaaaggaacatgttgacaggctttttgactcagcaaaagcaattgcaatggacatacccgttacaagagaagagatgaccgaaataatccttgagaccctgagaaaaaataacctcaaagacgcttacatccgccctatcgtctcaagaggagtcggagatctcgggcttgacccccgcaagtgtgaaaaaccgtgcgttgttgttatcgcccagggatggggtgccatgtacggcaacctttatgaaatcgggcttacaggagtcagcgtctgcgtccgcaggaatgcacctgatgccctgtcccctaacatcaagtccctgaactacctgaataatatccttgcaaagatagaagcaaatgagaaaggcggagatgaagccatattccttgaccagaacggctttgtgtgcgaaggttctggagacaacatctttatcgtcaaaaatgataaggtctttactccccacacaataagcaacttaaaaggcatcacaagagctacagccattgagcttctggatgaaatgggatacaaggttattgaagcaaacctcggcctttttgacctctacacggcagacgaaattttcgttaccgggactgcagccgaatctgctccggtcaccaggctcgacggaagaatcatcggtaatggcaaacccggtcctctcacaatgaagatggttgaagcctttgacaaaataacccgcagtacaggcacccctatttataaataa

SEQ ID NO: 7169 - protein, 294 aa, Methanosarcina mazei
MQMSELLIYLDGKFVPKSEAKVSVYDHGYLYGDGVFEGIRAYNGRVFKLKEHVDRLFDSAKAIAMDIPVTREEMTEIILETLRKNNLKDAYIRPIVSRGVGDLGLDPRKCEKPCVVVIAQGWGAMYGNLYEIGLTGVSVCVRRNAPDALSPNIKSLNYLNNILAKIEANEKGGDEAIFLDQNGFVCEGSGDNIFIVKNDKVFTPHTISNLKGITRATAIELLDEMGYKVIEANLGLFDLYTADEIFVTGTAAESAPVTRLDGRIIGNGKPGPLTMKMVEAFDKITRSTGTPIYK

SEQ ID NO: 7170 - DNA, 876 bp, Thermoanaerobacter tengcongensis
  CDS (1)..(876)
atgggattagtatatgtaaatggagagtttgtggacagcgaaaaagcttgtgtatcagtttttgaccatggctacctttatggggacggaatttttgaggggataagggtttacgacggagtcatatttaaattggatgagcatttaaagaggctttacagtatggcaaaagtgcttcttttggacattcctctttctatggaagagatgaaagaaaaagtcgtggaaacagtgagaattaataatttaagagatgcttacataaggttggttgtctcaagaggaaaaggggatttaggacttgacccttataaatgtcctaaacctacagtcgtgataattgcagataaaatcgccttgtatccagaatctatgtatgagacgggtcttaaaattataacatcttcctttagaagaaattcaatacagtcattggacccgcaaataaagtctttgaactatttaaacaacatcttagctaagattgaagcagtaaaagctggataccctgaggctttgattttaaatcaagagggttatgtggcagagtgcacaggcgacaatatttttataatctccaacggggttttgtattctccaccttcagccgttggggcattaggaggaattacgagagctacagtgattgacatagccagagagcttaacattcctttcgaagaaaaatacttttctctgtttaatgtgtacacagctgatgaatgcttccttacaggtacagcagcagaagcaattcctgtggtagaagtggaccacagagttataggagacggaaaaccaggacctataaccaagaaaataatagaggaatttagaaagcttacaaaagttttgggcacaaaggtgtatgaataa

SEQ ID NO: 7171 - protein, 291 aa, Thermoanaerobacter tengcongensis
MGLVYVNGEFVDSEKACVSVFDHGYLYGDGIFEGIRVYDGVIFKLDEHLKRLYSMAKVLLLDIPLSMEEMKEKVVETVRINNLRDAYIRLVVSRGKGDLGLDPYKCPKPTVVIIADKIALYPESMYETGLKIITSSFRRNSIQSLDPQIKSLNYLNNILAKIEAVKAGYPEALILNQEGYVAECTGDNIFIISNGVLYSPPSAVGALGGITRATVIDIARELNIPFEEKYFSLFNVYTADECFLTGTAAEAIPVVEVDHRVIGDGKPGPITKKIIEEFRKLTKVLGTKVYE

SEQ ID NO: 7172 - DNA, 885 bp, Methanosarcina acetivorans
  CDS (1)..(885)
atgcaaatgagtgatttactgatttatttaaacgggaaatttgtccccaaagacgaagccaaagtttcggtctatgaccacggcttcctttacggagacggtgtgttcgaaggcataagggcatacaacggacgtgtcttcaagttaaaggagcacgttgacaggctttatgactcggcaaaagcaatcgcaatggacatacccgtcacaagagaggaaatgaccgaaataatccttgaggccctcaggaaaaacaacctcaaagatgcttacatccgtcccatcgtctcaagaggaatcggcgacctcgggcttgacccccgtaagtgcgggaaaccaagtgtcatcgttattgcccagggctggggggccatgtacggagacctttacgaagtagggcttaccggagttagcgtctgtgtccggagaaatgccccggatgccctgtccccgaacatcaagtccctgaactatctcaacaacatcctcgcaaagatagaagccaacgagaagggaggagacgaagctattttccttgaccataacgggtttgtctgcgagggctcgggagacaacatcttcgtcgtcaaggacgacagggtcctgacccccttcacaataagcaacctgaaaggtataacaagggccacagccatcgaacttctggacgaaatgggatacaaggttatcgaatcaaacctcggcctgtttgacctttacacagcagatgagatctttgtcacaggaactgcagccgaatcggcccccgtgaccagacttgacggaagagtcataggtacaggcaaacccgggcctctcacaatgaaaatggttgaagcctttgcgaaaataacccagagcacgggaacacaaatttataaataa

SEQ ID NO: 7173 - protein, 294 aa, Methanosarcina acetivorans
MQMSDLLIYLNGKFVPKDEAKVSVYDHGFLYGDGVFEGIRAYNGRVFKLKEHVDRLYDSAKAIAMDIPVTREEMTEIILEALRKNNLKDAYIRPIVSRGIGDLGLDPRKCGKPSVIVIAQGWGAMYGDLYEVGLTGVSVCVRRNAPDALSPNIKSLNYLNNILAKIEANEKGGDEAIFLDHNGFVCEGSGDNIFVVKDDRVLTPFTISNLKGITRATAIELLDEMGYKVIESNLGLFDLYTADEIFVTGTAAESAPVTRLDGRVIGTGKPGPLTMKMVEAFAKITQSTGTQIYK

SEQ ID NO: 7174 - DNA, 888 bp, Methanopyrus kandleri
  CDS (1)..(888)
atgtctgagcgcgagcagctcatctacctgaacggcgaactggtcccccgggaagaggctaaaatctccgtctacgaccacgggttcctgtacggcgacggcgtcttcgaggggattcgggcctacgatggccggatattcaagttggacgagcacgtcgacagactgtacgactccgcaaaggccatcatgctcgagataccgatgaccaaggagaagatgaaggaggccatcatcgagaccgtacgggccaacgagctccgggacgcgtacatccgggtggtggtctcgcgcggcgaaggtgacctcgggttggacccggagaagtgtccggaacccaacgtggtgatcatcgcggagccgatggagccgttgtacggggacctgtacgagaaagggatcgaggtgatcacggcctccgtgcgtcgtattccaccggacgcgctcgatccgaagatcaagtcgtgcaactacctgaacaacatcctggcgaagatccaagccaacctggcgggcgccgacgaggccatcatgttggaccacgagggctacgtctgcgagggtaccggtgacaacgtgttcgtggtggaagacgggaccgtgtacactccaccggaggacactattctccgggggatcaccagggcgaccgtgatggagatctgcgaggagctcggtatacccgtggaagagaagcggataacactgggagaactgtacgcggcggacgaggtgttcctaacgggcacggcggcggaggtggcccccgttaggaaggtcgacgggcggaagatcggcgaggagtgcccaggacccatcacgaggcgtatcatggaggcgttccgggagctcacgaagaaggaaggtacgccggtgtacgaggagtga

SEQ ID NO: 7175 - protein, 295 aa, Methanopyrus kandleri
MSEREQLIYLNGELVPREEAKISVYDHGFLYGDGVFEGIRAYDGRIFKLDEHVDRLYDSAKAIMLEIPMTKEKMKEAIIETVRANELRDAYIRVVVSRGEGDLGLDPEKCPEPNVVIIAEPMEPLYGDLYEKGIEVITASVRRIPPDALDPKIKSCNYLNNILAKIQANLAGADEAIMLDHEGYVCEGTGDNVFVVEDGTVYTPPEDTILRGITRATVMEICEELGIPVEEKRITLGELYAADEVFLTGTAAEVAPVRKVDGRKIGEECPGPITRRIMEAFRELTKKEGTPVYEE

SEQ ID NO: 7176 - DNA, 1065 bp, Ralstonia solanacearum
  CDS (1)..(1065)
atgcaattctcgaacacgtcgactactcggccgacccccatagaacaacgcaaggaagcgctacgtgtccccaagcttggaaaggtgttcactgatcacatggtgaccatccagtggacgagcgaagacgggtggcacgatgccaggattcgtcctcgcgaacccttctccctcgaccctgcttccgcagtcctgcattacgctcaggaaattttcgagggcatgaaagcctatgcgcaaccggacggtggtgtggttttgttccgccccgtggacaacgcgcgccggttcaacgcgtcggcaacccgaatgacgatgccgactattccggaaactgtcttcgttgaggcaatcgagcaactgcttcgcgtagacggcgcgtgggttccgagtggcgaaggaacgagcttgtacctgcgccccttcatgtttgccagtgagtccttcctgggcgtgcgcccagctacccagttcacattttgcgtgatcgccagccctgcaggcgcctacttcaagggcggcgccgagccgatcactgtttggatctcggaacattactctcgcgcggcgaaaggcggcacgggcgcagccaaatgcggcgggaactacgccgggggattgatagcccaggcagaggcgacacgtaatggctgcgatcaggtcgcgtttctcgacgcagccgaaagccggtggatcgaggaactcggcggaatgaacgtcttctttgtcgtagacggcgtgttggttacacctccgctcggcacgattttgccaggtatcacacgagaatccatcatcagcatcgcggaaaagaagggcatcaaggtcgaggagcgtccttactccttcgatcaatggcgagaagatgctgcaactggccgactgaccgaagcattcgcctgtgggacagctgcggtgatcgcgtcgatcggcaaggtccgtttcaaggacggtgaattctcgatttcaggggggcaactgacagatgcactgcgagacgagttggtaggtattcagcgcggcgtcatcgcggacgatttcaactggacttggcgcgtgaaatga

SEQ ID NO: 7177 - protein, 354 aa, Ralstonia solanacearum
MQFSNTSTTRPTPIEQRKEALRVPKLGKVFTDHMVTIQWTSEDGWHDARIRPREPFSLDPASAVLHYAQEIFEGMKAYAQPDGGVVLFRPVDNARRFNASATRMTMPTIPETVFVEAIEQLLRVDGAWVPSGEGTSLYLRPFMFASESFLGVRPATQFTFCVIASPAGAYFKGGAEPITVWISEHYSRAAKGGTGAAKCGGNYAGGLIAQAEATRNGCDQVAFLDAAESRWIEELGGMNVFFVVDGVLVTPPLGTILPGITRESIISIAEKKGIKVEERPYSFDQWREDAATGRLTEAFACGTAAVIASIGKVRFKDGEFSISGGQLTDALRDELVGIQRGVIADDFNWTWRVK

SEQ ID NO: 7178 - DNA, 1026 bp, Clostridium perfringens
  CDS (1)..(1026)
atggataaaaagacagctattgattggaataatctaggcttctcttatatgaaaacagattatcgttacatatctcactataaagatggtaaatgggatgaaggaaaattagttacagacaacaaattaagcataagtgaagcttcaactgcccttcactatggccaacaatgttttgaaggtttaaaagcttatagaacaaaggatggaaagattcaactttttagagtagatgaaaatgctaagagaatgaataaatcatgtgataaacttttaatgcctgaaataccagttgaaaaattcatagatgcttgtatgcaagttgtcaaggctaatgaaagatttgtacctccatacggtactggtgcaactctttatataagacctttcatgataggtgttggtgataatataggtgttaaatctgctcctgaatttatattttcagtattctgccttccagttggtgcttattttaaaggtggaatgaagcctgtaaactttatgattgcagattatgatagagctgctcctaaaggaactggtgccgctaaagttggtggaaattacgcagcaagcttaaaggctcatgaaatagctgcaaaaaaaggatttgctgattgtatatatttagacccagcaactcacactaaaattgaggaagttggagctgcaaacttctttggaataacaaagaaaggtgagtttgttactccatattcagaatcaattttaccaagtataacaaaatactctttaatgcaaatagctaaagattatttaaaaatgcctgtatcagaaagagatgttttaatagataacttagatgaattcgctgaggctggcgcttgtggtacagccgctgtaataactccaataggaggaatagaatataagaataaacttcatgttttccatagcgaaactgaagttggtcctattactaaaaaactttatgatcttttatctggaatgcaatttggagatgtagaagctcctgaaggatggatatttgaagttaaataa

SEQ ID NO: 7179 - protein, 341 aa, Clostridium perfringens
MDKKTAIDWNNLGFSYMKTDYRYISHYKDGKWDEGKLVTDNKLSISEASTALHYGQQCFEGLKAYRTKDGKIQLFRVDENAKRMNKSCDKLLMPEIPVEKFIDACMQVVKANERFVPPYGTGATLYIRPFMIGVGDNIGVKSAPEFIFSVFCLPVGAYFKGGMKPVNFMIADYDRAAPKGTGAAKVGGNYAASLKAHEIAAKKGFADCIYLDPATHTKIEEVGAANFFGITKKGEFVTPYSESILPSITKYSLMQIAKDYLKMPVSERDVLIDNLDEFAEAGACGTAAVITPIGGIEYKNKLHVFHSETEVGPITKKLYDLLSGMQFGDVEAPEGWIFEVK

SEQ ID NO: 7180 - DNA, 930 bp, Ralstonia solanacearum
  CDS (1)..(930)
atgaccagcatggctgaccgcgacggcaagatctggaaagacggcaagctgatcgaatggcgcgacgcgcaactccacgtgctcacccacaccctgcactacggcatgggcgtgttcgagggcgtgcgcgcgtaccagacgccggccggccccgccatcttccgcctgtccgagcacacgcgccggctgttcaattcggccaagatcttccagatgcagattccgttctcggaacagcagctgatggacgcgcagcgcgaagtcgtgcgtgccaacgcgctggcgtcctgctacatccgcccgctggcgtggctcggctccgagaagatgggcgtgtccgcccgcggcaacaccgtccacgtggcgatcgccgcctggccttggggcgcctacctgggcgaagaaggcatgcagcgcggcatccgcgtcaagacgtcgtccttcacgcgccaccatgtgaacgtgtcgctggtgcgcgccaaggccagcggctactacatcaactcgatcctcgccaaccaggaagccaccggcctgggctacgatgaagccctgctgctcgacaccgagggctatgtgagcgaaggctcgggcgagaacgtcttcatcgtccgcaacggcgtgatctacacgcccgacctggcctcgtgcctggacggcatcacccgcgacgcaatcatcaccatcgcgggcgacctcggcatcgaggtgcgcgagaagcgcatcacccgcgacgagatgtactgcgcggacgaagccttcttcaccggcaccgcggcggaagtcaccccgatccgcgaactggatgaccgcgtgatcggcgcgggctcgcgcggcccgatcaccacgcagctgcagtcgacgttcttcgacatcgtcaacggcaagagcaccatcgaaaagtacaaggcgtggctgaccctggcctga

SEQ ID NO: 7181 - protein, 309 aa, Ralstonia solanacearum
MTSMADRDGKIWKDGKLIEWRDAQLHVLTHTLHYGMGVFEGVRAYQTPAGPAIFRLSEHTRRLFNSAKIFQMQIPFSEQQLMDAQREVVRANALASCYIRPLAWLGSEKMGVSARGNTVHVAIAAWPWGAYLGEEGMQRGIRVKTSSFTRHHVNVSLVRAKASGYYINSILANQEATGLGYDEALLLDTEGYVSEGSGENVFIVRNGVIYTPDLASCLDGITRDAIITIAGDLGIEVREKRITRDEMYCADEAFFTGTAAEVTPIRELDDRVIGAGSRGPITTQLQSTFFDIVNGKSTIEKYKAWLTLA

SEQ ID NO: 7182 - DNA, 912 bp, Pyrobaculum aerophilum
  CDS (1)..(912)
atgaagccgtacgctaaatatatctggcttgacggcagaatacttaagtgggaagacgcgaaaatacacgtgttgactcacgcgcttcactacggaacctctatattcgagggaataagagggtattggaacggcgataatttgctcgtctttaggttagaagaacacatcgaccgcatgtacagatcggctaagatactaggcataaatattccgtatacaagagaggaagtccgccaagctgtactagagaccataaaggctaataacttccgagaggatgtctacataagacctgtggcgtttgtcgcctcgcagacggtgacgcttgacataagaaatttggaagtctccctcgcggttattgtattcccatttggcaaatacctctcgcccaacggcattaaggcaacgattgtaagctggcgtagagtacataatacaatgctccctgtgatggcaaaaatcggcggtatatatgtaaactctgtacttgcgcttgtagaggctagaagcaggggatttgacgaggctttattaatggacgttaacggttatgttgttgagggttctggagagaatattttcattgtcagaggtggaaggcttttcacgccgccagtacacgaatctatcctcgagggaattacgagggatacggtaataaagctcagcggggatgtgggacttcgggtggaggaaaagcctattacgagggaggaggtgtatacagccgacgaggtgtttttagtaggaaccgccgcagagataacgccagtggtggaggttgacggcagaacaatcggcacaggcaagccgggccccattacgacaaaaatagctgagctgtactcaaacgtcgtgagaggcaaagtagagaaatacttaaattggatcactcctgtgtattag

SEQ ID NO: 7183 - protein, 303 aa, Pyrobaculum aerophilum
MKPYAKYIWLDGRILKWEDAKIHVLTHALHYGTSIFEGIRGYWNGDNLLVFRLEEHIDRMYRSAKILGINIPYTREEVRQAVLETIKANNFREDVYIRPVAFVASQTVTLDIRNLEVSLAVIVFPFGKYLSPNGIKATIVSWRRVHNTMLPVMAKIGGIYVNSVLALVEARSRGFDEALLMDVNGYVVEGSGENIFIVRGGRLFTPPVHESILEGITRDTVIKLSGDVGLRVEEKPITREEVYTADEVFLVGTAAEITPVVEVDGRTIGTGKPGPITTKIAELYSNVVRGKVEKYLNWITPVY

SEQ ID NO: 7184 - DNA, 864 bp, Rhizobium meliloti
  CDS (1)..(864)
atgccgagaatcgcctatgtcaacggcacttacgtccggcacgccgaagccgccattcacgtcgaggaccggggttaccagtttgccgacggcgtctacgaggtctgcgaggtgcggcacggcttcatcatcgacctgacccgacacctcgatcgcctagggcgatccctgggcgagctcaggataggctggccgatgagtcgtgcggcgctgatccatgtcatccgggaggtgctgcgccgaaacagggtccgcaacgggctcttctatctgcaggtgacccgcggcgtcgcgcggcgggatcatgttttccctgatgcggacacgccgccttcgatcgtcgtcaccgccaaacgcacggatcccggggcgatcgcccggaagaatgccgagggcatatcggcgataacggtgccggagaaccggtgggatcgcgtcgatatcaagagcgtcggccttctcccgaatgtgcttgcccgtcagcaggcgaaggaagcgggcgcgcaggaggcgatcttcgtcgacgtggacggcatggtcaaagagggggcggcgacgaatgtatggatcgtggaccgcgaagggacgttacgcacccgcccggcggaaagtggcattctgcgcggcgtgacccgcaccaccctgatggacgtggccaagccgctgggccttgcgatcgaggaaacggccttctccgtggaagaaatgctcgcagcgcgggaggtcttcatcaccgctgctaccagcatctgctttcccgtcgtttccgtcgacggaaagacgatcggcaacggtcatccaggaagcatagcacagaatattcgcgagacctttttcgacattgcggaaaagacggtgatttga

SEQ ID NO: 7185 - protein, 287 aa, Rhizobium meliloti
MPRIAYVNGTYVRHAEAAIHVEDRGYQFADGVYEVCEVRHGFIIDLTRHLDRLGRSLGELRIGWPMSRAALIHVIREVLRRNRVRNGLFYLQVTRGVARRDHVFPDADTPPSIVVTAKRTDPGAIARKNAEGISAITVPENRWDRVDIKSVGLLPNVLARQQAKEAGAQEAIFVDVDGMVKEGAATNVWIVDREGTLRTRPAESGILRGVTRTTLMDVAKPLGLAIEETAFSVEEMLAAREVFITAATSICFPVVSVDGKTIGNGHPGSIAQNIRETFFDIAEKTVI

SEQ ID NO: 7186 - DNA, 936 bp, Rhizobium meliloti
  CDS (1)..(936)
atgctgctttttccggatagagcggaagtgcgtgaagaaaagaaggaggcaccgatggccgtcgatacatccccacgatccaccacctggacctttgtcgacggcgagtggcttgccggcaacccgccgctgatcggcccgacatcccatgcgatgtggctcggttcgaccgtattcgacggtgcccgctggttcgacggcatcgcgccggatctcgacctccattgccagcgcgtcaaccgctccgccgaggctctgggtctcaagccgacgatgtcggccgaggagatcgagggattggcctgggaaggcgtgaagaagttcgacggcaagacggcgatctatgtgaagcccatgtattggggcgagcacggatcctggagcgtcgttgcggtggatcctgaatcgacacgcttcgcgctttgccttttcgaggcgccgatgggcaacggccatgccggctcgtcgctgacgctctctcccttccgccgaccgacgctggaatgcatgccgaccgatgccaaggccggctgcctctatcccaacaacgcccgcatcctcaacgaggcacgttcgcgcggtttcgacaatgcactggtgcgcgacatgctcggcaacatcgcggagaccggctcctcgaatatcttcatggtgaaggacggcgtcgtcttcacgccggccgccaacaggaccttcctcgccggcatcacccgctcgcgcgtgatggggcttctcagcgaggcaggcttcgaagtgatcgaaaccagcttgaccatggccgatttcgagggggccgacgaaatcttcacctcgggtaattattccaaggtgctgcccgtcacccgcctcgagcagcgcgaattgcaggccggtccggtcacggcgaaggcgcgcgatctctatatggactgggcgcacgcgaccgaaagggagtga

SEQ ID NO: 7187 - protein, 311 aa, Rhizobium meliloti
MLLFPDRAEVREEKKEAPMAVDTSPRSTTWTFVDGEWLAGNPPLIGPTSHAMWLGSTVFDGARWFDGIAPDLDLHCQRVNRSAEALGLKPTMSAEEIEGLAWEGVKKFDGKTAIYVKPMYWGEHGSWSVVAVDPESTRFALCLFEAPMGNGHAGSSLTLSPFRRPTLECMPTDAKAGCLYPNNARILNEARSRGFDNALVRDMLGNIAETGSSNIFMVKDGVVFTPAANRTFLAGITRSRVMGLLSEAGFEVIETSLTMADFEGADEIFTSGNYSKVLPVTRLEQRELQAGPVTAKARDLYMDWAHATERE

SEQ ID NO: 7188 - DNA, 1098 bp, Rhizobium meliloti
  CDS (1)..(1098)
atgaccggtagcggtgagcagactttcctgttcgagcagaacccgaccagagtggcgaacagcgagcgcgatgcgctgcttgcgaatccgggcttcgggcgcgtgttcaccgatcacatggcgacgatccgctattccgaggggcgcggctggcacgatgcgaagatcggcccgcggaaggcgttcgatctcgatccgtcgacactggtgctgcactacgcccaggagatcttcgagggtatgaaggcctatcgcctgcccgacggcggcgccacgctgtttcgccccgatgccaatgcgcgccgtttccgcaactccgcccttcggctcgcaatggcgccgctgccggaggagctgttcgtccaatccgtgcgcgaactggttcgtatcgaccgcgactggatacccgccggcgaaggagccgcgctctatcttcggccgttcatgatcgccacggaagtgctcctcggcgtgaagccttcggctgaatatctctactgcgtcattgcttcctcggtcggttcctacttcaagggcggcgccccggccattaccatatgggtttcggagaattacacccgggcagcgcccggcggcaccggcgaggccaaatgcggcggcaactacgccgcgagcctcgcggcgcaggcggaggcgatgcaggagggctgcgagcaggtggtgttcctcgacgcggtggaacgccgcttcgtcgaagagctcggcggcatgaacgttttcttcggtttccgcgacggctcgctgcagacgccgccgctgacgggcacgatcctgccgggcatcacgcgcgattcgctgatcacgcttgcccgcgatatggggctaacggtgcgcgaagagccctatgccatcgaccagtggcaggcggatgcggaaagcggccgcctcaccgaggccttcgcctgcgggacggctgcggtcgtaacgccgatcggcaaggtcaagggccgcgaacacagcttcaccattggcgacggcggagccggtccggtagccagccgcctgaagtcagccttgctcgacatccagaacggccgcgcgccggacccgcatggctggctcgaccggctgttctga

SEQ ID NO: 7189 - protein, 365 aa, Rhizobium meliloti
MTGSGEQTFLFEQNPTRVANSERDALLANPGFGRVFTDHMATIRYSEGRGWHDAKIGPRKAFDLDPSTLVLHYAQEIFEGMKAYRLPDGGATLFRPDANARRFRNSALRLAMAPLPEELFVQSVRELVRIDRDWIPAGEGAALYLRPFMIATEVLLGVKPSAEYLYCVIASSVGSYFKGGAPAITIWVSENYTRAAPGGTGEAKCGGNYAASLAAQAEAMQEGCEQVVFLDAVERRFVEELGGMNVFFGFRDGSLQTPPLTGTILPGITRDSLITLARDMGLTVREEPYAIDQWQADAESGRLTEAFACGTAAVVTPIGKVKGREHSFTIGDGGAGPVASRLKSALLDIQNGRAPDPHGWLDRLF

SEQ ID NO: 7190 - DNA, 870 bp, Brucella suis
  CDS (1)..(870)
atgaccatgattacgaattcgagctcggtacccaacggcgaatacgtcgccgcccgcgatgcccgcatctccattttcgaccgtggctttctcttcggcgacggcatttacgaagtaactgccgttctggaaggcaagcttgtcgatagcgaaccgcatatgcaacgcctgcgccgctcgaccggcgaaatcggcattgcgatgccgatgagcgaagacgagatcgtcaccatcgaacgcgagctgatccgccgcaacaagctgaccgaaggtctggtctatctacaggtgacacgcggcaatggaggcgaccgcgattttgtgccagccgcaaacatgaagccttcggtggttctcttcacgcaggaagccaacctgctcgacaagccagcactcaagaccggcgcgcatgtgctttcactggacgatctgcgctggaagcgccgtgacatcaagacagtctgcctgctgccgcaggcgctcaccaaggaaattgccaagaatgccggttgcgacgaggcatggatgatcgaagacggttatgtgaccgaaggcgcatcttccacggcctatatcgtaaccagggacgatgttatcgtcacccggcccaacagcaatttcaccctgcccggttgcacgcggctttcgcttttgcaactgattacagagaccggcatgaagctggaagaacgcctcttcaccatcgatgaggcctatgcggcaaaagaagcctttcttacaagtgcgggaactttcgtcacgccgatcaccgttattgatggaaaaaccatcggcgacggaaagcccggcccgattgcccggcgcctgcgcgaagtctatctcgaccacgcccgccgcacggcaatctga

SEQ ID NO: 7191 - protein, 289 aa, Brucella suis
MTMITNSSSVPNGEYVAARDARISIFDRGFLFGDGIYEVTAVLEGKLVDSEPHMQRLRRSTGEIGIAMPMSEDEIVTIERELIRRNKLTEGLVYLQVTRGNGGDRDFVPAANMKPSVVLFTQEANLLDKPALKTGAHVLSLDDLRWKRRDIKTVCLLPQALTKEIAKNAGCDEAWMIEDGYVTEGASSTAYIVTRDDVIVTRPNSNFTLPGCTRLSLLQLITETGMKLEERLFTIDEAYAAKEAFLTSAGTFVTPITVIDGKTIGDGKPGPIARRLREVYLDHARRTAI

SEQ ID NO: 7192 - DNA, 912 bp, Streptomyces avermitilis
  CDS (1)..(912)
atggacggactgtggcaggagcgggacctgccgttcgggagcaacagtgtccaacatggcacggccgtcttcgaaggcatccgcatgtacacgacgccggcaggcccggtgttgttccggctcgacgcgcatctggagcggctgctggactcggcggccctgctgggcatcccgcatgcctacgacctggccgccctgcgccggcacgtgcgggacgcggccgccggaagcggactggacaacgcctacgtgcggcccgtgctttacacccgagagccgcgcctcggcgtgaatctccgggacttccacttcactctcggcacggagatctgggcccttccccccgacgacaccccgtcccgacccgtacgggtcacggtgtcgccctggcgccgtccgtcacagctcacctttccggtgcgcgccaaggcgaccggcacgtatgtggtgtccgcgctggcccgcacacgcgccgccgcggacggattcgacgacgccatccagttggacccgaactccggcagggtcgcggagtccacgatcgccaacgtcttcctggttcgcgacggccgcctggtgacgccctggctcgaggacagcgtcctggcgggcatcacccgcgacaccgtcctgaccctcgccggagacctgggcatcgagaccgccgaggcacccgtgcagcccggtgaactgctcgccgccgacgaggtgttcctgaccgggacggcgagcggcctggtgtccgtggcgggtctcgacacccacacgtacgcggccggccgtcccgtgacggacgcgctgagccgcgcctatcgggaggccgtcctgggcgacggaccgcaccgtccctcctggctcacccccgtctctcgccccaccccatccacttcgcgcctccgaggagtatcgtga

SEQ ID NO: 7193 - protein, 303 aa, Streptomyces avermitilis
MDGLWQERDLPFGSNSVQHGTAVFEGIRMYTTPAGPVLFRLDAHLERLLDSAALLGIPHAYDLAALRRHVRDAAAGSGLDNAYVRPVLYTREPRLGVNLRDFHFTLGTEIWALPPDDTPSRPVRVTVSPWRRPSQLTFPVRAKATGTYVVSALARTRAAADGFDDAIQLDPNSGRVAESTIANVFLVRDGRLVTPWLEDSVLAGITRDTVLTLAGDLGIETAEAPVQPGELLAADEVFLTGTASGLVSVAGLDTHTYAAGRPVTDALSRAYREAVLGDGPHRPSWLTPVSRPTPSTSRLRGVS

SEQ ID NO: 7194 - DNA, 1398 bp, Capsicum annuum
  CDS (85)..(1242)
ttactcacaatttttctctttgcctctacctaatctgttgcttgcaaagatctaacactaaggtttatatttcttttggcaaagatgattcgaggggctgcatgttttcgaaagttgtttcaatcttctgctctatcatcaaagtttacaacaaggtactatacggctcaggcagcagtacagcctgctatttacagtagtgatgaggagtctggaagtattgactgggacaatcttggattcaagttaatgcaaactgattatatgtatgtgacaaaaacctctgatgatggaatttttagacaaggccaacttgatcgttatggcaatattcaattgagcccatctgctggtgtactgaactatggacaggggttattcgaaggtacaaaagcgtttagaagagaggatggacgactatttctatttcgccctgaacagaacgcgatcagaatgcaaattggtgcagagagaatgtgtatgccagctccttcgactgatcaatttgtcgacgcccttaaacaaacagccctttctaacaagcgctggattcctcctcctggaaaaggatcactttacattaggcctcttttaataggcactggccccattttgggtttggccccagcacctgagtacacattccttgtctatgcctgccctgtgggtaattatttcaaggaaggaacagcaccattgaacttgtacgttgaagaagacgttcatcgtgcctcacgtggtggagctggcggagtcaaaagcattactaactatgctccggttttaaaagcgatgaagaaagcaaaggcgaacggatattcagatgtactgtatgttgatgcagtaaataagaaatatattgaagaagtttcttcttgcaacattttcgttgtcaaaggaaatgtagtttcaactccaatagccaaaggaactattcttgaaggagtaacaagaaaaagcatcatggacattgcacttgatcttggatatacggttgaagaacgtttaattgaagctgatgaattaattagtgctgatgaagtattctgtacgggaactgcagttggtgttgctcctgttggaagtatcacttacaaaggccaaaggattgagtataaaataagctcagatctatcttgtaagaaattttattcaagattagtagggattcaaaaaggtgtgatcaaagatgaaaggaactggatcgtggagattgaatcatcttatttggttcaagattagtagagattcaaaaaggtgttatcaaggatgaaaggaactggatcatggagattgaatcgtcttaaagttattttacaaatctttttgccattatattaattcatgtgctagcaggctgtatattatatgataatatacaatatataatttttttta

SEQ ID NO: 7195 - protein, 385 aa, Capsicum annuum
MIRGAACFRKLFQSSALSSKFTTRYYTAQAAVQPAIYSSDEESGSIDWDNLGFKLMQTDYMYVTKTSDDGIFRQGQLDRYGNIQLSPSAGVLNYGQGLFEGTKAFRREDGRLFLFRPEQNAIRMQIGAERMCMPAPSTDQFVDALKQTALSNKRWIPPPGKGSLYIRPLLIGTGPILGLAPAPEYTFLVYACPVGNYFKEGTAPLNLYVEEDVHRASRGGAGGVKSITNYAPVLKAMKKAKANGYSDVLYVDAVNKKYIEEVSSCNIFVVKGNVVSTPIAKGTILEGVTRKSIMDIALDLGYTVEERLIEADELISADEVFCTGTAVGVAPVGSITYKGQRIEYKISSDLSCKKFYSRLVGIQKGVIKDERNWIVEIESSYLVQD

SEQ ID NO: 7196 - DNA, 1449 bp, Oryza sativa
  CDS (1)..(1146)
atggagtacggtgcagcaacgcgtggcgcgctcctcgcggccaccctgctcgccggcgcccggcgtagccggttgcccctctcaccgccgccgtcgccgccctctattcagattcagaatcgactttattcgatgtcgtcgcttccactaaaggctcgaggcgtgagaagatgcgaggcttctctagcaagtgactacacgaaggcatctgaggtagctgattttgattgggagaaccttggttttggaatcgtgcagaccgactacatgtatatcacaaaatgcggacaggacgggaatttttctgagggtgaaatgattccatttggacctatagcgctgaacccatcttctggagaaaatgcactgagaatgagaacaggtgcagaaagaatgtgcatgcctgcgcctagtgttgagcagtttgtggatgcagtaaagcagactgttttagcaaacaagagatgggtgcctcctaccggtaaaggttctttatatattagaccgctacttatgggtagtggtgctgttcttggtcttgcacctgctcctgagtatacgttcattatatttgtctcccctgtggggaactactttaaggaaggtttagctccaataaatttgatagttgaagataagtttcatcgtgcaacccctggtggaactggaagtgtgaagaccataggaaattatgcctcggtcttgatggcacaaaagattgcaaaagaaaagggctattctgatgttctctacttggatgctgttcacaaaaagtatcttgaagaagtttcttcatgtaatatttttgttgtcaagggcaatgtcatttcaactccagcagtaaaaggaacaatattgccaggcatcacaaggaaaagtatcattgatgttgctctgagcaagggtttccaggtcgaggagcgacttgtgtcagtagacgagctgcttgaagctgatgaggttttctgcacaggaactgctgtcgtagtgtctcctgtgggtagtattacctatcaagggaaaagggtcgaatatgctggcaacaaaggagttggtgtcgtgtctcagcagctatatacttcattgacaagcctgcagatgggccaggcagaagattggctaggctggactgtgcaactgagttaggaagtaataaaatgttcatcaacatcaaaactcaaaagatggacatgattatgatcatgtgtacccttcagttttgtagtttttgttggtgtgacatcctgctgtatatgtatagacggcagtgcattatagcgcgaagcagttttgctaaggaacgacaccatgcatccagctttatgccttttgcatgagaaatcaaacgtggaaggctctcctgactgaaatatcgacaactataaaactattttgctatgttgattacaatatcctagataatctaaattaacttcttttttgggctcc

SEQ ID NO: 7197 - protein, 381 aa, Oryza sativa
MEYGAATRGALLAATLLAGARRSRLPLSPPPSPPSIQIQNRLYSMSSLPLKARGVRRCEASLASDYTKASEVADFDWENLGFGIVQTDYMYITKCGQDGNFSEGEMIPFGPIALNPSSGENALRMRTGAERMCMPAPSVEQFVDAVKQTVLANKRWVPPTGKGSLYIRPLLMGSGAVLGLAPAPEYTFIIFVSPVGNYFKEGLAPINLIVEDKFHRATPGGTGSVKTIGNYASVLMAQKIAKEKGYSDVLYLDAVHKKYLEEVSSCNIFVVKGNVISTPAVKGTILPGITRKSIIDVALSKGFQVEERLVSVDELLEADEVFCTGTAVVVSPVGSITYQGKRVEYAGNKGVGVVSQQLYTSLTSLQMGQAEDWLGWTVQLS

SEQ ID NO: 7198 - DNA, 876 bp, Rhizobium loti
  CDS (1)..(876)
atggcgttcatggatggtcagtacctgccgatgtccgaagccaaggtgtcggttctggactggggctttctgcattccgatgccacctacgataccgttcatgtgtgggacgggaggttctttaggctgaatctgcacgtggaccggttcttccgcgggatggaaaagctccgcatgaagcttccctacaaccgcagtgagatcgaaaagatcctgtcgacctgtgtagcgctctccggacacaagtcggcctatgtcgaaatgatctgtacgcgaggtggctcgcccacctttagccgggacccgcgccagtcggagaaccggttcatcgcattcgcggtgcctttcgggtcggttgccaacaaggagcagctcgagcgcggcctgcatgtcgccatcagcaacactgtccggatcccgcccaagtcgatcgatccgaccatcaagaactatcactggctcgatctggtgaagggcctgttcgatgcgtacgactatggtgccgaaactgcattgatcgtcgacatcaacgacaacattgccgaagggcctggctttaacgttttcaccgtcaaagacggccgcttgaagacgccggcttatggtgtccttgccggcattaccaggcagaccgtatttgatctgtgcgacgaactgggcctatccgtcagcgccggcgacattgatcgcaacgaactgaagggcgccgatgaggttttcatcacgtctacagcaggcgggatcatgccggtgtccaagattgacgaaaccgttgtaggcgacggcaaggttggcgctctaacacgccagctggcagacctgtattgggagaagcatgctgatcccgcatggtcgacagcggtaaattacgcatag

SEQ ID NO: 7199 - protein, 291 aa, Rhizobium loti
MAFMDGQYLPMSEAKVSVLDWGFLHSDATYDTVHVWDGRFFRLNLHVDRFFRGMEKLRMKLPYNRSEIEKILSTCVALSGHKSAYVEMICTRGGSPTFSRDPRQSENRFIAFAVPFGSVANKEQLERGLHVAISNTVRIPPKSIDPTIKNYHWLDLVKGLFDAYDYGAETALIVDINDNIAEGPGFNVFTVKDGRLKTPAYGVLAGITRQTVFDLCDELGLSVSAGDIDRNELKGADEVFITSTAGGIMPVSKIDETVVGDGKVGALTRQLADLYWEKHADPAWSTAVNYA

SEQ ID NO: 7200 - DNA, 879 bp, Rhizobium loti
  CDS (1)..(879)
atgacactggcggcagcggcgcaatccgcgacttggactttcgtcgatggcgactggtacgaaggcaatgtcgccattctgggtccgcgcagccatgccatgtggctcggtaccagcgtgttcgacggggcgcgctggttcgagggcgtggcgcccgacctcgacctgcatgccaggcgtgtgaacgcctcggcgatcgcgctcggcctcaagccgaacatgtctcccgaacagatcgtcgggctgacctgggacggattgaagaaatttgacggcaagacggcggtctatatcaggccgatgtactgggccgagcatggtggctacatgggcgtgcccgccgatcccgcttcgacccgtttttgcctttgcctctatgaatcgccgatgatctcgccgaccgggttttcggtgacgatgtcgccgttccggcgcccgacgatcgagaccatgccgaccaacgccaaggctgggtgcctctatcccaacaatggccgcgccatcctcgaagccaagatgcgcggcttcgacaatgctttggttttggacatgctgggtaatgtcgccgagaccggaagctccaacatcttcctggtcaaggatggccacgtgctgaccccggcgccgaacggcaccttcctgtccgggatcacacgctcgcgcacgatgacgttgctgggcgagtacggattcaagacgacggaaaagacgctgtcggtgcgcgatttcctcgaagcggacgaaatattctcgaccggcaaccattccaaggtggtgccgatcacccgcatcgaggatcgcaatctgcaacccggcccggtggccaaaaaggcgcgcgagctttattgggattgggcgcattcggcgtcggccggctga

SEQ ID NO: 7201 - protein, 292 aa, Rhizobium loti
MTLAAAAQSATWTFVDGDWYEGNVAILGPRSHAMWLGTSVFDGARWFEGVAPDLDLHARRVNASAIALGLKPNMSPEQIVGLTWDGLKKFDGKTAVYIRPMYWAEHGGYMGVPADPASTRFCLCLYESPMISPTGFSVTMSPFRRPTIETMPTNAKAGCLYPNNGRAILEAKMRGFDNALVLDMLGNVAETGSSNIFLVKDGHVLTPAPNGTFLSGITRSRTMTLLGEYGFKTTEKTLSVRDFLEADEIFSTGNHSKVVPITRIEDRNLQPGPVAKKARELYWDWAHSASAG

SEQ ID NO: 7202 - DNA, 894 bp, Rhizobium loti
  CDS (1)..(894)
atggcatccgttcccttcgatcaactggacggcttcatctggatgaatggcgaattcgttgcgtggggcgacgccaagatccatgttctgacgcacggtctgcactacgccagcgcggtcttcgagggcgagcgcgcctatggcggcgagatcttcaagctcaacgagcataccgagcgcctgcatgaatcggcgcgcctgctcggcttcaagattccctattcggttgccgagctcaacgacgcctcgaccacgctgttgaagaagcaagggttccaggacgcctatgtcaggccgatcgcctggcgcggcagcgagcagatgggcgtttcggcgcagaacaaccgtatcaacgtcgccatcgccatctggcagtggccgagctatttcgatccggcgcagaagctgaagggcatccgcctcgatgtcgcggaatggcgccggcccgacccgcgcacggcgccgtcgaaatcgaaggccgccggcctctacatgatctgcaccatgtcaaagcacgccgccgaagcaaaaggctacgccgacgccatgatgctcgactggcgcggccaggtcgccgaagcaaccggcgccaacatcttcttcgtcaaggacggcaagatccatacgcccaagcccgattgcttcctcgacggcatcacccgccgcacggtcatcgggctcgccagggatcgtggcctggaagtgatcgaacgcgccatcctgccggaagaactcgaaggcttcgaacaatgcttcctgaccggaaccgcggcggaagtaacgccggtttcggagatcggcccctaccgattcgaggttggcgaaatcgccaagaaccttatgaatgactattctgcggcggttcagccgaagcacgcgatcgccgcagaataa

SEQ ID NO: 7203 - protein, 297 aa, Rhizobium loti
MASVPFDQLDGFIWMNGEFVAWGDAKIHVLTHGLHYASAVFEGERAYGGEIFKLNEHTERLHESARLLGFKIPYSVAELNDASTTLLKKQGFQDAYVRPIAWRGSEQMGVSAQNNRINVAIAIWQWPSYFDPAQKLKGIRLDVAEWRRPDPRTAPSKSKAAGLYMICTMSKHAAEAKGYADAMMLDWRGQVAEATGANIFFVKDGKIHTPKPDCFLDGITRRTVIGLARDRGLEVIERAILPEELEGFEQCFLTGTAAEVTPVSEIGPYRFEVGEIAKNLMNDYSAAVQPKHAIAAE

SEQ ID NO: 7204 - DNA, 963 bp, Rhizobium loti
  CDS (1)..(963)
atggaccagacgacggcaacacaggcttcaaagccgctgcccacagtcggcgaccgccacgtcgacccgcattcctaccccgacggcatcgccttcctcgacggccagtatctgccgatgtcgcaagccaaggtgtcggtgctggactggggcttcctgcattccgacgccacctacgacacggtgcatgtctggaacggccgcttcttccgcctcgacctgcatctcgaccgcttcttcggcggactggaaaagctgcgcatgaccatccccttcgacagggatggcgtggccgagatcctgcacaattgtgtcgccctttcgggccatcgcgccgcctatgtcgaaatgctgtgcacgcgcggcgcatcgccgaccttcagccgcgatccgcgccaggcgatcaaccgcttcatggccttcgccgtacccttcggctcggtcgccaatgccgagcagttgcagcgcggcctgcgcgtcgccatcagcgacaaggtgcgcatcccgccggcttcggtcgatccgtcgatcaagaactaccattggctcgatctggtgcgcggcctctacgacgcctatgacagcggtgcggagaccgcgctcattctcgacttcaacggcaatgtcgccgagggcccgggcttcaacgtcttctgcgtcaaggacggcaaactgtcgacgccggccatcggcgtgctgcccggcatcacgcgccgcacagtcttcgatctctgcgccgaagaaggtcttgccgccgccgccgccgatgtcagcgtcgccgcgctcaaggcggccgacgaggtcttcatcacctcgaccgccggcggcatcatgccggtgaccgagatcgacggcgcggcgatcgccgacggcaaggtcgggccggttaccagccggctaatggcgctctactggcaaaagcacgacgatccggcctggtcgtctcaggtgaagtatccctga

SEQ ID NO: 7205 - protein, 320 aa, Rhizobium loti
MDQTTATQASKPLPTVGDRHVDPHSYPDGIAFLDGQYLPMSQAKVSVLDWGFLHSDATYDTVHVWNGRFFRLDLHLDRFFGGLEKLRMTIPFDRDGVAEILHNCVALSGHRAAYVEMLCTRGASPTFSRDPRQAINRFMAFAVPFGSVANAEQLQRGLRVAISDKVRIPPASVDPSIKNYHWLDLVRGLYDAYDSGAETALILDFNGNVAEGPGFNVFCVKDGKLSTPAIGVLPGITRRTVFDLCAEEGLAAAAADVSVAALKAADEVFITSTAGGIMPVTEIDGAAIADGKVGPVTSRLMALYWQKHDDPAWSSQVKYP

SEQ ID NO: 7206 - DNA, 864 bp, Rhizobium loti
  CDS (1)..(864)
atgccgcgcattgcctatgtcaacgggcgctacgtcgctcacgcggacgcttccgtgcatatcgaggatcgcggctatcagttcgccgatggcgtctacgaggtctgcgaggtggcgcgcggcttcatcgtcgacatgccgcgccatcttgcccggctcaaccgctcgctgaccgaactgtcgatcgcctggccggtcgcgcgcaacgtgctgccgctgatcctgcgcgaggtggtcaatcgcaaccacgtcgtcaacggccttgtctatgtgcaggtgacgcgtggtgtcgccagccgcgagtttgttttcccgtcggcggacaccaagccgtcattggtggtcacagccagaaaggccgatccggcggctggagcaaagcgagccgaaaccgggatcgcggtcatcaccgtgccagagaatcgctgggaccgggtcgatatcaagaccgtcggactgctgcccaatgtattggccaagcaaaaagccaaggaagccggtgcgcaggaagcatggttcgtcgacaccgacggcaacgtcaaggaaggcggctcgtcgaacgcctggatcgtcacccgggatggcgtcctggtcaccaggccggccgatcacggcatcctgcgcggcatcacccgcacgacgatgttcgaagtcgcggccaagctcggcctgaagatcgaggagcgcggtttttccgtcgccgaggccaaggcggcgcgcgaggcgttcatcagttccgccacgacgattgccatgccggtcgtggccattgacggcgatccggtggccaacgggcaccccggctcagtgacactttcgttacggcaagccttttttgacattgcggaaaaaagtccagcctga

SEQ ID NO: 7207 - protein, 287 aa, Rhizobium loti
MPRIAYVNGRYVAHADASVHIEDRGYQFADGVYEVCEVARGFIVDMPRHLARLNRSLTELSIAWPVARNVLPLILREVVNRNHVVNGLVYVQVTRGVASREFVFPSADTKPSLVVTARKADPAAGAKRAETGIAVITVPENRWDRVDIKTVGLLPNVLAKQKAKEAGAQEAWFVDTDGNVKEGGSSNAWIVTRDGVLVTRPADHGILRGITRTTMFEVAAKLGLKIEERGFSVAEAKAAREAFISSATTIAMPVVAIDGDPVANGHPGSVTLSLRQAFFDIAEKSPA

SEQ ID NO: 7208 - DNA, 1200 bp, Rattus norvegicus
  CDS (1)..(1200)
atgaaggactgcagtaatggatgttcggcatcgtatgctgaagaagaagaattagaagcttcgaccgagtcgtatgatgaagaaggaggatcagaagcttcgacccagacgtttagggccaaagatctcattatcacaaaagccgatgtcttaaaaaagaagcccgaccccagctcgctggtctttggagcttcgttcactgaccacatgctgatggtggagtggacctccaagtatggatgggataagcctcacatcaagccttttgaaaacttgtccatacatcccgctgcctctgttttgcactatgctgtggaattgtttgaaggcttgaaggcttttcggggagttgataacaagatccgattgttccggccggacctcaacatgaaaagaatgtgccgatctgccgtgaggaccactctgccggagtttgacaaggaggagcttctgcaatgcgttcttcagctcatacagctcgaccgagagtgggtcccctactcaacctctgccagtctgtacatccgccccacattcatcgggattgagccatcgcttggagtcaagaagccttctaaagctctgctctttgtgattttgagccccgtgggatcttatttttctaatgggaccttttctccggtgtccctgtgggccaacccaaagttcgtcagatcctggaaaggtgggactggagacttcaagatgggctgcaactatggatcttcccttctggcgcagtgtgaggcggcagagaacggctgtcaccaggtcctgtggctgtacggcaaggaaaaccggataactgaagtgggcacgatgaatctcttcctctactggataaacaaagatggagaagaagaactggcgacgcctccgctagatggcgtcattctcccaggagtcactcggcagagcatcctggagctgggagaagagtggggcgagtttaaggtgtgcgagagacacatcaccatggatgacctgtccaccgccctggaggagaacagagtgaaggagatgttcggctcggggacagcctgcgttgtctgcccagttgccagtattctgtacaagggccagatgctgcacattccaaccatggagaatggccacaagctttcaagtcgcatcatggcaaagttgactgatatccagtatggacggatcaagagcgaatggacactggagttgccctaa

SEQ ID NO: 7209 - protein, 399 aa, Rattus norvegicus
MKDCSNGCSASYAEEEELEASTESYDEEGGSEASTQTFRAKDLIITKADVLKKKPDPSSLVFGASFTDHMLMVEWTSKYGWDKPHIKPFENLSIHPAASVLHYAVELFEGLKAFRGVDNKIRLFRPDLNMKRMCRSAVRTTLPEFDKEELLQCVLQLIQLDREWVPYSTSASLYIRPTFIGIEPSLGVKKPSKALLFVILSPVGSYFSNGTFSPVSLWANPKFVRSWKGGTGDFKMGCNYGSSLLAQCEAAENGCHQVLWLYGKENRITEVGTMNLFLYWINKDGEEELATPPLDGVILPGVTRQSILELGEEWGEFKVCERHITMDDLSTALEENRVKEMFGSGTACVVCPVASILYKGQMLHIPTMENGHKLSSRIMAKLTDIQYGRIKSEWTLELP

SEQ ID NO: 7210 - DNA, 873 bp, Rickettsia montana
  CDS (1)..(873)
atgacaatgataaaactagagcaaattttttggcatgtttggattaacggtgatttagttccttatcaatttgcaaggattcatgttttgactcatagcctgcattattcaggatcggtatttgagggtgagagagcttataacggcaaagtttttaaactaaaagaacatacggcaagattaataaaatcagcagaagcattaggtttgaaagtaccttataatgtagacgagataataaaagctcatgaacttgtaataaaacaaaataatattaaggatgcatatataagaccgcttatttggtgcggagacgagtcgctaaatatcactaatcagtatttatctactaatcttttgattgccggtattccatctatgccgaggtcttttgagaaaggtataaatttgcatgtaagccgctggcgtaaagcaatgcctgatagcaccccggtacaatctaaatccgccgctcaatataatatggcaataacgagtaaaaaagaagctaaggcttttggctatgatgatgcattattacttgattatgaagggtatattgctgaatgcactacaacaaatattttctttgttaaagataaaatattatatactccaattgccgataggtttttaaacggtataacaagacagactattattgaaattgcaaaagatttaggtctagaaataaaagaagagcgtttaaaattagagcaaatagaggattttaccggatgttttgttacaggcacggcaattgaggtacaaaatattggttctatagatcttggcaataaaaagattatttttgatgatcataaaattgcagatcgtttgaaagaagagtatggacgtgttgttagggagtag

SEQ ID NO: 7211 - protein, 290 aa, Rickettsia montana
MTMIKLEQIFWHVWINGDLVPYQFARIHVLTHSLHYSGSVFEGERAYNGKVFKLKEHTARLIKSAEALGLKVPYNVDEIIKAHELVIKQNNIKDAYIRPLIWCGDESLNITNQYLSTNLLIAGIPSMPRSFEKGINLHVSRWRKAMPDSTPVQSKSAAQYNMAITSKKEAKAFGYDDALLLDYEGYIAECTTTNIFFVKDKILYTPIADRFLNGITRQTIIEIAKDLGLEIKEERLKLEQIEDFTGCFVTGTAIEVQNIGSIDLGNKKIIFDDHKIADRLKEEYGRVVRE

SEQ ID NO: 7212 - DNA, 1023 bp, Pasteurella multocida
  CDS (1)..(1023)
atgataaaagatcttgattggaaaaatttaggctttggctatattaaaacagattatcgctatatcgcttattggaaagacggaaagtggtcaaaaggcgagctgacacaagataatgtactgcatattagtgaaggttcaactgcacttcattatgggcaacaatgctttgaaggactcaaagcttatcgctgtaaagacggttcgattaacttgttccgccctgatcaaaatgcagaacgtatgcaacgcagttgtcgccgtttattgatgcctgaagtgccaacagacatgtttattgatgcctgtaaacaagtggtcaaagcaaatcaagcatggttagcgccttatggcactggtgccaccctctatttacgccctttcttgattggtgtaggtgacaatgtcggcgtcaatcctgcgccagaatatattttctcgattttctgctgccctgttggcgcttattttaaaggtggcttaaaaccgaccaatttcttagtttcaaattatgatcgcgccgcaccgcaaggaaccggggcagcaaaagtgggtggaaattacgcagcaagtctttatcctggtaaagaagccaaacaaaacggctttggtgactgtatttatttagacccgaccacacacaccaaaattgaagaagtggggtcagcgaatttcttcggtatcacaaaagataacaaatttattactccgctttcgccgtcaattctgccaagtatcacgaaatactcgttactctatctcgctaaagcgcggttagggttagaaacagaagaaggggatgtgtatatcgatcaattagatcaatttaaagaagcgggcgcttgtggtactgctgccgtcatcacaccgattggtggtattcaatatggtgataacttccatgtgttctactctgaaacggaagtcggtgaaatcaccaccaaactctacaatgaattagtgggtatccaatttggtgatgttgaagcccctgaaggttggattgttaaagtagataactaa

SEQ ID NO: 7213 - protein, 340 aa, Pasteurella multocida
MIKDLDWKNLGFGYIKTDYRYIAYWKDGKWSKGELTQDNVLHISEGSTALHYGQQCFEGLKAYRCKDGSINLFRPDQNAERMQRSCRRLLMPEVPTDMFIDACKQVVKANQAWLAPYGTGATLYLRPFLIGVGDNVGVNPAPEYIFSIFCCPVGAYFKGGLKPTNFLVSNYDRAAPQGTGAAKVGGNYAASLYPGKEAKQNGFGDCIYLDPTTHTKIEEVGSANFFGITKDNKFITPLSPSILPSITKYSLLYLAKARLGLETEEGDVYIDQLDQFKEAGACGTAAVITPIGGIQYGDNFHVFYSETEVGEITTKLYNELVGIQFGDVEAPEGWIVKVDN

SEQ ID NO: 7214 - DNA, 1080 bp, Staphylococcus carnosus
  CDS (1)..(1080)
atgtcagaaaaagtaaaatttgaaaaacgtgaagacttaaaacaaaaaccagatccaaaaaatttagggtttggtcaatacttcacagattacatgttaagttatgactacgatagcgaaaaaggcggttggcatgatttgaagattacaccttatgcaccgatcgaactagatccagctgcacaaggacttcattatggtcaacttgtattcgaaggattaaaagcttataaacataacggtgaagtggttttattcagaccagaccaaaacttcgcacgtatcaatcaatcacttgatcgtttggaaatgcctcagattgatgaagaagagctattagaaggcttgaaacaattagtagatgtagaacgtgattgggtgcctgaaggcgaaggacaatctttatatattcgtccatttgtatttgcaacagaagcaggattaggtgttcaccctgcacataactataaattattaattatcttatctccttctgggtcttactatggtggagattcattgaaaccaacacgtatttatgttgaagacgaatacgttcgtgctgtacgcggtggtgtaggttttgcaaaagttgcaggtaactatgcagctagtttactatcacaatctaatgctaatgaacaaggctatgaccaagtattatggttagatggtgtagaacgcaaatatattgaagaagtgggcagtatgaatatcttcttcgtagaaaatggtaaacttgtaacacctaaattaaacggtagtatcttaccaggtattacacgtaagactgttatcgctttagcaaaagaattaggatatgaagtagaagaacgtcatatctctatcgatgaattactagagtcttatgataaaggcgaattagaagaagtatttggaacaggtactgctgcggttatttcaccagtaggcactttaaaatatgaagatcgtgaaatcacaatcaacaataatgaaactggtccaattacacaacgcttatatgatgaatatacaggtattcaaagcggtaaattagacgatccacaaggttggagagtcgtagtaccagaatattaa

SEQ ID NO: 7215 - protein, 359 aa, Staphylococcus carnosus
MSEKVKFEKREDLKQKPDPKNLGFGQYFTDYMLSYDYDSEKGGWHDLKITPYAPIELDPAAQGLHYGQLVFEGLKAYKHNGEVVLFRPDQNFARINQSLDRLEMPQIDEEELLEGLKQLVDVERDWVPEGEGQSLYIRPFVFATEAGLGVHPAHNYKLLIILSPSGSYYGGDSLKPTRIYVEDEYVRAVRGGVGFAKVAGNYAASLLSQSNANEQGYDQVLWLDGVERKYIEEVGSMNIFFVENGKLVTPKLNGSILPGITRKTVIALAKELGYEVEERHISIDELLESYDKGELEEVFGTGTAAVISPVGTLKYEDREITINNNETGPITQRLYDEYTGIQSGKLDDPQGWRVVVPEY

SEQ ID NO: 7216 - DNA, 822 bp, Streptomyces coelicolor
  CDS (1)..(822)
atgaagatctggctcgacggcgggttgcaggacatcggttccgcccgcgtctccgtcctcgatcacggactgaccgtgggcgacggcatcttcgagaccgtgaaggcggtggacggccggccgttcgcgttgacccggcacctggaccggctgacccgctcggcccgcggcctcggcctgcccgcccccgaccacgacgaggtccgccgcgcctgtgccgccgtgctggaggccaacccgatgccgctgggccggctgcgcgtcacctacaccggcggccacggcccgctcggctccgaccgcggcgagcacggcccgaccctcgtcgtcgccctcggcgagaccggccgccgccccgactccaccgccgtgatcacggtgccctggacccgcaacgaacgcggcgcgctcaccggcctgaagaccacctcctacgccgagaacgtcgtcgccctggcccgggcccgcgaacggggcgccaccgaggcgctgttcggcaacacggtgggccggctctgcgagggcaccgggtcgaacgtcttcgtcgtcctcgacggcgagatccacaccccgccggtcgcctccggctgcctcgccgggatcacccgcgccctggccgccgagtggaccggtgcccgcgagaccgacctcccgctggacgtcctggggcgcgccgacgaggtcttcctgacctcgacgctgcgggacgtacaggccgtgcaccggatcgacgaccgcgaactgccgggcgccccgggaccggtgacggccaaggccatgcggatcttccaggagcggtccggggacgacctggatccgtga

SEQ ID NO: 7217 - protein, 273 aa, Streptomyces coelicolor
MKIWLDGGLQDIGSARVSVLDHGLTVGDGIFETVKAVDGRPFALTRHLDRLTRSARGLGLPAPDHDEVRRACAAVLEANPMPLGRLRVTYTGGHGPLGSDRGEHGPTLVVALGETGRRPDSTAVITVPWTRNERGALTGLKTTSYAENVVALARARERGATEALFGNTVGRLCEGTGSNVFVVLDGEIHTPPVASGCLAGITRALAAEWTGARETDLPLDVLGRADEVFLTSTLRDVQAVHRIDDRELPGAPGPVTAKAMRIFQERSGDDLDP

SEQ ID NO: 7218 - DNA, 1700 bp, Solanum tuberosum
  CDS (340)..(1473)
gggggggggggaatttgtaacgccggagctgagcagagagataacataaaagataaatggagagcgccgccgtattgcggggcttcaccctactcctggtcaccataaccaccttctgggtccatcacgaactgctattaagcttcttcctccttccattgataaaatcattttttctcctttgcccatcaaggttttttcttccttaagccattcatatttcagtttctccattgaaactgatgctgttttatgattactgtgtgtatgatgttagcttcatgcgtgtagttttgtgtagagttgactaattcgtgtagatttcattgactttgtgtgatggaatttgtattgcagcttcagaagcagtcgcatttcacttcttatattgataatagtgccataaacagtggaaattcctttcgtgtggcctctcctgcaagcgacgttgcatctgaattagccgacatcgattgggacaaccttggctttggctttatgcctactgattatatgtatagcatgaaatgctctcaaggtgaaaacttttctaagggtgaattacagcgtttcggtaatattgagttgagtccgtctgctggaatattaaattatggtcagggattgtttgaaggtttaaaagcatatcgaaaacatgacggcaatatattgttgtttcgacccgaggaaaatgcaacgcgtttgaagatgggtgctgaacgtatgtgtatgccttcaccgtctgttgaacagtttgtggaagcagtgaaagccactgttttagctaatgaaagatggattcctcctcccggtaaaggctcattatacataagacctctgcttatggggagtggagctgtccttggtcttgctcctgctcctgagtacacattcctgatttatgtgtcacctgttggaaattattttaaggaaggtttggcaccaattaatttggtaattgagactgaaatgcaccgtgcaacacctggtggcactggaggcgtcaagactattggaaattatgctgcagttctgaaggcacagagtgctgctaaagcaaaaggctattccgatgttctgtaccttgattgtgttcagaaaaaatatctcgaagaggtttcctcttgcaatgtctttattgtgaagggtaatctgatagtaactcctgcaattaaaggaaccattcttcctggaattacgcgaaagagcataatcgatgtagcaattagtcaaggattccaggttgaggaacgacaggtgtctgtggacgaattgcttgatgctgatgaagttttctgtacgggaactgcagtggttgtatctcctgttggtagcattactcatcaagggagaagggtaacatatggaaatgatggtgttggccttgtgtcgcagcagttatactctgcacttactagcctacaaatggggctctcagaggataagatgggttggattgttgagctcaaatgagctctccaaccaaagggttgtactttccattgatgaaaaaatgttgacttggaagttctcagacacttgtgatccagagtttatccttgatcatacatccatgatgcgtgtcaagtatatctgtgtgtttgatatgtatccttcagctatgaaatagtcgtcgttttcaccccaaatttggtgatttaatctagtaaagtcttgtgttcaaaaaaaaaaaaaaaaaa

SEQ ID NO: 7219 - protein, 377 aa, Solanum tuberosum
MEFVLQLQKQSHFTSYIDNSAINSGNSFRVASPASDVASELADIDWDNLGFGFMPTDYMYSMKCSQGENFSKGELQRFGNIELSPSAGILNYGQGLFEGLKAYRKHDGNILLFRPEENATRLKMGAERMCMPSPSVEQFVEAVKATVLANERWIPPPGKGSLYIRPLLMGSGAVLGLAPAPEYTFLIYVSPVGNYFKEGLAPINLVIETEMHRATPGGTGGVKTIGNYAAVLKAQSAAKAKGYSDVLYLDCVQKKYLEEVSSCNVFIVKGNLIVTPAIKGTILPGITRKSIIDVAISQGFQVEERQVSVDELLDADEVFCTGTAVVVSPVGSITHQGRRVTYGNDGVGLVSQQLYSALTSLQMGLSEDKMGWIVELK

SEQ ID NO: 7220 - DNA, 1683 bp, Solanum tuberosum
  CDS (116)..(1372)
ttcggcacgaggtacgtcgttgttgtcaaaacaaaagaattagaaaaattaagacaacattgaaagtgagtgacaaacgaaacggctcaagtcgtagaagaagaagaacaaatcaatggagagcggcggcgcattagcagggcttcaccggaatcccactttccaccaccttctccggccaccacgaaccgccgttaataatcttctctcttcttcttcctccacctataagcgccatttttctcctcttcctctcaagtttcagaagcagtcacattttgcttcttatagttataattgctccataaacgatgggagtacttttcaggtggcttattctgctagtgcaacacactcattagccaacatcgattgggacaacttggcctttggggttatgcctactgattatatgtatagcatgaaatgttctcaagatgggaacttttctaagggcgagctacaacgttttgggaatattgagttgagcccagcttctgggatattaaattatggacagggattgtttgaaggtttaaaagcctataaaagacatgatggtaatatattgctgtttcgacccgaagaaaatgctctgcgtatgaagatgggagcagaacgtatatgcatgccttcaccatctgttgaacagtttgtggaagcagtaaaagccactgttttagcaaatgaaagatggattcctccaccaggtaaaggttcattatacataagaccactgcttatggggagtggagctattcttggtgttgctccagctcctgagtacacattcctgatttatgtatcacctgtgggaaattattttaaggaaggtatggcaccaataaatttggtaattgagacagaaatgcatcgcgcaactcctggtggtactggaggtgtcaagactatcggaaattatgctgcagttctgaaggcacagagtgctgctaaagcaaaaggctactctgatgttctgtaccttgattctgttaacaaaagatacctagaggaggttccctcttgtaatggcttcatcgtaaagggtaatctgatagcaactcctgcaattaaaggaaccattcttcctggtatcacacgaaagagcataattgacgtagctttaagccaagggttccaggttgaagaacggcaagtgtctgtggacgaattgcttgatgctgatgaagtgttctgcacaggaactgcagtggttgtatctcctgttggcagcattactcatcttgggaaaagggtatcatatggaagtgatggggttggtcgtgtatcaaagcaattatattctacacttacaagcctacaaatgggactagcaacggataacatgaattggactgttgcgctaaaatgaactttgctatctttggattaaagttatattcactgatagtgaatattcatgacgctatcagtgcaattttactgctcacagcaggttattactttattttcaaggtttattaggcctcttatggagagctacctattgttgtatgtcaaatttagttcatgctgtatattttttttacaatgtcgatgcacataacttaaacactctcttctagcttaagtttgtctgaagttctcgccttgtcatatagacttttatatgtctgttaacgatctcagttgatatcatttgtaaaaaaaaaaaaaaaaaaa

SEQ ID NO: 7221 - protein, 418 aa, Solanum tuberosum
MESGGALAGLHRNPTFHHLLRPPRTAVNNLLSSSSSTYKRHFSPLPLKFQKQSHFASYSYNCSINDGSTFQVAYSASATHSLANIDWDNLAFGVMPTDYMYSMKCSQDGNFSKGELQRFGNIELSPASGILNYGQGLFEGLKAYKRHDGNILLFRPEENALRMKMGAERICMPSPSVEQFVEAVKATVLANERWIPPPGKGSLYIRPLLMGSGAILGVAPAPEYTFLIYVSPVGNYFKEGMAPINLVIETEMHRATPGGTGGVKTIGNYAAVLKAQSAAKAKGYSDVLYLDSVNKRYLEEVPSCNGFIVKGNLIATPAIKGTILPGITRKSIIDVALSQGFQVEERQVSVDELLDADEVFCTGTAVVVSPVGSITHLGKRVSYGSDGVGRVSKQLYSTLTSLQMGLATDNMNWTVALK

SEQ ID NO: 7222 - DNA, 1668 bp, Arabidopsis thaliana
  CDS (1)..(1668)
atggcagaaccggaggtgattcactcatggtctgcaccaagatctctcagcaccagcctcatgtactcctttgctcagagacttgacactgaagttgtcgacgagccgttgtatgcatcatttcttaaagctacaggttttgataggccatacagagacgaagttctctccaagatggagtgcaatggagagaaagttgtgaaagatgtcatatatggatcaggatctaagaagtaccggtattgtaagcatatctcgaagcagcggcttttcggtttgccaagtgaactgatgagtagaggaaagcatttcatattaatacgaaatcctcttaacatattgccttcctttgagaaggtacaccctccatcatttctcgaattaggcttgggggaattagtgtcgatatacagtgatctctgtcagatgggaacaccaccagcagtcatcgatgcggatgagcttcagcgagatcccgagactacacttcgcggtctttgtgatgatttggagattccatttcaagcctctatgcttaaatggaaggctggtcctataccagaagatggagtatgggcaccatggtggtacaagagtgttcacgaatcaacgggtttctcatctccaaagaagtatcctcggacattccctttgtcgcattacgatttgctggagcgaagtctaccgctttacaacattctcaggagccacgtgaagcacagttcctccctcttgagtagtcccttgcctcctcctagtctcccagttcctgaaaatgcaaaacttcttgcatgggtcggtgacgagattttgcctcgtgaaatggcaaaggtttctgtttttgactcggttgttcaaggcggtgactctgtatgggaaggacttcggatttacaagggaaagatattcaagcttgaggaacatctagatcggttgtttgattcagcaaaggctctggctttcgataatgttccagcgcgtgaagaggtaaaagaagcaatcttcagaactcttataaccaatggtatgtttgacaatacacatatcaggttgtctctaactcgaggcaaaaaggttacttctggaatgagccctgcatataatcgatatgggtgcactcttattgtgcttgccgaatggaagcctccggtatatgacaatgaaggtggaattgtgctggtgactgcaaccacacgccgcaattcgcctaataatttggattccaagattcatcacaacaaccttctcaataacatactagcaaagattgaaagtaacaacacgaatgctgctgacgccattatgcttgacaaagatggttatgtgtctgaaaccaatgcaaccaacattttcatggtgaagaaaggctgtgtacttactcctcacgcagattactgtctccctggcataaccagagcaactgtaatggaacttgtggtgaaagagaacttcatcttagaagaaagaagaatcagtctctccgaattccatacagctaatgaggtatggacaacaggaactatgggagaactaagcccggttgtgaaaatcgatgggcgtgtgattggtgacggcaaagttggaccggtaacgagaacactgcaaaacgcttacaagaaactgacagaggattcaggtgtgccgatacctacttatcaagaaccctga

SEQ ID NO: 7223 - protein, 555 aa, Arabidopsis thaliana
MAEPEVIHSWSAPRSLSTSLMYSFAQRLDTEVVDEPLYASFLKATGFDRPYRDEVLSKMECNGEKVVKDVIYGSGSKKYRYCKHISKQRLFGLPSELMSRGKHFILIRNPLNILPSFEKVHPPSFLELGLGELVSIYSDLCQMGTPPAVIDADELQRDPETTLRGLCDDLEIPFQASMLKWKAGPIPEDGVWAPWWYKSVHESTGFSSPKKYPRTFPLSHYDLLERSLPLYNILRSHVKHSSSLLSSPLPPPSLPVPENAKLLAWVGDEILPREMAKVSVFDSVVQGGDSVWEGLRIYKGKIFKLEEHLDRLFDSAKALAFDNVPAREEVKEAIFRTLITNGMFDNTHIRLSLTRGKKVTSGMSPAYNRYGCTLIVLAEWKPPVYDNEGGIVLVTATTRRNSPNNLDSKIHHNNLLNNILAKIESNNTNAADAIMLDKDGYVSETNATNIFMVKKGCVLTPHADYCLPGITRATVMELVVKENFILEERRISLSEFHTANEVWTTGTMGELSPVVKIDGRVIGDGKVGPVTRTLQNAYKKLTEDSGVPIPTYQEP

SEQ ID NO: 7224 - DNA, 1680 bp, Arabidopsis thaliana
  CDS (1)..(1680)
atggaggtgatacacgcatggtctgctccaagatcactcagcaccactctcatgtactcctttgcccagagagatgacattgaagtgcttgatgagccattatacgctgcgttcctcaagtctacgggtgttgataggccttacaaagatgagcttctctctaagatggagtgtgatggagaaaaggtggtgaaggatatcatttatggtccaggaaagaagaaatataggttttgtaagcatatatcgaaacagcgacttcttggtttgccaagtgaactaatgagtgaagggaagcactttatattgatacgcaatcccctcaacatattgccttcttttgagaagatacacccttcatcgtttcacgaattgggactgggagagttagtatcgatatacagtgatctctgtcagatgggaacaccaccagcaatcatcgatgcagatgagctccagcgagatcccgaggctacactacgcagtctttgtgatgacttagagatcccctttcaagcctctatgcttaaatgggaggctggtcctataccagaagatggactttgggctccatggtggtacgagactcttcataaatcaacagggttctcgtcgccccagaagtaccctcagactttccctttaatgcattacgatttgctggagcaatgtttaccgctgtacaacattctgaggtgccacatgaagcacaagtcatcgctcttgtccagcaccttacctcctcccagtctcccagttcctgaaaatgctaaacttcttgcttgggttggtgatgagattgtgccacgagagatggcgaaggtttctgtttttgactcggtcgtgcaaggcggtgactctgtatgggaaggtcttcgtatatacaaagggaaagtatttaagcttgaagaacatctagaccggttgtctgattccgcaaaggctctggctttcaacaatgtcccaacccgcgaggagataaaagaagccatcttcagaactctcataaccaatgggatgtttgacaatacacatataagattgtctctaactcgaggcaaaaaggtcacatctggaatgagccctgcatttaaccgttatggatgtactttgatcgtgcttgctgaatggaagcctccggtatatgacaatgatggcggaattgtgctggtgactgcaactacacgccggaattcacccaacaatttagattccaagattcatcacaacaacctcctcaataatatacttgcaaagattgaaagcaacaatgccaacgtcgatgatgcaatcatgcttgacaaggatgggtttgtgtctgaaaccaatgcaaccaacattttcatggtgaagaaagaccgagtactcactcctcacgcagattattgtctccccggcattactcgagctactgtgatggaactggtggtgaaagagaactttatcttagaagaacgtagaatcagcttgtcggaattccatacagctgatgaggtatggactacaggaactatgggagaactcagcccggttgtgaaaattgatgggcgtgtgatcggtgaaggaaaagtaggaccggtaacaagaagacttcaaaatgcttacaagaaactgacggatggttcaggtgtcccaatacctacttaccaagaagtcaagaaccttgaaccatgtgtttga

SEQ ID NO: 7225 - protein, 559 aa, Arabidopsis thaliana
MEVIHAWSAPRSLSTTLMYSFAQRDDIEVLDEPLYAAFLKSTGVDRPYKDELLSKMECDGEKVVKDIIYGPGKKKYRFCKHISKQRLLGLPSELMSEGKHFILIRNPLNILPSFEKIHPSSFHELGLGELVSIYSDLCQMGTPPAIIDADELQRDPEATLRSLCDDLEIPFQASMLKWEAGPIPEDGLWAPWWYETLHKSTGFSSPQKYPQTFPLMHYDLLEQCLPLYNILRCHMKHKSSLLSSTLPPPSLPVPENAKLLAWVGDEIVPREMAKVSVFDSVVQGGDSVWEGLRIYKGKVFKLEEHLDRLSDSAKALAFNNVPTREEIKEAIFRTLITNGMFDNTHIRLSLTRGKKVTSGMSPAFNRYGCTLIVLAEWKPPVYDNDGGIVLVTATTRRNSPNNLDSKIHHNNLLNNILAKIESNNANVDDAIMLDKDGFVSETNATNIFMVKKDRVLTPHADYCLPGITRATVMELVVKENFILEERRISLSEFHTADEVWTTGTMGELSPVVKIDGRVIGEGKVGPVTRRLQNAYKKLTDGSGVPIPTYQEVKNLEPCV

SEQ ID NO: 7226 - DNA, 1973 bp, Arabidopsis thaliana
  CDS (571)..(1818)
tagttaaggtagggtagggaaaaatcgttggcttctagtgtgttgcagtgtgtgtatttgagaatatatgatttgtgagactaaaaagccgaaatcattatcggggtttattgtttcttctacttgtaatgatgttgatgattgatgtcttttagctcatcggttagtaagtgtcaacagcaagagtgttcggctggactaccgtggcccattctgtagatttctttctagcccggcccacaacttccattgggctagatatgtttttctcacgtaaaagatatctgactgtcgatattgaagtaacttcttaaaacatttagatttaattgataatttaaatgtcacttttggttttttagatgacgattaaaatccttttcataacccaaaatattagttttgccgatattagaaatccgaagaaaatgacagaaaataggattaatcaatttagggtttaataaaaaatagtgagtgagagagaggctacagtgctccacattgacatcaacaaggttgaagaagaacaacatcattcaacatcagcatcacgaatattttcgagtcatggagagaagcgccgttgcctcaggttttcatagaaattacatcctctgtgcttcacgcgccgccacttccacgacgcgcctccactctttgtcctccctcagaaactttccctcttcctctctcaggattcgtcactgtccttctcccatctcttccaatttcatcgttagtgaagtttcccgaaaccgacgatgcgacgccgtttcttccagcaccaccgatgtgactgaattagccgaaattgattgggacaagattgattttgggcttaaaccaacggattacatgtacgccatgaaatgtagccgtgatggtgaattctctcaaggtcaattgcaaccttttggtaacattgacattaacccagcagctggtgttctcaactatggacaaggtttgtttgaaggtctaaaagcttacagaaaacaagatgggaatattctactcttccgtcctgaggagaatgcgatccgaatgagaaatggcgctgaaagaatgtgtatgccttctccaaccgttgaacagtttgttgaggctgtgaaaactactgtattagctaacaaacgctggattccacctccaggtaaaggatcattatacataaggccattgctaatgggaactggagctgttcttggtcttgctcctgctcctgaatacactttccttatctttgtttcacctgtcgggaactacttcaaggaaggtgttgcgccgatcaacttaattgttgaaactgaattccatcgtgcaactcccggcggtactggaggtgttaaaaccatcggtaattatgctgcagtcttgaaggctcagtcgattgcgaaagctaaagggtattctgatgttttataccttgattgccttcacaaaagatatcttgaggaggtttcatcgtgcaatattttcattgtgaaggataatgtgatatctactcctgaaattaaaggaaccatcttgcctggaattacccggaagagtatcatcgaagtagctcgtagccaaggtttcaaggtggaggaacgaaatgtgacagttgatgaattggtagaagcagacgaggttttctgcacaggaaccgccgttgttttatctccggttggaagcatcacttacaaaagccaaaggttttcttatggagaagatggctttggaacagtctcgaaacaactctacacttccttgacgagcctgcaaatgggtctgagcgaagataacatgaactggactgttcaattgagttaaaaccagtcacgaacatatcaatattatacatatggatgtgttagtagatacagaagatatattagaattccatgcttctgatgcttcaagattctgtacttgaaactataaacaataatctgtctttaaaataactaaaacggggaataaaaagc

SEQ ID NO: 7227 - protein, 415 aa, Arabidopsis thaliana
MERSAVASGFHRNYILCASRAATSTTRLHSLSSLRNFPSSSLRIRHCPSPISSNFIVSEVSRNRRCDAVSSSTTDVTELAEIDWDKIDFGLKPTDYMYAMKCSRDGEFSQGQLQPFGNIDINPAAGVLNYGQGLFEGLKAYRKQDGNILLFRPEENAIRMRNGAERMCMPSPTVEQFVEAVKTTVLANKRWIPPPGKGSLYIRPLLMGTGAVLGLAPAPEYTFLIFVSPVGNYFKEGVAPINLIVETEFHRATPGGTGGVKTIGNYAAVLKAQSIAKAKGYSDVLYLDCLHKRYLEEVSSCNIFIVKDNVISTPEIKGTILPGITRKSIIEVARSQGFKVEERNVTVDELVEADEVFCTGTAVVLSPVGSITYKSQRFSYGEDGFGTVSKQLYTSLTSLQMGLSEDNMNWTVQLS

SEQ ID NO: 7228 - DNA, 1541 bp, Homo sapiens
  CDS (1)..(1179)
atggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 7229 - protein, 392 aa, Homo sapiens
MAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 7230 - DNA, 1953 bp, Ovis aries
  CDS (492)..(1649)
ctgtttccattgcgtccttaagtgtttttaaaattttaccccctcattccatgagttctgtccttaacgagtgaccttgcgcctgcattggaggaccctactcgtggagaaaatggttcactctggtccccatcgcttttccaggcttgctattgtgcgcccgtgatcgacaagaccacgaggctgagtgcgcccaggagatttctctgttaatggctttaagccctaatctagactatttcctcggataaaagggagacaattactttcttgttctttgctggtgaaccctggcgcttcagggagaacctggaatttaaccagtctgctcgaagccagcggtggaggacaaaaacagccgcgacctccgacagggcagaaagagaaggacagctctcgcaggacgctctcctttggggctggtgcctgggtgtttgattctccttttccagtttgcttggggaccagacccgagcgcagcgaagggtgtgatggactgcaataatggatgctccgcagaaggtaccggagaaggcggatccaaagagccggtggagactttcaaggctgaagatctaataatcacacgagccaccattttaaaggaaaaaccagaccccagtactctggtttttggaacagtttttacagatcacatgttaacagtggagtggtccttggagcttggatgggagaaaccacgcatcaaacctcttcaaaacctctcactgcatccgggttcatcggctttgcactatgctgtggaattatttgaaggattgaaggcatttcggggagtagataataaaattcgtctgtttcggccaaacctcaacatggataggatgtaccgatctgctatgagggccactttgccggcgtttgacaagaaagagcttttagagtgtattcagcagcttgtgaaattggatgaggaatgggtcccctactcaacatctgcgagtctatatatccgtcctacgttcattggaactgagccttctctgggagtcaagaagccgactaaagccctgctctttgtaatcttgagcccagtgggaccttatttttccagtggaagctttaatcctgtgtccctgtgggccaacccgaagtatgtaagagcctggaaaggtgggaccggggactgcaagatgggagggaattatggctcgtctctttttgcccaatgtgaagcagtggaaaatgcatgtcaacaggttctgtggctctatggagaagaaaatcaaataactgaagttggaactatgaatctttttctttattggataaatgaagatggagaagaagaactggcaactcctccgctagatggcatcattcttccaggagtgatgaggcagagcatcctggacttggcacacaagtggggtgaatttaaggtatcagagagatacctcaccatggatgacttgaccacagctgtagaggagaatcgggtgagggagatgtttggttcaggtaccgcctgcgttgtttgccctgtttcaactatactgtacaaggatgagactatacacattccaactatggagaacggtcctaagcttgcaagccgcatcttagaaaaactgactgatattcaatacggaagagaagagagcgactggacaatcacggtagcctgagtggaaaagaacaggatatcatctgtgtgcgcttgggacagactgtggcatttgagttatgggaaatgtctttggctacctgattttagttgtgcatcacgttgttcatattatgtgtgttaccagggcgattgtttcttcatgccagagaagacgaatcacaatcatccaatgatagtttctaaacttgctcctagaagttttccttaccttctctagagttgattatggaagccatataattgtagagttttcctccataatcttagtgcctcccttagggcttcactcagatttttttttt

SEQ ID NO: 7231 - protein, 385 aa, Ovis aries
MDCNNGCSAEGTGEGGSKEPVETFKAEDLIITRATILKEKPDPSTLVFGTVFTDHMLTVEWSLELGWEKPRIKPLQNLSLHPGSSALHYAVELFEGLKAFRGVDNKIRLFRPNLNMDRMYRSAMRATLPAFDKKELLECIQQLVKLDEEWVPYSTSASLYIRPTFIGTEPSLGVKKPTKALLFVILSPVGPYFSSGSFNPVSLWANPKYVRAWKGGTGDCKMGGNYGSSLFAQCEAVENACQQVLWLYGEENQITEVGTMNLFLYWINEDGEEELATPPLDGIILPGVMRQSILDLAHKWGEFKVSERYLTMDDLTTAVEENRVREMFGSGTACVVCPVSTILYKDETIHIPTMENGPKLASRILEKLTDIQYGREESDWTITVA

SEQ ID NO: 7232 - DNA, 1322 bp, Bacillus licheniformis
  CDS (247)..(1098)
taatactaaagtcacaaggaggatcacaatgtctaagtatacaggattggatagaagatgaatacaggatgaagggaaaaatatatcaaattttaagagaaaatgttgaacgatagggaatgctgtttttttgatcctgaaggcggaaaaaagtttttggaaatattgcactattttgatcagcagggtcgtgttagaatggaatggagaaaattcagaagtcaacaaaaataaggggatggagaaatgaaagttctttttaacggccggctgatggaacggagcgagtgtgcggttgatattgaggacagaggctaccaatttggagacggcgtctatgaagtcatccgcatttacaatggaatcttgttcacgcttgatgaacacattgcccgcttatacaaaagcgcagccgaaatcggaatcgacttgtctttttcagaagccgaactgaaaagccagctgaaagagctcgtcgacatcaatcagaggcgggacggcgggctgtatcttcaagtgacaaggggaaaagctccgaggaagcatcaatacggagcagggcttacgcctcaggtgacggcttatacatttcctattcagaagcctgaaaaagaacagcaaaacggcgtttcggctattactgcggacgacatgcgctggctgagatgcgacattaaaagcttaaatctgttgtacaatgtaatgatcaagcaaaaagcacaggaagcttccgcctttgaagcgatcttaattcgcgacggtttggtgacggaagggacgtcttcaaatgtttacgtcgccaaacaaaatgttatctacacccatcctgtgacaacgctcatcttaaacggcatcacgcggatgaaagttcttcagctgtgtgaagagaacggcttgaattacgaagaaaaagcggtgacaaaggatgaattgctgaatgcggatgaagtattcatcacgtcaacgacagccgaagtcattccggtcacatcgattgacgggcaaacaatcggctccggagcgcccggaccgctcacaaaaaatgtgcagaccgctttgcaaaacagcattttgtcagagacagccaaaacggtttaacaaaagaaaaacgccgcttccatgaggaaacggcgtttttttacttgcggaaaccgaacaaaattgaaaagagcggcgataaatataggaaaaacacaaacggcaaatattcaatgacgggaacgccgagcgcgctggacatgaacgcgccgctgactccccaagggatcatcggattgattaatgtccctccgtcttcaagcgatctcgacaaatgcttccgg

SEQ ID NO: 7233 - protein, 283 aa, Bacillus licheniformis
MKVLFNGRLMERSECAVDIEDRGYQFGDGVYEVIRIYNGILFTLDEHIARLYKSAAEIGIDLSFSEAELKSQLKELVDINQRRDGGLYLQVTRGKAPRKHQYGAGLTPQVTAYTFPIQKPEKEQQNGVSAITADDMRWLRCDIKSLNLLYNVMIKQKAQEASAFEAILIRDGLVTEGTSSNVYVAKQNVIYTHPVTTLILNGITRMKVLQLCEENGLNYEEKAVTKDELLNADEVFITSTTAEVIPVTSIDGQTIGSGAPGPLTKNVQTALQNSILSETAKTV

SEQ ID NO: 7234 - DNA, 1194 bp, Bacillus sphaericus
  CDS (134)..(985)
aagcttcacacgccaagcacttcactgaaaaatctactttgatttactgcatctggtcttacttgatcgtctagtgggaatcattgtacttaaaaatgtgaaaataacttaaaaatgaaaaggatgtataaacatggcatactcattatggaatgaccaaatcgttgaagaaggatctattacaatttcaccagaagaccgtggttatcaatttggtgatggtatttacgaagtaatcaaagtatataacgggcatatgtttacagcacaagagcacatcgatcgtttctatgctagtgccgaaaaaattcgccttgttattccttatacaaaagatgtattacacaaattattgcatgatttaatcgaaaaaaataatttaaatacaggtcatgtttacttccaaattacacgtggaacaacttctcgtaaccacattttcccggatgcaagcgtaccagcagtgctaacaggtaatgttaaaactggtgaacgttcaattgaaaatttcgaaaaaggcgtaaaagcgacattggttgaagatgttcgttggttacgttgtgatattaaatctttaaatttacttggcgcggtacttgcgaaacaagaagcatctgaaaaaggttgttacgaagccattttacaccgtggagatattatcacagaatgttcttctgctaatgtctatggtattaaagatggtaaactttatacgcacccagcaaataactacatcttaaatggtattacacgccaagttatattaaaatgtgccgctgaaataaatttaccagtgattgaagagccgatgacaaaaggcgatttattaacaatggatgaaattattgtgtcttctgtttcatctgaagtgacaccggttatcgatgtggatggtcagcaaattggtgcaggtgttcctggtgaatggactcgtaaattgcaaaaagcatttgaggcaaaattaccaatttcaattaatgcctaatctgtataaatgattaaaaagagctacctaaaacttggttattcgccaagttaggagggtagctcttttttatagaacaaaatatgcatgtattctcctgaaacgtcatgtaaaataaaaaagatagcgcctttagtcgatatcacggtgataccgactagtaacgaggcgaatttgatatggggcagtaagattggagtgacctaaac

SEQ ID NO: 7235 - protein, 283 aa, Bacillus sphaericus
MAYSLWNDQIVEEGSITISPEDRGYQFGDGIYEVIKVYNGHMFTAQEHIDRFYASAEKIRLVIPYTKDVLHKLLHDLIEKNNLNTGHVYFQITRGTTSRNHIFPDASVPAVLTGNVKTGERSIENFEKGVKATLVEDVRWLRCDIKSLNLLGAVLAKQEASEKGCYEAILHRGDIITECSSANVYGIKDGKLYTHPANNYILNGITRQVILKCAAEINLPVIEEPMTKGDLLTMDEIIVSSVSSEVTPVIDVDGQQIGAGVPGEWTRKLQKAFEAKLPISINA

SEQ ID NO: 7236 - DNA, 849 bp, Staphylococcus epidermidis
  CDS (1)..(849)
atgacaaaagtttttataaatggtgaatttgttaatgaagaggatgctaaggtttcatacgaagatcgaggctacgtgtttggggacggaatctatgaatatatacgggcatatgatgggaaattgtttaccgttaaagagcattttgaaagatttttaagaagtgctgaagaaataggactagatttaaattatactattgaggaattaattgaattagtacgccgattattaaaagaaaataatgtagtgaatggcggtatttatatacaagctactcgtggtgctgctcctcgaaatcattcatttcctacaccacctgtaaaacctgttattatggcgtttacaaaaagttatgatagaccttatgaagaattagaacaaggagtttatgccattacaactgaagacattagatggttacgttgtgatattaaaagtttaaatttattaggaaatgtattagctaaagaatatgctgttaaatataatgctgcagaggctatacaacaccgaggtgatattgtcactgagggtgcatctagtaatgtttacgcaattaaagatggagtgatatacacgcatccagttaataattttatattgaacggaattactcgccgtgtcataaaatggatagcagaggatgaacaaataccattcaaagaagaaaaatttacagtagaatttcttaaaagtgctgatgaagttatcatttctagtacttctgcagaagttatgccaattacaaaaattgatggtgaaaatgttcaagacggacaagttggtactataacacgacaattacaacaaggatttgaaaagtatattcaatcgcatagtatttaa

SEQ ID NO: 7237 - protein, 282 aa, Staphylococcus epidermidis
MTKVFINGEFVNEEDAKVSYEDRGYVFGDGIYEYIRAYDGKLFTVKEHFERFLRSAEEIGLDLNYTIEELIELVRRLLKENNVVNGGIYIQATRGAAPRNHSFPTPPVKPVIMAFTKSYDRPYEELEQGVYAITTEDIRWLRCDIKSLNLLGNVLAKEYAVKYNAAEAIQHRGDIVTEGASSNVYAIKDGVIYTHPVNNFILNGITRRVIKWIAEDEQIPFKEEKFTVEFLKSADEVIISSTSAEVMPITKIDGENVQDGQVGTITRQLQQGFEKYIQSHSI

SEQ ID NO: 7238 - DNA, 1529 bp, Staphylococcus haemolyticus
  CDS (216)..(1064)
atagaaatcaaactggtgatatgtctgaaccatatacaataggtgggggaacatatgctagaaatcttgataaaggtgtagcgtttggggctatgtttgaagattcagaggatttaatgcatcaaaagaatgagtatattactaaaaaacaattgttcaacgcgacaagtatctatttagaagcaatttattcactatgtgtggagggataatctatgacaaaagtttttattaacggcgaatttatcgaccaaaatgaagctaaagtatcttatgaagaccgtggttatgtatttggtgatggaatttatgaatacattagagcatatgatgggaaattatttacagtaacagaacactttgaacgatttattagaagtgcaagtgaaattcaattagatttaggctatactgtcgaagaattaattgatgtagttagagaattattaaaggtaaataatattcaaaatggtggtatctatattcaagctacgcgtggtgtagcaccaagaaatcactcgttcccaactccagaagtaaagccagttattatggcatttgctaaaagttatgaccgtccatatgatgatttagaaaatggtattaatgcagctactgttgaagatattagatggttacgttgtgatattaaaagtttaaaccttctaggaaatgtacttgcaaaggaatatgcggttaaatacaatgctggtgaagcaattcaacatagaggggaaactgttacagaaggcgcttctagtaatgtatatgcgattaaagatggtgctatttatacgcatcccgttaataattacattttaaatggtattactcgtaaggttattaaatggatttctgaagatgaagatattccttttaaagaagaaacattcactgttgaattcttaaaaaatgctgatgaagtcattgtttctagtacatctgctgaagtgacaccagttgttaagattgatggtgaacaagttggtgacggtaaggtaggtcctgtgactcgtcaattacaagaaggctttaataaatatattgaatctagaagtagttaattcattaaaataattaattgaagagcgtactaattcttaaaagatagaattttagtacgttcttttttatttttcagtgtgaataaattaaatgaattaaattaaaaatactcagtttaaagatatgaaaatgtgttataatgaaacctaaagattgaatcgaattttagcaagtatcgactagtaaaatgtatctttttgtttctcattttcagttgaaaaagcaaggctaaaaattatcaaaatcaacattgagtgataaaagagacgtatttatttaaataagtgttaggggacaataacatattatttaaaattatgacttatatgtaaaaacataactattttgaaataaataatctattttccaacaaatgattataataaattagaatatatggctcttgaaaacctatattctcgagccatttctatgaagtgaggtgaaccgagttggagcagttt

SEQ ID NO: 7239 - protein, 282 aa, Staphylococcus haemolyticus
MTKVFINGEFIDQNEAKVSYEDRGYVFGDGIYEYIRAYDGKLFTVTEHFERFIRSASEIQLDLGYTVEELIDVVRELLKVNNIQNGGIYIQATRGVAPRNHSFPTPEVKPVIMAFAKSYDRPYDDLENGINAATVEDIRWLRCDIKSLNLLGNVLAKEYAVKYNAGEAIQHRGETVTEGASSNVYAIKDGAIYTHPVNNYILNGITRKVIKWISEDEDIPFKEETFTVEFLKNADEVIVSSTSAEVTPVVKIDGEQVGDGKVGPVTRQLQEGFNKYIESRSS

SEQ ID NO: 7240 - DNA, 921 bp, Methanobacterium thermoautotrophicum
  CDS (1)..(921)
atgtcatgcgaagccagtggaaagatatggttaaacggtgaaatggttgaatgggaagaagccaccgtccacgtactctcacatgttgtgcattatggatcatctgtctttgagggaataaggtgctacaggaacagtaaggggtcagccatcttccgtttgcgggagcatgttaaacgcctttttgattctgcaaagatataccggatggacataccctacacccaggagcagatatgtgatgccatagttgagaccgtcagggagaacggacttgaggagtgctatataagacccgtggtattcaggggatacggtgagatgggtgttcacccggtgaactgcccagtggacgtcgctgtggctgcctgggaatggggggcctatctgggtgcagaggcccttgaggttggtgtcgatgctggtgtttcaacctggcggaggatggcaccaaacacaatgcccaacatggcaaaggccggcggtaactacctcaactcacagcttgccaagatggaggctgtgagacacggctatgatgaggccataatgctggactaccatggctacataagtgagggtagcggggagaacatattcctcgtcagtgagggtgaaatttacaccccccctgtttcatcatcccttctgagggggataacaagggactccgtaataaagatagccaggaccgagggtgttaccgtgcatgaggaacccataaccagggagatgctctacatcgcagatgaggccttcttcacaggtacagccgcagagataacacccatcagatcagttgatggtatagagataggtgccgggcgaaggggtcccgttacaaagctgctgcaggatgagttcttcaggataatcagggcagagacagaggacagcttcggatggctcacctacatctga

SEQ ID NO: 7241 - protein, 306 aa, Methanobacterium thermoautotrophicum
MSCEASGKIWLNGEMVEWEEATVHVLSHVVHYGSSVFEGIRCYRNSKGSAIFRLREHVKRLFDSAKIYRMDIPYTQEQICDAIVETVRENGLEECYIRPVVFRGYGEMGVHPVNCPVDVAVAAWEWGAYLGAEALEVGVDAGVSTWRRMAPNTMPNMAKAGGNYLNSQLAKMEAVRHGYDEAIMLDYHGYISEGSGENIFLVSEGEIYTPPVSSSLLRGITRDSVIKIARTEGVTVHEEPITREMLYIADEAFFTGTAAEITPIRSVDGIEIGAGRRGPVTKLLQDEFFRIIRAETEDSFGWLTYI

SEQ ID NO: 7242 - DNA, 1077 bp, Staphylococcus epidermidis
  CDS (1)..(1077)
atgtcagaaaaagtaaaattcgaaaaaagagagtctttaaaagaaaaacctgatacagcaaacttaggatttggacaatatttcacagactatatgttaagtgttgattatgacgctgatcaaggatggcatgatatgaagattgtgccgtacgcaccatttgaaatttcaccagcagcgcaagggttacattatggtcaggcagtttttgaaggccttaaagcctataaacataatggagaagttgtattattccgcccagatcaaaacttcaaacgtattaataattctttagcacgtttagaaatgccagaagttgatgaagaagcattattagaagggttgaagcagcttatcgacgttgaacgagattgggtacctgaaggcgaaggtcaatcgttatatattcgtccttttgtatttgctactgaaggtgttttgggtgtacgttcttcacatcaatataaattactaattattttatctccgtcaggcgcttattatggtggtgacacattaaagtcaactaaaatttatgtcgaagatgaatatgtacgtgcagtacgtggaggtgtaggtttcgctaaagttgcaggtaactatgctgccagcttactcgcacaaacaaacgctaataaattaggttatgaccaagtattgtggcttgatggtgttgaacaaaaatatgttgaagaagttggtagtatgaatattttcttcgtagaaaatggaaaagtagttacgccagcattaaacggtagtatcttgcctggtatcactagaaagtcaattattcaattagctgaagatttaggttatgaagttgaagagagaagagtttctatagaagagctgtttaacgcatatgataaaggtgaacttacagaagtatttggttcaggtacagcagctgttatctctcctgtaggtacacttcgctatgaagatagagaaattgttattaataacaatgaacctggtaaaatcactcaaaaattatatgacacatatactggtattcaaagtggcaaattagaagataaatacggatggagagtagaagttcctaagtattaa

SEQ ID NO: 7243 - protein, 358 aa, Staphylococcus epidermidis
MSEKVKFEKRESLKEKPDTANLGFGQYFTDYMLSVDYDADQGWHDMKIVPYAPFEISPAAQGLHYGQAVFEGLKAYKHNGEVVLFRPDQNFKRINNSLARLEMPEVDEEALLEGLKQLIDVERDWVPEGEGQSLYIRPFVFATEGVLGVRSSHQYKLLIILSPSGAYYGGDTLKSTKIYVEDEYVRAVRGGVGFAKVAGNYAASLLAQTNANKLGYDQVLWLDGVEQKYVEEVGSMNIFFVENGKVVTPALNGSILPGITRKSIIQLAEDLGYEVEERRVSIEELFNAYDKGELTEVFGSGTAAVISPVGTLRYEDREIVINNNEPGKITQKLYDTYTGIQSGKLEDKYGWRVEVPKY

SEQ ID NO: 7244 - DNA, 1074 bp, Cochliobolus carbonum
  CDS (1)..(1074)
atggcgatacccttgcctgcattttacaaatgggatgtttacgatagtaaattaaacaatgtacacggacacgtagaatgtcgatacacagcccaaacgggctactggtcagacccttgtttcgtccaaagcccttttctgagcgtccatggtcttgcaccggggctaaattatgggcagcaagtatacgaaggaattcaagctcggcgaaccgctcgtaacgaaatcttgatattccgtcccggcgcgagtgccgatcgtatggccaagtcagcaacggctgtctccatgcccccggtgccctacgaattgttcgtgagatcggttcacatggctgttgctttgaacgccgattatgttcctccacatgattttcatgggagcatgtatattcgtccgtgccaatttggatcgagttgtcaaattggacttcaaccccccgacgagtttatcttctgcgtcttcgtacagccacacattgcgttgcacgggcacggttccctgcgggcgctgatagcagaggactttgaccgggccgctacgaggggcactggtcatgtcaaaataggcggtaattatgcccccgtgataaggtggacacagtcagcgaagaaggaggaaaatggtgggtgggacgttttgctccacgtggacagcaaaacgcaaacgcggattgacgaattcagtacttcagcatttattgggacaaaatatgcagaggaacagaatgagccaccacaaatcatcttgccagaaagtgcagcggctattcaaagcatcacttcggattccgtcgcatggttagcgaagtcattcggctggaatattgtcaaacagcctgtcaccattgatgaacttgcttccttatcagaagtaatggctgtgggcaccgctgccggtcttgtgcctgttagttgtatacgtcataactccaccaatcggacgtttgaattcccttctgcgggacctatgtacagacagctcaaggaaacgctagataatatacaacggggcaggtcaagtgattcgtttggatggtgtgagaaacttcgatacgccgaattcgtacaatag

SEQ ID NO: 7245 - protein, 357 aa, Cochliobolus carbonum
MAIPLPAFYKWDVYDSKLNNVHGHVECRYTAQTGYWSDPCFVQSPFLSVHGLAPGLNYGQQVYEGIQARRTARNEILIFRPGASADRMAKSATAVSMPPVPYELFVRSVHMAVALNADYVPPHDFHGSMYIRPCQFGSSCQIGLQPPDEFIFCVFVQPHIALHGHGSLRALIAEDFDRAATRGTGHVKIGGNYAPVIRWTQSAKKEENGGWDVLLHVDSKTQTRIDEFSTSAFIGTKYAEEQNEPPQIILPESAAAIQSITSDSVAWLAKSFGWNIVKQPVTIDELASLSEVMAVGTAAGLVPVSCIRHNSTNRTFEFPSAGPMYRQLKETLDNIQRGRSSDSFGWCEKLRYAEFVQ

SEQ ID NO: 7246 - DNA, 24 bp, artificial sequence
  primer
atgaccacgaagaaagctgattac

SEQ ID NO: 7247 - DNA, 26 bp, artificial sequence
  primer
ttattgattaacttgatctaaccagc

SEQ ID NO: 7248 - DNA, 1791 bp, Saccharomyces cerevisiae
  CDS (2)..(1504)
aatgtctagattagaaagattgacctcattaaacgttgttgctggttctgacttgagaagaacctccatcattggtaccatcggtccaaagaccaacaacccagaaaccttggttgctttgagaaaggctggtttgaacattgtccgtatgaacttctctcacggttcttacgaataccacaagtctgtcattgacaacgccagaaagtccgaagaattgtacccaggtagaccattggccattgctttggacaccaagggtccagaaatcagaactggtaccaccaccaacgatgttgactacccaatcccaccaaaccacgaaatgatcttcaccaccgatgacaagtacgctaaggcttgtgacgacaagatcatgtacgttgactacaagaacatcaccaaggtcatctccgctggtagaatcatctacgttgatgatggtgttttgtctttccaagttttggaagtcgttgacgacaagactttgaaggtcaaggctttgaacgccggtaagatctgttcccacaagggtgtcaacttaccaggtaccgatgtcgatttgccagctttgtctgaaaaggacaaggaagatttgagattcggtgtcaagaacggtgtccacatggtcttcgcttctttcatcagaaccgccaacgatgttttgaccatcagagaagtcttgggtgaacaaggtaaggacgtcaagatcattgtcaagattgaaaaccaacaaggtgttaacaacttcgacgaaatcttgaaggtcactgacggtgttatggttgccagaggtgacttgggtattgaaatcccagccccagaagtcttggctgtccaaaagaaattgattgctaagtctaacttggctggtaagccagttatctgtgctacccaaatgttggaatccatgacttacaacccaagaccaaccagagctgaagtttccgatgtcggtaacgctatcttggatggtgctgactgtgttatgttgtctggtgaaaccgccaagggtaactacccaatcaacgccgttaccactatggctgaaaccgctgtcattgctgaacaagctatcgcttacttgccaaactacgatgacatgagaaactgtactccaaagccaacctccaccaccgaaaccgtcgctgcctccgctgtcgctgctgttttcgaacaaaaggccaaggctatcattgtcttgtccacttccggtaccaccccaagattggtttccaagtacagaccaaactgtccaatcatcttggttaccagatgcccaagagctgctagattctctcacttgtacagaggtgtcttcccattcgttttcgaaaaggaacctgtctctgactggactgatgatgttgaagcccgtatcaacttcggtattgaaaaggctaaggaattcggtatcttgaagaagggtgacacttacgtttccatccaaggtttcaaggccggtgctggtcactccaacactttgcaagtctctaccgtttaaaaaaagaatcatgattgaatgaagatattatttttttgaattatattttttaaattttatataaagacatggtttttcttttcaactcaaataaagatttataagttacttaaataacatacattttataaggtattctataaaaagataacttatgttattgttaacctttttgtctccaattgtcgtcataacgatgaggtgttcgatttttggaaacgagattgacatagagtcaaaatttgctaaatttgatccctcccatcgcaagataatcttccctcaag

SEQ ID NO: 7249 - protein, 500 aa, Saccharomyces cerevisiae
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETVAASAVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 7250 - DNA, 1461 bp, Vibrio cholerae
  CDS (1)..(1461)
atgtgtaaaaccaaaattgtggccactttaggccctgctagccaaactcgtgaaactttgactcaactcatccaagctggcgtgaacgtggttcgcttgaacttttctcacggcagcgctgaagaacacattgctcgcgcggaaatggtgcgtgagatcgcgcagcagctcaatgtgagcgttggcgtactggttgatctacaaggccctaaaattcgtatcgcttgctttgcagaaggcgcgattcaactctctgcaggcgacacatttattcttgatggccatttagatggtcaagccggtacgcaagagcgcgtgggtttagactacccagaactaattgatgatctaaacgtaggcaacatcctgctcctcgatgatggccgcattcaactggaagtcacggccgtcgatatgcaagctcgccttgttcacaccatcgcactcaatagtggcaaactgtccaaccgtaaaggcattaacttgcttggcggcggtctttccgctccggctctcacagaaaaagacaagctcgacattattactgcggcggagctgcaagccgacttcttagccgtctctttcccacgcaatgcggaagatattgaatacgcgcgccaactcgccactcaagcaggctgccatgcgcacattgtcgccaaagttgagcgcgcagaagtggtagccagtgaagaagcgatggacagcgttattcgcgcgtctgatgtgatcatggtggcgcggggtgatttgggcgtggaaattggtgatgctcgtttgccaagcgtacaaaaagcgctgatcgcgcgtgctaagcacttaggtaaacctgtcatcaccgccacgcaaatgatggaatcgatgatcgaaaacccactgccgacacgcgcagaagtcttggatgtcgcgaatgcggtgattgatggtactgatgcgatcatgctttctgcggaatcggccgcgggacgctaccctgtggaaacagtgcaagccatggtgcgcatcgcccaaggggttgagcacgaaactcactgtgcgcaaaattgttgggatgcgctacaacatctgtgcagcgatgcgggcaaaagctttgctctgtcatcgatgatttcagcatccaaagtcaataaagatctcggtgttgcgattgtgactgagcaaggtgaaacgccgcttttgatgtcacgctgtcaaagccaagccaccatttgggcggtgtctgataaacctgcgctactgcgtaagcttgctattttgcgtggtgtcacaccgacctatttcccacatttagataagcaaggtgatattgcgactcagctgattcatttgctgcgtaaacccgcacaagagaaaaaaatcgcctcgattttggtcactcaactggaatcggtcgaaggggttggtcacgtcaacgtgtgccgactactgaatttggcgcagcaggaagccctgttcgcctaa

SEQ ID NO: 7251 - protein, 486 aa, Vibrio cholerae
MCKTKIVATLGPASQTRETLTQLIQAGVNVVRLNFSHGSAEEHIARAEMVREIAQQLNVSVGVLVDLQGPKIRIACFAEGAIQLSAGDTFILDGHLDGQAGTQERVGLDYPELIDDLNVGNILLLDDGRIQLEVTAVDMQARLVHTIALNSGKLSNRKGINLLGGGLSAPALTEKDKLDIITAAELQADFLAVSFPRNAEDIEYARQLATQAGCHAHIVAKVERAEVVASEEAMDSVIRASDVIMVARGDLGVEIGDARLPSVQKALIARAKHLGKPVITATQMMESMIENPLPTRAEVLDVANAVIDGTDAIMLSAESAAGRYPVETVQAMVRIAQGVEHETHCAQNCWDALQHLCSDAGKSFALSSMISASKVNKDLGVAIVTEQGETPLLMSRCQSQATIWAVSDKPALLRKLAILRGVTPTYFPHLDKQGDIATQLIHLLRKPAQEKKIASILVTQLESVEGVGHVNVCRLLNLAQQEALFA

SEQ ID NO: 7252 - DNA, 1455 bp, Chlamydophila pneumoniae, Chlamydia pneumoniae
  CDS (1)..(1455)
atgatcacacgcactaaaattatttgcactatagggccagcaacgaatagtccagagatgttagcaaaacttctagatgctgggatgaacgtagcaagattaaatttcagtcatgggagtcacgaaactcatggacaggctattggatttctcaaggagttaagggagcagaagcgggttcctttagcaattatgctagatactaaggggcctgaaattcgtttagggaatattcctcagccaatttcggtttctcagggacaaaagcttcgtctggtaagtagtgatatcgatgggagtgctgaagggggagtgtctctctatcctaaggggatatttccctttgttcctgagggtgctgatgttttaatagatgatggctacattcatgctgttgttgtctcttcagaggctgattctttagaattagagtttatgaacagtggccttctcaagtctcataaatctttgagtatccgaggtgttgatgttgctcttccctttatgacagagaaagatattgcggatcttaagtttggggtagagcagaatatggatgtgaatgctgcatcttttgtgcgctacggtgaagatattgaaactatgcgcaagtgtttagcagacttaggcaatcctaagatgcccatcattgcaaaaatagaaaatcgtttaggggtagaaaatttctctaagattgccaagcttgcggatggaattatgattgctagaggagatttaggaatcgagctttctgtcgttgaagtcccaaatttgcaaaagatgatggctaaggtttctagagaaacaggtcacttctgtgtgactgcaacgcagatgctagaatctatgattcgcaatgtcttacctacacgagctgaagtctctgatattgccaatgcaatttatgatggttcttcagcagtgatgttgtcaggggaaactgcatctggagcccatcccgtggctgccgtgaaaatcatgcgttctgtgattttagaaacagaaaagaatctctcccatgattcattcttaaaattagacgatagcaatagcgctcttcaggtgtccccctatctctcagccattggattggcaggcattcagattgcagaaagggcagacgccaaagctcttattgtttatacagaatcaggaagttctccgatgtttctctctaaatatcgtccgaaattccctatcattgccgtgactccaagcacttctgtttactatcgcctagctttggaatggggggtctatcctatgcttacccaggaaagtgatcgcgctgtatggagacatcaggcctgtatttatggcatagaacagggcattctctctaattatgatcggattcttgtgcttagcagaggagcctgtatggaagaaacaaataatcttaccctgacaatagtgaatgatattttgactgggtcggaatttcctgaaacctag

SEQ ID NO: 7253 - protein, 484 aa, Chlamydophila pneumoniae, Chlamydia pneumoniae
MITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVNAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 7254 - DNA, 1419 bp, Clostridium acetobutylicum
  CDS (1)..(1419)
atgcaaaaaacaaaaatgatttttacaatagggccctctagtgattcagaggagaaattaaaagaattaatgaatgctggaatgaatgctgcaaggttaaatttttcacatggcactcatgaagatcacaaagaaaaaatagatattataaaaaaacttagaaaagaactgaacaaaaatgttgcaattgtagttgacatcaaaggaccaaaaattagaactcataattttgaaaatgacaaagctgaaataaaaaaaggtcaaaccttcacagtaatgtgtggaagcgaaattttgggaaattcagagaaatgctccgtttcttatgatgatctttataaagatgtaaaaaaaggtggattactccttgtcgatgatggtcttttagaatttgaaataactgatgtacaagacaaaaacattatttgtaaggcaaaaaataatggtattatttcaaatcataaaggtgtaaatgtacctggtgtttctataggtcttcctgctgtaactgaaaaagatgtattagatttaaaatttgcatgtaaaatgcaagctgatttagtagctgcttcttttataagaaaagcagaagatgtatctgtcgttagaaaggttcttaaagaaaatggtggagaagatataagagttatctctaagatagaaactcaagaaggtgttgataacatcgataagattctcgaactatctgatggaatcatggtagcaagaggagatatgggtgttgaaattccaatagaggatgttccttcaatacagaaaatgataataagaaaatgtaatgatgcaggcaaaatagttataacagctactcaaatgcttgattcaatgataagaaacccaagacctacaagagctgaggcatcagatgttgccaatgcaatatatgacggaacagatgctataatgctaagtggagaaagtgcaagtggtttatatccaattgaagctgctgaaactatggcaaagatagcacaaaaaacagaatctcaaatagactatactaaagctcttaatgaaagaaaaggtgaaattataacaaaaatttcagacgctataagtcttgctgcatgctcaactgctgctgaacttaaagctgctgctataataacagctactcaaagcggtataactgcaagaatggtatctaaattcagaccaacttgccctataatagctgttacacctcatgatgatgttgcaagaagacttgctctaaactttggtataacacctattacatctgaaaaagttgtttcaacagatgaacttatatctgtttcaataaaaagagcacttaacgagaatttaattaaaaaaggtgacttagttgttgtagttgcaggtgttcctgtaggcgaatctggaactactaatatgttaaaaattcaatacacataa

SEQ ID NO: 7255 - protein, 472 aa, Clostridium acetobutylicum
MQKTKMIFTIGPSSDSEEKLKELMNAGMNAARLNFSHGTHEDHKEKIDIIKKLRKELNKNVAIVVDIKGPKIRTHNFENDKAEIKKGQTFTVMCGSEILGNSEKCSVSYDDLYKDVKKGGLLLVDDGLLEFEITDVQDKNIICKAKNNGIISNHKGVNVPGVSIGLPAVTEKDVLDLKFACKMQADLVAASFIRKAEDVSVVRKVLKENGGEDIRVISKIETQEGVDNIDKILELSDGIMVARGDMGVEIPIEDVPSIQKMIIRKCNDAGKIVITATQMLDSMIRNPRPTRAEASDVANAIYDGTDAIMLSGESASGLYPIEAAETMAKIAQKTESQIDYTKALNERKGEIITKISDAISLAACSTAAELKAAAIITATQSGITARMVSKFRPTCPIIAVTPHDDVARRLALNFGITPITSEKVVSTDELISVSIKRALNENLIKKGDLVVVVAGVPVGESGTTNMLKIQYT

SEQ ID NO: 7256 - DNA, 1413 bp, Yersinia pestis
  CDS (1)..(1413)
atgaaaaagactaaaattgtttgtactatcggtccaaaaaccgaatccgaagaaatgctgacaaacctgctgaatgctggcatgaacgttatgcgtttaaacttctctcacggtgactatgcagagcacggtcaacgtatcaaaaacctccgggctgtaatggcaaaaacaggcaaaaaagccgcgattttgctggatactaaaggccctgaaatccggaccatgaaactggaaggcggcaaagatgctgcgctggttgcaggtcagaccttcacgttcacgactgatcaaagcgttgtcggtaacgacaaaattgttgcagtcacctacccaggcttcgccgctgacctgaaaattggtaacactgttctggttgacgatggcttgatcggtatggaagtcattgaagtcactgaacacaccgttgtctgtaaagtcttgaacagtggtgatttgggtgaaaacaaaggcgttaacctgccaggcgtgtcgatccaactgcccgcattagcagaaaaagataaaggcgacctgatcttcggttgcgaacaaggcgttgatttcgttgccgcctcctttatccgtaaacgttctgatgtactggaaattcgtgaacacctgaaagcacacggtggcgaacatatccagatcatctctaaaatcgaaaatcaggaaggtctgaataacttcgacgaaatcctggaagcctctgacggtatcatggttgcccgtggtgacttaggtgttgagatccctgtcgaagaagtcatcttcgcgcagaagatgatgatcgagaaatgtaaccgcgcacgtaaagttgttattactgcaactcaaatgctcgattccatgatcaaaaacccacgtcctacccgcgcagaagccggtgacgttgcaaacgccatccttgacggtaccgacgcggtcatgctgtccggcgaaagtgctaagggtaagtacccattagagtctgtcaccatcatggcgaccatctgtgagcgtacagaccgtgttatgcctagccgcattgagtcactgaacgacaaccgtaaaatgcgaatcactgaagccgtttgccgtggtgctgttgaaaccgcagaaaaactggaagccaaagtgattgtggtcgcaaccggggggggtaaatctgcaaaatctgtccgtaaatacttccctactgcgaccattctggcactgacgaccaatgaaatgacagcccatcagttaattctgactaaaggcgtaatcactcagttggtagacgaaatcgcctcaaccgatgatttctaccgtctcggtaaagaagcggctctggcgagcggcctggcacagaaaggcgacgtggtcatcatggtttcaggtgccttggtaccaagcggtacgaccaatacctcttcagtacacgtgttataa

SEQ ID NO: 7257 - protein, 470 aa, Yersinia pestis
MKKTKIVCTIGPKTESEEMLTNLLNAGMNVMRLNFSHGDYAEHGQRIKNLRAVMAKTGKKAAILLDTKGPEIRTMKLEGGKDAALVAGQTFTFTTDQSVVGNDKIVAVTYPGFAADLKIGNTVLVDDGLIGMEVIEVTEHTVVCKVLNSGDLGENKGVNLPGVSIQLPALAEKDKGDLIFGCEQGVDFVAASFIRKRSDVLEIREHLKAHGGEHIQIISKIENQEGLNNFDEILEASDGIMVARGDLGVEIPVEEVIFAQKMMIEKCNRARKVVITATQMLDSMIKNPRPTRAEAGDVANAILDGTDAVMLSGESAKGKYPLESVTIMATICERTDRVMPSRIESLNDNRKMRITEAVCRGAVETAEKLEAKVIVVATGGGKSAKSVRKYFPTATILALTTNEMTAHQLILTKGVITQLVDEIASTDDFYRLGKEAALASGLAQKGDVVIMVSGALVPSGTTNTSSVHVL

SEQ ID NO: 7258 - DNA, 1413 bp, Salmonella enterica subsp. enterica serovar Typhi
  CDS (1)..(1413)
atgaaaaagacgaaaattgtttgtactatcggtccgaaaaccgaatccgaagagatgttaagcaaaatgctggacgcgggcatgaacgtgatgcgtctgaacttctctcatggcgattatgcagaacacggtcagcgtatccagaacttgcgcaacgtgatgagcaaaactggtaaaaaagctgctattctgcttgatactaaaggaccagaaatccgcaccattaaactggaaggcggtaacgacgtttcgctgaaagcgggccaaacctttacttttaccaccgacaaatccgtggtcggtaataatgaaatcgttgccgtcacctatgaaggcttcaccagcgacctgagcgttggcaacaccgtcctggttgacgatggtctgatcggtatggaagtgaccgccatcgaaggcaataaagtcatttgtaaggtgctgaacaacggcgatctgggcgagaacaaaggcgttaacctgccgggcgtttctattgctctgccggcgctggctgaaaaagacaaacaggacctgatcttcggttgcgaacagggcgttgactttgttgctgcgtcctttatccgtaaacgttctgacgttgtcgaaattcgcgagcatctgaaagcccacggcggcgaaaacatccagattatctctaagatcgaaaaccaggaaggcctgaacaacttcgatgaaattctcgaagcttccgacggcatcatggttgcgcgtggcgacctgggcgtagaaatcccggttgaagaagtgatctttgcgcagaaaatgatgatcgaaaaatgtatccgcgcacgtaaagtcgtgatcaccgcgactcagatgctggattctatgatcaaaaatccgcgtccgacccgcgcagaagcaggcgatgttgcaaacgccatcctcgacggtacggatgcggttatgctgtccggcgaatccgcaaaagggaaatacccgctggaagccgtttctatcatggcgaccatctgcgaacgtaccgaccgcgtcatgaacagccgtctggactacaacaacgacagccgtaaactgcgcattacggaagcggtatgccgcggcgcggtagaaaccgccgaaaaattgaaagcgccgctgatcgtggtagcgacccagggcggtaaatccgctcgcgccgtgcgtaaatacttcccggacgccaccatcctggcattgaccaccaatgaagtgaccgcccgtcagttagtactgagcaaaggcgtggtatcgcagctggtgaaagaaatcaattctactgatgatttctaccgtctgggcaaagatgtcgccctacaaagcggcctcgcccagaaaggcgacgtcgtagtgatggtctccggcgcgctggttccaagcggcaccactaacaccgcctctgttcacgtactgtaa

SEQ ID NO: 7259 - protein, 470 aa, Salmonella enterica subsp. enterica serovar Typhi
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLKAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 7260 - DNA, 1758 bp, Listeria innocua
  CDS (1)..(1758)
atgaaaaaaacgaaaattgtttgtacaattggtcctgcaagtgagtcagttgacacattagttcagttgatcgaagcaggaatgaacgttgcacgtcttaatttctctcacggagattttgaagagcacggtgcgcgtattgtaaatatccgtgaagcatcgaaaaaaactggcaaacaagttgctatcttacttgatacaaaaggtccagaaatccgtacaaacgacatggtcggcggaaaattagaattccaaacaggtgacgttgtacgtgtatctatgactcctgttgaaggaacaaaagaaaaattctctgtaacttacggagaactttatgatgacgtagaaattggttcttccattttacttgatgacggtttaatcggtcttgaagtaatcgaaaaagacgaagctaatcgcgaactagtaactaaagtacttaacccaggtgtacttaaaaataaaaaaggtgttaacgtaccgaatgtttctatcaacctaccaggaatcacagaaaaagatgctgctgatatccgcttcggtttagaacaaggtattgactttatcgctgcatctttcgtacgtcgtgctacagatgttcttgaaattactaaaattttagaagagcataacgcaactcacgtacaaatcattcctaaaatcgaaaaccaagaaggcgttgacaacatcgacgaaatcttacaagtatctcaaggcttaatggttgctcgtggtgacctaggtgttgaaattccagctgaagaagttccgattgtacaaaaagaacttatcagaaaatgtaataaacttggtaaacctgttattactgctacacaaatgcttgattccatgcaacgtaacccacgtccaactcgcgctgaagcaagtgacgtagcgaatgcgatttttgatggaacagatgctattatgttatccggtgaaacagctgctggggattatccagtagaagcagttaaaatgatggcgaaaatcgctgttcgtactgaggaagttctagttgctcaagataaatttgcacttaaacttcatgaaaatacagatatgacagaagctatcggtcaagcagttggccatactgcgaaaaacctaaatgtacaaactatcgttgctgcgactcaaagtggtcacacagctcgtatgatttctaaataccgtccaaaatctcatatcgttgctgtaacattcaacgaacatgtatatcgcggattagctctttcttggggcgtatatcctcgtctagctactccagttagcaatacagacgaaatgtttgaccttgcagtaaaagaatctcttgcttcaggtgttgcgaaacaaggcgacctaatcatcatcactgctggtgttccagttacagaaagcggaacaacaaacgttatgaaaatccaattaattggtgaaaaagtagttaaaggccaaggtattggtagcaaatcagttattggtaaagcagtagttgctaaatccaatgcagaagctcttcaaaaagcagaagaaggcggaatcttaatcgttaaaacaactgataaagaaatccttcctgcattcgagaaaagtgctgcagttgttgtggaagaaggcggcttaactagccatgcagcagttgttggaatcaaccttggcattcctgtcatcgttggcgctaaagacgcaacatcccttgtaaaagacggtgaaatcatcactgttgattctcgtcaaggtgttgtatataacggcaaaacagcaactcactaa

SEQ ID NO: 7261 - protein, 585 aa, Listeria innocua
MKKTKIVCTIGPASESVDTLVQLIEAGMNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAVVAKSNAEALQKAEEGGILIVKTTDKEILPAFEKSAAVVVEEGGLTSHAAVVGINLGIPVIVGAKDATSLVKDGEIITVDSRQGVVYNGKTATH

SEQ ID NO: 7262 - DNA, 1431 bp, Nostoc sp. PCC 7120
  CDS (1)..(1431)
atgcgtcgaactaaaattatctgtactgtaggcccggctacatctgcaccagaacgtttagaagcgttggtagaagctgggatgaatgtagcacggctgaatttttctcatggagcttatgacttccatgcccaaactgctcagtatttgcggcaaatcagtgctgacagacaaaagcctgtggcgattatgcaagacctatgcgggccgaagattcgcttgggaactttaccaccagaagggttaatggtagaggctggtcaggaagtgacttttgtcttgcaagaaaagggtagtagtcttgatgaattgcctttacctttgccgaccttgttcgcaatggtacgacctggggaaccaatcttaattaatgatggtcgtgtcaagttgattgtgacagatcgcgatgccgatcgcattcgggctattgccaaaatcgggggtcttctttctacccgtaagggtgttaacctgccagcgactcgtttacctgtcagttccatcaccgaaaaggacttgcaggatttgcgttttggcatcgatttgagtgtagattgggtggcggtgtcttttgtgcgatcgccttatgacctcgaaccagcgcaacggatgattgaagcggcggggaaaactattcgggtaatcgccaaaattgaacgtccagaagccgttgagcaaattgattctatcatcgacgttgctgatgcgattatgattgctcgtggtgacttgggtgtggaaatgcctatccatgaagtcccattgattcaaaaggacatcattcgccgttgcaaccaagctggtaagcccgtgattacagcaacgcaaatgctagagtcgatgattagcgctcccgatcccacccgtgcggaggctacagacgttgctaactctattctcgatggtacagatgccgtcatgctctctggggaaacggctgtaggacaatatcccgtcgccgccgtccaggttatgcacgatatcgccgtgactacagaaaagtctttgcaagagggtagtaaacattgcttatcccatgaagcaggtggtctgagtgtcaccgaatctgtagctgaagcggtctgtcgtatcgcctacgaaacaggcgcaaaagcgattctttgcaacaccacatcagggagtacagcaaagctcgtgtcgaaatatcgtccgactacacccatttttgcgttgacccccgacgaaaccgcctaccatcagttagcactttcttggggtgtggaacctttattaaccccaccagtccacaatgcggaagaaatgtttatgaatctcatcaacaccgccgtgagaacgggtttggtgcatgacggtgacaaggtagttattacttctggagtgccaattggtaaatcaggcacaactagtttaattaaagtgcattctattggacaaccaatcaccgcctaa

SEQ ID NO: 7263 - protein, 476 aa, Nostoc sp. PCC 7120
MRRTKIICTVGPATSAPERLEALVEAGMNVARLNFSHGAYDFHAQTAQYLRQISADRQKPVAIMQDLCGPKIRLGTLPPEGLMVEAGQEVTFVLQEKGSSLDELPLPLPTLFAMVRPGEPILINDGRVKLIVTDRDADRIRAIAKIGGLLSTRKGVNLPATRLPVSSITEKDLQDLRFGIDLSVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQVMHDIAVTTEKSLQEGSKHCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITA

SEQ ID NO: 7264 - DNA, 1440 bp, Agrobacterium tumefaciens
  CDS (1)..(1440)
atgaagcgtaaccgcaaagtcaaaattcttgcaactctcggcccggcctcttccgaagaggccatgatcgaaaagctgcatcttgctggcgctgatcttttccggatcaacatgagccatgcgagccacgacgtgatgcggacgctcattcagcgtatccgctctgtcgaaagccgcaacggccgtcccatcggcattctggccgacctgcagggtcccaagctgcgcgtcggaaaattcgccgagacgaaggtcgatctggttccgggccagaccttcacgcttgataacaacgacacccccggcgacaacacccgcgttttcctgccgcatcctgaaattctcgaggcggtcaagcccggccaccgtctgctgatcgatgacggcaagctgcatctgcgcgctgaaaagagcgacggcaagagcatcgtcaccacggtcgtttccggcacccggatttccgaccgcaagggcatcagcctgcccgacaccctgctcggcgtcggcgttctgaccgacaaggaccgcgtcgacctcgatgccgttctcgagaccaacgaagtggactgggttgctctttccttcgttcagcgccctgaagacctggcagaagtgcgcaagatttcccgcggccgcgttggcctgatgtccaagatcgaaaagccgcaggctgttgaacgcatcgaggaaatcatcgagctttccgatgcattgatggttgcgcgcggcgatcttggcgtggaaatgccgttggaagccgttccgggcatccagaagcagctgacccgtgcctgccggcgcgccggcaaacccgtcgtcgttgccacccagatgctggaatcgatgataacggcaccggttccgacccgcgcggaagtatcggacgttgcaacggccgtattcgaaggcgccgacgccatcatgctctcggctgagtccgcttccggcgattatccgatcgaagccgtatcgaccatggcgtctatcgccagcacggtggaacaggacccctattattccaacatcatctacgcgcagcgtccgcagccggaagcaaccggtgccgacgccatttcgcttgccgcccgccagatcgctgaaacgctgaagcttgcggcgatcgtcacctatacgtcctcgggcacgaccggcctgcgcgccgcgcgcgagcggccgcaggtgccgatcattgcactgtcaccgatcatccagaccgcacgccgcctgtcggtcgtctggggcctgcactgcgtcgtcaccggcgatgccagcgatctggacgacatggtgaaccgcgcttgtcgcatcgttgtttccgaaggtttcggcaagcccggtgatcgcatcatcatttccgccggcgtgccgctcggcacccccggcgcaaccaacatggtgcgcatcgcctatatcggctcggacggccagagcggcgtctga

SEQ ID NO: 7265 - protein, 479 aa, Agrobacterium tumefaciens
MKRNRKVKILATLGPASSEEAMIEKLHLAGADLFRINMSHASHDVMRTLIQRIRSVESRNGRPIGILADLQGPKLRVGKFAETKVDLVPGQTFTLDNNDTPGDNTRVFLPHPEILEAVKPGHRLLIDDGKLHLRAEKSDGKSIVTTVVSGTRISDRKGISLPDTLLGVGVLTDKDRVDLDAVLETNEVDWVALSFVQRPEDLAEVRKISRGRVGLMSKIEKPQAVERIEEIIELSDALMVARGDLGVEMPLEAVPGIQKQLTRACRRAGKPVVVATQMLESMITAPVPTRAEVSDVATAVFEGADAIMLSAESASGDYPIEAVSTMASIASTVEQDPYYSNIIYAQRPQPEATGADAISLAARQIAETLKLAAIVTYTSSGTTGLRAARERPQVPIIALSPIIQTARRLSVVWGLHCVVTGDASDLDDMVNRACRIVVSEGFGKPGDRIIISAGVPLGTPGATNMVRIAYIGSDGQSGV

SEQ ID NO: 7266 - DNA, 1770 bp, Nostoc sp. PCC 7120
  CDS (1)..(1770)
atgcaattaagagattctgtacgccggacaaaaatcgtcgctacaattggccctgccactagtagccccgaaatgctgaaagccatcattgaagcgggtgcaacaacgctgcgactcaacttttcccacggttcccacgccgaccatcagcgtagtattcgcctaattcggcaaaccgcttttgaactaaatcagccagtggcaattctccaagatttgcaagggccaaaaattcgcttgggaaagtttgaaaacgggtctatagttttagctaaaggcgatcgcttcaccttaacaaatcgcccagttgttggtagtcaagaaattagctgtgtcacctacgattatttggcagatgaggtccctgtaggtgcaaaaatcctcctggatgatggccgtgtagaaatggtggtagaggatatcaaccgcgacaaaggggatttgaactgtcgggtgactgtagcaggtaagttatctaataacaaaggtgttaactttcctggcgtttatctctcaattaaagccatgaccgacaaagatcgtgaggatctgatgtttggtctagatcagggtgttgattgggtagccctttcctttgtccgcaatccgcaagacatcattgaaattaaagagctaatttccagcactggtaaacaagtgccggtagttgccaaaatagaaaagcatgaagcgatcgaacaaatggaagcagttctcgctttatgtgatggcgtaatggtggctagaggcgatttaggtgtagaactaccagcagaagatgtccccgtactacaaaagcgcttaattgccacagcaaaccgcttggggattcccatcatcactgctactcaaatgttagatagcatggtgagcaatccccgtcccacccgcgcggaagtgtccgatgtagccaatgccattcttgatggtacagatgcggtcatgctctccaatgaaacggctgtgggtagctacccagtggaagcagtggcgacaatggcaagaattgccgaacgcatcgagcaggaagaagctatggctagtaaattacgccaaatgcgagataaccgccgttctattcccaacgccatcagccaagctgtaggtcaaattgctgaacagttgggagcagcagcaattatgactctcacccaaacaggggcgactgcacgcaacgtttccaaattccgcccccaaacaccaatcttggcagtaacaccccacgttaacgtagctcgtcaactacaaatggtgtggggcgtaaaacctttgttggtcttagaattaccttccactggtcaaactttccaagccgccattaacgtcgcccaagagcatagtttactgtttgaaggtgatttagtcgtgatgacagccgggacgttacaaggggtatctggctcaacggacttgattaaagttgaagtggtaacggcagttctaggacagggaattggtctaggacagggtttggtaagcggttgtgctagggttgctcacaccgggatggatgtggggaactttaacgctggtgatattttggttgcaccccgcacaggtgcagattttgtcgaggcgattcgcaaagccggcgggattattacagaggatgaaagtttaactagtcatgcggcggtgattggtttacgcctgggtgtgccggtgattgtaggtgtgaagaaagccacgcaagttatccgtgatggagcaattttgactctggatttgcaacgaggtttagtttattccggagcagtaggaactccttaa

SEQ ID NO: 7267 - protein, 589 aa, Nostoc sp. PCC 7120
MQLRDSVRRTKIVATIGPATSSPEMLKAIIEAGATTLRLNFSHGSHADHQRSIRLIRQTAFELNQPVAILQDLQGPKIRLGKFENGSIVLAKGDRFTLTNRPVVGSQEISCVTYDYLADEVPVGAKILLDDGRVEMVVEDINRDKGDLNCRVTVAGKLSNNKGVNFPGVYLSIKAMTDKDREDLMFGLDQGVDWVALSFVRNPQDIIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSYPVEAVATMARIAERIEQEEAMASKLRQMRDNRRSIPNAISQAVGQIAEQLGAAAIMTLTQTGATARNVSKFRPQTPILAVTPHVNVARQLQMVWGVKPLLVLELPSTGQTFQAAINVAQEHSLLFEGDLVVMTAGTLQGVSGSTDLIKVEVVTAVLGQGIGLGQGLVSGCARVAHTGMDVGNFNAGDILVAPRTGADFVEAIRKAGGIITEDESLTSHAAVIGLRLGVPVIVGVKKATQVIRDGAILTLDLQRGLVYSGAVGTP

SEQ ID NO: 7268 - DNA, 1401 bp, Thermotoga maritima
  CDS (1)..(1401)
atgcgaagtacaaagatcgtatgtacggtcggaccaagaacagacagctatgaaatgatagaaaagatgatagaccttggagtgaacgtcttcagaataaacacctcacatggtgactggaacgagcaggaacagaaaatactcaaaataaaagatctgagagagaaaaagaaaaaacccgtagccattctgatcgatcttgcggggccgaagatcagaaccggatacctcgaaaaagagtttgtggaattaaaagaaggccagatcttcactctcaccacaaaggaaatacttggaaacgaacacatagtctcggtgaatctcagctctcttccaaaggacgtgaagaaaggagacaccattctgctgagcgatggagagatagtgcttgaggtaattgaaacaaccgatacagaagtgaaaacagtggtgaaagtcggtggaaagatcacacacaggagaggtgtgaacgtaccgacggccgatctttcggtggaatccataacggacagagacagagaattcataaaactcggaacgttgcatgacgttgaatttttcgctctttcttttgtgagaaagccagaggacgtgctcaaggcaaaagaagagatcagaaaacacggaaaggaaatacctgtaatctccaaaatagaaacgaaaaaggctctggagcgtctcgaggagataataaaggtgagcgatggaatcatggtcgcacgcggtgacctgggagtggagatacccatagaagaagtccccatcgttcagaaagaaatcatcaaactctccaagtactactccaaaccagtcatagtcgcaactcagatactcgaatcgatgatagaaaatccgttccccacgagggcagaggtcaccgacatagccaacgccatcttcgatggagcggacgccctgctcctcacagcggaaacagcggttggaaaacatcccctggaagccataaaggtgctgagtaaagtagcaaaagaagccgaaaaaaaactggaatttttcagaacgatagaatacgataccagcgacatatctgaggctatatcacacgcctgctggcagctctctgaatctctgaacgcgaagctgatcatcacacctaccatatccgggagtaccgctgttcgtgtttcaaagtacaacgtttctcaacccattgtggccctgacaccagaagagaaaacctactacagactttctctcgtgaggaaggtgatacccgttctcgctgaaaaatgttcccaggaattagagtttatcgaaaaagggctgaagaaagtagaagaaatgggtttggcagaaaaaggggatctggtggttctcacttccggcgttccaggaaaggtgggaacgacaaacaccataagggtgttgaaggtggattga

SEQ ID NO: 7269 - protein, 466 aa, Thermotoga maritima
MRSTKIVCTVGPRTDSYEMIEKMIDLGVNVFRINTSHGDWNEQEQKILKIKDLREKKKKPVAILIDLAGPKIRTGYLEKEFVELKEGQIFTLTTKEILGNEHIVSVNLSSLPKDVKKGDTILLSDGEIVLEVIETTDTEVKTVVKVGGKITHRRGVNVPTADLSVESITDRDREFIKLGTLHDVEFFALSFVRKPEDVLKAKEEIRKHGKEIPVISKIETKKALERLEEIIKVSDGIMVARGDLGVEIPIEEVPIVQKEIIKLSKYYSKPVIVATQILESMIENPFPTRAEVTDIANAIFDGADALLLTAETAVGKHPLEAIKVLSKVAKEAEKKLEFFRTIEYDTSDISEAISHACWQLSESLNAKLIITPTISGSTAVRVSKYNVSQPIVALTPEEKTYYRLSLVRKVIPVLAEKCSQELEFIEKGLKKVEEMGLAEKGDLVVLTSGVPGKVGTTNTIRVLKVD

SEQ ID NO: 7270 - DNA, 1377 bp, Aeropyrum pernix
  CDS (1)..(1377)
atgagggggcctgtcaagatagtcgccacggtagggccatcatcatcctctgcctccatactagcacagatgctcagcctaggagttgatgtggctaggataaacgccagccacgggggtgtagagcagtggaatagcatgctggagtcgcttaggagggctgaggaggctgtcgggaagagggtcggagtggctgtcgacctagagggccctagggttaggactggtaacagcgagcctgttaagctggagaagggtgatctcgttacactaggcttcatggagggcgacgtgccggttgacgccagacagtttttcgaaacaatagacgagggcgatatagtgcttctcgacgacgggaagataatcctccaggtggagtctgtggaggggttccgggttaaagccagggttctagagggtggagtgctagggcctaggaagggcgtggttgttagaggtaaggagcccgatctcccgccactctcggctaaggataggagggcgctcgagttcttcgctgacaagggggtcagccacgtctatgtgagcttcgcccgcagtgctgaacatgttgagaaggttcgtaccgtggtgagaaggctcggactgaggcaggccaggattttcgccaagatagaggggcctagcggcgtgtctaggataggagagattgctgaggccagcgatggcgtgataatagctagaggagacctcgggatgcactacagcctagaggagctcccggagattcaggagcttatagtatgggaggctaggaagaggtacaagactgttgtgctagccacggagttcctgtcaagcatgatcgagaagccggtccccactagaagcgaggtagtcgatatataccaggcggtgcttcagacggcggacgcgctcatgctgacgggtgagactgccataggcaagtaccccgtcaagtctgtacagtggatggcaaagatatcctcccgagcctacaaaaagctggcgactagccccccggagaggcccaggcccacgtcgaccccctacaagctagcattggggcttgtagagctggcggagagcctcgactcccctctagtcgtctacagtaagaccggcaggttcgccgagaggcttgcaagcttcaagccgctcaaaaccttctacgtgggggtgcccagccgtgaggtggagagggttgtcagacacctctggggggctgagcccatagttgtgggcgattatccctacgaagcgggcctcgccaagacctatgagaagcttcgtagagagaacattatacacggtgatgaaaccgtggttgaggcggcctggagcagcgagaggggaatatacataatcagagttaggaacctggagttctag

SEQ ID NO: 7271 - protein, 458 aa, Aeropyrum pernix
MRGPVKIVATVGPSSSSASILAQMLSLGVDVARINASHGGVEQWNSMLESLRRAEEAVGKRVGVAVDLEGPRVRTGNSEPVKLEKGDLVTLGFMEGDVPVDARQFFETIDEGDIVLLDDGKIILQVESVEGFRVKARVLEGGVLGPRKGVVVRGKEPDLPPLSAKDRRALEFFADKGVSHVYVSFARSAEHVEKVRTVVRRLGLRQARIFAKIEGPSGVSRIGEIAEASDGVIIARGDLGMHYSLEELPEIQELIVWEARKRYKTVVLATEFLSSMIEKPVPTRSEVVDIYQAVLQTADALMLTGETAIGKYPVKSVQWMAKISSRAYKKLATSPPERPRPTSTPYKLALGLVELAESLDSPLVVYSKTGRFAERLASFKPLKTFYVGVPSREVERVVRHLWGAEPIVVGDYPYEAGLAKTYEKLRRENIIHGDETVVEAAWSSERGIYIIRVRNLEF

SEQ ID NO: 7272 - DNA, 1449 bp, Deinococcus radiodurans
  CDS (1)..(1449)
atgaaacactttgaccgtgccaccaaaatcgtggcgactgtcggccccgccagccgcagcaccgaagttctcgggcgcatgatcgacgttggcctgaacgtggtccgcctcaacttcagccacggcgacctcgaagaccaccgtcagacggtgcagatggtgcgtgacctcgccgtgagcaagggcgtgaccatcggtatcctgcaagacctgcaaggccccaagattcgggtgggccgctttgccgaaggttcggtgaccctgaatcccgggcagaagttcgtcatcacgatggacgaggtggagggcaatgccgagcgcgtgggcagcacctacaagggcctcgccggtgacgtgacccccggcatgacgctgctgctcgacgacggcaacatgagcctgcgggtggaccacgtgcgcggcaacgacattcagacgactgtcctgatcggcggcacgttgaaaaacaacaagggcatcaacgtgcccgaagccgacctgaccgtgcccgcactgtcggaaaaagatgtgcaggacatggaatttggcgcgagcctcggcgtggactgggtggccttgagcttcgtgcgctcgcgcgatgacctgctgctcgcccggcattacctcgcccgcttcggcagccgcgccaagctgatggccaaaatcgagaagccgcaggcggtggaccgcttcgccgacatcctcaaggaagtggacggcgtgatggtggcgcgcggcgacctcggtgtggaaatgcgccccgagcaggtgccgaccatccagaaacgcatcatccgcatgtgccgtgaggcgggcaagccggtcattacggccacccagatgctcgaaagcatgatcaacctgccgcgccccacccgcgccgaggcgtcggacgtggcgaacgctatttatgacggcaccgacgcggtgatgctttccgccgaatcggcggcgggccagtacccggtcgagtcggtcgctatgatggaccgtattgcccgcgaggccgaagcgagcgagctttaccagttgatgcagcgtcaggtcgtgatggacaccgagcaggcgcaggacgccattgcgctcgccgcctgcaacatcggggctaagctcgaagcgcccgccatcgtgacctttaccagcacgggcggggcggccacccgcatttccaagaaccgtccgccgctcgccatcgtcgcgctgacccccaacgagatcacccgcaaccagctcgcgctttcctggggcgtctaccccatgctcagcgaagaccccgaggacaccgatgacatggtacgcatcgccaacgacgagctgaaaaagagcggcctggccgacgtgggcgaccgctacgtgattacggcgggcgtgcccttcggcgtgcgcggcaccaccaatatgctgcgcgtggaaaagttgaaggccgaggacttgtcggaccgcgtttaa

SEQ ID NO: 7273 - protein, 482 aa, Deinococcus radiodurans
MKHFDRATKIVATVGPASRSTEVLGRMIDVGLNVVRLNFSHGDLEDHRQTVQMVRDLAVSKGVTIGILQDLQGPKIRVGRFAEGSVTLNPGQKFVITMDEVEGNAERVGSTYKGLAGDVTPGMTLLLDDGNMSLRVDHVRGNDIQTTVLIGGTLKNNKGINVPEADLTVPALSEKDVQDMEFGASLGVDWVALSFVRSRDDLLLARHYLARFGSRAKLMAKIEKPQAVDRFADILKEVDGVMVARGDLGVEMRPEQVPTIQKRIIRMCREAGKPVITATQMLESMINLPRPTRAEASDVANAIYDGTDAVMLSAESAAGQYPVESVAMMDRIAREAEASELYQLMQRQVVMDTEQAQDAIALAACNIGAKLEAPAIVTFTSTGGAATRISKNRPPLAIVALTPNEITRNQLALSWGVYPMLSEDPEDTDDMVRIANDELKKSGLADVGDRYVITAGVPFGVRGTTNMLRVEKLKAEDLSDRV

SEQ ID NO: 7274 - DNA, 1446 bp, Vibrio cholerae
  CDS (1)..(1446)
atgagctcaactttgcgtagaacaaaaatcgtcgccaccttaggtccttccacagaaagccctgaaattctcgaagccattatccgagccggagccaatgtcgttcggatgaatttttcacacggcaccgcggaagaccataaaaaccgtgcgcagaaagttcgcgaaattgccgccaaactcggtcgccacgtcgccttattaggtgatttacaaggtccaaaaattcgtgtttctactttcaaagaaggcaaaattatccttaatgaaggggaacacttcattcttgatgcggaattagccaaaggggaaggtacgcaagaaagcgtggggattgattacaaaaagctaccgcaagatgtttgtaacgacgatattttgctgcttgatgatggccgtgtgcagttacaagttatgcgagttgaaggcaataaaatccacaccaaagtcttggtcggcggtcctctctccaacaataaagggattaacaaaaaaggcggcggtttgtcggcagatgctttgactgagaaagacaaaaatgacattcgacttgcggcagaaattcaagttgagtacctcgcggtgtctttccctcgcaatggtgaagacatgaaattcgcgcgccgccttgcccaagaatctgggctttatgcgcgtatggtcgccaaagttgaacgcgcagaaaccgtctcttgtgatgaaaacattgatgatattgttcgtgcctcggatgtcatcatggtcgcacggggtgatctcggggtggaaatcggtgaccccgaactcatcgccgtacagaaaaagctgatttcacgcgcgaaaaaactcaaccgtgtggtgattaccgcaacgcaaatgatggaatcgatgatcagtaaccctatgccaacccgcgccgaagtcatggatgtggcgaatgcggtgctcgatggcactgacgctgtgatgctgtcgggagaaacggctgcgggcaaatatccggttgaaaccgtcaaagcgatggctgaagtctgcattggtgcagaaaagatgattgagtcgaatgagcaaaactatcgcattaaaagtgtgttccgcacggaagaagaagcgattgctatgtcgactatctatgcagccaaccacttagaaggcgttaaagccatggtcacgctcaccgaatcaggacgcaccgcattaatgacctcaaggctcaattccgtattcccgatttttgcgatgtctgccaaccaagcaaccctcaatcgctgcgcgttattgcgcggggtgatccctttctacttcgataccaaacaagccagcggtctggaagcagccattgcagcattagatgccctcaaagagcgaaacctactcgaagaaggggatctcgtgatcattacccaaggcgatattatgggagtcgaaggctccaccaactgtatgcgcatcttacctgtctattag

SEQ ID NO: 7275 - protein, 481 aa, Vibrio cholerae
MSSTLRRTKIVATLGPSTESPEILEAIIRAGANVVRMNFSHGTAEDHKNRAQKVREIAAKLGRHVALLGDLQGPKIRVSTFKEGKIILNEGEHFILDAELAKGEGTQESVGIDYKKLPQDVCNDDILLLDDGRVQLQVMRVEGNKIHTKVLVGGPLSNNKGINKKGGGLSADALTEKDKNDIRLAAEIQVEYLAVSFPRNGEDMKFARRLAQESGLYARMVAKVERAETVSCDENIDDIVRASDVIMVARGDLGVEIGDPELIAVQKKLISRAKKLNRVVITATQMMESMISNPMPTRAEVMDVANAVLDGTDAVMLSGETAAGKYPVETVKAMAEVCIGAEKMIESNEQNYRIKSVFRTEEEAIAMSTIYAANHLEGVKAMVTLTESGRTALMTSRLNSVFPIFAMSANQATLNRCALLRGVIPFYFDTKQASGLEAAIAALDALKERNLLEEGDLVIITQGDIMGVEGSTNCMRILPVY

SEQ ID NO: 7276 - DNA, 1740 bp, Halobacterium sp. NRC-1
  CDS (1)..(1740)
atgagaaacgcgaagatcgtctgtacgctcggccccgcgaccaacgacgacgcgtcggtgcgggcgctcgcggacgccggcatgacggtagcacggatcaacgccagccacggcgacgcggccgcgcgccgggagctcatcgagaccacgcgggccgtcgacgcccagaccgacaagccgcttgcggtgatgctcgacacccaaggcccggaggtcaggaccgcaccgatcgacgacgacggcaccatccacatcgaaaccggcagcgacgtggcgttcgtcgagggcgacaccgcgacccccgatcggatcgggatctccaccagcatcgcggccgccgaacccggtgacacggtgttgctcgacgacggccgcatcgaggccgacgtcgaccgcgtcgccggcgacacggtgcacgccaccgtggtgtccggcgggagcctcggcagccggaagggcgtcaacgtgccgggcgtcgagctggacgtggacgtcgtcaccgagaaggaccgccgcgatctggcgttggccgccgagctggacgtcgattacgtggcggcgagcttcgtccgggacgccgacgacgtgttggccgtcaaccgcgtcctggagtcccacggtgccgacatccccatcgtggcgaagatcgagcgggcgggtgccgtggagaacctggacggcatcatcgacgccgcccagggcgtgatggtggcgcgcggcgatctcggcgtggagtgtccgatggaggacgtgccgatgatccaaaagcgcatcatcgcgcagtgccgggacgcgggggtgccggtgatcaccgcgaccgagatgctggactcgatggtgcacgcccggcgtccgacgcgcgcggaggccagcgacgtggccaacgcggtcctggacggcaccgacggcgtgatgttgtccgcggagaccgcggtgggggacaaccccacgcgggttgtcgagacgatggaccgcatcgtgcgggaggtcgaaggcagcgcggagtacagcgagcgccaggagcaggcggtgccgacggccgacgggacggcgaagacggacgcgctggcgcggtcggcgcggtatctggcccgcgacatcgacgccagcgcggtggtggtggcctccgagtcggggtacaccgcccggaaggccgcgaagttccggcccagcgtcccggtggtctgtgcgacgccgtcccacgacgtgcgccggcagctcgcgctcaactggggggtccacgccaactacgcggcggtcgcggagggcgacgcgacgacggtcgtcgagcgcgcggtgcaggcggccgtcgactccggcgtggtggcgagcggcgacaccgtggtggtgctcgtgggcatgatgacggagcttgagggcgcatcgacgacgaacacgctgaaagtgcacgtggccgcggagacgctctcgaccgggcgggcggtcgtcgacgggcggacgaccggccggacgtaccgtgccgacagcggggatctcagcgacgccccggagaacgcggtggtgctgttggcgcacgggttcgacggcgagttcgacggcgatctctcgaagatcggggcgatcgtgagcgcggacgccgggctgaccgggtatccggcggtgatcgcgcgcgaactcgacgtgccgatggtcggcgatgtcgacgtggacgcggtgccggctggcgatctggtgaccgtggacggcgagcgcggcgtcgtctacgaggccgatcagtga

SEQ ID NO: 7277 - protein, 579 aa, Halobacterium sp. NRC-1
MRNAKIVCTLGPATNDDASVRALADAGMTVARINASHGDAAARRELIETTRAVDAQTDKPLAVMLDTQGPEVRTAPIDDDGTIHIETGSDVAFVEGDTATPDRIGISTSIAAAEPGDTVLLDDGRIEADVDRVAGDTVHATVVSGGSLGSRKGVNVPGVELDVDVVTEKDRRDLALAAELDVDYVAASFVRDADDVLAVNRVLESHGADIPIVAKIERAGAVENLDGIIDAAQGVMVARGDLGVECPMEDVPMIQKRIIAQCRDAGVPVITATEMLDSMVHARRPTRAEASDVANAVLDGTDGVMLSAETAVGDNPTRVVETMDRIVREVEGSAEYSERQEQAVPTADGTAKTDALARSARYLARDIDASAVVVASESGYTARKAAKFRPSVPVVCATPSHDVRRQLALNWGVHANYAAVAEGDATTVVERAVQAAVDSGVVASGDTVVVLVGMMTELEGASTTNTLKVHVAAETLSTGRAVVDGRTTGRTYRADSGDLSDAPENAVVLLAHGFDGEFDGDLSKIGAIVSADAGLTGYPAVIARELDVPMVGDVDVDAVPAGDLVTVDGERGVVYEADQ

SEQ ID NO: 7278 - DNA, 1437 bp, Haemophilus influenzae
  CDS (1)..(1437)
atgtctagaagactaagaagaacgaagattgtatgtactatgggcccatcaactgaccgtgataacaatcttgaaaaaattatcgcagcgggcgcaaacgtagttcgtatgaacttctctcacggtacacctgatgaccatatcggacgtgctgaacgtgtacgttctattgcgaaaaaattaggtaaaaccgtggcaatcttaggtgatttacaaggtcctaaaattcgtgtttctacttttaaagacggtaaaattttcttaaacgttggcgataaattcattcttgatgcagagttaccaaaaggcgaaggcactcaagaatccgttggtttagactataaaacgcttcctcaagatgttgtgccgggcgatattcttttattagatgatggccgtgttcaattaaaagtattatcaactgatggtgcaaaagttttcactgaagttactgttggtggtccattatcaaataataaaggtatcaataaattaggtggcggtttatctgcggatgccctaacagaaaaagataaagccgacattattaccgctgcacgcattggtgttgatttcttagccgtttctttccctcgttcaagtgcagatttaaattatgcacgtgaacttgctcaacaagcaggtttaaatgcaaaaatcgttgctaaagttgaacgtgcagaaaccgttgctaatgatgaagccatggacgatattattttagcctctgatgtaattatggttgcacgtggtgacttaggtgtagaaatcggcgatcctgaattagtcggtgtacagaaaaaattaatccgtcgttcacgtcaattaaatcgtgctgtaattacagcgactcaaatgatggaatcaatgattagtaacccaatgccaactcgtgctgaagtaatggacgttgcaaacgcagtattagatggaactgatgcagttatgctttctgcagaaacagcagctggtcaatatccttctgaaacagtggcagcaatggctagcgtatgtttaggtgcagaaaaaatgccaagcattaacgtttctcgtcaccgtatggataaagaatttgaaactattgaagaatctgttgcgatgtctgcaatgtatgcagcaaaccacatgaaaggtgtagcggcaatcgtcactttaagtagcacaggccgtactccattattaatgtcacgcattagctctggcttaccaatctttgctttatctcgtaatcaagaaaccctaaacctttgtgcactataccgcggtgtaacaccaatttatcacggcgaagaaagtcgtacagaagctggtgcaaaagcagcacctcaatcattaaaagaaaaaggttatttatctactggcgatttagtgctggtaacccaaggtggtcaaggtgcgacacaaactaacgtatgtcgtacattaattgttgaataa

SEQ ID NO: 7279 - protein, 478 aa, Haemophilus influenzae
MSRRLRRTKIVCTMGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLSSTGRTPLLMSRISSGLPIFALSRNQETLNLCALYRGVTPIYHGEESRTEAGAKAAPQSLKEKGYLSTGDLVLVTQGGQGATQTNVCRTLIVE

SEQ ID NO: 7280 - DNA, 1434 bp, Borrelia burgdorferi (Lyme disease spirochete)
  CDS (1)..(1434)
atgatttcaaagttaacaaaaattgtagcaacaatatctgatcttagatgcgaaccagaacatataaaagatttacacgatgcaggggtaaatgttataagactaaatactgctcatcaatcacacgaagatacaataaaagtaatagacaatgttagaaaaatttcaaataaaatagctttaatgattgatacaaaaggaccagaagttagaacagcaaatattgaaaatcctattattgtaaaaactggagacaaggtaatcatttcaacctcgcctattaatgagcctaataactttcaaaccaattatgatggatttgttaaagaagtaccccaaggatctaaagtgctaattgatgacggtgaacttgaaatgactgttgttgccaaattgcctgacagattaatttgtgaaattaaaaatgacggccaaattaaaaataaaaaatcaatcaatacccccggaatttctcttaagctacaatcagtaaccgaaaaagacaaaggatttattgagcttgcagcaaaatataatgttgattttattgcccattcgtttgtaagacattccaaagacgttcaagatgttcaagaaattttaactgcctctggaaatcctgatgtaaaaattatatccaaaatcgaaaatcaagagggaattgacaacattgaagaaattgcaaaagcttcttacggaataatggttgcaaggggagacatgggagttgaaattcctgcagaagatgtacccattgctcaacttaaaataacacaaacctgtataaagtatggaatacccgtgattacagcaactcaaatgcttcatacaatgattgaaaatccaagacctactagagcagaagtgtctgacatcgctaacgctattttaaacggcacagacgcaattatgttatccggagaaaccgcctacgggaaatatccaattgaagctgtaaaaatgatgacaagcattgctaaaaaagttgaaaaacacagaaaaatgaccttatataaggatgaacttttttacgataaaagtatcacaagaaactatattatcaaatgtgcaattgatgccacaaaacttatggacataaaagcaattattgtagattctctaaaaggcaaaaccgcaagaataatggcaacctacagagcaagtgttccattattcattacaacaaatagcgaaagactagcaagagaattagcattatcttacggggtttattctaatcttgtagacaataatttcaaaagaactaccgaatttgtagtaacttctcttaaaatgttaaaagaacaaggtgttgttaatgacaaagatactgtaataattatttctggaaatccaaatagaaatattgaaaaaggaacagaatttatggaaataaacacagtagaagatgcaatcaaaggacgaaatatataa

SEQ ID NO: 7281 - protein, 477 aa, Borrelia burgdorferi (Lyme disease spirochete)
MISKLTKIVATISDLRCEPEHIKDLHDAGVNVIRLNTAHQSHEDTIKVIDNVRKISNKIALMIDTKGPEVRTANIENPIIVKTGDKVIISTSPINEPNNFQTNYDGFVKEVPQGSKVLIDDGELEMTVVAKLPDRLICEIKNDGQIKNKKSINTPGISLKLQSVTEKDKGFIELAAKYNVDFIAHSFVRHSKDVQDVQEILTASGNPDVKIISKIENQEGIDNIEEIAKASYGIMVARGDMGVEIPAEDVPIAQLKITQTCIKYGIPVITATQMLHTMIENPRPTRAEVSDIANAILNGTDAIMLSGETAYGKYPIEAVKMMTSIAKKVEKHRKMTLYKDELFYDKSITRNYIIKCAIDATKLMDIKAIIVDSLKGKTARIMATYRASVPLFITTNSERLARELALSYGVYSNLVDNNFKRTTEFVVTSLKMLKEQGVVNDKDTVIIISGNPNRNIEKGTEFMEINTVEDAIKGRNI

SEQ ID NO: 7282 - DNA, 1413 bp, Vibrio cholerae
  CDS (1)..(1413)
atgaaaaagaccaaaatcgtatgtacgattggcccaaaaactgagtctgtagagaaactgactgagcttgtaaacgctggcatgaatgttatgcgtctcaacttctctcacggtgactacgttgaacacggcactcgtatcactaacttccgtaaagtgatggaagtgaccggtaaacaactggcgatcctactggatactaaaggtccagagatccgtactatcaagctggaaaacggtgacgatgtggatctggtcgctggccaagagttcactttcacaactgacacgaaagttgttggtaacaaagagcgcgtagcagtcacttactctggttttgcaaaagacctgaacgtgggcaaccgtattctggttgacgacggtcttatagagatggaagtactggcgaccactgacactgaagtgaagtgtaaagttctgaacaacggcgctctgggtgaaaacaaaggtgttaacctgccaggcgtttctgtcaatctgccagcgctgtctgaaaaagacaaaaacgacctgaaatttggttgtgagcaaggcgttgatttcgttgctgcctctttcatccgtaaaggttctgacgtgaaagaaatccgtgaagtattagcttctcacggcggtcaaaacattcaaatcatctctaaaatcgaaaaccaagaaggcttggacaacttcgatgagatccttgagctgtctgacggcatcatggttgcacgtggcgacctaggtgtagaaatcccagcagaagaagttatcttcgctcaaaagatgatgatcgagaaatgtaaccgtgcacgtaaagtggttatcacggcgacgcaaatgctggattcaatgatcaagaacccacgtccaactcgcgcagaagcgggcgacgttgcgaacgcgatcatggatggtactgatgctgtaatgctttctggcgaaacagcaaaaggtaagtacccagttgaagcggtgaagatcatggcgcaaattgctgagcgtactgaccctgtactgaaagcagaactgggttcacgcctagacagcccacgtctacgtatcactgaagccgtatgtaaaggtgcagtagacaccgcagagaaactggcagcgccactgatcatcgtagcaactgaagcgggtaaatctgctcgttcagttcgtaagtacttcccaacggctaacattattgcagtcaccaccaacaagaaaacagcagctcagttagtgctttctaaaggtgtaacgccagttgtggttgacgcgattgacaacactgacgctttctaccacctaggtaaagagattgcgctgcaatctggccttggcaagaaaggcgacatcgtagtgatggtttcaggcgcactggttgcttctggcacaacgaacactgcatcagtacacgtactgtaa

SEQ ID NO: 7283 - protein, 470 aa, Vibrio cholerae
MKKTKIVCTIGPKTESVEKLTELVNAGMNVMRLNFSHGDYVEHGTRITNFRKVMEVTGKQLAILLDTKGPEIRTIKLENGDDVDLVAGQEFTFTTDTKVVGNKERVAVTYSGFAKDLNVGNRILVDDGLIEMEVLATTDTEVKCKVLNNGALGENKGVNLPGVSVNLPALSEKDKNDLKFGCEQGVDFVAASFIRKGSDVKEIREVLASHGGQNIQIISKIENQEGLDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVKIMAQIAERTDPVLKAELGSRLDSPRLRITEAVCKGAVDTAEKLAAPLIIVATEAGKSARSVRKYFPTANIIAVTTNKKTAAQLVLSKGVTPVVVDAIDNTDAFYHLGKEIALQSGLGKKGDIVVMVSGALVASGTTNTASVHVL

SEQ ID NO: 7284 - DNA, 1755 bp, Bacillus halodurans
  CDS (1)..(1755)
atgcgaaagacaaaaatcgtttgtacgatcggtccggcgagtgaaagtgtagaaaagttagaacaattaatggaagcaggcatgaatgttgcgcggttaaatttttcccatggggactttgaagagcacggtgcacgaatcaaaaacattcgagaagcagcgaaacgtatcggaaaaacagttgcaattttacttgatacaaaaggaccggaaattcgtacccaaacccttgaagggggcgtggccgaattaaaggcagggcaagagcttgtcatctctatgaaggaggttgtaggtacgagtgagcgtatttctgtcacatatccgggcctagttcatgatgttgtaccaggtgcaaaaattttattagatgatgggttaattgggctagaagtcgttgaggttcgcgatcaagagattttgacaaaagtcttgaacagcggcacattgaaaaataaaaaaggtgtcaatgtcccgaacgtaagcgtcaacctgcctggaatcacagaaaaagacgcagcggatatcaagtttgggatagagcaaggcgtcgatttcattgcagcttcattcgttcgcagagcgcaagatgtactagaaattcgcgaattgcttgagcagcacggggcagagcatattaaaatcatccctaagatcgagaatcaagaaggcgttgataacatcgaggaaattcttgaagtatcagacggtttgatggtggcccgcggagatctaggggtagagattcctgctgaggaagttccacttgtgcaaaagtcgcttattaagaaatgcaaccttgtagctaaacctgttattacagcgacacagatgcttgactcgatgcagcgtaacccacgtccaactcgagccgaagctagtgatgtagcgaatgcgatttttgatggaacggatgcgatcatgctttccggtgaaaccgcagctggggattatccagtcgaggcggttcagacgatgagccgaattgcagagcgtgcagagcaagccctaaactatcaagaaatcttgtccaagcatacaaaagaagcgagaacgacgattacgagtgctattagtcaatcggttggccacacagcattcaacttgaatgcaagtgcaatcttgacggcgactgaaagcggccatacagctcgcgtagtagcgaaataccgcccgaaatcaccaattgtagcagttacaagtaacgaaacagttgttcgtcaactcgctctcgtttggggagtgtattcaatccttggagaagaggcagagacgacggatgatatgcttcaagtgaccgttgagacagcgttaaagtcccaattggtgaaacaaggggatcttgtcgtcatcacggcaggtgttccagtgggagagacaggaacgacgaacattatgaaagttcacgtcattggtgaagtggtcgcgaaaggtcaaggcattggacgcgacacggtgaacggcaaagtcgtcattgctgctaatgcagaggaagcaaatgcaaaggttgaagaagggtcgattttagttactttcagcacggataaggatatgatgccagcctttgaaaaagcagccgccgtcattaccgaagaaggtgggattacatcccatgccgcagttgttggtctaagtcttaatacacctgtgatcgtcggtgtacaaaatgcgtctgcgctctttaaagatggggaagaaataacggtcgatacgagccgcggtgacatttacagagggcaagcaagtgtactataa

SEQ ID NO: 7285 - protein, 584 aa, Bacillus halodurans
MRKTKIVCTIGPASESVEKLEQLMEAGMNVARLNFSHGDFEEHGARIKNIREAAKRIGKTVAILLDTKGPEIRTQTLEGGVAELKAGQELVISMKEVVGTSERISVTYPGLVHDVVPGAKILLDDGLIGLEVVEVRDQEILTKVLNSGTLKNKKGVNVPNVSVNLPGITEKDAADIKFGIEQGVDFIAASFVRRAQDVLEIRELLEQHGAEHIKIIPKIENQEGVDNIEEILEVSDGLMVARGDLGVEIPAEEVPLVQKSLIKKCNLVAKPVITATQMLDSMQRNPRPTRAEASDVANAIFDGTDAIMLSGETAAGDYPVEAVQTMSRIAERAEQALNYQEILSKHTKEARTTITSAISQSVGHTAFNLNASAILTATESGHTARVVAKYRPKSPIVAVTSNETVVRQLALVWGVYSILGEEAETTDDMLQVTVETALKSQLVKQGDLVVITAGVPVGETGTTNIMKVHVIGEVVAKGQGIGRDTVNGKVVIAANAEEANAKVEEGSILVTFSTDKDMMPAFEKAAAVITEEGGITSHAAVVGLSLNTPVIVGVQNASALFKDGEEITVDTSRGDIYRGQASVL

SEQ ID NO: 7286 - DNA, 1443 bp, Buchnera sp
  CDS (1)..(1443)
atgttaaatcgattaagaagaacaaaaatcgtagctactttaggaccttctacagacattaataataatttagaaaaaataattcgttctggagtaaatgttcttcgatttaatttctctcatggttcaaaagatgaacataaatccagagcaaatcaagctcgagaaataatgactcgtttaaattttcacattgcattgcttggcgatttacaaggtcctaaaattcgcatttctaaatttataaaaaataatatttttttgaatgttggtgatttttttatattagatgcgaatttagatcaaaataatggaaatcaagaacgggtaggaattgattataaacagttaccatatgatctaaaagtaggtgatgtattattattagatgatggaagaatacaattaaaggttataaaatcaactggtcatgaaatattaacaaaagttgttatcggcggaatactttctaacaataaaggcattaataaactaggtggtggtttatctgcagatgcgttaactgaaaaagacaagaaggatataatcctagcaactgaaattaatgtagactatttagcaatatctttcccacgatgcagtaatgacttgaaacaagcaagaaaattagctaaagaatttggtagcaatgctaaaattatcgctaaaatagaacgtgctgaagctgtattaaatcaaaatactatcgaagatataattttagcatcagatgcaattatgatagctagaggcgatttaggtgtggaaattggagattctgaattagcaggtattcaaaaaaaattaatacgaactgctaggcaattaaatagaatagtaattactgctacacagatgatggaatctatgattactaacccattacctactcgtgcagaagttatggatgtagctaatgctgttttagatggcagtgatgcagttatgctttcggctgaaacagcatcaggcgaatatccagctgaaactgttataaaaatggcaaaaatttgcaaaggtgcagaaaaagttcctagtattaatgtatctagacatcgtattcatgcaaaatttgatgatattgaagaagcaattgctatgtccgcaatgtatgttgctaatcatttgaaaggtattacagcaattataacgatgacagaatcaggtaagactgcactaatgacatcgaggattacatctggattgcctatttttgctttatcaaaaaataaagaaactttaaatttagcaagtctttatagaggtgtgactcctatatattttaatagtaaaaataataattttaaagctgcgaatgaagcaattgttcttttacgtaaacgaggttttttatgtcgtggcgagttagttattataactcaaggtgatattatgggaaaaatcggaaaaactaatactagtagaattttaaaagtagtatga

SEQ ID NO: 7287 - protein, 480 aa, Buchnera sp
MLNRLRRTKIVATLGPSTDINNNLEKIIRSGVNVLRFNFSHGSKDEHKSRANQAREIMTRLNFHIALLGDLQGPKIRISKFIKNNIFLNVGDFFILDANLDQNNGNQERVGIDYKQLPYDLKVGDVLLLDDGRIQLKVIKSTGHEILTKVVIGGILSNNKGINKLGGGLSADALTEKDKKDIILATEINVDYLAISFPRCSNDLKQARKLAKEFGSNAKIIAKIERAEAVLNQNTIEDIILASDAIMIARGDLGVEIGDSELAGIQKKLIRTARQLNRIVITATQMMESMITNPLPTRAEVMDVANAVLDGSDAVMLSAETASGEYPAETVIKMAKICKGAEKVPSINVSRHRIHAKFDDIEEAIAMSAMYVANHLKGITAIITMTESGKTALMTSRITSGLPIFALSKNKETLNLASLYRGVTPIYFNSKNNNFKAANEAIVLLRKRGFLCRGELVIITQGDIMGKIGKTNTSRILKVV

SEQ ID NO: 7288 - DNA, 1344 bp, Methanococcus jannaschii
  CDS (1)..(1344)
atggtgggaatgatgagaaaaactaaaattttagtcactttaggaccatccttagaaaataaattagataaagcaataaatttgatagatggagttagatttaacatgtctcatgccacaacagattattgtgaaaagtttttgaatatattggaaaaaaataatatcgccaaagttatggatttgaagggaataaaaattagaattaaagaagttaaattaaaaaataaaatattaaaaatgggggagaaggttgttattggagaggatataaagctcaactacaatatagacacaattgaagaagggcattttattttaataaacgatgggaaaattaagctaagagttgtagaaaaaactgataaaattatcgcagttgtagaagttgggggagagattaaagaaggtatgggagttaatcttccagatacaaggatagaactcccaataattgatgaaactgatttgaagaatataaaattcgctgtagaaaaggactttgaatatattgctttatcatttgttaggaataaggaagatgttaaggaattaaaagatattatatcagaatacaaaggagattgtgaggtaatatcaaaaatagaaactaaggagggattaaagaatataaaagagatagcaagagaaagtgatggagtgatggtagcaaggggagatttgggtgtagaggttccaatagaaaatattccaattgaacaaaagaatatattgagaatagctaatagatatggaattttgtcaataacagccacacaaatattggattctatgataaacaatccatttccaacaagagctgaggttacagacatagctaatgccatatacgatggaactgactgcttaatgctctccaacgaaacaactattggaaaatacccaatagaggcgataaaggtattaaataaggttgccaaagtggcagatgaacattatgaggagtttggtgatagagtttgtttagaggttgagagcattgatgaaggtttagtatatgctgtttatgagctatataagaagctaaatactaagttagttataactccaacatattctggaagaactgctaagttaatatctaaattaaggataaatagtaaaataatagctccaacgccaaatataagaactttaaaaaggttgagattggtttggggagttgaaagctgtttgatggaagaatttgatgatatggagaaaataatcaacacctgtagagaaatggctaaaaaagaaattggaaaggggatttacttaatcacattaggtcatccaataggtcaaaagaaaactaacactataaaagttgaaagtatctaa

SEQ ID NO: 7289 - protein, 447 aa, Methanococcus jannaschii
MVGMMRKTKILVTLGPSLENKLDKAINLIDGVRFNMSHATTDYCEKFLNILEKNNIAKVMDLKGIKIRIKEVKLKNKILKMGEKVVIGEDIKLNYNIDTIEEGHFILINDGKIKLRVVEKTDKIIAVVEVGGEIKEGMGVNLPDTRIELPIIDETDLKNIKFAVEKDFEYIALSFVRNKEDVKELKDIISEYKGDCEVISKIETKEGLKNIKEIARESDGVMVARGDLGVEVPIENIPIEQKNILRIANRYGILSITATQILDSMINNPFPTRAEVTDIANAIYDGTDCLMLSNETTIGKYPIEAIKVLNKVAKVADEHYEEFGDRVCLEVESIDEGLVYAVYELYKKLNTKLVITPTYSGRTAKLISKLRINSKIIAPTPNIRTLKRLRLVWGVESCLMEEFDDMEKIINTCREMAKKEIGKGIYLITLGHPIGQKKTNTIKVESI

SEQ ID NO: 7290 - DNA, 1413 bp, Escherichia coli
  CDS (1)..(1413)
atgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccggaaatccgcaccatgaaactggaaggcggtaacgacgtttctctgaaagctggtcagacctttactttcaccactgataaatctgttatcggcaacagcgaaatggttgcggtaacgtatgaaggtttcactactgacctgtctgttggcaacaccgtactggttgacgatggtctgatcggtatggaagttaccgccattgaaggtaacaaagttatctgtaaagtgctgaacaacggtgacctgggcgaaaacaaaggtgtgaacctgcctggcgtttccattgctctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgcattaccgaagcggtatgccgtggtgccgttgaaactgctgaaaaactggatgctccgctgatcgtggttgctactcagggcggtaaatctgctcgcgcagtacgtaaatacttcccggatgccaccatcctggcactgaccaccaacgaaaaaacggctcatcagttggtactgagcaaaggcgttgtgccgcagcttgttaaagagatcacttctactgatgatttctaccgtctgggtaaagaactggctctgcagagcggtctggcacacaaaggtgacgttgtagttatggtttctggtgcactggtaccgagcggcactactaacaccgcatctgttcacgtcctgtaa

SEQ ID NO: 7291 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 7292 - DNA, 1434 bp, Pseudomonas aeruginosa
  CDS (1)..(1434)
atgacagccgacaagaaagccaagatcctcgccaccctcggcccggccacccgcagccgcgacgatatccgtgccctggtggaggccggcgccaacctgctccgcctgaacttcagccacggcgactatgccgatcacgcgcagcgcttcgcctgggtgcgcgaggtggaagcggagctgaactacccgatcggcgtgctcatggacctgcagggtccgaagctgcgggtcggccgcttcgccgccggtgccgtgcaattgcagcgtgggcagaccttcaccctcgacctcagcgacgcccccggcgacgagcggcgggtcaacctgccgcatccggagatcatccatgccctggaaccgggcatgagcctgctgctggacgacggcaagatccgcctggaagtggtcaactgccacagcgacgccatcgagacccgcgtggcggtgggtggcgagctgtccgatcgcaagggcgtcaacgtgccggaagcggtgctgcaactcagcccgctgaccgacaaggaccgccgcgatctggccttcggcctggaactgggggtcgactgggtggcgctgtccttcgtgcaacgcccggaggacatcgacgaggcccgtgggctgatcggcgacaaggccttcctcatggccaagatcgagaagcccagcgcggtgagcgccatcgaggcgatcgccgagcgcgccgacgcgatcatggtggcgcgcggcgacctcggcgtagaggtgccggcggagagcgtgccaggcatccagaaacgcatcgtccaggtctgccgccagctcggcaagccggtggtggtggccacccagatgctcgagtcgatgcgcttctcccccgccccgacccgcgccgaggtgaccgacgtagccaccgcggtgggcgccggcgccgacgcggtgatgctctcggcggaaaccgcttccggacaataccctcgcgaggcggtagagatgatggcgaagatcgtccgccaggtggaggccgagccggactaccacgtccagctcgaggtcaaccgtccgcagcccgacgctaccgtctccgatgcgatcagctgcgcgatccgccgggtcagccggatcctcccggtggcggtgctggtgaactacaccgagtcgggcaactcgaccctgcgcgccgcccgcgagcggcccaaggcgccgatcctcagcctgaccccgaacctgcgtaccgcgcggcgactgaccgtggcctggggcgtgtattcggtggtcaacgagcaactggcgcacgtcgacgagatctgctcgaccgccctcgacatcgccctggcccagcgcatggcgcgccgcggcgacaccgtggtggtcaccgccggcgtaccgttcggtcgccccggctcgaccaacatgctgcgcatcgagaccgtggcgccgccgctgggagatctctga

SEQ ID NO: 7293 - protein, 477 aa, Pseudomonas aeruginosa
MTADKKAKILATLGPATRSRDDIRALVEAGANLLRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNCHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGRPGSTNMLRIETVAPPLGDL

SEQ ID NO: 7294 - DNA, 1509 bp, Lactococcus lactis subsp. lactis
  CDS (1)..(1509)
atgaataaacgtgtaaaaatcgtctcaactcttggacctgctgtcgaaattcgtggtggcaaaaaatttggtgaaagcggctattggggagaatctcttgacgtcgaagcatcagcaaaaaacattgcagctttgattgaagaaggcgcaaatgtcttccgtttcaacttctcacacggtgaccatcctgaacaaggtgctcgtatggcaacagttcaccgcgctgaagaaatcgctggtcataaagtaggtttcttgcttgatactaaaggtcctgaaatgcgtacagaactctttgctgacggtgctgatgcaatcagcgttgttactggagataaattccgcgttgcaactaaacaaggtcttaaatcaactcctgaattgattgctttgaacgtagctggtggtcttgatatctttgatgatgttgaaatcggtcaaactattttgattgacgatggtaaacttggtttgtcattgactggtaaagatgcagcaactcgtgagtttgaagttgaagcacaaaatgatggcgttattggtaaacaaaaaggtgttaacattcctaacactaaaattcctttcccagctcttgctgaacgtgatgatgcggatatccgtttcggactttcacaacctggtggaatcaactttatcgctatctcattcgtacgtactgcaaatgacgttaaagaagtacgtcgtatttgtgaagaaactggaaatccacacgtacaacttttggctaaaattgaaaaccaacaaggtatcgaaaaccttgatgaaatcatcgaagcagctgatggtatcatgattgctcgtggtgacatgggtatcgaagttccatttgaaatggttccagtttaccaaaaattgatcatcagcaaagttaacaaagcaggtaaaatcgttgttactgcaacaaacatgcttgaatcaatgacttacaacccacgtgctactcgttcagaaatttcagacgtattcaacgctgttattgacggaactgacgcaacaatgctttcaggtgaatctgctaatggtaaatacccacgcgaatcagttcgtacaatggctactgttaacaaaaatgctcaaacaatgttgaaagaatacggacgtcttcacccagaacgttacgacaaatcaactgtaacagaagtagttgctgcatcagttaaaaacgctgcagaagctatggatatcaaattgattgttgctttgactgaatcaggtaacactgctcgtttgatttctaaacaccgtcctaatgctgatatcttggctattacatttgacgaaaaagttgaacgtggattgatgattaactggggtgtaatcccaacaatgactgaaaaaccttcatctacagatgacatgtttgaagttgctgaaaaagttgctttggcttcaggtttagttgaatctggtgacaatatcatcatcgttgctggtgttccagttggtactggtcgtacaaatacaatgcgtatccgcactgttaaataa

SEQ ID NO: 7295 - protein, 502 aa, Lactococcus lactis subsp. lactis
MNKRVKIVSTLGPAVEIRGGKKFGESGYWGESLDVEASAKNIAALIEEGANVFRFNFSHGDHPEQGARMATVHRAEEIAGHKVGFLLDTKGPEMRTELFADGADAISVVTGDKFRVATKQGLKSTPELIALNVAGGLDIFDDVEIGQTILIDDGKLGLSLTGKDAATREFEVEAQNDGVIGKQKGVNIPNTKIPFPALAERDDADIRFGLSQPGGINFIAISFVRTANDVKEVRRICEETGNPHVQLLAKIENQQGIENLDEIIEAADGIMIARGDMGIEVPFEMVPVYQKLIISKVNKAGKIVVTATNMLESMTYNPRATRSEISDVFNAVIDGTDATMLSGESANGKYPRESVRTMATVNKNAQTMLKEYGRLHPERYDKSTVTEVVAASVKNAAEAMDIKLIVALTESGNTARLISKHRPNADILAITFDEKVERGLMINWGVIPTMTEKPSSTDDMFEVAEKVALASGLVESGDNIIIVAGVPVGTGRTNTMRIRTVK

SEQ ID NO: 7296 - DNA, 1431 bp, Caulobacter crescentus
  CDS (1)..(1431)
atgatccgcgcccgtcgctcgcgcatcgtcgccaccctcggtccggcgtcgagctctttcgacatgatcgtcaccctggccaaggccggggctgacgtctttcgcctgaacttcagccacggcgcccacgagacccacgcggccgtctatgcggccattcgcgaggcggagaaggtcgtcaatcgcccgctgggcgtgctggccgaccttcaggggcctaagctgcgcgtcggcaagttcgccgatggtccggtgatgctgaaggccggccaggcgttccgcttcgacagcgatccggcgccgggcgacgagacgcgcgtgcatctcccgcacccggaaatcctgaccgccatgcggccgggcgcgaccctgctgctggacgacggcaagctgcggatgaccgtgacggatgcgggccccggctacgccaacaccaaggtcgtcaacagcggcaaactgtcggaacgcaagggcgtagcggtgccggatgtcgtcatcccgatgtcgccgctgaccgccaaggaccgtgaggacctggccttcgccctgcgcctgggcgtggactgggtggcgctgtcgttcgtgcaggcccctgaggatatggccgagctgcgccggatcgtcgaaggccgcgccgccgtgctggccaagatcgaaaagccgcaggcgctgaaggtgctgggcccgatcctggatctctgcgacggcgtcatggtggcgcgtggcgatctcggcgtcgaaatggcgcccgaggaggtgccggtcgcccagaaggaaatcctgcgcgcggcgcgtgagcggggcattcccgtgatcgtcgccacccagatgctggagtcgatgaccagctcgccgacccctacgcgggccgaggcgtcggacgtcgccaacgccgtctatgagggcgccgatgcggtgatgctgtcggcggagtcggcggcgggtgactatcccgaagagtcggtctcgatgatgaaccgcatcatcgaacgcgttgagcgtgacccgaagtggccagagctgatgtacgccgagcagagccacgacgacgtggacgccgacgtgctggtggtcgccgccgccggggcggccaagtcggggtccaccaagtgcctcgtggccttcaccaccacgggcgcgaccgcgcgccgcctctcgcgcgagcgccccttgcagccggtgctggccctgtcgcccgagatcagcgccgtgcgtcgcatgtgcctggtctggggtgtggagccgcgcgtcagcgctcagcccgacagcctggaggtcgtcacgacggacgcgtcgagcaaggcgttggagcttgggctggtggcgcccggtgagcgactgctggtcgtcgcgggcacgcccttcggcgctccgggcgcagcgaaccttctgcgcctggcgcatgcgcccgcgccggcgcgccggcgttag

SEQ ID NO: 7297 - protein, 476 aa, Caulobacter crescentus
MIRARRSRIVATLGPASSSFDMIVTLAKAGADVFRLNFSHGAHETHAAVYAAIREAEKVVNRPLGVLADLQGPKLRVGKFADGPVMLKAGQAFRFDSDPAPGDETRVHLPHPEILTAMRPGATLLLDDGKLRMTVTDAGPGYANTKVVNSGKLSERKGVAVPDVVIPMSPLTAKDREDLAFALRLGVDWVALSFVQAPEDMAELRRIVEGRAAVLAKIEKPQALKVLGPILDLCDGVMVARGDLGVEMAPEEVPVAQKEILRAARERGIPVIVATQMLESMTSSPTPTRAEASDVANAVYEGADAVMLSAESAAGDYPEESVSMMNRIIERVERDPKWPELMYAEQSHDDVDADVLVVAAAGAAKSGSTKCLVAFTTTGATARRLSRERPLQPVLALSPEISAVRRMCLVWGVEPRVSAQPDSLEVVTTDASSKALELGLVAPGERLLVVAGTPFGAPGAANLLRLAHAPAPARRR

SEQ ID NO: 7298 - DNA, 1452 bp, Pseudomonas aeruginosa
  CDS (1)..(1452)
atgtccgttcgccgcaccaaaatcgtcgccaccctcggcccagccagcaattccccggaagtgctggagcaactgatcctggccgggatcgacgtcgcccgcctcaacttctcccacggcacccccgatgaacaccgcgcccgcgccaggctggtgcgcgaactggcggccaagcacggccgcttcgtcgccctgctcggcgacctgcaaggaccgaagatccgcatcgccaagttcgccaacaagcgcatcgaattgcaggtcggcgacaagttccgcttctccaccagccacgcccgcgacgccggtacccaggaagtggtcggcatcgactacccggacctggtgaaggactgcggggtcggcgatgaactgctgctggacgacggccgggtggtgatggtggtcgaggaagtcgccgccgacgaactgcgctgccgggtgctgatcggcggcccgctgtccgaccacaagggcatcaaccgccgcggcggcggtctcaccgcgccggcgctgaccgacaaggacaaggccgacatcaagctggccgcggacatggacctggactacgtggccgtttccttcccgcgcgacgccaaggacatggaatacgcccgccgcctgctcaccgaggccggtggcaaagcctggctggtagccaagatcgagcgcgccgaggcggtcgccgacgacgacgcactcgacggcctgattcgtgccagcgacgcggtaatggtggcccgtggcgacctcggcgtggaaatcggcgatgccgagctggtcggcatccagaagaagatcatcctgcacgcccgccgcaacaataaagtggtgatcaccgcgacccagatgatggagtcgatgatccacagcccgatgccgacccgcgcggaagtctccgacgtggccaacgctgtgctcgactacaccgacgcggtgatgctctcggcggaaagcgccgccggcgagtacccggtggaagcggtgaaagccatggcccgcgtctgccagggcgccgagaagcacccgaccagccagaaatccagccaccgcctcggccagactttcgaccgctgcgacgagagcatcgccctggcgtcgatgtacacggccaaccacttcccggggatcaaggcgatcatctgcctgaccgaaagcggcttcaccccgctgatcatgtcgcgcatccgctcgtcggtaccgatctacgcctactccccgcaccgcgagacccaggctcgcgtggcgatgttccgcggcgtagaaaccatccccttcgacccggcggcgctgccggcggagaaggtcagccaggccgcggtcgacgagttgctcaagcgcggcgtggtgaccaagggcgactgggttatcctgaccaagggcgacagctacaccgcccagggcggcaccaacaccatgaaggtgctgcacgtcggcgacctgctggtataa

SEQ ID NO: 7299 - protein, 483 aa, Pseudomonas aeruginosa
MSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVKAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 7300 - DNA, 1437 bp, Pyrococcus horikoshii
  CDS (1)..(1437)
atgagaaggatgaagcttccctcccataaaacaaagattgtcgcaacgatagggccggcaactaactcgaaaaaaatgatcaaaaaattaattgaagctggcatgaacgttgcaagaataaacttttctcatggcacattcgaagagcatgcaaagatcatagagatggtgagggaacagtcacagaagttagataggagagttgcaatattagccgaccttcccggactgaagattagggttggggagataaaggggggatatgtggaacttgaaagaggggagaaagttactttgacaacaaaagatattgagggagatgaaacaacgatccccgtagaatataaggatttcccaaagcttgtatctaagggagatgtgatatacctaagcgatggctatatagtgttaagagtcgaagatgtaaaggagaatgaagttgaagcagtagttatttctggtggaaaactcttctcgaggaaagggataaacattccaaaggcctatcttcccgttgaagctataactccaagagatatagagataatgaagttcgcaatcgaacatggcgtcgatgcaataggactcagctttgttggaaacgtttacgatgtactaaaagcgaagagctttttggagagaaatggcgcaggtgacaccttcgttatagctaagatcgaaagacccgatgctgttagaaacttcaatgaaattctaaatgccgctgacgggattatgatagccaggggtgatctaggggttgagatgccaatagaacaacttccaattctccagaagaggttaattaggaaagccaacatggaaggaaagcctgtaattacggcaacccagatgctcgtttccatgacaatggaaaaagtcccaacaagagctgaagttacagacgttgccaatgcaatactagatggaaccgatgccgttatgttgtctgaagaaacagcagttggaaaattcccgattgaggccgtcgagatgatggcaaggatagcgaaagtaactgaggaatatagggaaagctttgggataaccagaatgcgagagttcctggaaggaacgaagaggggaacgataaaggaggcgataaccaggagtatcattgatgccatctgcactataggtataaagttcatattgacgccaactaaaacgggtagaacggcaagattgatctccagatttaagccaaagcagtggatacttgcattctctacgagggagaaagtttgcaataacctaatgttcagctatggagtgtatccattctgtatggaggaagggttcaatgagaatgacattgttaggttaataaagggactaggattggttggaagcgatgacatagttttgatgacggaaggtaagccgatagagaaaaccgttgggactaattcaataaagatattccaaatagcgtga

SEQ ID NO: 7301 - protein, 478 aa, Pyrococcus horikoshii
MRRMKLPSHKTKIVATIGPATNSKKMIKKLIEAGMNVARINFSHGTFEEHAKIIEMVREQSQKLDRRVAILADLPGLKIRVGEIKGGYVELERGEKVTLTTKDIEGDETTIPVEYKDFPKLVSKGDVIYLSDGYIVLRVEDVKENEVEAVVISGGKLFSRKGINIPKAYLPVEAITPRDIEIMKFAIEHGVDAIGLSFVGNVYDVLKAKSFLERNGAGDTFVIAKIERPDAVRNFNEILNAADGIMIARGDLGVEMPIEQLPILQKRLIRKANMEGKPVITATQMLVSMTMEKVPTRAEVTDVANAILDGTDAVMLSEETAVGKFPIEAVEMMARIAKVTEEYRESFGITRMREFLEGTKRGTIKEAITRSIIDAICTIGIKFILTPTKTGRTARLISRFKPKQWILAFSTREKVCNNLMFSYGVYPFCMEEGFNENDIVRLIKGLGLVGSDDIVLMTEGKPIEKTVGTNSIKIFQIA

SEQ ID NO: 7302 - DNA, 1443 bp, Campylobacter jejuni
  CDS (1)..(1443)
atgcttaaaaaaacaaaaattgtagccacagtaggtccagcaagtgaaaaggaagaaattctacgccaaatgattatcaatggtgtaaatgttttccgtttaaacttttctcatggaacacatgagtatcataaaaaaaacttagataccataagaagagtagctaaagaattgcatactcgtattggaattttacaagacattagtggtcctaaaattcgtacaggtgaacttaaagaaccatttgaattaaaaaagggtgatagacttgatttttatcgtgaaacaattttaggggagaagattgctcaaaatcattataaaatcagtatcaatcaaaaatccattttagatatgttaaaaattgatgaatatatttatctgtatgatggatcaattcgtgctaaagtagtaaatatagataatcaaaaaattgaaaccattatagaaaatgatggttttttaaactcaaataaaggtattaattttccgaatactaaaatcaatattgatgttattacacaaaaagataaaaatgatttactttggggtataaaaaatgaagtagattttttagcaatatctttcgtacaaaatgcgcacgatattgatgaagttcgtgaaattttagcacaaaataacgcaaaaatatctatttttgcaaaaattgaaaaatttgatgcagtagaaaatattgatgagattattaaatctagcgatggtataatggttgcaagaggagacttaggtattgaggtaccttattataaagttcctaatatccaaaaagaaattatacaaaaagcaaacaatgcctctaagcctgttattactgcgactcagatgcttttttcattagccaaaagcaaaaccgccacaagagctgaaatttcagatgttgcaaatgctgttttagatggaacagatgcagtaatgctaagtgaagaaagtgccgttggtatagatcctgcaaacgctgttgatataatgtgccaaactataatagaaacagaaaaacgctatccatataacaaatttaatgattttaatgatttagacaatacagataaaatcatgcgttcttcagctcatcttgcaacagatcttaacgctgatgctattttttctttaacaagtagcggaaaatctgctattaagattgcgagatatcgtccaaatatagaaatcatagcagtagggcattctgaaaaaaccttaaactctttaagtatagtttggggagttaatcctgcaatcttggttaacaaaagtaatgaacttacagaattattaaaagactctgtaagatcaagtgttgaaaaaggttttatggatgaagataaatgctatcttctaactgcaggctttccaacaggagtagaaggtactagcaatcttatccgcattctcaataaagagcaaattgcttattatctacaataa

SEQ ID NO: 7303 - protein, 480 aa, Campylobacter jejuni
MLKKTKIVATVGPASEKEEILRQMIINGVNVFRLNFSHGTHEYHKKNLDTIRRVAKELHTRIGILQDISGPKIRTGELKEPFELKKGDRLDFYRETILGEKIAQNHYKISINQKSILDMLKIDEYIYLYDGSIRAKVVNIDNQKIETIIENDGFLNSNKGINFPNTKINIDVITQKDKNDLLWGIKNEVDFLAISFVQNAHDIDEVREILAQNNAKISIFAKIEKFDAVENIDEIIKSSDGIMVARGDLGIEVPYYKVPNIQKEIIQKANNASKPVITATQMLFSLAKSKTATRAEISDVANAVLDGTDAVMLSEESAVGIDPANAVDIMCQTIIETEKRYPYNKFNDFNDLDNTDKIMRSSAHLATDLNADAIFSLTSSGKSAIKIARYRPNIEIIAVGHSEKTLNSLSIVWGVNPAILVNKSNELTELLKDSVRSSVEKGFMDEDKCYLLTAGFPTGVEGTSNLIRILNKEQIAYYLQ

SEQ ID NO: 7304 - DNA, 1446 bp, Chlamydia muridarum, Chlamydia trachomatis MoPn
  CDS (1)..(1446)
atgatcgctagaacaaaaattatttgtacaataggccctgcaacaaacaccccagaaatgcttgaaaaacttcttgatgcggggatgaatgtagcgcgtcttaacttcagtcatggtacccacgaaagccacggccggaccattgctattcttaaggaactacgcgaaaagcgccaagtccctttagctattatgttggatacaaaaggaccagaaattcgtttaggccaagtagaatctcctataaaagtgaagccaggagaccgtctcactttaaccagtaaagaaattttgggatccaaagaagctggagtcactctttatcctagctgcgtgttccctttcgttcgcgaacgcgctcccgtcctgattgatgatggatatatccaagccgtagttgtcaatgctcaagagcatctcattgagatagaatttcagaattcaggagaaatcaagtctaataaatcacttagcatcaaagatatagacgtagccctccccttcatgacagagaaggatatcacggatctaaaattcggggtcgaacaagaacttgaccttatcgcagcatcttttgtccgatgtaacgaagacatcgatagcatgcgtaaagttttagaaaacttcggccggccaaatatgccgatcattgccaaaatagaaaatcatttaggggtacaaaatttccaagaaatagccaaagcttctgatggaattatgatcgcacgaggagatctcggcatcgaattatctatcgttgaagtccctgccttacaaaaatttatggctcgtgtgtccagagaaacaggccgtttttgtatcaccgcaacacaaatgctcgagtcaatgattcgcaatccccttcctacacgagccgaagtttccgatgtagctaatgctatccacgatggaacttccgctgtgatgttatcaggagaaactgcttcaggaacttatcctatagaagctgtaaaaactatgcgctcgatcatccaagaaacggaaaaatcctttgattaccaagcctttttccaactcaatgacaaaaatagcgctctcaaagtctctccttatcttgaagcaataggcgcttcagggatccaaatcgctgagaaagcttctgctaaagcgattattgtatacacccaaactgggggatctcccatgtttctttctaaatatcgtccctatctccccattattgccgttaccccaaaccgcaatgtatactatcgcttagcagtagaatggggcgtataccctatgctaacctcagaatctaaccgaacagtttggcgccaccaagcttgtgtctatggagtagagaaaggaatcctttcaaactatgataaaattcttgtttttagccgaggagcagggatgcaggacacgaataaccttactctgactactgtaaacgatgttttatctccttctcttgaatga

SEQ ID NO: 7305 - protein, 481 aa, Chlamydia muridarum, Chlamydia trachomatis MoPn
MIARTKIICTIGPATNTPEMLEKLLDAGMNVARLNFSHGTHESHGRTIAILKELREKRQVPLAIMLDTKGPEIRLGQVESPIKVKPGDRLTLTSKEILGSKEAGVTLYPSCVFPFVRERAPVLIDDGYIQAVVVNAQEHLIEIEFQNSGEIKSNKSLSIKDIDVALPFMTEKDITDLKFGVEQELDLIAASFVRCNEDIDSMRKVLENFGRPNMPIIAKIENHLGVQNFQEIAKASDGIMIARGDLGIELSIVEVPALQKFMARVSRETGRFCITATQMLESMIRNPLPTRAEVSDVANAIHDGTSAVMLSGETASGTYPIEAVKTMRSIIQETEKSFDYQAFFQLNDKNSALKVSPYLEAIGASGIQIAEKASAKAIIVYTQTGGSPMFLSKYRPYLPIIAVTPNRNVYYRLAVEWGVYPMLTSESNRTVWRHQACVYGVEKGILSNYDKILVFSRGAGMQDTNNLTLTTVNDVLSPSLE

SEQ ID NO: 7306 - DNA, 1704 bp, Arabidopsis thaliana (mouse-ear cress)
  CDS (1)..(1704)
atggctgcttatggtcaaatctcctcgggaatgactgtagatcctcaggttctctcttcctccagaaacattggagtttccctatcacctctccggagaacactaatcggcgccggagttaggtctactagtatctctctccgtcaatgttctctctccgttagatcgattaaaatctccgaagatagccgcaaacctaaagcttatgcagagaacggtgcttttgatgtgggagttttggattcttcatcatatagattggctgattcaagaacaagtagtaatgattcaaggaggaagactaagattgtgtgtacgattggaccgtcttcgagttctagggaaatgatttggaaactcgcggaagctggaatgaatgtggctcgtttgaatatgtctcatggtgatcatgcttctcatcagataactattgatttagttaaggagtataattctttgtttgttgacaaagctattgctattatgttggatacaaagggtcctgaggttcgaagcggggatgtaccgcagccgatatttcttgaagagggtcaagagtttaactttactatcaagagaggtgtttcgcttaaagacactgttagtgtaaattatgatgattttgtgaacgatgttgaagttggggatatacttttggtggatggtggaatgatgtcgttagctgttaaatcaaagacgagtgatttggtgaagtgtgtggttattgatggtggagagcttcaatctagacgtcacttgaatgttcgaggaaagagtgcgactcttccatccattacagacaaagattgggaagacataaaatttggagtggacaaccaagtcgatttctacgccgtctcctttgttaaggatgctaaagttgtccatgagttgaagaactatctcaaaaacatatcggtgattgtgaaaattgaaagtgcagactctataaagaatcttccttctatcatatctgcttgtgatggggcaatggttgctcgtggagatcttggagctgaacttcccattgaagaggtcccgttgttacaggaagaaataatcagaaggtgtagaagcattcataaaccagtgattgttgccacaaacatgctagagagtatgattaatcatccaacgcctacaagagctgaagtctctgacattgcaattgcagtacgtgaaggcgcagatgctatcatgctttctggtgaaaccgcacatggaaagtttccgctgaaagctgttaacgtaatgcatactgtggcgttgagaaccgaggcaagtctacctgtcagaacctcggcatcccgtaccactgcttacaagggtcacatgggccaaatgtttgcttttcatgcttctataatggcaaatacactgagctcaccgctaattgtatttacgagaaccggatccatggcagtgcttctaagccactaccgcccatctgcaacaattttcgccttcacaaaccagagaagaataatgcaaaggcttgctctttatcaaggtgtcatgcctatatatatggagttctcggatgatgcagaagatacatatgcccggtctctcaaactcttacaggacgagaatatgctcaaggaaggacaacatgtaactcttgtccaaagtggctcgcaacccatttggcgtgaagaatcaacacatctcatacaagtccgtaagataaagataggtggatga

SEQ ID NO: 7307 - protein, 567 aa, Arabidopsis thaliana (mouse-ear cress)
MAAYGQISSGMTVDPQVLSSSRNIGVSLSPLRRTLIGAGVRSTSISLRQCSLSVRSIKISEDSRKPKAYAENGAFDVGVLDSSSYRLADSRTSSNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSLKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKNISVIVKIESADSIKNLPSIISACDGAMVARGDLGAELPIEEVPLLQEEIIRRCRSIHKPVIVATNMLESMINHPTPTRAEVSDIAIAVREGADAIMLSGETAHGKFPLKAVNVMHTVALRTEASLPVRTSASRTTAYKGHMGQMFAFHASIMANTLSSPLIVFTRTGSMAVLLSHYRPSATIFAFTNQRRIMQRLALYQGVMPIYMEFSDDAEDTYARSLKLLQDENMLKEGQHVTLVQSGSQPIWREESTHLIQVRKIKIGG

SEQ ID NO: 7308 - DNA, 1758 bp, Staphylococcus aureus
  CDS (1)..(1758)
atgagaaaaactaaaattgtatgtacaattggaccagcttcagaatcagaagaaatgattgagaaattaatcaatgctggtatgaacgttgcacgattaaacttttcacatggtagtcatgaagagcataaaggtagaattgatacaattcgtaaagtagctaaaagattagacaaaattgtagcaattttattagatacaaaaggtccagaaattcgtacgcataatatgaaagacggtatcattgaacttgaacgtggcaacgaagttattgttagcatgaatgaagttgaaggaacacctgaaaagttctcagtaacatatgaaaacttaattaacgatgttcaagtaggttcatacattttacttgatgatggcttaattgaattacaagttaaagatattgaccatgctaaaaaagaagttaaatgtgatattttaaactctggtgagcttaaaaacaaaaaaggtgttaacttacctggcgtaagagtaagtttacctggtattacagaaaaagatgctgaagatatccgtttcggtattaaagaaaatgttgacttcattgcagcaagtttcgtacgtcgtcctagtgatgttttagaaattcgtgaaattttagaagaacaaaaagctaacatttcagtattccctaaaattgaaaaccaagaaggtattgataatattgcggaaattcttgaagtgtctgatggtttaatggttgcacgtggtgacatgggtgttgaaattccacctgaaaaagtaccaatggttcaaaaagatttaatcagacaatgtaacaaattaggtaaaccagttattacagctacacaaatgttagattctatgcaacgtaacccacgtgctacacgtgcagaagctagtgacgttgccaacgcaatctatgatggtacagatgcagtaatgttatctggtgaaactgctgctggtttatatcctgaagaagctgttaaaacaatgagaaatattgctgtatcagctgaagcagcccaagattacaaaaagttattgtcagatcgtactaaattagttgaaacttcattagtgaatgctatcggtatttcggttgcacatacagctttaaacttaaatgttaaagcaattgtagctgctactgaaagtggttcaacggcacgtactatctccaaatatcgtccacattcagacattattgcggtgactccaagtgaagaaactgcacgtcaatgttcaattgtttggggagttcaacctgtagttaaaaaaggacgtaagagtacagatgcattgttaaacaatgcagttgcaacagctgttgaaactggtagagtatctaatggtgatttaatcattattactgctggtgtaccaactggtgaaactggaactactaatatgatgaaaatccacctagttggtgacgaaattgctaatggtcaaggtattggacgtggatcagttgttggtactacgttagttgctgaaactgttaaagatttagaaggtaaagatttatctgacaaagttatcgttactaactcaatcgatgaaacgtttgtaccttatgtagaaaaagctttaggcttaattacagaagaaaatggtattacatcaccaagtgcaattgttggtttagaaaaaggtattccaacagttgtaggtgtagaaaaagctgttaaaaacataagcaataacatgttagttacgattgatgctgctcaaggtaaaatctttgaaggatatgcaaacgtactataa

SEQ ID NO: 7309 - protein, 585 aa, Staphylococcus aureus
MRKTKIVCTIGPASESEEMIEKLINAGMNVARLNFSHGSHEEHKGRIDTIRKVAKRLDKIVAILLDTKGPEIRTHNMKDGIIELERGNEVIVSMNEVEGTPEKFSVTYENLINDVQVGSYILLDDGLIELQVKDIDHAKKEVKCDILNSGELKNKKGVNLPGVRVSLPGITEKDAEDIRFGIKENVDFIAASFVRRPSDVLEIREILEEQKANISVFPKIENQEGIDNIAEILEVSDGLMVARGDMGVEIPPEKVPMVQKDLIRQCNKLGKPVITATQMLDSMQRNPRATRAEASDVANAIYDGTDAVMLSGETAAGLYPEEAVKTMRNIAVSAEAAQDYKKLLSDRTKLVETSLVNAIGISVAHTALNLNVKAIVAATESGSTARTISKYRPHSDIIAVTPSEETARQCSIVWGVQPVVKKGRKSTDALLNNAVATAVETGRVSNGDLIIITAGVPTGETGTTNMMKIHLVGDEIANGQGIGRGSVVGTTLVAETVKDLEGKDLSDKVIVTNSIDETFVPYVEKALGLITEENGITSPSAIVGLEKGIPTVVGVEKAVKNISNNMLVTIDAAQGKIFEGYANVL

SEQ ID NO: 7310 - DNA, 1758 bp, Bacillus subtilis
  CDS (1)..(1758)
atgagaaaaactaaaattgtttgtaccatcggtccggcaagtgaaagtattgaaatgcttacgaaattaatggagtcaggaatgaacgtggctcgattaaacttttctcacggagattttgaggagcacggtgcaagaattaaaaatatccgcgaagcaagtaaaaaacttggcaagaacgttggaattctgcttgatacaaaaggtcctgaaatccgcacacatacaatggaaaacggcggtattgagcttgaaacaggcaaagagctcattatttcaatggacgaggttgtaggaacaacagataaaatttcagtgacatatgaaggtttagtccatgacgttgaacaaggttcaacgattctgttagatgacggccttatcggtcttgaggtacttgatgtagatgccgctaaacgcgaaatcaaaacaaaagtattaaacaacggaacactcaaaaataaaaaaggtgttaacgtaccgggcgtaagtgtcaatcttccggggattactgaaaaggatgcgcgagacatcgttttcggtattgagcaaggagtagacttcatcgcaccatctttcattcgacgttctacggatgtgctcgaaatccgtgagcttcttgaagagcacaacgctcaggatattcaaatcatccctaaaatcgaaaaccaagagggcgttgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcgacacaaatgcttgacagcatgcagcgcaacccgcgtccgactcgtgcggaagcaagtgacgttgcaaacgcgatcttcgacggaacagatgcgatcatgctttctggtgaaactgctgccggaagttacccggttgaagcagttcaaacaatgcataacatcgcgtcccgttctgaagaagcattaaattataaagaaattctctcaaaacgcagagaccaagtgggcatgacaattacagacgcaattggacaatctgtcgcacatacggcgattaacctgaatgctgctgcgatcgtaacgccgacagaaagcggccatacagcacgtatgattgcaaaataccgtccgcaggctccgattgttgcggttactgtaaatgactctatttccagaaagcttgccctcgtatctggcgtattcgcggaaagcggccaaaatgcgagctcaacagatgagatgcttgaggatgctgtccaaaaatcattgaacagcggaattgtaaaacacggcgatcttatcgttattacagctggcactgtcggtgagtccggcactacgaacttaatgaaggttcatactgtcggcgatatcatcgctaaaggccaaggcattggacgcaaatcagcttacggtccggttgtcgttgcacaaaatgcaaaagaagctgagcaaaaaatgactgacggtgcggtacttgttaccaaaagcactgaccgtgatatgattgcatcccttgaaaaagcgtctgctcttattacagaagaaggcggtttgactagccatgctgcggtagtcggattaagccttggcatcccggttatcgtgggtctggaaaatgcgacatctattttgacagatggccaggatattacagttgacgcttccagaggcgcagtctatcaaggccgtgcgagcgttctttaa

SEQ ID NO: 7311 - protein, 585 aa, Bacillus subtilis
MRKTKIVCTIGPASESIEMLTKLMESGMNVARLNFSHGDFEEHGARIKNIREASKKLGKNVGILLDTKGPEIRTHTMENGGIELETGKELIISMDEVVGTTDKISVTYEGLVHDVEQGSTILLDDGLIGLEVLDVDAAKREIKTKVLNNGTLKNKKGVNVPGVSVNLPGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMIASLEKASALITEEGGLTSHAAVVGLSLGIPVIVGLENATSILTDGQDITVDASRGAVYQGRASVL

SEQ ID NO: 7312 - DNA, 1419 bp, Mycobacterium tuberculosis
  CDS (1)..(1419)
atgacgagacgcgggaaaatcgtctgcactctcgggccggccacccagcgggacgacctggtcagagcgctggtcgaggccggaatggacgtcgcccgaatgaacttcagccacggcgactacgacgatcacaaggtcgcctatgagcgggtccgggtagcctccgacgccaccgggcgcgcggtcggcgtgctcgccgacctgcagggcccgaagatcaggttgggacgcttcgcctccggggccacccactgggccgaaggcgaaaccgtccggatcaccgtgggcgcctgcgagggcagccacgatcgggtgtccaccacctacaagcggctagcccaggacgcggtggccggtgaccgggtgctggtcgacgacggcaaagtcgcattggtggtcgacgccgtcgagggcgacgacgtggtctgcaccgtcgtcgaaggcggcccggtcagcgacaacaagggcatctcgttgcccggaatgaacgtgaccgcgccggccctgtcggagaaggacatcgaggatctcacgttcgcgctgaacctcggcgtcgacatggtggcgctttccttcgtccgctccccggccgatgtcgaactggtccacgaggtgatggatcggatcgggcgacgggtgccggtgatcgccaagctggagaagccggaagccatcgacaatctcgaagcgatcgtgctggcgttcgacgccgtcatggtcgctcggggcgacctaggtgttgagctgccgctcgaagaggtcccgctggtacagaagcgagccatccagatggcccgggagaacgccaagccggtcattgtggcgacccagatgctcgactcgatgatcgagaactcgcggccgacccgagctgaggcctccgacgtcgccaacgcggtgctcgatggcgccgacgcgctgatgctgtccggggaaacctcggtagggaagtacccccttgctgcggtccggacaatgtcgcgcatcatctgcgcggtcgaggagaactccacggccgcaccgccgttgacacacattccccggaccaagcgtggggtcatctcgtatgcggcccgtgacatcggcgaacgactcgacgccaaggccttggtggccttcactcagtccggtgataccgtgcggcgactggcccgcctgcataccccgctgccgctgctggccttcaccgcgtggcccgaggtgcgcagccaactggcgatgacctggggcaccgagacgttcatcgtgccgaagatgcagtccaccgatggcatgatccgccaggtcgacaaatcgctgctcgaactcgcccgctacaagcgtggtgacttggtggtcatcgtcgcgggtgcgccgccaggcacagtgggttcgaccaacctgatccacgtgcaccggatcggggaagatgacgtctag

SEQ ID NO: 7313 - protein, 472 aa, Mycobacterium tuberculosis
MTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLEKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 7314 - DNA, 1458 bp, Chlamydia trachomatis
  CDS (1)..(1458)
atgatcgctagaacgaaaattatttgtacgataggccctgcaacgaatacccctgagatgctggaaaagcttcttgatgcagggatgaatgtagctcgccttaattttagccacgggacccatgaaagccatggccggaccatcgctattcttaaagaactacgagagaagcgccaagttcctttagctattatgctagatacaaaaggtcccgaaattcgtttaggccaagtagaatctcctataaaagtacagcctggggatcgtcttactctcgttagcaaagaaattttaggatccaaagaaagcggcgttactctttatccaagttgtgtattcccttatgttagagaacgagctcctgttctcattgatgatgggtatatccaagcagtggtggtcaatgctcaagagcatatggtggaaatagagtttcaaaattcaggagaaataaaatccaacaaatctcttagcatcaaagatatcgatgttgctcttcctttcatgacagagaaggatattgcagacttaaaatttggggtagaacaagaactcgatcttatcgctgcttcgttcgtcagatgtaatgaagatattgacagcatgcgtaaagttttggaaagctttggtcgtcctaatatgcccatcattgctaaaatagaaaatcatttaggagtacaaaatttccaagagatcgctagagctgctgatggtatcatgattgcacgcggggatcttggtattgaattgtctattgttgaagttcctggactacaaaaatttatggcccgagcatcgagggaaacgggtcggttttgtatcactgcaacgcaaatgctcgagtcaatgattcgcaacccccttcctacacgagccgaagtctctgacgttgccaacgccatttacgatggaacctctgcagtcatgttgtctggagaaactgccttaggagcccatcctgtacatgcagtaaaaacaatgcgttccattatccaagagactgagaagactttcgattaccacgcttttttccagctgaacgacaaaaacagcgctctcaaagtttctccttatcttgaagccattgggttttctggaatccaaattgcagaaaaagcatctgccaaagccattattgtgtatacccagacgggaggatctccgatgtttttatccaaatatcgaccttatctccctattattgctgttacccctaaccgcaatgtgtactatcgtttagctgtagaatggggagtatatcctatgctaaccctagaatcgaaccgtacagtctggcgtcaccaagcttgtgtatatggagtagaaaaaggaattctttctaactatgataaaattcttgtcttcagccgcggagctgggatgcaagacaccaacaatctcaccttgacaactgtgcatgatgtgctatccccctctcttgacgagatagttccataa

SEQ ID NO: 7315 - protein, 485 aa, Chlamydia trachomatis
MIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESGVTLYPSCVFPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETALGAHPVHAVKTMRSIIQETEKTFDYHAFFQLNDKNSALKVSPYLEAIGFSGIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDVLSPSLDEIVP

SEQ ID NO: 7316 - DNA, 1437 bp, Pyrococcus abyssi
  CDS (1)..(1437)
atgattgccatgaggcttcctgatcacaagacaaagatagttgcaacaatagggcccgccacaagctctaggaatatgataaagaagctaatagaaaacggtgtgagcgttgtgaggctcaacttctctcacggtagctttgaggagcatgcaaaggtcatagagaaagtcagggatatatcacaaaagcttgacagaagggttgcaatattggccgacctcccaggattgaagattagagtgggcgagataaagggagggtacgtagagcttaagagaggtgagaaggtagttttgactacgagagatgttgttggggatgaaactacgattcccgtagagtacaaggacttcccaagattagtctccaagggcgacgtcatatacctaagtgacggttacatcgttcttagggttgaagaggtaaggggtcaagacgttgaggcagttgtcgtctctggtggaaaactgttctcaagaaagggaataaacattccaaaggcctacctaccagtggaggcagtaactcccagggacatggagataataaagttcgccatcgagcagggagttgatgcaataggcttaagctttgttggaagcgtttatgacgttctcaaggttaaaagtttcctcgagaagaatgatgccgaggacgtcttcgttatttcaaagatagaaagaccggacgcagtcaggaacttcgatgaaatcctgaaggcttcagatggcatcatgatagctagaggtgatcttggggttgagatgccgatagaaagattgccaatacttcagaaggagcttataagaaaggcaaacacggagggtaagccagtaataacagctactcagatgttagtttcaatgacggccgaaaaggttccaaccagagctgaagttacggacgttgccaacgcgatacttgacggaacagacgcggtcatgctctctgaggagaccgcgattggaaaattcccaatcgatgccgtcaagatgatggcaaagatagccaaggtcaccgaggagtacagggagagctttggaatgtcgaggctcagggaactcgtggaggatgggacaagggggacaataaaggaggcaatagcgagaagcataatagatgcgctctgcaccctaaacataaagtacatactaacccccactagaacgggcaggacggcaaggctcatctcgaggtttaagccaaagcagtggatatttgggttctccactaacgaaagggtttgcaacaacttgatgttcagctatggagtttatgcgttctgtctcgaggagggcttcgatgagagggacataataaggctaattaagggacttggactggttgagagtgacgacatagtgctgatgaccgagggtaagccaatagagaagaccatgggaacgaactccatcaagatattccagatagcgtga

SEQ ID NO: 7317 - protein, 478 aa, Pyrococcus abyssi
MIAMRLPDHKTKIVATIGPATSSRNMIKKLIENGVSVVRLNFSHGSFEEHAKVIEKVRDISQKLDRRVAILADLPGLKIRVGEIKGGYVELKRGEKVVLTTRDVVGDETTIPVEYKDFPRLVSKGDVIYLSDGYIVLRVEEVRGQDVEAVVVSGGKLFSRKGINIPKAYLPVEAVTPRDMEIIKFAIEQGVDAIGLSFVGSVYDVLKVKSFLEKNDAEDVFVISKIERPDAVRNFDEILKASDGIMIARGDLGVEMPIERLPILQKELIRKANTEGKPVITATQMLVSMTAEKVPTRAEVTDVANAILDGTDAVMLSEETAIGKFPIDAVKMMAKIAKVTEEYRESFGMSRLRELVEDGTRGTIKEAIARSIIDALCTLNIKYILTPTRTGRTARLISRFKPKQWIFGFSTNERVCNNLMFSYGVYAFCLEEGFDERDIIRLIKGLGLVESDDIVLMTEGKPIEKTMGTNSIKIFQIA

SEQ ID NO: 7318 - DNA, 1473 bp, Neisseria meningitidis
  CDS (1)..(1473)
atgaaccagacaagccgcgatctgacccgcatcagccacaacactaaaatcgtcgccacccttgggccgggcagcaacaacgtcgaactgttggaagacatgatccgcgtcggcggtctgaacgtcgtccgcttcaacttcagccacggcacgcccgaattccatcaggaaaacgcccgcatcgtgcgcgaggcggcaaaacgcaccggacaggaaatcgccatcattgccgacctgcagggcccgaaaatccgcgtgggcaaaatcgccggcggcggcatcgaattgaacaaaggcgaaacgctgggactggatgccgcgctcgaaggcgaaggcacgcgcgaggcggtcggtttggactaccgcgacctgcccgacgacgttgccgcaggcgatgtcttgtggctggacgacggcctgctgaccctgaccgtggaatccgtcgaaggcagcaggattatcacaagggtggaaaacagccacgtcctgaaaagcaacaagggcatcaacaaacgcggcggcggtctgtccgcaggcgcgttgaccgaaaaagacttccgcgacctgaaaaccgcgattgccatcggttgcgactatctcgccatcagctttgtgaaatccgccgaagatttgcacatcgcgcgcgccaaagtcgaagaagaaatgaaaggcagtacggccgtgcgccccggtttggtttccaaaatcgaacgcgtagaagcgattgaaaaccttgatgaaatcatcctcgccggcgacggcattatggttgcacgcggcgacttggcggtcgaagtcggacacgccgccgtccccgccctgcaaaaacggatgatccgccgcgcccgcgagttgcgccgcttcagcattacggcgacgcaaatgatggaatcgatgattaccaaccccgtgccgacccgcgcggaagtcagcgatgtggcaaacgcggtattggacggcaccgatgcggtgatgtgttccgccgaaaccgccgtcggcgcgtatccgtttgaaaccgtcagccaaatggcgattatctgcgcggctgcggaaaaagagcaggattcgctcaacggcgttgccgaacaggtcgagtatcccgaagcggtcagcaccaacctggcggttgccggcggtgcggtcagcgtggcgcgcgcggttcacgccaaagccatcgtcgccctgaccgaaagcggttcgaccgcctttgaaatcagccgccacaacatcaccctgccgattttcgcgctgaccccgagcgtttccgcccaacgccgtatggcgatgtaccggggcgtgcgcccgctgattttggcaaccagcaccgaccacgacacggcgttaaacgaagtcgaaaccatgctggtggaacacaacatcctgcattccggcgaccaatacatcattaccagcggctcgcaaatgcgcgaatccggttcgaccaatacgctggaagtgctgcgcgtcaaataa

SEQ ID NO: 7319 - protein, 490 aa, Neisseria meningitidis
MNQTSRDLTRISHNTKIVATLGPGSNNVELLEDMIRVGGLNVVRFNFSHGTPEFHQENARIVREAAKRTGQEIAIIADLQGPKIRVGKIAGGGIELNKGETLGLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 7320 - DNA, 1506 bp, Streptococcus pneumoniae
  CDS (1)..(1506)
atgaacaaacgtgtaaaaatcgttgcaactttgggtcctgcggtagaaatccgtggtggtaaaaaattcggtgaggacggatactggggtgaaaaacttgatgttgaagcttcagctaaaaacattgctaaattgattgaagctggtgctaacacattccgattcaacttctcacacggcgaccaccaagaacaaggtgagcgtatggcaactgttaaacttgcggaaaaaattgcaggtaaaaaagttggtttccttcttgatacaaaaggacctgaaatccgtacagaattgttcgaaggtgaagctaaagaatattcatacaaaactggtgaaaaaattcgtgttgcaactaaacaaggaatcaaatcaactcgtgaagtgattgcgttgaacgttgctggtgctcttgatatctatgatgatgttgaagttggtcgtcaagttttggttgacgatggtaaacttggtcttcgtgtggttgctaaagatgatgcaactcgtgaatttgaagttgaagttgaaaacgatggtatcatcgctaaacaaaaaggtgtgaacatccctaacactaaaattcctttcccagctcttgctgaacgcgataacgacgatatccgtttcggtcttgaacaaggtatcaacttcatcgcaatttcattcgtacgtactgcaaaagatgtgaacgaagttcgtgcaatctgtgaagaaactggaaacggacatgttcaattgttcgctaaaatcgaaaaccaacaaggtatcgataacttagacgaaatcatcgaagcagctgatggtattatgattgctcgtggtgatatgggtatcgaagtaccgttcgaaatggttccagtttatcaaaaaatgattatcaagaaagtcaatgctgcaggtaaagttgttatcactgcaacaaacatgcttgaaacaatgactgaaaaaccacgtgcaactcgttcagaagtatcagacgtattcaacgctgttatcgacggaactgacgctacaatgctgtcaggcgagtctgcaaacggtaaatacccactcgagtcagtaactacaatggctacaatcgacaagaacgctcaagctcttcttaatgaatacggacgtcttgattcagattcatttgagcgtaactctaagacagaagtaatggcttctgctgttaaagatgctactagctcaatggatatcaaattggttgtaactcttactaagacaggtcatactgcacgtttgatttctaaataccgtccaaatgctgacatcttagcattgacatttgacgaattgacagaacgtggcttgatgttgaactggggtgttatcccaatgttgacagatgctccatcttcaactgacgatatgttcgaaatcgctgaacgtaaagcggtagaagcaggtctcgttgagtcaggcgatgatatcgttatcgttgctggtgtgccagtaggagaagctgttcgcacaaacacaatgcgtatccgcacagtacgttaa

SEQ ID NO: 7321 - protein, 501 aa, Streptococcus pneumoniae
MNKRVKIVATLGPAVEIRGGKKFGEDGYWGEKLDVEASAKNIAKLIEAGANTFRFNFSHGDHQEQGERMATVKLAEKIAGKKVGFLLDTKGPEIRTELFEGEAKEYSYKTGEKIRVATKQGIKSTREVIALNVAGALDIYDDVEVGRQVLVDDGKLGLRVVAKDDATREFEVEVENDGIIAKQKGVNIPNTKIPFPALAERDNDDIRFGLEQGINFIAISFVRTAKDVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLTKTGHTARLISKYRPNADILALTFDELTERGLMLNWGVIPMLTDAPSSTDDMFEIAERKAVEAGLVESGDDIVIVAGVPVGEAVRTNTMRIRTVR

SEQ ID NO: 7322 - DNA, 1422 bp, Clostridium acetobutylicum
  CDS (1)..(1422)
atgcaaaaaactaaaatgatttttacagttggaccagcaagtgagacagaggagattgtaacagctttcataaaagctggaatgaatgcttcaagacataacttttcacacggtgatcatgcagagcacggtggaagaatagctttagtaaaaaaggttagagcaaagcttaataagcctgtagctatatgccttgatactaaaggaccagaaataagaactggagatttcaatccttcaaagcttgaacttcaaaaaggttcaaaatttactatcgtttgtggcgaagaaatagttggagatgctacaaaatgttcaatatcatataaagatttatacaaagatgtaaaaccaggaaacactatattaatagatgatggtttagttggacttacagtagaagctatagaaggaacaaatgtaatttgtactgtagcaaatacaggattagttggaagccataaaggagtaaatgttccaaacgtttcaatacaacttcctgcaatgacagaaaaagataagagcgatttaatattcggatgtaaagaagaaatagatatggtaagtgcatcattcataagaaaacctgaagatgtacttgcaataagaaaagtattaaatgagaatggcggagaaaacattcaaatattctctaaaattgaaaatcaagaaggcgtggacaacatagatgctattatagaagtttctgacggaataatggtagctagaggagatatgggagttgaaattcctatacaaagagttccattaatccaaaaaatgataatcaaaaaatgtaatgcagtaggaaaacctgttataacagcaactcaaatgcttgattcaatgatgagaaatccaagacctacaagagcagaagcttcagatatagcaaatgctatatttgatggaacagatgctataatgttaagtggagaaagcgctaatggatcatatccaatagaagctgtaactacaatggcaaaaatagcacaagaggcagaaaatgaaatcaattatgataaattcctagcagaaagaaaaggaaatgaaaagaaaaatacttctgatgtaataagtcttggaacttgcacagcagcagcagacttagaagcttcagcaataataactgcaactcaaacaggaagcacagcaagaacagtttcaaaatatagaccaaaagcacctgtaatagcagttactccatctgaaaaagtagcaagaaaacttgcaatgagctggggagtacaccctataatatctgataaatttggttcaactgatgaacttatctctacttcagtagataaagcccttgaagcaggatatgtacaaaaaggagatcttgtagttgtagctgcaggtgtaccaacaaatgtatcaggtactacaaacatgcttaaagttcaagttgttgagtaa

SEQ ID NO: 7323 - protein, 473 aa, Clostridium acetobutylicum
MQKTKMIFTVGPASETEEIVTAFIKAGMNASRHNFSHGDHAEHGGRIALVKKVRAKLNKPVAICLDTKGPEIRTGDFNPSKLELQKGSKFTIVCGEEIVGDATKCSISYKDLYKDVKPGNTILIDDGLVGLTVEAIEGTNVICTVANTGLVGSHKGVNVPNVSIQLPAMTEKDKSDLIFGCKEEIDMVSASFIRKPEDVLAIRKVLNENGGENIQIFSKIENQEGVDNIDAIIEVSDGIMVARGDMGVEIPIQRVPLIQKMIIKKCNAVGKPVITATQMLDSMMRNPRPTRAEASDIANAIFDGTDAIMLSGESANGSYPIEAVTTMAKIAQEAENEINYDKFLAERKGNEKKNTSDVISLGTCTAAADLEASAIITATQTGSTARTVSKYRPKAPVIAVTPSEKVARKLAMSWGVHPIISDKFGSTDELISTSVDKALEAGYVQKGDLVVVAAGVPTNVSGTTNMLKVQVVE

SEQ ID NO: 7324 - DNA, 1359 bp, Sulfolobus solfataricus
  CDS (1)..(1359)
atgagaaagactaaaatagttgctactttaggtccttcctcagaggaaaaagtaaaagaactggcagaatacgttgatgtttttagaataaattttgcacatggagacgaaacatctcataggaagtattttgatcttattagaacatatgcaccggaatctagtattatagtagatttgccagggcctaagttgagactaggagaactcaaagaaccaatagaggtgaagaaaggagataagatagttttctctcaaaaagatggaattccagttgatgatgagttattttattcggctgtaaaagaaaactcggatatcttaattgcagacggaacaatacgtgtgagggttaagtcaaaagctaaggatagagtagagggaaccgtaatagagggtggaattttattatcgagaaaaggaataaatattcctaatgtcaatctaaaatctgggataacggacaacgatttaaaacttttaaaaagagctttagatctgggagcagattatataggactctcttttgtaataagtgagaatgatgtaaagaaggtaaaggaatttgtaggtgatgaagcttgggttatcgcgaagatagaaaaaagtgaggcattaaagaacttaaccaatatcgttaatgaatcggatggaataatggtagccagaggcgatttgggggttgagactggcttagaaaatctgcctttaattcaaaggagaatagtaaggacttcaagagtatttggcaaacccgtcattttagcaactcaagtattaacttcgatgataaacagccctatacctaccagagctgagattatagatatttctaactcgattatgcagggagtggactctataatgttaagcgatgaaacagccataggcaattatccagttgaaagcgtaagaactcttcataatatcataagtaatgtagaaaagagtgtaaaacatagaccaatcggaccactaaatagtgagagtgatgcgatagctctagctgctgtaaatgcaagtaaagtatctaaggcagatgtaatagtagtgtatagtagatcaggtaattcaatattgcgcgtatcgagactgagacctgaacgtaacataataggagtctctcctgatcctagactagctaaaaagtttaagctttgttatggtgtaatacccattagtataaacaaaaagatgcagtccatagacgagataatagacgtctcagccaagctaatgcaggaaaaaataaaggacttaaaatttaaaaaaatcgttatagtaggaggggatcctaaacaagaagcggggaagactaacttcgttatagttaagacactagaacaacaaaagaaatga

SEQ ID NO: 7325 - protein, 452 aa, Sulfolobus solfataricus
MRKTKIVATLGPSSEEKVKELAEYVDVFRINFAHGDETSHRKYFDLIRTYAPESSIIVDLPGPKLRLGELKEPIEVKKGDKIVFSQKDGIPVDDELFYSAVKENSDILIADGTIRVRVKSKAKDRVEGTVIEGGILLSRKGINIPNVNLKSGITDNDLKLLKRALDLGADYIGLSFVISENDVKKVKEFVGDEAWVIAKIEKSEALKNLTNIVNESDGIMVARGDLGVETGLENLPLIQRRIVRTSRVFGKPVILATQVLTSMINSPIPTRAEIIDISNSIMQGVDSIMLSDETAIGNYPVESVRTLHNIISNVEKSVKHRPIGPLNSESDAIALAAVNASKVSKADVIVVYSRSGNSILRVSRLRPERNIIGVSPDPRLAKKFKLCYGVIPISINKKMQSIDEIIDVSAKLMQEKIKDLKFKKIVIVGGDPKQEAGKTNFVIVKTLEQQKK

SEQ ID NO: 7326 - DNA, 1428 bp, Mycoplasma pulmonis
  CDS (1)..(1428): transl_table=4
atgtattcgataaaaaagaaatcaaaactaattgctacaattggaccttcttctgataactatgaagttttaaaagagttagtagaaaatggagtaacttgtgtaagggctaatttttcacatggagactatcaagaacaaaaaagaaaatttgatcttgccaaaaaagtaagccatgatttaaacacccccctttcattaatgttagatactaaaggacctgaaattagaattgggaaaatgaaagatggagttcaaaaaattgaggccaatcaaagtttaaaaatttgagtctcagaagaaaaatataaaaatttattaggaacctcagaagatattagcgtttcttataatatgtctcaagatttaaaaaagggcaatcaagttcttcttgatgatggaaaattagatactattgtagaaaaagtaacccctgagtatgttcaagtaagagcacttaattctcataatttaaaaacaaacaaaagaattaatcttcccggagtggctttttcacttccttttctaagtgaaaaagataaaaaagatatagcctttggagttgaaaatgatattaactatgttgcagcttcatttgttaattccaaagaaaatgtattagaacttagagctattttaaaatcactaaacgcagagcatgttcaaattatttcaaaaattgaatcaactttaggaattgaaaacattgatgaaataattgaacactcagatggaattatgatagcaagaggagatttaggtcttgagattccttattatgaagttccttattgacaaaaaacaattattagaaaatgtagaaatgtaggcaaagttgtaatagttgcaactcaaatgcttgatagtatggaacacaatactaatccaacaagagccgaagtcactgatgtttattttgcaactgagctaggcgctgatacaacaatgctctcaggagagacagctcaaggatcttttccagttgaagctgttaaggttatgtcaaaaattaaccaaagagctgaaaaagagttttatagcaaactttactataacgctcaacttgaatcaaatgcaaaattagccactaccaaaagagctaaaattgcctatgaagttgcaaaacagactcaatctggagattttaaatatacagtagtgctttcagctagtggtaatttattaaaaaaagtagctaactttagacctaatacttcaattatcggctttgttgaagacaaaaaactaattaatgcttttggaattgtctcttcagtgtttgtctctcttgagtctgttcaaaaatattttgaactaaaaaataatcctttagctgcaattagcacccttaaaaactatgatgctaggccaggggatagattcttaattgttcataatgaaaaaattacccaacacgttgttgagtaa

SEQ ID NO: 7327 - protein, 475 aa, Mycoplasma pulmonis
MYSIKKKSKLIATIGPSSDNYEVLKELVENGVTCVRANFSHGDYQEQKRKFDLAKKVSHDLNTPLSLMLDTKGPEIRIGKMKDGVQKIEANQSLKIWVSEEKYKNLLGTSEDISVSYNMSQDLKKGNQVLLDDGKLDTIVEKVTPEYVQVRALNSHNLKTNKRINLPGVAFSLPFLSEKDKKDIAFGVENDINYVAASFVNSKENVLELRAILKSLNAEHVQIISKIESTLGIENIDEIIEHSDGIMIARGDLGLEIPYYEVPYWQKTIIRKCRNVGKVVIVATQMLDSMEHNTNPTRAEVTDVYFATELGADTTMLSGETAQGSFPVEAVKVMSKINQRAEKEFYSKLYYNAQLESNAKLATTKRAKIAYEVAKQTQSGDFKYTVVLSASGNLLKKVANFRPNTSIIGFVEDKKLINAFGIVSSVFVSLESVQKYFELKNNPLAAISTLKNYDARPGDRFLIVHNEKITQHVVE

SEQ ID NO: 7328 - DNA, 1533 bp, Solanum tuberosum (potato)
  CDS (1)..(1533)
atggccaacatagacatagctggaatcatgaaggatctcccaaatgatggccgtattccaaagaccaagattgtttgcacgttagggccatcttctagaacagtgccaatgctggagaagcttctccgtgctggcatgaacgttgccaggtttaacttttctcatgggacccatgagtaccatcaggagacattggacaatcttaagattgctatgcagaatactcagatcctgtgtgctgtcatgcttgacaccaaggggcctgagattcgtactggtttcttaacagatggaaaaccgattcagcttaaggaaggtcaagaaatcactgtatccacagactataccataaaaggaaatgaagaaatgatctcaatgagctataagaagttggtaatggacttgaagcccggcaataccattttgtgtgcagatggtaccataacccttactgttttgtcatgtgatccaccgtctggaacggtgagatgtcgctgcgagaatactgccaccttaggagagaggaagaatgtaaaccttccaggtgtggttgtggaccttccaacacttacagagaaggataaagaagatatactagagtggggtgttcctaacaacattgatatgatagcgctttcgtttgtgcgtaagggttcagatcttgtcaatgttcgcaaggttcttggtccacatgccaagcgcattcaactaatgtcaaaggttgaaaaccaagaaggggtaatcaactttgatgaaatccttcgtgagacagattcttttatggttgctcgaggtgatctcggaatggaaattccagttgagaagattttcttggctcagaaaatgatgatatacaagtgtaatcttgctggcaaagctgtggtaactgccactcagatgcttgaatcaatgatcaagtctccagcacccacccgtgctgaggctactgatgtggctaatgctgtcttggatggcactgattgtgttatgttaagtggggagagtgcagctggtgcttatcctgagctggcagtaaaaatcatgtcacgaatctgcattgaggcagagtcttcacttgacaacgaggctatcttcaaggaaatgatcaggtgtaccccactgccaatgagcccattggagagtcttgcatcatcagctgtccgtacggctaacaaagctagagcaaaactcattgttgtcctgacacgtggcgggagtacagcaaagctggttgccaagtataggcctgcagttcctattctgtcagtagtcgtgcctgttttgaccacagactctttcgattggtccatcagcgacgagaccccagctagacacagtttggtatataggggcttgattccacttcttggtgaaggttctgcaaaggccactgattctgaatcaactgaggtaatccttgaagcggccctgaagtctgccgtaacgagagggctatgcaaacctggtgatgctgtcgtggcacttcatcgtattggttctgcatccgttatcaagatttgcgtcgtgaagtaa

SEQ ID NO: 7329 - protein, 510 aa, Solanum tuberosum (potato)
MANIDIAGIMKDLPNDGRIPKTKIVCTLGPSSRTVPMLEKLLRAGMNVARFNFSHGTHEYHQETLDNLKIAMQNTQILCAVMLDTKGPEIRTGFLTDGKPIQLKEGQEITVSTDYTIKGNEEMISMSYKKLVMDLKPGNTILCADGTITLTVLSCDPPSGTVRCRCENTATLGERKNVNLPGVVVDLPTLTEKDKEDILEWGVPNNIDMIALSFVRKGSDLVNVRKVLGPHAKRIQLMSKVENQEGVINFDEILRETDSFMVARGDLGMEIPVEKIFLAQKMMIYKCNLAGKAVVTATQMLESMIKSPAPTRAEATDVANAVLDGTDCVMLSGESAAGAYPELAVKIMSRICIEAESSLDNEAIFKEMIRCTPLPMSPLESLASSAVRTANKARAKLIVVLTRGGSTAKLVAKYRPAVPILSVVVPVLTTDSFDWSISDETPARHSLVYRGLIPLLGEGSAKATDSESTEVILEAALKSAVTRGLCKPGDAVVALHRIGSASVIKICVVK

SEQ ID NO: 7330 - DNA, 2083 bp, Bacillus psychrophilus
  CDS (271)..(2031)
gcatgcgaaatcatgtggtggtagactatgagttgacagatgttttcgaacaatcaaatggtttggatatggaaatgtacaagctgtccaacgaattgtctatttaactttatgtagcaaaaattccctgcctttatacgtgggaagacaaacgcgaacgaagtcagtaattcagagggcatcaaaatgtcggctgaatcgagcgagcactatttaaaatctgggtgcaattaattgggttgttaaaaaaactaaaagaggcgatatttgatgagaaaaacgaaaatagtatgtacgattggccctgcaagtgaatcaccggaattattggaacaacttattgaggctggtatgaatgtagcgaggctgaatttttcccatggtaatcatgcggaacataaagcccgtatcgattccattagaaaagtcgcacgtgaaaaaggcaaagttgttgggattctattagatacgaaaggaccagaaattcggacgcattctatgatgaatggaaagttggaacttgtaacaggacaaaaaattgatatttccatgacgcaagtcgaaggaaacaatgatgtattttcagtaagttacgataaacttattgaagatgtaaacgagggttctgttattcttttagacgatggtctaatccaattagaagttactggtaaagacgtagcacgagggttaattcatacactaattattaattcggggtcattaagcaataataagggcgttaacataccgggtgtttcagtacaacttcctggaatgacggaaaaagatgcagaagatatcctgtttggtattagggaaggtgtcgacttcatagctgcctcattcgtaagacgggcttccgatgttatggaaatccgtgcccttcttgagaacaacaacggctcgaacctgcaaattattccgaagatagaaaaccaagaaggcgtcgacaatatcgatgaaattttgaatgtttcagatggtcttatggtagcacgtggtgatctgggtgtagaaataccaccagaagaagtaccacttgtccagaaaaatttgattgagaagtgtaaccaggcgggtaaaccggttatcacggcaacacaaatgcttgattcgatgcagcgtaacccgcgtcctacacgtgcagaagcgagcgatgtagcgaatgcgatttttgacggtaccgatgcaattatgctgtcaggagagacggcagcaggaatttatccagtcgaatcagtccaaacgatggatcgaattgcgcttactacggaagctgccatcgattatcgctctgtagtgtcgacacgtcgacgagaaaaacatggtaatatgactgaagcgattggacaagctgcagcatacacggctatcaacttgaaagtgaaggctgtccttgccccaacagaaagtggtcacacagctaaaatgattgccaaatatcgtccaggttgcccagttattgcggtaacgtcatctgaaatgtgttcaagaaaactatcacttatctggggcgtctacccgatagttggaaaaaaagcttcttcgattgatgaaatcttgcaagagtctgtagaagagagtgttaaacatcaatatgtcggacatggtgatgtggttatcattacagcaggtgttccagttggtgaagcgggaacgacgaacttgatgaaaatacatgtcataggtgatttgcttgcacgaggacaaggaattggcaaagatgtagcttatggtcgaactgttgtagccaaaaatgcagctgaagcattggcgtatgatacagaaggagctattcttgtaacgaacgcatctgatcgtgatatgatgcctgccatcgagaaatgcgcaggactcattacggaagaaggcggattgacgagtcatggtgcaattgtcggactcagtttaggtataccgataattgtcggagttgaaaatgctaccgagcttatccaacatggcaaggaaattacgatggatgctgaatctggcgttatctataatggacacgcgagcgttctataaagttaatcttcaatcagagtgggggttcttcatcccccactgattgtttaaa

SEQ ID NO: 7331 - protein, 586 aa, Bacillus psychrophilus
MRKTKIVCTIGPASESPELLEQLIEAGMNVARLNFSHGNHAEHKARIDSIRKVAREKGKVVGILLDTKGPEIRTHSMMNGKLELVTGQKIDISMTQVEGNNDVFSVSYDKLIEDVNEGSVILLDDGLIQLEVTGKDVARGLIHTLIINSGSLSNNKGVNIPGVSVQLPGMTEKDAEDILFGIREGVDFIAASFVRRASDVMEIRALLENNNGSNLQIIPKIENQEGVDNIDEILNVSDGLMVARGDLGVEIPPEEVPLVQKNLIEKCNQAGKPVITATQMLDSMQRNPRPTRAEASDVANAIFDGTDAIMLSGETAAGIYPVESVQTMDRIALTTEAAIDYRSVVSTRRREKHGNMTEAIGQAAAYTAINLKVKAVLAPTESGHTAKMIAKYRPGCPVIAVTSSEMCSRKLSLIWGVYPIVGKKASSIDEILQESVEESVKHQYVGHGDVVIITAGVPVGEAGTTNLMKIHVIGDLLARGQGIGKDVAYGRTVVAKNAAEALAYDTEGAILVTNASDRDMMPAIEKCAGLITEEGGLTSHGAIVGLSLGIPIIVGVENATELIQHGKEITMDAESGVIYNGHASVL

SEQ ID NO: 7332 - DNA, 2054 bp, Bacillus licheniformis
  CDS (132)..(1889)
gaattcaaaataaccagttggtgcatcatgatatcattgaaatactcgagcaaaaacatacaattgatcaaagcatgtaccgcttgtctcaagaactgtcaatctagtgtaaaacccgaggaggaagcaatatgagaaagactaaaatagtttgtacaattggaccggccagcgaaagtgttgaaaagctcacccagctgatggaagccggaatgaacgtggcgcgcctgaacttttcccatggagatttcgaagagcacggcgcaagaattaaaaacattcgtgaagcagccggcaagctgggaaaagatatcggcatccttcttgacacgaaagggcctgaaatccgcacgcacacaatggaaaacggttcgatcgaactggcagcgggttctcagctgatcgtttcaatggacgaagtcatcggtacgcctgataaaatctcagttacatatgatgggttgattcacgatgtgtcagtcggttcaacgattttgcttgacgatggattggtcggacttgaagtcactgacataaacaaggacaagcgtgaaatcgtcacgaaagtgatgaacagcggaacgttgaaaaacaaaaaaggcgtgaatgtgccgggcgtcagcgtcaatcttccgggaattacggaaaaagatgcaaacgacatcgtattcggcatcgagcagggcgttgatttcatcgcggcatcctttgtgcgccgtccgtcggatgtccttgaaatccgcgaacttcttgaagagcacaatgcggcagatattcaaatcattccaaaaatcgaaaaccaggaaggcgttgacaacatcgatgccattcttgaagtatcagacggtctgatggttgcgcgtggagacctgggtgtagaaatccctgccgaagaagtgccgctcgttcaaaaagaactgatcaaaaaatgcaatgcgcttggcaagcctgtcatcacggctacccaaatgctcgacagcatgcagcgcaatccgcgcccgacacgcgcggaagcgagcgacgttgccaatgcgatctttgacggaactgacgcaatcatgctttcaggtgaaacggcagcgggaaattatcctgttgaagccgttcagacgatgcacaatatcgcttcccgttcagaagaagcgctcaaccataaaaagatcctttccgcacgaagcaagcaagtcagcatgtcaattacggatgcgatcggccaatctgtggcgcatacggcaatcaaccttgatgtgaatgccatcgtcacaccgacggaaagcggccatacggcgagaatgatttccaaatatcgcccgcaggcgccgattgtcgcagttacggtaaacgatgcggtgtcaagaaagctgtcacttgtgttcggggttttcgcaacaagcggacaaaaccacagctccactgacgaaatgcttgaaaaagcggtgcaaaaatctctcgatacaggcatcgtacgccacggcgacttgatcgttatcacggccggagctgtcggtgaagccggtacaacaaacttgatgaaagtgtatgttgtcggagacgtggtcgcaaaaggccagggcatcggacgcaaatccgcatttggtgaagtggtcatcgctcaaaacgcacaagaagcggccaaaaaaatgaaagatggcgccgttttagttacaaaaagcacggatcgtgacatgatggcatcccttgaaaaagcggctgcgctgattacggaagaaggcggcttaacaagccacgcggcagtcgtaggcttaagcctcggcatccctgtcatcgtcggaatggaaaatgcgacttccattctgaaagagggagaagacatcacggtcgactccgcccgcggagctgtatacaaaggacgtgcaagcgtgctttaatcgcttattgaagaagaagggaagctttccccttcttttagatttatgacaaaatcctaaaacgtttttcagttttaggattttgtcatccttcaattcagcgtgattgaaaacccttgcagtctaggaaggccgagcatcggagcggagcgaatgttggaattc

SEQ ID NO: 7333 - protein, 585 aa, Bacillus licheniformis
MRKTKIVCTIGPASESVEKLTQLMEAGMNVARLNFSHGDFEEHGARIKNIREAAGKLGKDIGILLDTKGPEIRTHTMENGSIELAAGSQLIVSMDEVIGTPDKISVTYDGLIHDVSVGSTILLDDGLVGLEVTDINKDKREIVTKVMNSGTLKNKKGVNVPGVSVNLPGITEKDANDIVFGIEQGVDFIAASFVRRPSDVLEIRELLEEHNAADIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGNYPVEAVQTMHNIASRSEEALNHKKILSARSKQVSMSITDAIGQSVAHTAINLDVNAIVTPTESGHTARMISKYRPQAPIVAVTVNDAVSRKLSLVFGVFATSGQNHSSTDEMLEKAVQKSLDTGIVRHGDLIVITAGAVGEAGTTNLMKVYVVGDVVAKGQGIGRKSAFGEVVIAQNAQEAAKKMKDGAVLVTKSTDRDMMASLEKAAALITEEGGLTSHAAVVGLSLGIPVIVGMENATSILKEGEDITVDSARGAVYKGRASVL

SEQ ID NO: 7334 - DNA, 1617 bp, Trichoderma reesei
  CDS (1)..(1617)
atgtcccagatctcccgcacgcagagcatcatggctaccacggcccaggagcacctggaaaccggcggccgcatcaattggctggcctcgctcaacacggcctttacgcctgcccgcaactttcgccgcacctccatcatctgcaccatcggccccaagaccaactcggtcgaggccctcaacaagctgcgtgatgccggcctcaacgtcgcccgcatgaacttctcccacggcagctacgagtaccaccagtccgtcatcgacaatgtgcgcgcctctgtcgccgcccaccctggccggcccgtcgccattgccctcgacaccaagggccccgagattcgaactggcaacacggccggcgacgtggacattcccatcagcgccggcaccgtcatgaacttcaccaccgacgagaagtacgcgacggcctgcgacactcagaacatgtacgtcgactacaagaacatcaccaaggtgatccagcctggccgtgtcatctacgtcgacgacggtgtcctcgcctttgacgtcctcagcatcaaggacgaccagaccgtcgaggtccgcgcccgcaacaacggcttcatctcctcccggaagggtgtcaacctgcccaacaccgatgtcgacctgcctgctctctccgagaaggacaaggccgatctccggtttggtgtcaagaacaatgtcgacatggtctttgcctcatttatccgccgtgcgcaggatatcaaggatatccgcgacgtgctgggccccgagggcaagcagatccagatcattgccaagatcgagaaccgacagggtctcaacaactttgccgagatccttgaggagaccgacggtgtcatggtcgcccgtggtgacctgggtattgagatccccgccgccgaggtgttcgccgcccagaagaagatgattgccatgtgcaacattgccggcaagcccgtcatctgcgctacccagatgctcgagtccatgatcaagaaccctcgacctacgcgtgccgagatcagcgatgtcggcaacgccgtcactgatggcgccgactgtgttatgctatctggcgagactgccaagggtaactaccctgccgagtccattcatgagatgcacgaggccagtctcaaggctgaaaacaccatcccctacgtctcccactttgaggagatgtgcactctggtcaagcgccccgtctcgaccgtcgagtcttgcgccatggctgccgtccgcgcctctctcgacctcggcgccggtggcatcattgtcctgtccacctctggcgactctgcccgcctgctgtccaagtaccgccccgtctgccccatcttcatggtgacccgaaaccccaccacctctcgattcagccacctgtaccgcggtgtctaccccttcctgtatcccgagcagaagcccgactttgatactgtcaactggcaggaggacgtcgacaagcgcatcaagtgggccgtcacccgcgccattgagctcaagacgctcactgccggcgacaccgttgtcgtcgtccagggctggaagggcggcatgggcaacacaaacaccctgcgcattgtccgcgctgaccccgaccacctgggcattggacagatggagtag

SEQ ID NO: 7335 - protein, 538 aa, Trichoderma reesei
MSQISRTQSIMATTAQEHLETGGRINWLASLNTAFTPARNFRRTSIICTIGPKTNSVEALNKLRDAGLNVARMNFSHGSYEYHQSVIDNVRASVAAHPGRPVAIALDTKGPEIRTGNTAGDVDIPISAGTVMNFTTDEKYATACDTQNMYVDYKNITKVIQPGRVIYVDDGVLAFDVLSIKDDQTVEVRARNNGFISSRKGVNLPNTDVDLPALSEKDKADLRFGVKNNVDMVFASFIRRAQDIKDIRDVLGPEGKQIQIIAKIENRQGLNNFAEILEETDGVMVARGDLGIEIPAAEVFAAQKKMIAMCNIAGKPVICATQMLESMIKNPRPTRAEISDVGNAVTDGADCVMLSGETAKGNYPAESIHEMHEASLKAENTIPYVSHFEEMCTLVKRPVSTVESCAMAAVRASLDLGAGGIIVLSTSGDSARLLSKYRPVCPIFMVTRNPTTSRFSHLYRGVYPFLYPEQKPDFDTVNWQEDVDKRIKWAVTRAIELKTLTAGDTVVVVQGWKGGMGNTNTLRIVRADPDHLGIGQME

SEQ ID NO: 7336 - DNA, 1725 bp, Rattus norvegicus (Norway rat)
  CDS (1)..(1725)
atgtctgtccaggagaacactctaccccagcagctctggccgtggatctttaggtcccaaaaagacttggcaaagtctgccttaagtggggctcccggagggccagcgggataccttcgacgtgcgagtgtggctcaactgacccaggagctgggcactgccttcttccagcagcagcaactgcccgcagctatggcggacaccttcctggaacacctctgccttctggatatcgactcacagcctgtggctgctcgtagcaccagcatcattgccaccattgggccagcatcccgctctgtggaccgcctcaaggagatgatcaaagcagggatgaacattgcacgactcaacttctcccatggctcccatgagtaccatgcagaatacatcgccaacatccgggaggcaactgagagttttgcaacctccccactcagctacagacctgtggccatcgccctggacaccaagggacctgagatacgaaccggagtcttgcaggggggtccggagtcggaggtggaaattgtgaagggctcacaggtgctggtgacggtggacccgaagttccagacaaggggtgatgcaaagacagtgtgggtggactaccacaatatcacccgggtcgttgcagtggggggccgcatctacattgacgacgggctcatctccttagtggtacagaaaatcggcccagagggactggtgacagaagtggagcacggtggtatcttgggcagcaggaagggtgtgaacttgccaaacactgaggtggacctgcccgggctgtctgagcaagaccttttggatctgcgcttcggggtgcagcataatgtggacatcatctttgcctcctttgtgcggaaagccagtgacgtgttagcagtccgggatgccctggggccagaaggacagaacatcaaaattatcagcaaaatcgagaaccatgaaggcgtgaagaggtttgatgaaattctagaagtgagcgatggcatcatggtggcacggggtgacctgggcattgagatccctgcggagaaggttttcttggctcagaagatgatgattggacgctgcaacctggccggcaagcctgtcgtttgtgccacacagatgctggagagcatgatcactaaggctcgaccaactcgggcggagacaagcgatgtggccaatgccgtgctggatggggctgactgtatcatgctgtccggagagaccgccaagggcagttttcctgtggaagctgtaatgatgcaacatgcgattgcgcgggaggcagaggccgctgtgtaccaccgccagttgtttgaggagctacgccgggcagcgccgctgagccgtgacccaactgaggtcactgcgattggagccgtggaggcttccttcaagtgctgtgcagcagccatcatcgtgctgacgaagactggccgttcagcccagcttctatctcaataccgacctcgggcggctgtcattgctgtgactcgatctgcccaggctgcccgacaggtccacctgtcccgaggagtcttccccttgctctaccgtgagcctccagaggccatctgggcagatgatgtggatcgaagggtccaatttggcattgaaagtggaaagctccgtggtttcctccgtgtgggtgatctggtgattgtggtgacaggttggcggcctggctctggctataccaacatcatgcgggtgctgagcgtatcctga

SEQ ID NO: 7337 - protein, 574 aa, Rattus norvegicus (Norway rat)
MSVQENTLPQQLWPWIFRSQKDLAKSALSGAPGGPAGYLRRASVAQLTQELGTAFFQQQQLPAAMADTFLEHLCLLDIDSQPVAARSTSIIATIGPASRSVDRLKEMIKAGMNIARLNFSHGSHEYHAEYIANIREATESFATSPLSYRPVAIALDTKGPEIRTGVLQGGPESEVEIVKGSQVLVTVDPKFQTRGDAKTVWVDYHNITRVVAVGGRIYIDDGLISLVVQKIGPEGLVTEVEHGGILGSRKGVNLPNTEVDLPGLSEQDLLDLRFGVQHNVDIIFASFVRKASDVLAVRDALGPEGQNIKIISKIENHEGVKRFDEILEVSDGIMVARGDLGIEIPAEKVFLAQKMMIGRCNLAGKPVVCATQMLESMITKARPTRAETSDVANAVLDGADCIMLSGETAKGSFPVEAVMMQHAIAREAEAAVYHRQLFEELRRAAPLSRDPTEVTAIGAVEASFKCCAAAIIVLTKTGRSAQLLSQYRPRAAVIAVTRSAQAARQVHLSRGVFPLLYREPPEAIWADDVDRRVQFGIESGKLRGFLRVGDLVIVVTGWRPGSGYTNIMRVLSVS

SEQ ID NO: 7338 - DNA, 1596 bp, Trypanosoma brucei
  CDS (59)..(1558)
ctaattatcacctaataaaggaacaattcagacaaaacagatttattccgacgagtccatgtcgcagctagagcacaacattgggctctccatttttgagccggtggccaaacaccgtgccaaccgcattgtgtgcaccatcggacccagcacacagagcgttgaagccctgaaaaacctaatgaagagtggtatgtctgttgcccgtatgaacttttcccatggatcccatgaataccaccagacgacaataaacaacgttcgcgcagctgctgctgaacttggccttcatattggtattgcgctggacacgaaaggtcctgaaatccgtacaggcctcttcaaggatggtgaggtgacgttcgcccctggtgacatcgtgtgtgtcactaccgatcccgcctatgagaaggttggcacaaaggaaaagttctatatcgactacccacaactgacgaaggcagtgcccgtgggtggttccatttatgtcgacgacggtgtgatgactctccgcgtcttaagcaaagaggacgatcggacgctgaagtgccacgtgaacaatcaccaccgcctgaccgaccgcaggggtatcaacctcccaggttgtgaggtggatctgcccgccgtttccgagaaggaccgcaaggacttggagttcggtgtggcacaaggtgttgatatgatttttgcctcgttcatccgcacggctgagcaggttcgtgaggtgcgcgccgccctcggtgagaagggaaaagacatccttatcatttccaagattgaaaaccaccagggtgtgcagaacattgactccatcattgaagcgagcaatggcattatggttgctcgtggtgatcttggcgtcgagatccccgccgagaaggtgtgtgtggcgcagatgtgcatcatcagcaagtgcaacgtggtgggcaaacctgtcatctgtgccacgcaaatgctcgagagcatgacgtcaaacccccgccccacacgtgccgaagtatccgatgttgccaatgctgttctcaacggagccgactgtgtcatgctttccggtgaaacggccaaagggaagtaccccaacgaagtggtacagtacatggctcgcatctgtgtcgaggcgcagagcgcaacgcacgatactgttatgttcaacagcattaagaacctgcagaaaatccccatgtgccccgaagaggccgtttgcagcagcgccgtcgcctctgcatttgaggtacaagccaaggcaatgctcgtgctaagcaacacgggccgaagtgctcgcctcatcagcaagtaccgcccgaactgccccatcatttgtgtcaccacacgtctgcaaacgtgccgtcaactcaacgtgacgcgctccgtcgtgagtgttttctacgacgccgcaaagagtggtgaggacaaggataaggaaaagcgcgtgaaactcggtttggattttgcgaagaaggagaaatatgccagcactggagacgtggtggttgtcgtgcatgccgaccactctgtgaaggggtacccgaaccaaactcgcctcatctatcttccttaagcattggtgggtgggtgagcaatgtaatgaggggttaa

SEQ ID NO: 7339 - protein, 499 aa, Trypanosoma brucei
MSQLEHNIGLSIFEPVAKHRANRIVCTIGPSTQSVEALKNLMKSGMSVARMNFSHGSHEYHQTTINNVRAAAAELGLHIGIALDTKGPEIRTGLFKDGEVTFAPGDIVCVTTDPAYEKVGTKEKFYIDYPQLTKAVPVGGSIYVDDGVMTLRVLSKEDDRTLKCHVNNHHRLTDRRGINLPGCEVDLPAVSEKDRKDLEFGVAQGVDMIFASFIRTAEQVREVRAALGEKGKDILIISKIENHQGVQNIDSIIEASNGIMVARGDLGVEIPAEKVCVAQMCIISKCNVVGKPVICATQMLESMTSNPRPTRAEVSDVANAVLNGADCVMLSGETAKGKYPNEVVQYMARICVEAQSATHDTVMFNSIKNLQKIPMCPEEAVCSSAVASAFEVQAKAMLVLSNTGRSARLISKYRPNCPIICVTTRLQTCRQLNVTRSVVSVFYDAAKSGEDKDKEKRVKLGLDFAKKEKYASTGDVVVVVHADHSVKGYPNQTRLIYLP

SEQ ID NO: 7340 - DNA, 1581 bp, Aspergillus niger
  CDS (1)..(1581)
atggccgccagctcttccctcgaccacctgagcaaccgcatgaagttggagtggcactccaagctcaacactgagatggtgccctccaagaacttccgccgcacctccatcatcggaaccatcggccccaagaccaactccgtggagaagatcaactctctccgcactgccggtcttaacgttgttcgcatgaacttctcccacggttcttatcagtaccaccaatctgttatcgacaacgcccgcgaggccgccaagacccaggtcggacgtcctctcgccattgctcttgataccaaaggacccgagatccgtaccggaaacacccccgatgataaggatatccctatcaagcagggccacgagctcaacatcaccaccgacgagcaatatgccaccgcctccgacgacaagaacatgtacctcgactacaagaacatcaccaaggtgatctctcctggcaagctcatctatgttgatgacggtatcctttccttcgaggtcctcgaagtcgtagatgacaagaccatccgcgtccggtgcttgaacaacggcaacatctcttcccgcaagggtgttaacttgcccggcactgacgttgacctccccgccctttccgagaaggacattgccgatctcaagttcggtgttaggaacaaggtcgacatggtcttcgcttctttcatccgccgcggtagcgacattcgccacatccgtgaggttctgggtgaggagggcaaggagatccagatcattgccaagattgagaaccagcagggtgtcaacaacttcgacgagatcctcgaagagactgacggtgtcatggttgcccgtggtgaccttggtatcgagatccccgcccccaaggtcttcatcgcccagaagatgatgatcgccaagtgtaacatcaagggtaagcccgtcatctgtgccactcagatgctcgagtccatgacatacaaccctcgtcctactcgtgccgaggtgtccgatgttgccaacgccgtccttgacggtgccgactgtgtcatgctgtcgggagagaccgccaagggtaactaccccaacgaggccgtcaagatgatgtccgagacctgcctgctcgccgaggttgccatcccccacttcaatgtgttcgatgagctccgcaaccttgctcctcgccccaccgacactgtcgagtccatcgccatggctgccgttagcgccagtctggaactcaacgctggtgccattgtcgtcttgactaccagcggtaaaactgctcgctacctttccaagtaccgccccgtctgccccattgtcatggttacccgtaaccccgctgcctcccggtactctcacctgtaccgtggtgtctggcccttcctcttccccgagaagaagcccgacttcaacgtcaaggtctggcaggaggatgttgaccgccgtctcaagtggggtatcaaccacgctcttaagctcggcatcatcaacaagggtgacaacatcgtctgtgtccagggatggcgcggcggtatgggccacaccaacaccgtccgtgtggtccctgctgaggagaaccttggcctggctgagtaa

SEQ ID NO: 7341 - protein, 526 aa, Aspergillus niger
MAASSSLDHLSNRMKLEWHSKLNTEMVPSKNFRRTSIIGTIGPKTNSVEKINSLRTAGLNVVRMNFSHGSYQYHQSVIDNAREAAKTQVGRPLAIALDTKGPEIRTGNTPDDKDIPIKQGHELNITTDEQYATASDDKNMYLDYKNITKVISPGKLIYVDDGILSFEVLEVVDDKTIRVRCLNNGNISSRKGVNLPGTDVDLPALSEKDIADLKFGVRNKVDMVFASFIRRGSDIRHIREVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPNEAVKMMSETCLLAEVAIPHFNVFDELRNLAPRPTDTVESIAMAAVSASLELNAGAIVVLTTSGKTARYLSKYRPVCPIVMVTRNPAASRYSHLYRGVWPFLFPEKKPDFNVKVWQEDVDRRLKWGINHALKLGIINKGDNIVCVQGWRGGMGHTNTVRVVPAEENLGLAE

SEQ ID NO: 7342 - DNA, 1636 bp, Bacillus stearothermophilus
  CDS (114)..(1598)
gtcgaccatgacatcgcggaggcgctagccaacaaacatacgattgatcagcggatgtacgcattgtcgaaagaattgtccatttaagtcccgaggggaaaggagaagacaagatgaagcggaaaacgaaaatcgtctgcacgatcgggccggcaagcgagagcgtagacaagctcgtgcaactgatggaagcgggaatgaacgtggcgcgcctaaacttttcgcacggcgatcatgaagagcacgggcggcgcatcgccaatattcgcgaagcggcgaagcgaacgggccgaacggtcgccattttgcttgacacgaaagggccggaaatccggacgcacaatatggaaaacggcgccattgagctgaaggaagggtcaaagctcgtcatttcgatgagcgaagtgctcggcacgccggaaaaaatttcggtcacctatcccagcttaatcgatgatgtgtccgtcggcgcgaaaattttgcttgatgacgggctcatcagcctggaagtcaacgcggtcgacaagcaagcgggagaaatcgtcacgaccgtgttaaacggcggcgtgctgaaaaacaaaaaaggagtcaatgtgccgggtgtcaaagtcaacttgccaggcatcaccgagaaagatcgggctgacattttgtttggcattcgccaagggatcgatttcatcgccgcctcgtttgtgcgccgggcgtccgatgtgctggagatccgcgagctgcttgaggcgcatgacgccctccatatccaaattatcgccaaaattgaaaatgaagaaggcgtcgccaacattgacgaaattttagaagccgccgacggcctgatggtggcgcgcggcgatttgggcgtggaaattccggctgaggaagtgccgctcattcaaaaactgctcattaaaaagtgcaacatgctcggcaagccggtcattacggcgacgcaaatgctcgattcgatgcagcgcaatccgcgtccgacgcgggcggaggcgagcgacgtcgccaacgccatttttgacggcaccgacgccgtcatgctttccggggaaacggcggccggccagtatccggtcgaagcggtgaaaacgatgcaccaaatcgcgctccgcaccgaacaggcgcttgagcaccgcgacattttgtcccaacgcacaaaagaaagccaaacgacgatcaccgacgccatcgggcagtcggtcgcccacaccgcgctcaacttggatgtggcggcgatcgtgacgccgaccgtgagcggaaaaacgccgcaaatggtggcgaagtatcgcccgaaggcgccgattattgccgtgacgtcaaatgaagcggtatcgcgccggctggcgcttgtgtggggcgtgtatacgaaagaagcgccgcatgtgaacacgacggacgaaatgctcgatgtcgccgtcgatgcggcggtgcgctccgggttggtgaagcacggtgacttggtcgtcatcacggctggcgtgccggtcggcgaaacgggttcgacgaacttaatgaaggtgcacgttatcagcgatcttctcgccaaagggcaaggcatcggcgcaagtcggcgttcggcaaggccgttgtagcgaaaacagcggaagaagcgcggcaaaaaatggtcgac

SEQ ID NO: 7343 - protein, 494 aa, Bacillus stearothermophilus
MKRKTKIVCTIGPASESVDKLVQLMEAGMNVARLNFSHGDHEEHGRRIANIREAAKRTGRTVAILLDTKGPEIRTHNMENGAIELKEGSKLVISMSEVLGTPEKISVTYPSLIDDVSVGAKILLDDGLISLEVNAVDKQAGEIVTTVLNGGVLKNKKGVNVPGVKVNLPGITEKDRADILFGIRQGIDFIAASFVRRASDVLEIRELLEAHDALHIQIIAKIENEEGVANIDEILEAADGLMVARGDLGVEIPAEEVPLIQKLLIKKCNMLGKPVITATQMLDSMQRNPRPTRAEASDVANAIFDGTDAVMLSGETAAGQYPVEAVKTMHQIALRTEQALEHRDILSQRTKESQTTITDAIGQSVAHTALNLDVAAIVTPTVSGKTPQMVAKYRPKAPIIAVTSNEAVSRRLALVWGVYTKEAPHVNTTDEMLDVAVDAAVRSGLVKHGDLVVITAGVPVGETGSTNLMKVHVISDLLAKGQGIGASRRSARPL

SEQ ID NO: 7344 - DNA, 1581 bp, Emericella nidulans, Aspergillus nidulans
  CDS (1)..(1581)
atggccgcaagctcttccctcgaccacttgtccaaccgtatgaagctggagtggcactccaagctgaatactgagatggtgccggcgaagaacttccgccgtacatccatcatctgtaccatcggtcccaagacaaactccgttgagaaaatcaatgccctccgcagagccggtctcaatgtcgttcgcatgaacttttctcacggttcatacgagtaccaccaatcagttatcgaccacgctcgggaagccgaaaagcaggcagctggccgccccgttgccattgctctggacaccaaaggacccgagatccgtaccggaaacaccgtaggtgacaaggacatcccaatcaaggctggccatgagatgaacatcagcaccgatgagcaatatgccaccgcatccgacgaccagaacatgtatgtcgattacaagaacatcaccaaggtgatttctgccggcaagctcatctatgtcgatgacggtatcctttcatttgaggttcttgaagttgtagatgacaagaccctgcgcgtccgatgccttaacaacggcaacatctcttcccgcaagggtgtcaaccttcccggtaccgacgtagacttgcccgctctttcagagaaggacatcagcgatctgaagtttggtgtcaagaacaaggtcgacatggttttcgcttccttcatccgtcgtggcagcgacatccgccacatccgtgaggtgttgggtgaagagggccgagagattcagatcatcgccaagattgagaaccaacaaggtgtcaacaatttcgacgagattctggaagagaccgacggtgtcatggtcgcccgtggtgaccttggtatcgagatccccgctcccaaggtgttcatcgcccagaagatgatgatcgccaagtgtaacatcaagggcaagcccgtcatttgtgccactcagatgcttgagtccatgacatataaccctcgtcccactcgtgctgaggtgtccgatgtggccaacgctgttctcgacggtgccgactgtgtcatgctttctggagagactgccaagggtaactacccttgcgaggctgtcacgatgatgtctgagacctgcctcctcgccgaggttgccattcctcacttcaacgtcttcgacgagctgcgaaacctggcccctcgtcccaccgacactgttgaatccatcgccatggctgctgtgagtgccagtcttgaactgaacgccggcgccattgtggtcctcaccactagtggaaacactgcccgtatgatctccaagtaccgccccgtttgccccatcatcatggtttctcgcaaccctgctgctacaaggtactcccacctgtaccgtggtgtctggcccttctacttccccgagaagaagcccgacttcaacgtcaagatctggcaggaggatgtcgaccgtcgcctcaagtggggtatcaaccacggtctcaagctcggtatcatcaacaagggcgacaacatcgtctgtgttcagggctggcgcggcggtatgggccacactaacactgtccgtgtggtccctgctgaggagaacctcggactttctgagtaa

SEQ ID NO: 7345 - protein, 526 aa, Emericella nidulans, Aspergillus nidulans
MAASSSLDHLSNRMKLEWHSKLNTEMVPAKNFRRTSIICTIGPKTNSVEKINALRRAGLNVVRMNFSHGSYEYHQSVIDHAREAEKQAAGRPVAIALDTKGPEIRTGNTVGDKDIPIKAGHEMNISTDEQYATASDDQNMYVDYKNITKVISAGKLIYVDDGILSFEVLEVVDDKTLRVRCLNNGNISSRKGVNLPGTDVDLPALSEKDISDLKFGVKNKVDMVFASFIRRGSDIRHIREVLGEEGREIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPCEAVTMMSETCLLAEVAIPHFNVFDELRNLAPRPTDTVESIAMAAVSASLELNAGAIVVLTTSGNTARMISKYRPVCPIIMVSRNPAATRYSHLYRGVWPFYFPEKKPDFNVKIWQEDVDRRLKWGINHGLKLGIINKGDNIVCVQGWRGGMGHTNTVRVVPAEENLGLSE

SEQ ID NO: 7346 - DNA, 1847 bp, Nicotiana tabacum (common tobacco)
  CDS (45)..(1571)
gttgctgtcgcttttcgtttgaaaaaaaactaaaattctctgctatggcgattgagaataacaacaatggagtgaatttttgtacggtgaagaggccgaagacgaagatagtatgtactttggggccagcatctcgatcggtgccgatgatcgagaagcttctacgggcaggcatgaacgtggcccgattcaacttttctcatggatctcacgactatcatcaggagactattgacaatctccgtcaagctatggagagtaccggtattctctgtgccgttatgcttgacaccaagggtccagaaattcgaacagggtttttaaaagatgctaagcctgttcaacttaaacagggtcaggagatcacaatctcaactgattacagcattaaaggtgatgagagtatgatatgcatgagctacaaaaagttagcagaggacgtaaagccacaaagtgtgatcctctgtgcagatggccaaatcacctttacagttttgtcttgtgacaaagagaacggtttggatcgatgccgctgtgagaacactgctgttcttggtgaaagaaagaatgtcaatctcccgggagtaattgtggatctgccaacattgacagataaagacaaggatgacattttaaactggggagttccgaatcatattgacatgattgcgttatcttttgttcgtaagggttcagatctcgtggaggttcggaagctgctaggtgaacatgcaaagaacattcttctgatgtctaaggttgaaaaccaggaaggtgtagcgaattttgatgacattcttctcaactctgatgcatttatggtggcaagaggtgacctgggaatggaaattccaattgagaagatatttttggctcaaaaggtaatgatttacaagtgcaacatccaagggaagcctgttgtcacagcaacacagatgttggagtccatgatcaaatctccaaggccaactcgtgcagaagcaacagatgttgccaatgctgttcttgatggcacagactgtgtcatgcttagtggtgaaacagctgctggagcttaccctgatcttgcagtgggtaccatggctaagatttgtattgaagcagaaagcacaattgattatccagatgttttcaaaagaattatgtcaaatgccccagttcccatgagcccattggagagccttgcatcttctgctgttcgaaccgctaactctgcaaaagctgctcttatcctagtgttaaccaggggaggaagtactgcaaaattggtggccaagtacagacctggaatgcctatattgtcggtggttgtccccgagatcaaaactgattcttttgattggacttgcagtgacgagtctccagcaaggcatagccttatattcaggggattggttcccgttctccatgcaggatctgctagggcttctcatgaagagtctacagaagaagcactggactttgctcttcaacatgccaaaacaaaagggttatgcaagcaaggagactccgttgtagccctacaccgtgttggaactgcatctgtgatcaagattgttacagtcaagtgatagatgaactttgacgcgtgctttttgggtttctgttgttgcaaaagggtaactgataaatgtttttgcttgtttcactgaatcattttctgccttctagagaaggaacttatgactataccttatattatgtctctatataacgcctggctgttttttgctttggctggagtttcatacccttttatctttttatgcaatttgtctacagacacagatatgatgcgaaataaattccttgtgccttcaatttatctgtctaaaaaaaaaaaaaaa

SEQ ID NO: 7347 - protein, 508 aa, Nicotiana tabacum (common tobacco)
MAIENNNNGVNFCTVKRPKTKIVCTLGPASRSVPMIEKLLRAGMNVARFNFSHGSHDYHQETIDNLRQAMESTGILCAVMLDTKGPEIRTGFLKDAKPVQLKQGQEITISTDYSIKGDESMICMSYKKLAEDVKPQSVILCADGQITFTVLSCDKENGLDRCRCENTAVLGERKNVNLPGVIVDLPTLTDKDKDDILNWGVPNHIDMIALSFVRKGSDLVEVRKLLGEHAKNILLMSKVENQEGVANFDDILLNSDAFMVARGDLGMEIPIEKIFLAQKVMIYKCNIQGKPVVTATQMLESMIKSPRPTRAEATDVANAVLDGTDCVMLSGETAAGAYPDLAVGTMAKICIEAESTIDYPDVFKRIMSNAPVPMSPLESLASSAVRTANSAKAALILVLTRGGSTAKLVAKYRPGMPILSVVVPEIKTDSFDWTCSDESPARHSLIFRGLVPVLHAGSARASHEESTEEALDFALQHAKTKGLCKQGDSVVALHRVGTASVIKIVTVK

SEQ ID NO: 7348 - DNA, 2243 bp, Nicotiana tabacum (common tobacco)
  CDS (318)..(2006)
cgttgctgtcgagcaaacgtgcggtgcgtgggagaagcgcgagtttggttggacagtagggcagatgagaagaaaatagaaaatgtcttagtccccaagagtctcaaaatcctctgagcctctgcagacagccgctcttttcggaactcaacttctctttgttttctccctttcttcctcacattcaccacacacatacacacacacactttctccaagttttttcttctcgttttctccgtagctaccacaactctatatctttctttctctctttcttctattcttcatcttctacttcttctgttacttgttcaatggccacaatgaatctacctacaggactacatgtcgcggctaaaccggcgtcattggatcggctttcctcggccaagaacgtcggtgatttgttcttctccgattctcgtcacaggaaacgagtgaatacttcgaatcaaatcatggccgttcaatcacttgagcatattcatggcgttaataacaatgtttatgccaattatgttaatttcaatgtaccctcttccggttacagtctggggcaagaaagtgtgtatctgaattctccaagaaaaaccaagatagtttgcaccattggtccctccacaagctcacgggagatgatctggaaattggcagaggctggaatgaacgtggcccgtctgaatatgtcacatggggaccacgcatcgcatcagagaacgattgaccttgttaaagaatacaatgctcaatttgaggacaaggttattgcaataatgttggacactaagggacctgaggtaataagtggagatgtgcccaaaccaattctccttaaggagggtcaagaattcaactttagcattaaaagaggagtcagcacagaagacaccgttagtgtaaattatgatgatttcataaatgatgtggaggccggagacatactactcgttgatggtgggatgatgtcattagctgtgaaatcgaaaaccagcgatatagtgaaatgtgaagttattgatggaggagaactgaaatcgagacggcatctaaatgtaagaggaaaaagtgccaccctgccttcaataacagaaaaagactgggatgatattaagtttggtgtgaacaatcaagtcgacttctatgccgtttcttttgtgaaggatgctaaggtggtccatgaattgaaagattacctgaaaagctgtaatgcagatattcatgttattgtaaagattgaaagtgcagactccattccaaatctccactcgatcatttccgcttccgatggggcaatggtggcccgtggtgatcttggagctgaacttccaattgaggaagtgccgttgcttcaggaagacattattagaaggtgtcagagcatgcaaaaacctgtaatagtagcaacgaacatgctcgaaagcatgattgatcacccaaccccaacaagggcagaagtttcagacatttccattgcagtacgtgaaggcgctgatgctgtaatgctttcaggcgaaaccgctcatgggaagtatccactgaaggcagttaaggtgatgcatattgtggcattaaggaccgagtctagcctacaaaaaagcactagttctcctagtcaatctgccgcctataagagccatatgggtgaaatgtttgccttccactcttcctcaatggctaatacccttagcactcccatcattgtcttcacaagaactgggtccatggcaataattttaagtcataatcggccttcatcaacagtttttgccttcacaaacaatgaaagggtgaagcagcgtctggctctgtatcatggtgtcgtgcctatatatatggagttttcaagtgacgcagaggagaccttttctcgagctatcaagcttttgttgagcaaaagcttggtgaaggatgggcaatatgtaactctcgtccaaagtggagcccaaccaatctggcgtagacattctactcaccacatacaagtccgtaaggtccaaagttgatacgtgtagcaaccatttattttggtgtaatcacgtcgattggtaggcattaggatgcaatttttcaaagtttcttatatacagttgctttttttttcttcttctgaagttattccttgtatgatgaaactggagaaatcttcttaaaacttaaaattctaggcacagatgtttctgtaattgtgaactttctggcagatggaagcttaagttttgataaaaaaaaaaaaaaaaaaa

SEQ ID NO: 7349 - protein, 562 aa, Nicotiana tabacum (common tobacco)
MATMNLPTGLHVAAKPASLDRLSSAKNVGDLFFSDSRHRKRVNTSNQIMAVQSLEHIHGVNNNVYANYVNFNVPSSGYSLGQESVYLNSPRKTKIVCTIGPSTSSREMIWKLAEAGMNVARLNMSHGDHASHQRTIDLVKEYNAQFEDKVIAIMLDTKGPEVISGDVPKPILLKEGQEFNFSIKRGVSTEDTVSVNYDDFINDVEAGDILLVDGGMMSLAVKSKTSDIVKCEVIDGGELKSRRHLNVRGKSATLPSITEKDWDDIKFGVNNQVDFYAVSFVKDAKVVHELKDYLKSCNADIHVIVKIESADSIPNLHSIISASDGAMVARGDLGAELPIEEVPLLQEDIIRRCQSMQKPVIVATNMLESMIDHPTPTRAEVSDISIAVREGADAVMLSGETAHGKYPLKAVKVMHIVALRTESSLQKSTSSPSQSAAYKSHMGEMFAFHSSSMANTLSTPIIVFTRTGSMAIILSHNRPSSTVFAFTNNERVKQRLALYHGVVPIYMEFSSDAEETFSRAIKLLLSKSLVKDGQYVTLVQSGAQPIWRRHSTHHIQVRKVQS

SEQ ID NO: 7350 - DNA, 2044 bp, Xenopus sp. (clawed frog)
  CDS (29)..(1612)
ttacgtagattccatacagtaggtcaacatgtctgaggcaggtagtgctttcattcagacccagcagctgcatgctgccatggcagacaccttcttggaacacatgtgccgtctagacatagactctgagccaattgtagcacgtaacacaggcatcatctgcactattggccctgcttcacgttctgtggaaatgctaaaggagatgataaaatctggaatgaatattgctcgtctgaacttttcccatggaacacacgagtatcatgctggcaccattaaaaatgtccgtgaagcaaccgagagcttagcttccaatcccattcactaccggcctgtggcagtggccctggacacaaagggaccagaaatccgcactggtctcattaaaggaagtggcacagcagaagtggagctaaaaaagggagcaactatgcgtatcactcttgatgatgcattccaggaaaactgtgatgagaatgtactgtgggtagattacaaaaaccttacaaaagtggtgaaacctggcagcaagatctatgtggatgatgggcttatttccttgctcgttaaggaaattggtccagacttctgcgtgactgagattgagaatgggggaatgttaggaagtaagaaaggagtgaacctccctggggcagctgtggatttgcctgctgtatcttcaaaagatatccaagacctgcaatttggtgtggagcaagatgtcgacatggtttttgcttcttttatcagaaaggcagcagatgtacatgaagtgagggaagttcttggagagaaaggcaaaaacatcaagattatcagcaaaattgaaaaccacgagggtgttcgcaggtttgatgagattctagaagcaagtgatggtataatggtggcacgtggtgatcttggtattgagatccctgccgaaaaagtcttccttgctcaaaagatgatgattggacgctgcaatcgtgctggcaaacctgtgatctgcgccactcagatgctggaaagcatgatcaaaaagcctcgcccaacacgtgccgaaggtagtgatgtggccaatgctgttctggatggggctgactgtataatgttgtcaggggagactgcaaagggagattacccattggaggctgtacgcatgcagcatgctattgcacgagaggcagaagcggccattttccatcggcagttgtttgaggaactgagacgcgtgtccccactgacccgtgatcccacagaagcgactgctgttggagcagtagaggcatcattcaaatgctccagtggagccatcatcgtgcttactaaatctggcaggtctgcgcatttactgtctcgttaccgcccacgcgcacccatcatctctgttactcgtaatgggcagacagcacgtcaggcacatctctatcgtggcatctttcctgtactctatagagaagctgtgcacgaggcatgggctgaggatgttgatagcagggtcaactttgcaatggacattggcaaggcccgtggctttttcaagagtggggatgttgtgatcgtactcactggctggcggccaggctctggtttcaccaacacaatgcgtgttgttccagtgccttaatctgcaaacccgataaaactataatctgttgtccattttttttctgcactctccacccagcagacgtaaactctgtagaccagattataaaccctttatttgtggcattgggagagacattagtgtgtttgtgcgcagcacggaattccattgttccgttgcttattacgatccctgtgttagtcggttattgcaagtgctgcccacatatacatgagatgtgtagaaatatctgtaattacactcctttctcagcccttcacttgtgcaagaaattgccttggatgtgcaataagtttgctcttcatctctagtctgagcagctacgtagttttttttgcttgtggttaggggaaggctttgtgttgtcctcatcctgtctgagatgcactgagtttagtgttaataaatcgatgcttatgcagcctcaca

SEQ ID NO: 7351 - protein, 527 aa, Xenopus sp. (clawed frog)
MSEAGSAFIQTQQLHAAMADTFLEHMCRLDIDSEPIVARNTGIICTIGPASRSVEMLKEMIKSGMNIARLNFSHGTHEYHAGTIKNVREATESLASNPIHYRPVAVALDTKGPEIRTGLIKGSGTAEVELKKGATMRITLDDAFQENCDENVLWVDYKNLTKVVKPGSKIYVDDGLISLLVKEIGPDFCVTEIENGGMLGSKKGVNLPGAAVDLPAVSSKDIQDLQFGVEQDVDMVFASFIRKAADVHEVREVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHAIAREAEAAIFHRQLFEELRRVSPLTRDPTEATAVGAVEASFKCSSGAIIVLTKSGRSAHLLSRYRPRAPIISVTRNGQTARQAHLYRGIFPVLYREAVHEAWAEDVDSRVNFAMDIGKARGFFKSGDVVIVLTGWRPGSGFTNTMRVVPVP

SEQ ID NO: 7352 - DNA, 2146 bp, Mus musculus (house mouse)
  CDS (30)..(1625)
ccgaagtacgcccgaggacttcaggaaccatgccgaagccacacagtgaagcagggactgccttcattcagacccagcagctccatgcagccatggctgacaccttcctggaacacatgtgccgcctggacattgactctgcccccatcacggcccgcaacactggcatcatttgtaccattgggcctgcttcccgatctgtggagatgctgaaggagatgattaagtctggaatgaatgtggctcggctgaatttctctcatggaacccatgagtaccatgcagagaccatcaagaatgtccgtgaagccacagaaagctttgcatctgatcccattctctaccgtcctgttgcggtggctctggatacaaagggacctgagatccggactggactcatcaagggcagcggcaccgctgaggtggagctgaagaagggagccactctgaagatcaccctggacaacgcttacatggagaagtgtgacgagaacatcctgcggttggactacaagaacatctgcaaggtggtggaggtgggcagcaagatctacgtggacgatgggctcatctcactgcaggtgaaggagaaaggcgctgacttcctggtgacggaggtggagaatggtggctccttgggcagcaagaagggcgtgaacctgccgggcgctgctgtggatctccccgctgtgtcggaaaaggacatccaggacctgaagtttggcgtggagcaggatgtggacatggtgtttgcatctttcatccgcaaggcagccgacgtgcatgaagtcaggaaggtgctgggagagaagggcaagaacatcaagatcatcagcaaaatcgagaaccatgaaggcgtccgcaggtttgatgagatcttggaggccagcgatgggatcatggtggctcgtggtgacctgggcactgagattcctgcagagaaggtcttcctgtctcagaagatgatgatcgggcgatgcaaccgagctgggaagcctgtcatctgttccacacagatgctggagatcatgatcaagaagccacgccccacccgtgctgaaggcagtgatgtggccaatgcagtcctggatggagcagactgcatcatgctgtctggagaaacagccaagggggactaccctctggaggctgttcgcatgcagcacctgattgcccgagaggcagaggctgccatctaccacttgcagctattcgaggaactccgccgcctggcgcccattaccagcgaccccacagaagctgccgccgtgggtgccgtggaggcctccttcaagtgctgcagtggggccattatcgtgctcaccaagtctggcaggagtgctcaccaagtggccaggtaccgccctcgggctcctatcattgccgtgactcgaaatccccagactgctcgccaggcccatctgtaccgtggcatcttccctgtgctgtgtaaggatgccgtgctgaatgcctgggctgaggatgtcgaccttcgtgtaaacttggccatggatgttggcaaggcccgaggcttcttcaagaagggagatgtggtcattgtgctgaccgggtggcgccctggctctggattcaccaacaccatgcgtgtagtgcctgtaccttgatggccctctggagcccctcttctagcccctgtcccttcccctcccctatcctttccattaggccagcaacgcttgtagtgctcactctgggccatagtgtggcgctggtgggctgggacaccagggaaaattaatgcctctaaaacatgcaatagagaccagctattattcagggccctacctgagccaggggtggaggaggaatgcaggactggaaaccctgactttatcacagaagggcggcagcatctctggactttgcttctgtagaaagttgtcagagaattcgcagccctagcctggagtcaggagacagcaagagtaggggctgaggttgtggggcccagggtcccagtgtagatgacgacttctggccctggccctgacctgctttcccaacagctttggcctccccactccttgtgcactccacttctgtcactgcagacactccactctccaccttgtattctgcagtctccaggcctgttgctatagtgcccacctgaatgtcaataaag

SEQ ID NO: 7353 - protein, 531 aa, Mus musculus (house mouse)
MPKPHSEAGTAFIQTQQLHAAMADTFLEHMCRLDIDSAPITARNTGIICTIGPASRSVEMLKEMIKSGMNVARLNFSHGTHEYHAETIKNVREATESFASDPILYRPVAVALDTKGPEIRTGLIKGSGTAEVELKKGATLKITLDNAYMEKCDENILRLDYKNICKVVEVGSKIYVDDGLISLQVKEKGADFLVTEVENGGSLGSKKGVNLPGAAVDLPAVSEKDIQDLKFGVEQDVDMVFASFIRKAADVHEVRKVLGEKGKNIKIISKIENHEGVRRFDEILEASDGIMVARGDLGTEIPAEKVFLSQKMMIGRCNRAGKPVICSTQMLEIMIKKPRPTRAEGSDVANAVLDGADCIMLSGETAKGDYPLEAVRMQHLIAREAEAAIYHLQLFEELRRLAPITSDPTEAAAVGAVEASFKCCSGAIIVLTKSGRSAHQVARYRPRAPIIAVTRNPQTARQAHLYRGIFPVLCKDAVLNAWAEDVDLRVNLAMDVGKARGFFKKGDVVIVLTGWRPGSGFTNTMRVVPVP

SEQ ID NO: 7354 - DNA, 1596 bp, Homo sapiens (man)
  CDS (1)..(1596)
atgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagcccccgcccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtga

SEQ ID NO: 7355 - protein, 531 aa, Homo sapiens (man) [sequence omitted]

SEQ ID NO: 7356 - DNA, 2113 bp, Saccharomyces cerevisiae
  CDS (437)..(1957)
cgcttttatgaacatattccgatatctctcacgatactaatattcgaaaaatctttctccttcgccgcgatggatggaagtaaaaacacatatataaaagtataaaatgaatgctggcgtattcttacatacaagagatttgtaaaaagtcaatgaaaagttctccacacgtgtttttctcttttactttttttttcttccttttggtttccttttttctttctcgtcgcttttatttagcgacgcagcataggaaacaggggtaaagtgtcataactttttagagaaaatgatatatcattaatatgcacacgtttatataaatggagaaagaaaacaaagaacataaaacattttgaagcagagcggtgaaacgcaactatattttactttcatcctctacgtccattgtaagattacaacaaaagcactatcgatgccagagtccagattgcagagactagctaatttgaaaataggaactccgcagcagctcagacgcacctccataataggtaccattgggcccaagacaaatagctgcgaggccattactgctctgagaaaagctggtttgaacatcattcgattgaacttttcccatggctcctacgaattccatcaatcagtaatcgaaaatgctgtgaaatcggaacagcaattccctggcaggccgctcgccattgccctggataccaagggtcccgagatcagaacaggtcgcacgttaaatgaccaagatctttatatccccgtagaccaccaaatgatctttaccactgacgcaagttttgcaaacacctccaatgataaaatcatgtatatagactatgctaacctgacaaaagttatcgttccggggagatttatatacgtggacgacgggattctctcttttaaagtgctccaaatcattgacgaatctaatttaagggtgcaagcggtaaactcgggttatatcgcatctcataaaggtgttaatctgcctaataccgacgttgatttgccccccttgtccgccaaagacatgaaggacttgcaattcggagtccgcaatggcattcacatcgtatttgcctctttcataagaacttcagaagatgtgttgtctatcagaaaagcgttgggttctgaagggcaagatatcaagattatatccaagatagaaaaccagcaagggttggataattttgacgaaatcctggaagtcacggatggtgttatgatagcgagaggcgatttaggaattgaaatcctggcacctgaagtattagccattcaaaaaaagctgattgcaaaatgtaatttggcgggcaaacctgtcatttgcgcgactcagatgctggattcaatgacacacaatccgagaccgacaagggctgaagtatcggatgtgggtaacgctgtgttggatggtgctgattgtgttatgctttctggagaaacggcgaagggtgattatccggtgaatgcagttaatattatggcggcgaccgctctgattgctgaaagtactatcgctcatttggctctttatgacgatctcagagacgccactcccaaacctacttccactacggaaactgtagcagctgcagctaccgcagcaatcttggagcaagatggtaaggccatcgttgtattatctactacagggaacacggcaaggctactgtcgaagtatagaccaagctgccctatcatattagtaacaagacacgcaagaacggcaagaattgcgcatttgtatagaggtgttttcccatttctgtatgaaccgaaacgcctagacgactggggtgaggatgttcataggcgcctaaagtttggtgttgaaatggcgaggtctttcggaatggtggacaacggtgatactgttgtttccattcaaggattcaaaggaggagtcggccattccaataccttacgcatttctactgttggtcaagaattctagtaaaaattaaagtccttattttttttacttaattttatttaattgtccattgtgtcagttattttttttttctttggtaataatcatgcagatattacaggtaatgttcgcaaactgcgtgtttactgtatgctgaaatgtttttttttttttaat

SEQ ID NO: 7357 - protein, 506 aa, Saccharomyces cerevisiae
MPESRLQRLANLKIGTPQQLRRTSIIGTIGPKTNSCEAITALRKAGLNIIRLNFSHGSYEFHQSVIENAVKSEQQFPGRPLAIALDTKGPEIRTGRTLNDQDLYIPVDHQMIFTTDASFANTSNDKIMYIDYANLTKVIVPGRFIYVDDGILSFKVLQIIDESNLRVQAVNSGYIASHKGVNLPNTDVDLPPLSAKDMKDLQFGVRNGIHIVFASFIRTSEDVLSIRKALGSEGQDIKIISKIENQQGLDNFDEILEVTDGVMIARGDLGIEILAPEVLAIQKKLIAKCNLAGKPVICATQMLDSMTHNPRPTRAEVSDVGNAVLDGADCVMLSGETAKGDYPVNAVNIMAATALIAESTIAHLALYDDLRDATPKPTSTTETVAAAATAAILEQDGKAIVVLSTTGNTARLLSKYRPSCPIILVTRHARTARIAHLYRGVFPFLYEPKRLDDWGEDVHRRLKFGVEMARSFGMVDNGDTVVSIQGFKGGVGHSNTLRISTVGQEF

SEQ ID NO: 7358 - DNA, 1527 bp, Mycoplasma pneumoniae
  CDS (1)..(1527): transl_table=4
atgattcaccacctaaaacgcactaagattattgccacctgtggtccggctttaactaaaaagctatgaacgctagcaatgttagatgacccagcttacgctgcgatgaaagcagaagcttacgccaacattgaaaatattattaaaaacggcgtaacggtaatccgcttaaacttctcccatggtaaccatgaagagcaggctgtaaggattaagattgttcgtgatgtggctaaaaagctcaacctcccggtgtcaattatgttagacaccaacggtccggaaatccgcgtctttgaaacggcccctgaagggttaaagatcctcaaggacagtgaggtggttattaacaccaccactaaggaagtggctaaaaataaccagtttagtgtgagtgatgctagtggcacttacaacatggtaaacgatgttaaggtgggacaaaaaatcctcgttgatgatggtaagttaagcttagtcgtaaagcggattgatacgaagaacaaccaggttatttgtgttgcccaaaatgaccacactatctttaccaaaaagcgcttaaacctccccaatgccgactactcaattccctttttaagtgctaaagacctacgcgacattgactttggtttaacccaccaaattgactacattgccgcttcctttgtcaatacaacggaaaacatcaagcaactgcgtgactacctcgcttctaagaatgccaagcatgtcaagcttattgccaaaattgagtccaaccacgctttaaacaacattgatgggattattaaagcgagtgatggcattatggtagcacggggtgatttgggcttggagatcccatattacaaggtgccttactgacaacggtacatgataaaagcgtgtcgtttctttaacaagcgtgttattaccgcaactcaaatgttggactctttggaaaaaaacatccaaccaactcgcgctgaagttactgatgtgtactttgccgtggaccgcggcaatgatgccaccatgttaagtggagaaaccgcaaatggggcgtttccccttaatgctgtgtatgtaatgaagatgattgataaacagtccgaaacgttctttgattaccagtacaacttgaactattacatggccaactccaaggcccgtcacagtgagttttgaaagcaggtggtgttaccgttagcacaaaaaacagcaccaaaacgcaaactgattaacagtgactttaaatacgactttgtggtgcacgccaccaacaaccttaatgaaatctatgccttgtccaacgctcgcttagcggctgcggtaattatcttgaccaatgacccccaagtatacaccgggcacggcgttgattatggcatcttcccttacttaattgaccaaaagccgcaaagcttaagtaaagctgagtttaagagcttagctaatgttgccattaaacactaccagcagcatggggaaattagtcaattaaagcagtgtttgggagtatttcacaataagatcattagcttataa

SEQ ID NO: 7359 - protein, 508 aa, Mycoplasma pneumoniae
MIHHLKRTKIIATCGPALTKKLWTLAMLDDPAYAAMKAEAYANIENIIKNGVTVIRLNFSHGNHEEQAVRIKIVRDVAKKLNLPVSIMLDTNGPEIRVFETAPEGLKILKDSEVVINTTTKEVAKNNQFSVSDASGTYNMVNDVKVGQKILVDDGKLSLVVKRIDTKNNQVICVAQNDHTIFTKKRLNLPNADYSIPFLSAKDLRDIDFGLTHQIDYIAASFVNTTENIKQLRDYLASKNAKHVKLIAKIESNHALNNIDGIIKASDGIMVARGDLGLEIPYYKVPYWQRYMIKACRFFNKRVITATQMLDSLEKNIQPTRAEVTDVYFAVDRGNDATMLSGETANGAFPLNAVYVMKMIDKQSETFFDYQYNLNYYMANSKARHSEFWKQVVLPLAQKTAPKRKLINSDFKYDFVVHATNNLNEIYALSNARLAAAVIILTNDPQVYTGHGVDYGIFPYLIDQKPQSLSKAEFKSLANVAIKHYQQHGEISQLKQCLGVFHNKIISL

SEQ ID NO: 7360 - DNA, 1452 bp, Synechocystis sp
  CDS (1)..(1452)
atgccagccctgattaacccggtgaagtttatgagacccctaagtcatcgcaccaaaattgtggccaccattggccccgccagtagttcggtagaggtgatacgtcagatggtggatgcgggcatgaatgtggcccggctgaatttttcccacggtagttatgaggaccatgccaccatggttcgcctactacggtcagtggagcaggaaatggacacccccattacccttttgcaagatttacaggggcccaaaattcggattggtcagttgccggggggagaaaagcaactgcgggaaggggaaaaagtttctttggtgccggtggaaattggcgatcgccatcctggagcggtgggcattgactatccccatttggcgacggaggcaaaagtaggggaaagaattttattggacgatggtttactggaaatgaaagttgtgtccattcaagatccagaggtaatttgtgaagtggtgaccgggggcatcctcaaaagtcgcaaaggggtcaatctaccgggtttagtcctaaccctaccttccatgacgaccaaagacaagcaagacttagaatttggtttgagccaaggcattgactgggtttcccttagttttgtccgcaaaggggaagatatccacacccttaaacaatttctcgctgaacggggccatcctgatctgccggtcattgccaaaattgaaaaaccccaggcgatcgataatctagaagaaatcgtggcagtttccaacggcattatggtggccaggggggatctgggggtggaagtaaacccagaaaaggttccccgtttgcaaaaggaaattattcggcgctgtaacgtgcgggccattccggtcatcaccgctacccaaatgctagatagcatgattcaaaattcccgacccaccagggcggaagccagtgacgtggccaacgctattttggacggcaccgatgcggtgatgttatcgggggaatcggcagtgggacaatatcccgttaaatcagtgcaaatgttgcgaaaaattgccgaagagacggaagtgggtctacatcttgttaataatcccccaatagaaaatacggaaacccatgccctaagtgaagcgttagtggtaattgacggaattctagatttaaaatacattgtcacgttcaccacctcaggttttacttctctcctcgcttccaaccaaagaccgtcggtgccggtgattgctttcactccctcagaaaaggtttaccatagcctcaacttagtttggggtattattccctttttaattaacgaagaatttgacacctttgaggatttaatccaacaggcggaggtactactgcgggatagaaaaatggtggaaaagggcgatcagttgctaatcatggcgggaattcccactaaaatacccaggggcactaatttcctcaagattcaccgtatttcttaa

SEQ ID NO: 7361 - protein, 483 aa, Synechocystis sp
MPALINPVKFMRPLSHRTKIVATIGPASSSVEVIRQMVDAGMNVARLNFSHGSYEDHATMVRLLRSVEQEMDTPITLLQDLQGPKIRIGQLPGGEKQLREGEKVSLVPVEIGDRHPGAVGIDYPHLATEAKVGERILLDDGLLEMKVVSIQDPEVICEVVTGGILKSRKGVNLPGLVLTLPSMTTKDKQDLEFGLSQGIDWVSLSFVRKGEDIHTLKQFLAERGHPDLPVIAKIEKPQAIDNLEEIVAVSNGIMVARGDLGVEVNPEKVPRLQKEIIRRCNVRAIPVITATQMLDSMIQNSRPTRAEASDVANAILDGTDAVMLSGESAVGQYPVKSVQMLRKIAEETEVGLHLVNNPPIENTETHALSEALVVIDGILDLKYIVTFTTSGFTSLLASNQRPSVPVIAFTPSEKVYHSLNLVWGIIPFLINEEFDTFEDLIQQAEVLLRDRKMVEKGDQLLIMAGIPTKIPRGTNFLKIHRIS

SEQ ID NO: 7362 - DNA, 1776 bp, Synechocystis sp
  CDS (1)..(1776)
atgcaaacgtctccccttccccgtcgtaccaaaatcgtcgctaccattggccccgcgacccaaagcaaggaagtgctgagacaactgatccaagccggtgctaccactttccgcctcaatttttcccacggagaccacgcttaccaccaacaaagtatccgtttgattcgccagattgcctttgaactgaaccaaccagtgggcattctccaggatttacaggggccaaagattcgggtgggcaaatttctcaatgatgccggctctgtgcaactcaaaaacggtgatccctataccctcaccagtcgcccggtggaatgtacggaaaccattagttccattagctacgaatatttagccgacgaagtaccttctggggcaagaattttgctcgacgacggcaaactggaaatgttggtggaggaagtggacactgttgcccgggatctccactgtcgggtgattgtggggggaaccctttccagcaataaaggggttaattttcccggggtctgcctttccgttaaggccatgaccgataaagataaggaagatttgatgttcgggctggaccaaggggtggactgggtggccctgagttttgttcgtaatccccaggatattgatgagattaaggggttaattgcggcggcagggaaatccgtgccggtaatcgccaaaattgagaagcacgaagcgattaaggatatgcaggcggtgctggaaaaatgtgacggtgtcatggtggcccggggggacttgggggtagaactacccgcagaagatgtacctattttgcaaaagaaactcattgccactgctaaccggttgggcattcctgtcattactgctacccaaatgttggacagtatggtcaacagcccccgacctactagggctgaagtgtccgacgtggccaatgccatcctcgatggtaccgatgcggtgatgctctccaacgaaacggcgatcggtaaatttcccgtggaagcagtggctattatggccaaaattgcggagcgcattgaacaggaagatatcaatccttcccaagcggaagccagtcgcacttctattcccaatgctatttccagcgccgttagccagattgcggaaaccctcaacgcggcggctattatgtctttgactaagaccggatccaccgcccgccatgtgtcaaagttccgccccaaaacccccattctggccgttacgccccatgtggatgtgtcccgtcagttgcagttggtgtggggagttaagcccctgttggtattggatttaccttccaccagccaaacgttccaagccgccattaacgtggcccaggaaaaccattttctccgggatggagatttggtggtgatgaccgccgggacattgcagggagttgccggttcgacggatttaatcaaagtggaagtggtcaaggccattcttggtcggggtgtaggtattggccaaggagctgtaagtggccgggccagggttgccagtcgtccccaggcgatcgcccaatttacccagggagaaattttagtagttccctctaccaacgctgattgtgtggacatgatgcgacgggcggcgggcattatcaccgaagaagaaagcctgactagccatgcggccattattggtttgcggctgggggtgccggtcattgtgggttttaaaggcgctacccaaaagattcgagatggagccattgtcaccatcgatgcccaaaaaggactgatttattccggtgcattacccccggtgtccaaaggatag

SEQ ID NO: 7363 - protein, 591 aa, Synechocystis sp
MQTSPLPRRTKIVATIGPATQSKEVLRQLIQAGATTFRLNFSHGDHAYHQQSIRLIRQIAFELNQPVGILQDLQGPKIRVGKFLNDAGSVQLKNGDPYTLTSRPVECTETISSISYEYLADEVPSGARILLDDGKLEMLVEEVDTVARDLHCRVIVGGTLSSNKGVNFPGVCLSVKAMTDKDKEDLMFGLDQGVDWVALSFVRNPQDIDEIKGLIAAAGKSVPVIAKIEKHEAIKDMQAVLEKCDGVMVARGDLGVELPAEDVPILQKKLIATANRLGIPVITATQMLDSMVNSPRPTRAEVSDVANAILDGTDAVMLSNETAIGKFPVEAVAIMAKIAERIEQEDINPSQAEASRTSIPNAISSAVSQIAETLNAAAIMSLTKTGSTARHVSKFRPKTPILAVTPHVDVSRQLQLVWGVKPLLVLDLPSTSQTFQAAINVAQENHFLRDGDLVVMTAGTLQGVAGSTDLIKVEVVKAILGRGVGIGQGAVSGRARVASRPQAIAQFTQGEILVVPSTNADCVDMMRRAAGIITEEESLTSHAAIIGLRLGVPVIVGFKGATQKIRDGAIVTIDAQKGLIYSGALPPVSKG

SEQ ID NO: 7364 - DNA, 1494 bp, Arabidopsis thaliana (mouse-ear cress)
  CDS (1)..(1494)
atggctatggaacagaggcctaagacgaagatcgtgtgcacactcgggccggcgtccagatctgtcccaatggtcgagaagcttcttatggcggggatgagcgtggctcgcttcaacttttctcatggatcttacgaatatcaccaggagactctcgacaatcttcgtcaggccatgcttaacactggcatgctatgtgctgtcatgctcgacaccaagggaccagagattcgaaccgggttcttaaaggatgggaaacctatccagctcaaacaaggccaagaaatcaccatttcaactgactatgacttgaagggtgatgagaaaactatttgcatgagctacaagaagttggcgcaagatgtgaatccaggcatggtcatactctgtgccgatggtaccatctcgttaaaggtcctttcttgtgacaaagaaaagggcactgtccgttgtcgttgtgagaacacttcaatgcttggtgaaagaaagaacgttaatctccctggtgttgtggttgatctcccaactctaactgaaaaagacaagcaagacattcttgaatggggagttcccaatcaaatcgacatgattgctctgtcttttgtcagaaaaggttcggacttggtacaagttaggaagctacttggaaaacatgctaaaaccatacttctcatgtcaaaggttgaaaaccaagaaggtgtagcgaattttgatgatatcttgataaactcggatgcgtttatgatcgcaagaggtgaccttggaatggagattccaattgagaagatattcttagctcagaaagtgatgatctacaagtgcaatttcatggggaagccagtggttacagcgactcagatgcttgagtctatgatcaaatccccacgaccaacaagagcagaagctactgatgttgcaaatgctgtcctcgatggcacagactgtgtcatgcttagtggtgaaaccgcagctggagcatacccagagcttgctgttcgtacaatggccaagatatgtgtggaagcagagagcacacttgactatggagacatcttcaagaggataatgcttcacgctgcggtccctatgagcccgatggagtcacttgcttcatctgcggtcagaaccgctacttcctcaagagccactcttatgatggtcttgaccagaggaggcagcacggcgaggctggtggctaagtatagaccagggatacccattttgtccgtggtggttcctgaaatcacgtctgactcttttgattgggcgtgtagcaacgaggcaccggcaagacacagtctcatctaccgtggtttagtcccggtgctgtatgctggatcggctagagcctcgatcgacgagtcaacagaagaaactctcgagttcgcgtcagagtatggtaaaaagaagcaactctgcaagaccggagactctgttgtggctctcttccgtacaggtaacgctattgttatcaagatcttgaccgtcaagtga

SEQ ID NO: 7365 - protein, 497 aa, Arabidopsis thaliana (mouse-ear cress)
MAMEQRPKTKIVCTLGPASRSVPMVEKLLMAGMSVARFNFSHGSYEYHQETLDNLRQAMLNTGMLCAVMLDTKGPEIRTGFLKDGKPIQLKQGQEITISTDYDLKGDEKTICMSYKKLAQDVNPGMVILCADGTISLKVLSCDKEKGTVRCRCENTSMLGERKNVNLPGVVVDLPTLTEKDKQDILEWGVPNQIDMIALSFVRKGSDLVQVRKLLGKHAKTILLMSKVENQEGVANFDDILINSDAFMIARGDLGMEIPIEKIFLAQKVMIYKCNFMGKPVVTATQMLESMIKSPRPTRAEATDVANAVLDGTDCVMLSGETAAGAYPELAVRTMAKICVEAESTLDYGDIFKRIMLHAAVPMSPMESLASSAVRTATSSRATLMMVLTRGGSTARLVAKYRPGIPILSVVVPEITSDSFDWACSNEAPARHSLIYRGLVPVLYAGSARASIDESTEETLEFASEYGKKKQLCKTGDSVVALFRTGNAIVIKILTVK

SEQ ID NO: 7366 - DNA, 2115 bp, Ricinus communis (castor bean)
  CDS (118)..(1869)
ggcccctcctctctgccactatggttcagccttcttcgctgctctctctttctttcttcctacttgttctcttccatggctctctagctcgccgtgtgtccgccaccggtaacaacaatgtcacagtctctccatttctcaccgaacctcactttcgccaaacaacctttccctaagctccctctcccattcccaacctccaattcccggtatccagtcaataattataaatcactctcaatcaaagcgtccacgtcgccgtcatcatcatcagatcctcaagttttagttgcggataacggaacagggaacagcggcgttttgtataataataacaacaaatcagttacagtttctgatccgagctcaattgaagttgacgccgtgacggagacggagttaaaagagaatggattcaggagtacacgtaggacaaagctagtgtgtacgataggaccagcgacttgtggatttgaagagctggaagcgttagcagtaggaggaatgaatgtagcgagaattaatatgtgtcatggaacacgtgagtggcacaagagtgtaattgaacgtgttaggagattgaatgaagagaaaggttttgctgttgctattatgatggatactgaaggtagtgaaattcatatgggtgatttaggtggtgcttcttctgctaaagctgaggatggtgaaatctggacttttagtgtcagagcctatgattctcctcgcccagagcgcaccatcaatgttaactatgacggttttgctgaggatgtgaaagttggggatgagctacttgtggatggtggaatggttaggtttgaggtgattgagaaaattggcccagatgtcaagtgccgatgtactgatcctggactgttattaccacgagctaatttgactttctggagggatgggagtcttgttagagaacgtaatgcaatgcttccaacaatttcctctaaggattggttagatattgactttggtatcgcagagggtgttgattttattgcaatatcttttgtcaagtctgctgaagtgattaatcatcttaaaagctacattgctgcaaggtctcgtgacagtgatatagctgtcattgctaagatagagagtattgactcattgaagaacttagaagagatcattcgagcatcagatggagctatggtagcaagaggagatctgggtgctcagataccattggaacaggttccatcagcccagcaaaacattgttcaggtctgcaggcagctaaataagccagtcattgttgcttctcagttacttgaatcaatgattgaataccctacacccaccagagcagaagtggctgatgtttctgaagctgttaggcaacgggctgatgctttgatgctctctggtgagtcagccatgggccagtaccccgagaaggcattggctgttctcagaagtgtcagtgtgagaattgagaagtggtggagagaagagaagcaccatgaagcaatggaactcccagcaattggatccacttattccgactctatttcagaggagatttgcaactctgctgccaagatggcgaacaacttgggggtggatgcactttttgtgtatacaaaagatggtcacatggcatctctcttgtctcgttgccggcctgactgcccaatctttgcttttacaactaccacatctgtacggagacgcctgaatttacagtggggcctgatacccttccgcctgagctttgctgatgatatggaaagcaaccttaacaaaaccttctctttgctcaaggctagaggaatgatcaaatcgggtgatcttgttatagctgtttcagacatgttacagtccatccaagttatgaatgttccttagaatttattttagatcgctgacgccatttcaacccttcatctagactgccttatctattatttgctatgtccatcgttactagttctgcaatttggttactgctggaaagatttgctggaaaggaaacggagagtaactgtgagttcatcatgttttcacctggctttatgcttgttatttcaaggagagcctcctatttttcaaaatggttggttgggattattccatttttggcaggtaatcaca

SEQ ID NO: 7367 - protein, 583 aa, Ricinus communis (castor bean)
MSQSLHFSPNLTFAKQPFPKLPLPFPTSNSRYPVNNYKSLSIKASTSPSSSSDPQVLVADNGTGNSGVLYNNNNKSVTVSDPSSIEVDAVTETELKENGFRSTRRTKLVCTIGPATCGFEELEALAVGGMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTTSVRRRLNLQWGLIPFRLSFADDMESNLNKTFSLLKARGMIKSGDLVIAVSDMLQSIQVMNVP

SEQ ID NO: 7368 - DNA, 2022 bp, Ricinus communis (castor bean)
  CDS (46)..(1527)
cgggtgggtatggtaccacaagtggttatggtcccactgcaggatatggcggtggtggtaaaggatttggaagaagcagtgagagtggtagttttggcagtgttaagggatatggaagtggtggtggtgctggtaacggcagtcatgggagtagtaggggatatgaatgtagcgagaattaatatgtgtcatggaacacgtgagtggcacaagagtgtaattgaacgtgttaggagattgaatgaagagaaaggttttgctgttgctattatgatggatactgaaggtagtgaaattcatatgggtgatttaggtggtgcttcttctgctaaagctgaggatggtgaaatctggacttttagtgtcagagcctatgattctcctcgcccagagcgcaccatcaatgttaactatgacggttttgctgaggatgtgaaagttggggatgagctacttgtggatggtggaatggttaggtttgaggtgattgagaaaattggcccagatgtcaagtgccgatgtactgatcctggactgttattaccacgagctaatttgactttctggagggatgggagtcttgttagagaacgtaatgcaatgcttccaacaatttcctctaaggattggttagatattgactttggtatcgcagagggtgttgattttattgcaatatcttttgtcaagtctgctgaagtgattaatcatcttaaaagctacattgctgcaaggtctcgtgacagtgatatagctgtcattgctaagatagagagtattgactcattgaagaacttagaagagatcattcgagcatcagatggagctatggtagcaagaggagatctgggtgctcagataccattggaacaggttccatcagcccagcaaaacattgttcaggtctgcaggcagctaaataagccagtcattgttgcttctcagttacttgaatcaatgattgaataccctacacccaccagagcagaagtggctgatgtttctgaagctgttaggcaacgggctgatgctttgatgctctctggtgagtcagccatgggccagtaccccgagaaggcattggctgttctcagaagtgtcagtgtgagaattgagaagtggtggagagaagagaagcaccatgaagcaatggaactcccagcaattggatccacttattccgactctatttcagaggagatttgcaactctgctgccaagatggcgaacaacttgggggtggatgcactttttgtgtatacaaaagatggtcacatggcatctctcttgtctcgttgccggcctgactgcccaatctttgcttttacaactaccacatctgtacggagacgcctgaatttacagtggggcctgatacccttccgcctgagctttgctgatgatatggaaagcaaccttaacaaaaccttctctttgctcaaggctagaggaatgatcaaatcgggtgatcttgttatagctgtttcagacatgttacagtccatccaagttatgaatgttccttagaatttattttagatcgctgacgccatttcaacccttcatctagactgccttatctattatttgctatgtccatcgttactagttctgcaatttggttactgctggaaagatttgctggaaaggaaacggagagtaactgtgagttcatcatgttttcacctggctttatgcttgttatttcaaggagagcctcctatttttcaaaatggttggttgggattattccatttttggcaggtaatcacaattttacccagtgacttcactttgcttaggttgagagtgatttattggttaatgtaccaaagaagatagagctgtaattacaaacagtatgctgtgactagtatgctatttaccagcttgaattaatggttcaacaaatgcttagactaagcatgatcaacataaaaaaatgtcagcagattctttttaagctgccatgttgctacatggtactttgttcttcattctactaaaacaatgagtatgata

SEQ ID NO: 7369 - protein, 493 aa, Ricinus communis (castor bean)
MAVVVKDLEEAVRVVVLAVLRDMEVVVVLVTAVMGVVGDMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTTSVRRRLNLQWGLIPFRLSFADDMESNLNKTFSLLKARGMIKSGDLVIAVSDMLQSIQVMNVP

SEQ ID NO: 7370 - DNA, 1548 bp, Caenorhabditis elegans
  CDS (1)..(1548)
atgtatcaggacgatcatatcggttcagagcattcatctgctactactaatatttctcatttatgcggacttcggatctcggagagacctcaaaaaacaagaaaaactggtgttatttgcactatcggaccagcgtgtagtgatgtagagacactgagaaaaatgataaacactggaatgaatattgccagattgaatttctcacatggaactcacgaggcacatgctgcaacaatcaagacaatccgtgaagctgctgaaaatgctccattcccggtcgcaattgctcttgacaccaaaggacctgaaattcgtaccggaatgtttgccaataatatgaaagaagttcaattggaaaatgggaaaagtgttcgagtttccacagatccatctatggaatttgctgcaacatcttctcatatttatgctgactacagaaatcttccaaaagttgttcaacctggttcaagaatctatattgatgacggattgatttctttaatcgtcgaaagttgtgaagaaacagcagttatatgtacaattgaaaatggaggagctcttggaacacggaaaggtgttaatcttcctggaactattgttgatcttcctgcagtcacatcaaaagatatcgaagatttattatttggagttgagcaaggtgttgatattatttttgcatcattcatcagaaatgccgacggaattcataaaattcgacaagttcttggagaaaaaggaaagcatatttacataattgcaaaaatcgaatcagaagatggagtcactaattgcgatgaaatcatcgaagcatccgatggagtaatggttgcaagaggagatcttggaattgaaattcctgcggagaaagtattcctcgcccagaaaatgctcattgccaaatgtaatctggcgggaaaacctgtgatatgtgcaacccagatgctcgagagcatgatcaccaaacctcgtccgactagagcagaatgcagtgacgtggcaaacgctgtcttggatggagttgactgtgtgatgttgagtggagaaactgcaaaaggagattatccagttgaagcattggcgattatgcataatatctgcaaagaagcagaatctgcattcttccatatgaaacattttgaagagcttattcttcataccaagaaaccaactggaatgactcatacaactgcaattgcagctgtttctgcaacaatcacatgccgtgctgtcgctattattctcatcacaacaacgggaaaaaccgcccgtctatgttcccgataccgtccaccagttccaattattactgtttctcgtgatgaacgaatctctcgtcaacttcatcttcacagaggaatctttcctgtttactatccaaagggacgtattgatgaatgggatgttgatgttgaggaacgtgtgcaatacggagtaaatcttggtaagacacgtggattcattcatcttggagatccacttattgtgatcactggatggaagcaaggagctggattcacaaacaccatgagaattgtagttgccacctaa

SEQ ID NO: 7371 - protein, 515 aa, Caenorhabditis elegans
MYQDDHIGSEHSSATTNISHLCGLRISERPQKTRKTGVICTIGPACSDVETLRKMINTGMNIARLNFSHGTHEAHAATIKTIREAAENAPFPVAIALDTKGPEIRTGMFANNMKEVQLENGKSVRVSTDPSMEFAATSSHIYADYRNLPKVVQPGSRIYIDDGLISLIVESCEETAVICTIENGGALGTRKGVNLPGTIVDLPAVTSKDIEDLLFGVEQGVDIIFASFIRNADGIHKIRQVLGEKGKHIYIIAKIESEDGVTNCDEIIEASDGVMVARGDLGIEIPAEKVFLAQKMLIAKCNLAGKPVICATQMLESMITKPRPTRAECSDVANAVLDGVDCVMLSGETAKGDYPVEALAIMHNICKEAESAFFHMKHFEELILHTKKPTGMTHTTAIAAVSATITCRAVAIILITTTGKTARLCSRYRPPVPIITVSRDERISRQLHLHRGIFPVYYPKGRIDEWDVDVEERVQYGVNLGKTRGFIHLGDPLIVITGWKQGAGFTNTMRIVVAT

SEQ ID NO: 7372 - DNA, 1437 bp, Streptomyces coelicolor
  CDS (1)..(1437)
atgcgccgagcaaagatcgtctgcactcttgggcccgccaccgactcgtacgaccagatcaaggacctggtcgacgccggaatggacatcgcccgcttcaatttcagccacggcacccacgccgaacacgaagagcgctaccaccgtgtccgcaaggcgtccgacgagaccggccgcagcgtcggtgccctcgccgaccttcagggcccgaagatccgcctcggccacttcggtgaagggcccgtactccttgaacgcggcgacagcttcaccatcaccgtcgaggagggcgtcgagggcgaccgctacatctgcggcaccacctacgcgggcctggccgaggacgtcacccccggtgagcgcgtcctcgtcgacgacggcaaggtctgcctggaggtgaccggggtcgacgggacccgggtgcggacgcgggtgatcgagggcggcatggtctccgaccacaagggcctcaacctgcccggcgtcgcggtgtccgtgcccgccctgtcgaagaaggacgaggacgacctgcgctgggcgctgcgggccggcttcgacgtggtcgccctctccttcgtccgcagcggacgcgacatcctcgacgtgcaccgcatcatggacgaggagggccgccgcctccccgtcatcgccaaggtcgagaagccgcaggccgtggagaacatcgaggacatcgtcgcggccttcgacggcatcatggtcgcccggggcgacctcggcgtcgagatgcccctggaacaggtgccgaccgtccagaagcgcgcggtgaagctggccaagcgcaacgccaagccggtcatcgtcgccacccagatgctcgactcgatgatcgacaacgcccgccccacccgcgcggaggcctccgacgtcgccaacgccgtcatcgacggcaccgacgccgtgatgctctccggcgagaccagcgtcggcaagcaccccaccgacaccgtgcgcacgatggcccggatcgtcgaagcggccgaggaggacatcctcgccaagggactccccccgctgaccgaacggaacaagccccgcacccagggcggtgcggtcgcccgcgccgccgccgagatgggcgacttcctcggcgccaagttcctggtcgccttcacccagtccggcgacacggtccgccgcctctcccgctaccgctcgcccattccgctgctcgccttcaccccggaaccggcgacccgctcccagctgagcctgacctggggtgtggagaccttcctcggtccgcacgccgactccacggacgcgatggtcgaccaggtggacgagcttctcacccgctacggacgctgcgaaaagggcgacgtcgtggtcatcacggccggctcaccgccgggggtgtccggcacgacgaacctggtgcgtgtgcaccacatcggggaggacgacattcccaagtga

SEQ ID NO: 7373 - protein, 478 aa, Streptomyces coelicolor
MRRAKIVCTLGPATDSYDQIKDLVDAGMDIARFNFSHGTHAEHEERYHRVRKASDETGRSVGALADLQGPKIRLGHFGEGPVLLERGDSFTITVEEGVEGDRYICGTTYAGLAEDVTPGERVLVDDGKVCLEVTGVDGTRVRTRVIEGGMVSDHKGLNLPGVAVSVPALSKKDEDDLRWALRAGFDVVALSFVRSGRDILDVHRIMDEEGRRLPVIAKVEKPQAVENIEDIVAAFDGIMVARGDLGVEMPLEQVPTVQKRAVKLAKRNAKPVIVATQMLDSMIDNARPTRAEASDVANAVIDGTDAVMLSGETSVGKHPTDTVRTMARIVEAAEEDILAKGLPPLTERNKPRTQGGAVARAAAEMGDFLGAKFLVAFTQSGDTVRRLSRYRSPIPLLAFTPEPATRSQLSLTWGVETFLGPHADSTDAMVDQVDELLTRYGRCEKGDVVVITAGSPPGVSGTTNLVRVHHIGEDDIPK

SEQ ID NO: 7374 - DNA, 1530 bp, Schizosaccharomyces pombe
  CDS (1)..(1530)
atgtcctcttctgctgtctctcctaagcaatgggtcgccggcctcaacagcgagcttgatatccccgctgtcaaccgtcgtacctccatcatttgcaccattggtcccaagtccaacaacgttgagaccttgtgcaagctccgtgatgctggtatgaacattgttcgtatgaacttctctcacggttcctacgaataccaccaatccgtcattgacaatgcccgtaaggcctctgccaccaaccctctcttccccttggccattgccttggatactaagggacctgagattcgtactggtctcaccgttggcggtactgactaccccatctcctctggtcacgagatgatcttcaccaccgacgatgcttatgccgagaagtgtaacgacaaggtcatgtacattgactacaagaacatcaccaaggtcattcaacctggccgtatcatctacgttgatgatggtatcctttccttcactgtcatcgagaaggttgatgacaagaatttgaaggtccgtgtcaacaacaacggtaagatctcttccaagaagggtgtcaacttgcctaagactgatgtcgatttgcccgctttgtccgagaaggacaaggccgatctccgcttcggtgtcaagaacggtgtcgacatgatctttgcttccttcatccgtcgtgctgaggacgttatccacatccgtgaagttttgggtgaggagggtaagaacatcaagatcatctgcaagatcgagaaccaacaaggtgttaacaactttgactctatccttgacgttaccgacggtatcatggttgcccgtggtgacttgggtattgaaatccctgcctctcaagttttcgtcgcccaaaagatgatgattgccaagtgcaacatcgctggtaagcccgttgcttgtgccactcaaatgcttgagtccatgacctacaaccctcgtcctactcgtgccgaggtttccgatgttggtaacgccgttctcgatggtgctgacttggtcatgctttccggtgagactaccaagggttcttaccccgttgaagccgttacctacatggctgagactgcccgtgttgctgaggcttccatcccttacggcagcctttaccaagagatgttcggcctcgtccgtcgtcctcttgagtgtgctaccgagaccactgctgtcgctgccatcggtgcctccattgagagtgatgccaaggccatcgttgtcttgtccaccagcggtaacactgctcgtctctgctccaagtaccgtccttctatccccattgttatggttactcgttgccctcaaagagctcgtcaatctcacctcaaccgtggtgtctaccccgtcatctacgagaaggagcctctttctgactggcaaaaggatgttgacgctcgtgttgcctacggttgccaacaagcttacaagatgaacatcctcaagaagggtgacaagatcattgtccttcaaggtgccgttggtggtaagggtcacacctccatcttccgtcttaccgttgccgagtaa

SEQ ID NO: 7375 - protein, 509 aa, Schizosaccharomyces pombe
MSSSAVSPKQWVAGLNSELDIPAVNRRTSIICTIGPKSNNVETLCKLRDAGMNIVRMNFSHGSYEYHQSVIDNARKASATNPLFPLAIALDTKGPEIRTGLTVGGTDYPISSGHEMIFTTDDAYAEKCNDKVMYIDYKNITKVIQPGRIIYVDDGILSFTVIEKVDDKNLKVRVNNNGKISSKKGVNLPKTDVDLPALSEKDKADLRFGVKNGVDMIFASFIRRAEDVIHIREVLGEEGKNIKIICKIENQQGVNNFDSILDVTDGIMVARGDLGIEIPASQVFVAQKMMIAKCNIAGKPVACATQMLESMTYNPRPTRAEVSDVGNAVLDGADLVMLSGETTKGSYPVEAVTYMAETARVAEASIPYGSLYQEMFGLVRRPLECATETTAVAAIGASIESDAKAIVVLSTSGNTARLCSKYRPSIPIVMVTRCPQRARQSHLNRGVYPVIYEKEPLSDWQKDVDARVAYGCQQAYKMNILKKGDKIIVLQGAVGGKGHTSIFRLTVAE

SEQ ID NO: 7376 - DNA, 1584 bp, Arabidopsis thaliana (mouse-ear cress)
  CDS (40)..(1584)
atgcattccagtcatcttcttctcgaggagccgatcaggatggcttcaatcctcgagccttccaaatctagtttcttcccggcattgactaagatcgtcggaactctaggtcctaaatcccgatccgtcgaggctctctccggctgtctcaaagccggcatgtctgtggctcgatttgatttctcgtggggagatgctgattatcaccaggagacacttgataatttgaaagttgctgtgaggagcactaagaagctttgtgctgttatgcttgatactgttggacctgagctacaagttattaacaaatctgagaaagctattactttgaaagctgatggccttgtaactttgacaccgaatcaagatcaagaagcttcttctgaagttcttcccattaatttcaatggacttgccaaggcagtgaagaaaggagacaccatcttcgttgggcaatacctattcactggtagtgaaacaacttcagtttggctcgaggttgatgaagttaaaggagatgatgtcatttgcctttcaaggaatgctgctactctggctggttctttgttcactttacactcctctcaagttcacattgatctcccaacgcttacagagaaggataaggaggttataagcacatggggagttcaaaataaaatcgattttctctcattgtcttattgtcgtcatgctgaggatgttcgccagacccgtgaaatgcttaaaaagttgggcgacctctctcaaacacaaatatttgctaagattgagaacgtagagggactaacccacttcgatgagattctacaagaagctgatggcattattctttctcgtgggaatttgggtatagatttacccccggaaaaggtgtttttgtttcaaaaggctgctctttacaagtgcaacatggctggaaagccagctgttcttacccgtgttgttgacagtatgactgacaacttgcgaccaactcgtgctgaggccacggatgttgctaatgctgttttagatggaagtgatgcaattcttcttggtgctgagacccttcgtggattgtaccctgttgagacaatatcaactgttggtaggatctgtgctgaggcagaaaaggttttcaatcaagatttgtactttaagaagactgtcaagtatgttggagaaccaatgactcacttggaatcgattgcttcttcagctgtacgggcagccattaaggttaaggcatccgtaattatatgcttcacctcttctggaagagcagccagattgattgccaaatacaggccaacgatgccggttatttctgttgtcattccccgggttaagacaaatcaactgaaatggagctttagtggagcttttgaggcgaggcagtcacttattgtcagaggcctcttccctatgcttgctgaccctcgtcaccctgcggaatctacaagtgcgacaaacgagtcagtcctgaaggttgctctagaccatgggaagcatgctggagtaatcaagtcgcatgacagagtagtggtgtgtcagaaagttggtgatgcatctgtggttaagatcattgagcttgaggattaa

SEQ ID NO: 7377 - protein, 514 aa, Arabidopsis thaliana (mouse-ear cress)
MASILEPSKSSFFPALTKIVGTLGPKSRSVEALSGCLKAGMSVARFDFSWGDADYHQETLDNLKVAVRSTKKLCAVMLDTVGPELQVINKSEKAITLKADGLVTLTPNQDQEASSEVLPINFNGLAKAVKKGDTIFVGQYLFTGSETTSVWLEVDEVKGDDVICLSRNAATLAGSLFTLHSSQVHIDLPTLTEKDKEVISTWGVQNKIDFLSLSYCRHAEDVRQTREMLKKLGDLSQTQIFAKIENVEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKHAGVIKSHDRVVVCQKVGDASVVKIIELED

SEQ ID NO: 7378 - DNA, 1533 bp, Arabidopsis thaliana (mouse-ear cress)
  CDS (1)..(1533)
atggagatgttacttggtggacaagcaaccaatggagctcttcgttcaaagacgaagataatttgtactcttggaccggtttcaagatcggtggagatgattgagaagcttctcaaggctggtatgaacgtagcccggttcaatttctctcatggttctcactcttaccatcaagaaactctcgataatctccgaaccgccatggacaacactggtattctctccgccgtcatgctcgacacaaagggtcctgagatacgaaccgggtttctcaaagaaggcaaaccgatacagctaaaccaaggtcaagagatcaccatctcaattgattacatgatagaaggagattcaaacgttatctccatgagctacaagaaacttgcagaagacgtcaaacctggtgatgtgattctctgttcagacggcacaatctctttaactgtcttgtcctgtgacaagtctttcggtcttgttcgttgccgttgcgagaactctgcaattctaggagaaagaaaaaacgttaatcttcctggaattgtagttgatctcccaacacttactgagaaagataaagaagatatcatccaatggggagttccgaacaaaatcgacatcatcgctctttcttttgttcgtaaaggatctgacctaactgaagttaggaggttacttggagaacactcaaagaacatcatgctcatgtcaaaggtggagaatcaagaaggggtcatgaattgtgaaaagattctggagaattctgatgctttcatggtggctagaggagatcttggaatggagattccgatcgaaaagatgttccttgctcagaaaacaatgatcaagatggctaatgctcttgggaaaccagttgtcacagccacacagatgcttgaatccatgacagtatctcctcgtccgactagagctgaagccactgacgttgcaaacgctgttcttgacgggacagactgcgttatgcttagtggagaaaccgctgctggagctcaccctgaggctgccgtgctaacaatgtcaaggatctgtaaagaagcagaggatttcatcgattacgacattctccacaagaaaaccctaggaatggtttcgttaccgttatctccgatcgagagcttagctgcttcagttgtttcgacggcacagagtgtttttgcgtcggcgatcgttgttctcaccaaaggcggttacacggcggagcttgtggctaaatacaggccgagcgttccgattttgtcagtgattgtgccagagattgctcaagggaatgatatggagatgtcgtgctcagactcggtggctcatgcggcgagacgtggtttgatttaccgtaggattattccggtggtggcgacgggatcttcggctagggattcaaacaaagatgcaacggaggagatgattaatttggctatcggattcgcgaagacgaagggaatttgcaagaatggagattcgattgtggcgttgcacaagattgatggttcctctgttgttaagatagtgaccgtggagtaa

SEQ ID NO: 7379 - protein, 510 aa, Arabidopsis thaliana (mouse-ear cress)
MEMLLGGQATNGALRSKTKIICTLGPVSRSVEMIEKLLKAGMNVARFNFSHGSHSYHQETLDNLRTAMDNTGILSAVMLDTKGPEIRTGFLKEGKPIQLNQGQEITISIDYMIEGDSNVISMSYKKLAEDVKPGDVILCSDGTISLTVLSCDKSFGLVRCRCENSAILGERKNVNLPGIVVDLPTLTEKDKEDIIQWGVPNKIDIIALSFVRKGSDLTEVRRLLGEHSKNIMLMSKVENQEGVMNCEKILENSDAFMVARGDLGMEIPIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMVSLPLSPIESLAASVVSTAQSVFASAIVVLTKGGYTAELVAKYRPSVPILSVIVPEIAQGNDMEMSCSDSVAHAARRGLIYRRIIPVVATGSSARDSNKDATEEMINLAIGFAKTKGICKNGDSIVALHKIDGSSVVKIVTVE

SEQ ID NO: 7380 - DNA, 1479 bp, Arabidopsis thaliana (mouse-ear cress)
  CDS (1)..(1479)
atggagatgttacttggtggccgagcaaccaatggagctctccgttcaaagacgaagatagtttgtactcttggaccggtttcaagatcggtggagatgattgagaagcttctcaaggctgaaactctcgataatctccgaactgccatgaacaacactggtatcctctgcgccgtcatgctcgatacaaagggtcctgagatacgaaccggttttctcaaagaaggcaaaccgatacagctaaaccaaggtcaagagatcaccatctcaattgattacaagatagaaggagattcaaacattatctccatgagctacaagaaacttgcagaggacgtcaaacctggtgatgtgattctctgttcagacggcacaatctctttaactgtcttgtcctgtgacaagtctttcggtcttgttcgttgccgttgcgagaactctacaattctaggagaaagaaaaaacgttaatcttcctggaattgtagttgatctcccaacacttactgagaaagataaagaagatatcatccaatggggagttccgaacaaaatcgacatcatcgctctttcttttgttcgtaaaggatctgacctaactgaagttaggaagttacttggagaacactcaaagaacatcatgctcatgtcaaaggtggagaatcaagaaggggtcatgaattgtgaaaagattctggagaattctgatgctttcatggtggctagaggagatcttggaatggagattcagatcgaaaagatgttccttgctcagaaaacaatgatcaagatggctaatgctcttgggaaaccagttgtcacagccacacagatgcttgaatccatgacagtatctcctcgtccgactagagctgaagccactgacgttgcaaacgctgttcttgacgggacagattgcgttatgcttagtggagaaaccgctgcaggagctcaccctgaggctgccgtgctaacaatgtcaaggatctgtaaagaagcagaggatttcatcgattacgacattctccacaagaaaaccctaggaatgctttcgttaccgttatctccgatcgagagcttagctgcttcagttgtttcgacggcacagagtgtttttgcgtcggctatcgtcgttctcaccaaaggcggttacacggcggagcttgtggctaaatacaggccgagcgttccgattttgtcggtgattgtgcctgagattgctcaagggaatgatatagagatgtcgtgctcggactcggtggctcatgtggcgagacgtggtttgatttaccgtgggattattccggtggtggcgacgggatcatcggctagggattcaaacaaagatgcaacggaggagatgattaatttggctatcggattcgcgaagacgaagggaatttgcaagaatggagattcgattgtggcgttgcacaagattgatggttcctctgttgtgaagatagtgagcgttgagtaa

SEQ ID NO: 7381 - protein, 492 aa, Arabidopsis thaliana (mouse-ear cress)
MEMLLGGRATNGALRSKTKIVCTLGPVSRSVEMIEKLLKAETLDNLRTAMNNTGILCAVMLDTKGPEIRTGFLKEGKPIQLNQGQEITISIDYKIEGDSNIISMSYKKLAEDVKPGDVILCSDGTISLTVLSCDKSFGLVRCRCENSTILGERKNVNLPGIVVDLPTLTEKDKEDIIQWGVPNKIDIIALSFVRKGSDLTEVRKLLGEHSKNIMLMSKVENQEGVMNCEKILENSDAFMVARGDLGMEIQIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMLSLPLSPIESLAASVVSTAQSVFASAIVVLTKGGYTAELVAKYRPSVPILSVIVPEIAQGNDIEMSCSDSVAHVARRGLIYRGIIPVVATGSSARDSNKDATEEMINLAIGFAKTKGICKNGDSIVALHKIDGSSVVKIVSVE

SEQ ID NO: 7382 - DNA, 1572 bp, synthetic construct
  CDS (1)..(1572)
atggccgccagctcttccctcgaccacctgagcaaccgcatgaagttggagtggcactccaagctcaacactgagatggtgccctccaagaacttccgccgcacctccatcatcggaaccatcggccccaagaccaactccgtggagaagatcaactctctccgcactgccggtcttaacgttgttcgcatgaccttctcccacggttcttatgaggaccaccaatctgttatcgacaacgcccgcgaggccgccaagacccaggtcggacgtcctctcgccattgctcaaggacccgagatccgtaccggaaacacccccgatgataaggatatccctatcaagcagggccacgagctcaacatcaccaccgacgagcaatatgccaccgcctccgacgacaagaacatgtacctcgactacaagaacatcaccaaggtgatctctcctggcaagctcatctatgttgatgacggtatcctttccttcgaggtcctcgaagtcgtagatgacaagaccatccgcgtccggtgcttgaacaacggcaacatctcttcccgcaagggtgttaacttgcccggcactgacgttgacctccccgccctttccgagaaggacattgccgatctcaagttcggtgttaggaacaaggtcgacatggtcttcgcttctttcatccgccgcggtagcgacattcgccacatccgtgaggttctgggtgaggagggcaaggagatccagatcattgccaagattgagaaccagcagggtgtcaacaacttcgacgagatcctcgaagagactgacggtgtcatggttgcccgtggtgaccttggtatcgagatccccgcccccaaggtcttcatcgcccagaagatgatgatcgccaagtgtaacatcaagggtaagcccgtcatctgtgccactcagatgctcgagtccatgacatacaaccctcgtcctactcgtgccgaggtgtccgatgttgccaacgccgtccttgacggtgccgactgtgtcatgctgtcgggagagaccgccaagggtaactaccccaacgaggccgtcaagatgatgtccgagacctgcctgctcgccgaggttgccatcccccacttcaatgtgttcgatgagctccgcaaccttgctcctcgccccaccgacactgtcgagtccatcgccatggctgccgttagcgccagtctggaactcaacgctggtgccattgtcgtcttgactaccaggggtaaaactgctcgctacctttccaagtaccgccccgtctcgcccattgtcatggttacccgtaaccccgctgcctcccgggactctcacctgtaccgtggtgtctggcccttcctcttccccgagaagaagcccgacttcaacgtcaaggtctggcaggaggatgttgaccgccgtctcaagtggggtatcaaccacgctcttaagctcggcatcatcaacaagggtgacaacatcgtctgtgtccagggatggcgcggcggtatgggccacaccaacaccgtccgtgtggtccctgctgaggagaaccttggcctggctgagtaa

SEQ ID NO: 7383 - protein, 523 aa, synthetic construct
MAASSSLDHLSNRMKLEWHSKLNTEMVPSKNFRRTSIIGTIGPKTNSVEKINSLRTAGLNVVRMTFSHGSYEDHQSVIDNAREAAKTQVGRPLAIAQGPEIRTGNTPDDKDIPIKQGHELNITTDEQYATASDDKNMYLDYKNITKVISPGKLIYVDDGILSFEVLEVVDDKTIRVRCLNNGNISSRKGVNLPGTDVDLPALSEKDIADLKFGVRNKVDMVFASFIRRGSDIRHIREVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPNEAVKMMSETCLLAEVAIPHFNVFDELRNLAPRPTDTVESIAMAAVSASLELNAGAIVVLTTRGKTARYLSKYRPVSPIVMVTRNPAASRDSHLYRGVWPFLFPEKKPDFNVKVWQEDVDRRLKWGINHALKLGIINKGDNIVCVQGWRGGMGHTNTVRVVPAEENLGLAE

SEQ ID NO: 7384 - DNA, 2795 bp, Corynebacterium glutamicum
  CDS (740)..(2173)
gggaattggtcgtctgggcaactgctttaaccaggagctctacggtgcagaaactaccgttccatgggctttggaaatctactatcgggtagatgaaaatggaaaattcgcaccggtgacaggaacatccaccggtgaagtaatggctactgttcatccaacattcctctatgaactgttgtggaacctactgatcttcgctttgttgatgtgggctgacaagcgattcaagctgggacatggccgagtatgcactctacgtagctggttataccttgggccgtttctggattgaacaaatgcgcgttgatgaagccacgcttattggcggcatccgaatcaacaccatcgtctccgcagtagtgtttgccggcgcgatcatcgtgttcttcctgttgaagaagggtagggaaactcccgaagaggtagatccgactttcgcagcgtctgttgcagcagatgctgtagcttcgccggatggaaaacccttgccgaaagcaggggagggcattgatggagaaacgccctcaacgcgataggtttcaaccataggcctgacctggctgagatgtttttggtagaaaaaccgagtgcccgaattgttttgtgggtgcccggttttttctgatttaagcacgtcagaggcgtagaacattgtctgttcacactctgggtcgcaagattcatcgagaattaatggtagtacctgtggcttgagggggaatgacgtactaggcttatgggcgtggatagacgaactaagattgtatgtaccctaggcccagcggtggctagtgcagatggaattctgcgtttggtagaagacggcatggatgttgctcgcctcaacttctcccatggtgaccacccagatcatgagcaaaactacaagtgggtccgcgaggcggcggagaagactggccgtgcagtcggtattctcgcagacctccaaggaccgaagatccgtcttggccgtttcactgacggcgcaaccgtgtgggaaaacggcgagaccattcggatcaccgttgacgatgtagagggaacgcacgatcgtgtgtccaccacctacaagaatctggcaaaagacgcgaagccaggcgaccgcctgctcgttgatgacggcaaggttggcctcgtctgcgtttccgtcgaaggtaacgacgtcatctgtgaggttgttgagggcggaccagtctccaacaacaagggtgtttccctgccaggtatggatatttccgtacctgcactgtccgaaaaggatatccgtgacctgcgcttcgccctgaagctcggcgtggactttattgcactgtccttcgtacgttccccagcagatgctgaactcgttcacaagatcatggacgaagaaggtcgtcgtgttcctgtgatcgccaagctggaaaagccagaggctgtcacctccctcgagccaatcgtgttggcattcgacgccgtcatggttgctcgtggtgacctcggcgttgaggttcctctggaggaggttccactggttcagaagcgcgcaatccagattgcccgtgagaacgcaaagccagttatcgtggcaacccagatgctggattccatgattgagaactcccgcccaacccgtgcggaagcttctgacgtggcaaacgctgtgctcgatggcgcagatgctgtcatgctttctggtgaaacttcagtgggcaaagatccgcacaacgttgtgcgcaccatgtctcgcattgttcgcttcgctgaaaccgacggtcgcgtcccagacctgacccacatccctcgcactaagcgtggcgttatttcctactctgcacgtgatatcgccgagcgcctcaacgctcgtgcattggttgcgttcaccacctctggtgataccgcaaagcgtgtggctcgtctgcacagccacctgccactgctcgtgttcactccaaatgaggcagttcgctctgagctggcgctgacctggggtgcaaccaccttcctgtgtccacctgtcagcgataccgatgacatgatgcgcgaagtcgaccgtgctcttttagcaatgcctgagtacaacaagggtgacatgatggttgttgttgcaggttcccctcctggtgttaccggtaacaccaacatgattcacgtccaccttcttggtgacgacacaaggattgcaaagctctaatcgcttaaatctttcaaaaaatgcgttgacactgtacgtggtgtcagcgcatttttcgtggctagggcaggggaaatccgcctcatttaagaatttacttgacacggaaagtaaattggtgaacaatggtgttcaacagcaaaacagccaccaacacttaaaggatgaaacaccatggcacttcttgagcagagcatcaataggacaccttcatggatgcagttagccttcgcgtcggcgacctagaggtatgactagttactactcttcaatccttagcgttgaaccaatggaagaaaaagttcacggaaaagaagttcaccgtgtactcggtcgcaatggcacccctctcgttcgcctgatttctaccccaggtcttctgcggtagatcctcgtcaagctggcctttatcacaaccgtttcctcttcgatacccaagagagcttggctgccaccgtttaccgcgcagcgcaagaatcacgctcacgttttgtgggttcttcagatcacctagtctctgaagctttttacttcaccgatcctgagggaaacggcattgagctctatgttgaccgccctcgaagtgcatggaagtatgcagacaacggcgatgtccgcatga

SEQ ID NO: 7385 - protein, 477 aa, Corynebacterium glutamicum
MGVDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 7386 - DNA, 2264 bp, Bacillus subtilis
  CDS (258)..(2012)
ttgggccatatccagcgcggaggttctccgagtgctgctgaccgtgtgttagcaagccgttctcgcgcatatgcagttgaactgctgcttgaaggaaaaggcggaccgtgtgtaggtatacaaaacaataagcttgtagaccatgatattatagaaatacttgagacaaaacacacagttgagcaaaacatgtatcagctttcaaaagaactgtctatctaatgtgcagctgaagatttcagaaggaagtgaaccaaatgagaaaaactaaaattgtttgtaccatcggtccggcaagtgaaagtattgaaatgcttacgaaattaatggagtcaggaatgaacgtggctcgattaaacttttctcacggagattttcaggagcacggtgcaagaattaaaaatatccgcgaggcagctgaaaaacttggcaagaacgttggaattctgcttgatacaaagggtcctgaaatccgcacacatacaatggaaaacggttccatagagctgaacgcaggaagcaaactcgtaataagcatgacggaggtgataggaacaccagataaaatttcagtgacatatgaaggtttagtccatgacgttaacaaaggttcaacgattctgttagatgacggccttatcggtcttgaggtacttgatgtagatgccgtaaaacgcgaaatcaaaacaaaagtattaaacaacggaacactcaaaaataaaaaaggtgttaacgtacccgggcgtaagtgtcaatcttccgggattactgaaaaggatgcgcgagacatcgttttcggtattgagcaaggagtagacttcatcgcaccatctttcattcgacgttctacggatgtgctcgaaatccgtgagcttcttgaagagcacaacgctcaggatattcaaatcatccctaaaatcgaaaaccaagagggcgttgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcgacacaaatgcttgacagcatgcagcgcaacccgcgtccgactcgtgcggaagcaagtgacgttgcaaacgcgatcttcgacggaacagatgcgatcatgctatctggtgaaactgctgccggaagctatccggttgaagcagttcaaacaatgcataacatcgcgtcccgttctgaagaagctttaaattataaagaaattctctcaaaacgcagagatcaagtgggcatgacaattacagacgcaattggacaatctgtcgcgcatacggcgattaacctgaatgctgcgatcgtaacgccgacagaaagcggccatacagcacgtatgattgcaaaataccgtccgcaggctccgattgttgcggttactgtaaatgactctatttccagaaagcttgccctcgtatctggcgtattcgcggaaagcggccaaaatgcgagctcaacagatgagatgcttgaggatgctgtccaaaaatcattgaacagcggaattgtaaaacacggcgatcttatcgttattacagcaggcactgtcggtgagtccggcactacgaatttgatgaaggttcatactgtcggtgatatcatcgctaaaggccaaggcattggacgcaaatcagcttacggtccggtcgtcgttgcacaaaatgcaaaagaagctgagcaaaaaatgactgacggtgcggtacttgttaccaaaagcactgaccgtgatatgattacatcccttgaaaaagcgtctgctcttattacagaagaaggcggtttgactagccatgcggcggtagtcggattaagccttggcatcccggttatcgtgggtctggaaaatgcgacatctattttgacagatggccaggatattacagttgacgcttccagaggtgcagtctatcaaggccgtgcgagcgttctttaattacaggtgaaaacggaaggggaatcccttccttttctctttatcatgccttttgttgaacagaacgtgttacacgtgtggggggcttggatatgagatttttgtttttgctttttattgtgtttccggcaatagaaatcgggatattcctatttttaggcaagctgattggcattttaccgacagttctattcatgattctgacgggcattatcggcgcagcagctgcaaaaaaacaaggaaccgaagtgt

SEQ ID NO: 7387 - protein, 584 aa, Bacillus subtilis
MRKTKIVCTIGPASESIEMLTKLMESGMNVARLNFSHGDFQEHGARIKNIREAAEKLGKNVGILLDTKGPEIRTHTMENGSIELNAGSKLVISMTEVIGTPDKISVTYEGLVHDVNKGSTILLDDGLIGLEVLDVDAVKREIKTKVLNNGTLKNKKGVNVPGRKCQSSGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMITSLEKASALITEEGGLTSHAAVVGLSLGIPVIVGLENATSILTDGQDITVDASRGAVYQGRASVL

SEQ ID NO: 7388 - DNA, 2569 bp, Zymomonas mobilis
  CDS (137)..(1564)
gatctctttgcgaagagacgcttcccttttccttccatttgtaacaaattgacaaacgaagttgtgcttgatcatctgatgatagaagcgcaaatggcatatgtaattaaatcagcaaagcggaaggaatagaagcatgactgaaggacttttcccacgcggccgcaaggtacgtgttgtttctacgctgggtcctgccagctcgacggcagaacagattcgtgatcgtttcttggctggtgcggatgtattccgtatcaacatgagccatggtacccatgacgaaaagaaggtcatcgttgacaacattcgtgcgcttgaaaaagaattcaaccgcccgaccacgatccttttcgatcttcagggtccgaagctccgcgttggtgacttcaaagaaggcaaggttcagttgaaagaaggccagaccttcactttcgatcaggacccaactctcggtgacgaaacccgcgtcaacctgccgcatcctgaaatcttcaaggctttagacaaaggtcatcgcctgcttttggatgatggtaagatcgttgttcgttgcgtcgaatcttccccgaccaaaatcgttacccgcgtcgaagttccgggtccgctttccgaccataaaggtttcaacgttcctgacgttgtgattccgctggccgctctgaccccgaaagatcgcaaagatctcgactttgctcttaaggaaaaagctgactgggttgctcttagctttgtgcagcgcgtcgaagacgtcatcgaagccaaagaactcatcaaaggtcgcgcaccgcttctcgttaaactcgaaaagccagctgccattgaaaacctcgaatccatcttggctgcaaccgatgctgtcatggttgctcgtggtgacctcggtgttgaatgcttgccggaatccgttcccccgacgcagaagcgtatcgttgaacgctcccgccagctgggtaagccggttgttgttgcaaccgctatgctcgaatccatgatcaaagctccggctccgacccgcgctgaagtaagtgacgttgcaaacgccatttacgaaggtgctgatggtatcatgctttctgcagaatccgccgccggtgattggccgcatgaagctgtcaacatgatgcatcgtattgcttcttatgttgaaaatgctccgggttacatcgaacgcgttcgcttcaccccgactccggcagaaccgacgacggttgacgctctggctgaaaacgccagcaaaaccgctgaaacggttggcgcaaaagcgatcatcgtcttcaccgaaaccggtaagaccgcacagcgcgtttcccgcgcccgtccggttgctccgatcctgtctctgaccccggatgccgaagttgctcgtcgtcttggtttggtctggggcgcacagccggttcaggtttccacggttaagaccctcgacgaagccaagaagctggctgctgaaaccgctaaaaaatacggtttcgccaaagccggtgacaagctggttgttgttgcaggtgaacctttcggtaaagctggaaccaccaacattgttgatgttatcgaagcctaattcgctttataacaacacagaaaaaaggccggggggacatttctctccggcttttttttaaggctcaagaatagcccgatatctgcttttccccaagatagtcacccttgctagtcacaaagaaagactgtcatctcgttttctcattcgggacagactttctatcgcaaaatcaacgcggctgtcttttccagctatccggctattgatgaccttattcccgctgcgtgcccgctcaatattgtggtcaaagaatgtggataatgaaatgtcttcttcagccccctcgcccctagccaaaatcgaaaatttcacgcttcaagatggcgttccccctgataatatcccttccgcccttcaacttttctggcaagcctttgaaagaaaattgaagataccctttaggcccacccgaaaaaggccaagaatttcttcgtcacagcatggggcgatcgatccatcgtcagcgcgatccgcaaggatggcaaactactcgggtgtcgcgacctataaaagctatcgccccaattcgcttactcaagatttggaaacatcttttgcgacttacgggaaagccagcggcctattccgtggattattattaagtcaactagaccaacaacctgccgcggatgaaatgatggtagaaagcatctgcgttgatgaaaaagcgcgcagccatggcattggccatgcacttcttggctatatcaaggaacaggcgacccgacagggtatgaaaagggttatcctcgatgtcattaccaaaaatgaaagggcgcatcgcctttatagccgcctaggctatcgcgatatcagacatcattctgttggtctcttgtcacccattttcggttttaaagagtctatccgcatgggtctaagcctaactcagtagcgattcctcccgaaaagaaggcttttcaagaggaacgctttgtctttcttctttttaaaaaatccgatacggcgatcactatacctgcaggtcgacactagtggatc

SEQ ID NO: 7389 - protein, 475 aa, Zymomonas mobilis
MTEGLFPRGRKVRVVSTLGPASSTAEQIRDRFLAGADVFRINMSHGTHDEKKVIVDNIRALEKEFNRPTTILFDLQGPKLRVGDFKEGKVQLKEGQTFTFDQDPTLGDETRVNLPHPEIFKALDKGHRLLLDDGKIVVRCVESSPTKIVTRVEVPGPLSDHKGFNVPDVVIPLAALTPKDRKDLDFALKEKADWVALSFVQRVEDVIEAKELIKGRAPLLVKLEKPAAIENLESILAATDAVMVARGDLGVECLPESVPPTQKRIVERSRQLGKPVVVATAMLESMIKAPAPTRAEVSDVANAIYEGADGIMLSAESAAGDWPHEAVNMMHRIASYVENAPGYIERVRFTPTPAEPTTVDALAENASKTAETVGAKAIIVFTETGKTAQRVSRARPVAPILSLTPDAEVARRLGLVWGAQPVQVSTVKTLDEAKKLAAETAKKYGFAKAGDKLVVVAGEPFGKAGTTNIVDVIEA

SEQ ID NO: 7390 - DNA, 1701 bp, Homo sapiens
  CDS (1)..(1701)
atgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctga

SEQ ID NO: 7391 - protein, 566 aa, Homo sapiens
MPLTTQQCGADPQRGRPREVCSGMEGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 7392 - DNA, 1515 bp, Debaryomyces hansenii
  CDS (1)..(1515)
atgtctaacgcatcattatcttggttaaccaaattgaataccagtgaaaccccagataaggttttacgtcgttcgtctattatcggtactattggaccaaagaccaacaacgttgacgttttggtcaaattaagaaaggccggtttaaacattgttcgtatgaacttctcgcacggatcttacgaataccatcaatccgttattgacaatgctaagcaatcggaagaaatctacaagggccgtccattggccattgctttggacactaaaggtccagaaatcagaactggtactaccattgacgacaaggactacccaatcttaccaaaccatgaaatgatcttcaccactgacgaagcttacgctaagaagtgtgacgacaaggttatgttcatcgactacaagaatatcaccaaggtcatcgaagccggtaaaatcatatatattgacgatggtgttgtttcattcgaagttttacaaattgtcgacgataagaccttgaaggttagatccgtcaactccggtaagatatgttcccacaagggtgttaacttgccaggtaccgatgttgacttaccagctttatccgaaaaggataaggctgatatcaaattcggtgtcaagaacggtgtccacatgatctttgcttctttcatcagaactggtgacgatatcaaggaaatccgtaaggttttaggtgaagaaggtaaggatatccaaatcattgctaagatcgaaaatcaacaaggtgtcaacaactttgacgaaatcttagtcgaaaccgatggtgttatggttgccagaggtgatttaggtattgaaattcctgctcctcaagtctttgttgttcaaaagcaattgattgctaagtgtaacttggctgctaagccagtcatttgtgccacccaaatgttggaatccatgacttacaacccaagaccaaccagagccgaagtttctgatgtcggtaacgccattttagatggtgctgattgtgttatgttgtctggtgaaactgccaagggtaactacccattcgaagctgtctccatgatgcacaacaccgctatcattgctgaaaaggccatcgcttaccaacctttacacaacgaaatcaggtctttagctaacagaccaacacctaccaccgaaacatgtgccatggcttccgtctcagctgcctacgaacaagatgctaaggctattgttgttttgtccacctctggtttcacctccagattggtttccaaatacaagccaaatgtcccagttatgatggttacaagaaaccatagagctgctagatactgtcacttgtacagaggtgtctacccatttgtctacgaaaagaaaactgttgacaactggcaagaagatgtcgaaaacagattaagatgggctgtttctgaagctattgatttaggtatcatcaagaagggtgactccatcgttactattcaaggttggaccagaggttctggtcactctaacactgttagggttgtccaagcttaa

SEQ ID NO: 7393 - protein, 504 aa, Debaryomyces hansenii
MSNASLSWLTKLNTSETPDKVLRRSSIIGTIGPKTNNVDVLVKLRKAGLNIVRMNFSHGSYEYHQSVIDNAKQSEEIYKGRPLAIALDTKGPEIRTGTTIDDKDYPILPNHEMIFTTDEAYAKKCDDKVMFIDYKNITKVIEAGKIIYIDDGVVSFEVLQIVDDKTLKVRSVNSGKICSHKGVNLPGTDVDLPALSEKDKADIKFGVKNGVHMIFASFIRTGDDIKEIRKVLGEEGKDIQIIAKIENQQGVNNFDEILVETDGVMVARGDLGIEIPAPQVFVVQKQLIAKCNLAAKPVICATQMLESMTYNPRPTRAEVSDVGNAILDGADCVMLSGETAKGNYPFEAVSMMHNTAIIAEKAIAYQPLHNEIRSLANRPTPTTETCAMASVSAAYEQDAKAIVVLSTSGFTSRLVSKYKPNVPVMMVTRNHRAARYCHLYRGVYPFVYEKKTVDNWQEDVENRLRWAVSEAIDLGIIKKGDSIVTIQGWTRGSGHSNTVRVVQA

SEQ ID NO: 7394 - DNA, 1443 bp, Erwinia carotovora subsp
  CDS (1)..(1443)
atgtccagacggctcagaagaaccaagattgttaccaccctggggcccgctaccgaccgcgataataatctcgaaaagattatcaatgcgggcgctaacgttgtacgcatgaatttttctcacggcacagcagaagaccatcaattacgtgccaacaaagttcgtgaaattgcggctaaattaggccgccatgttgccattcttggcgatctacagggtccaaaaattcgtgtttctaccttcaaagaaggtaaaatcttcctgaatatcggcgacaaattcttgctggatgccaacttagcgaaaggcgaaggcgataaagaaaaagtcgggatcgattacaaaggcttgccgagcgacgtggtgcctggcgatatcctgttactggatgacggccgcgtacagctgaaagtcctccaagttgaaggcctgaaagtttacaccgaagtcaccgttggtggcccgctgtctaacaataaaggcatcaacaaactcggtggcggtctgtctgccgaagccctgacggaaaaagataaagccgacattattactgctgcaaaaattggcgtcgactatctggcagtctctttcccacgcaccggtgaagacctcaactacgcacgccgcctcgcacgcgacgcaggctgtaacgccaagatcgtatcaaaagttgaacgtgctgaagcagtctgctcagatgccgcaatggatgacattattctggcttccgacgtggtaatggtcgcaaggggcgatctgggtgttgaaatcggtgaccctgagctggtagggattcagaagaaattgattcgccgtgcccgtcagttgaatcgtgcagtcattacggccacgcagatgatggaatcgatgatcaccaatccgatgccgacacgcgccgaggtaatggacgtcgccaacgccgtgctggatggcaccgatgcggtgatgctctcagcagaaaccgctgcgggtcaatatccggctgaaaccgtcgctgccatggcgaaagtgtgtttaggtgcggaaaaaatcccaagcatcaacgtctccaagcatcgccttgacgtgcagtttgataacacggaagaatccatcgcgatgtcttccatgtatgcagccaaccacctgaaaggggttactgcactgattgccatgacggagtctggccgtaccgctctgatgatgtctcgtatcagttctggcttgccgattttcgccatgtctcgccatgagcacacactgaacctgaccgcgctgtatcgcggcgtcacaccggtacatttcgacagctatacggatggcgttgccgcggccaatgatgcggtgatcctactgcgtgataaagggttcctgatgtctggggatctggtcatcgtcacacaaggtgacatcatgggtaccgtaggcacaaccaacaccattcgcattctgcgcgtggaataa

SEQ ID NO: 7395 - protein, 480 aa, Erwinia carotovora subsp
MSRRLRRTKIVTTLGPATDRDNNLEKIINAGANVVRMNFSHGTAEDHQLRANKVREIAAKLGRHVAILGDLQGPKIRVSTFKEGKIFLNIGDKFLLDANLAKGEGDKEKVGIDYKGLPSDVVPGDILLLDDGRVQLKVLQVEGLKVYTEVTVGGPLSNNKGINKLGGGLSAEALTEKDKADIITAAKIGVDYLAVSFPRTGEDLNYARRLARDAGCNAKIVSKVERAEAVCSDAAMDDIILASDVVMVARGDLGVEIGDPELVGIQKKLIRRARQLNRAVITATQMMESMITNPMPTRAEVMDVANAVLDGTDAVMLSAETAAGQYPAETVAAMAKVCLGAEKIPSINVSKHRLDVQFDNTEESIAMSSMYAANHLKGVTALIAMTESGRTALMMSRISSGLPIFAMSRHEHTLNLTALYRGVTPVHFDSYTDGVAAANDAVILLRDKGFLMSGDLVIVTQGDIMGTVGTTNTIRILRVE

SEQ ID NO: 7396 - DNA, 1179 bp, Mycoplasma arthritidis
  CDS (1)..(1179): transl-table=4
atgaaagatgatgcttgcttacttaaaaaaggtagcatcgtaactatcaaaacagatgaaaattcttataaaaatttagttggcgatgataaagtgatcactgtttcatatcgcatggataaagatatgcatgtaggtgcaaaagttttattagatgatggcaaattagtgacaatcgttaaagaaatcaagcctgaaattattttagtagaagtgcaaaatgaccatgttctaaaaactaataaaagagtgaatattcctggaattgatttttcaatgccttttatgtcgcctaaggatcgtgaagacattatttgaggtgctaaatatggcgttgatttcattgccgcttcttttgtgaatagtgctaaaaatgttcatgaaatccgtgaaattttaaaacaagcaaatgctgaacacattcaaatttgttcaaagattgaatcacaaaccggaattgacaatattgacgaaattattgaagctagtgattcaattatgattgctcgtggtgatttaggtcttgaaattccttactacgaagtgccatattgagagaaaaaaattattgccaaatgtcgcaaagcaaacaaagaagtaattgttgcaacccaaatgcttgattctatggaaaaaacgccgcttcctacaagagcagagattagtgatgtttattgggctactgaattgggtgcttctgctactatgacctctggtgaaactgctagtggacaatatccagttgaagcaattaaaacgatggcaacaataaatcatcgtgctgaacaagaatatttcaatgaaatagcaacttcatgtaactgccaatgccaaccaaaatgtgagcttggacatgttgctaaagaacttaaagaaaaaacaaaaactggcgattttccatatactattgctatttcagaagatggcaaattattgaaaaaaattgccaaatataaaccaaatactactgtaattgcattggttagcgatccgaagattgaaactgctttcggaatcactttcggaatcttttgtgaaaaaaatggtgctaaagcaattgaaaaagtcataaaggatcctaagtacttgaatgaaattttggcttcgcattttgatattaaaaaaggtcaaaaattcttagtaattaaagatggtttaatttctgaaaattcattgtaa

SEQ ID NO: 7397 - protein, 392 aa, Mycoplasma arthritidis
MKDDACLLKKGSIVTIKTDENSYKNLVGDDKVITVSYRMDKDMHVGAKVLLDDGKLVTIVKEIKPEIILVEVQNDHVLKTNKRVNIPGIDFSMPFMSPKDREDIIWGAKYGVDFIAASFVNSAKNVHEIREILKQANAEHIQICSKIESQTGIDNIDEIIEASDSIMIARGDLGLEIPYYEVPYWEKKIIAKCRKANKEVIVATQMLDSMEKTPLPTRAEISDVYWATELGASATMTSGETASGQYPVEAIKTMATINHRAEQEYFNEIATSCNCQCQPKCELGHVAKELKEKTKTGDFPYTIAISEDGKLLKKIAKYKPNTTVIALVSDPKIETAFGITFGIFCEKNGAKAIEKVIKDPKYLNEILASHFDIKKGQKFLVIKDGLISENSL

SEQ ID NO: 7398 - DNA, 1437 bp, Mesoplasma florum L1
  CDS (1)..(1437): transl_table=4
atgaacaagaaagaattacaagcacgtgtaaaacgtactaaaattattactacaactggtccatcaacaaatgaaccagaacaaataagagaattatttgaaaatggaatgacaacaatacgtttaaatttttcacatggtgattatgaagaacaaggttacagaattgctggagctaaaaaagttagagaagaattaggaaaacctgtttctattttattagatacaaaagggcctgaaattcgtgttggtaaatttgtagatggaaaacaagaagttactgcaaatcaatcaattacaatttacacagatgctgaatcattcaaaaacaaagaatgtttatcaggagaaatgactgttgcttatgacatgtcagttgatttaaaaattggtgatacaattttaatcgatgatggtaaattagaaatgactgttgaagaagttaaaccaggtgttgttaaagctatcgctttcaataaccacttagtaaaaactaacaaacgtgttaacttaccaggtgttgatttctcaatgccattcttagctcaaaaagatatcaatgatattaaatatggagttgaacaaggtgttgactacatcgctgcatcatttgttaactcagctgaaaatgtaaaagaaattcgtgatattttagcagaagctaatggatcagatattcaaattatttcaaaaattgaatcacaagttggaattgacaacattgatgcaattattgaagcatcagatggaattatgattgctcgtggtgacttaggattagaaattccttactacgacgtaccatactgagaaaaaataatgatcagaaaatgtcgtgaagctggtaaagttgttattgttgctactcaaatgttagaaacaatgacagaaaacccagcacctacaagagctgaagtaactgacgtttactttgctactgaattaggagcagatgcaacaatgttatctggagaatcagcagctggagattacccattcattactgttaacacaatggcaacaatcaacaaacgtgctgaaatagaattctacaaaaaagcatactaccaaactcaattagaaaacgctaaaaactcaactagtggaccacgtgcagatattgcaatggacttagctgaaagaactcgtgatggacaatatgaatttgctgttgttttatcaagaactggagctttattaaaaactatttctaaatttagaccaaatgtaacaattttaggtgtaagtgaatcagaaagattatgaactgcatttggtgtatgacactcaatcttcatgaacaaaactgctaacttattagaattagaagaaaatgttgctcaaatctcagaaattgcaaaattatgaggtgcaaaatcaggatcaaaaatcttagttgtaagaaacaaagatattcgtgaaattacagtagcttaa

SEQ ID NO: 7399 - protein, 478 aa, Mesoplasma florum L1
MNKKELQARVKRTKIITTTGPSTNEPEQIRELFENGMTTIRLNFSHGDYEEQGYRIAGAKKVREELGKPVSILLDTKGPEIRVGKFVDGKQEVTANQSITIYTDAESFKNKECLSGEMTVAYDMSVDLKIGDTILIDDGKLEMTVEEVKPGVVKAIAFNNHLVKTNKRVNLPGVDFSMPFLAQKDINDIKYGVEQGVDYIAASFVNSAENVKEIRDILAEANGSDIQIISKIESQVGIDNIDAIIEASDGIMIARGDLGLEIPYYDVPYWEKIMIRKCREAGKVVIVATQMLETMTENPAPTRAEVTDVYFATELGADATMLSGESAAGDYPFITVNTMATINKRAEIEFYKKAYYQTQLENAKNSTSGPRADIAMDLAERTRDGQYEFAVVLSRTGALLKTISKFRPNVTILGVSESERLWTAFGVWHSIFMNKTANLLELEENVAQISEIAKLWGAKSGSKILVVRNKDIREITVA

SEQ ID NO: 7400 - DNA, 1506 bp, Candida glabrata
  CDS (1)..(1506)
atggactctagattggctagattgactaccttgcaaacctctgccggtgaggaattgagaagaacctctatcatcggtaccattggtccaaagaccaacaacccagaaaccttggttgctctaagaaaggctggtttgaacattgtccgtatgaacttctcccacggttcttacgaataccacaagtctgtcattgacaatgccagaaagtccgaagagctatacccaggtagaccattggctatcgctttggacaccaagggtccagaaatcagaactggtaccaccactaacgaagtcgactacccaatcccaccaaaccacgaaatgatcttcaccaccgatgacaagtacgctaaggcttgtgacgacaagatcatgtacttggactacaagaacatcaccaaggtcatctccgctggtagaatcatctacgtcgatgacggtgttttgtctttcgaagtcttgcaagtcgttgacgacaagaccttgaaggtcaagtccttgaacgctggtaagatctgctcccacaagggtgttaacttgccaggtaccgatgtcgacttgccagctttgtctgaaaaggacaaggctgacttgagattcggtgttgaaaacggtgtccacatgatcttcgcttctttcatcagaaccgctcaagatgttttgaccatcagagaagttttgggtgaagacggtaaggacatcaagatcgtcgtcaagattgaaaaccaacaaggtgttaacaacttcgacgaaatcttgaaggtcactgacgctgtcatggttgccagaggtgacttgggtatcgaaatcccagccccagaagtcttggctgtccaaaagaagttgatcgctaagtctaacttggccggtaagccagttatctgtgctacccaaatgttggaatctatgacctacaacccaagaccaaccagagctgaagtttccgatgtcggtaacgctgttttggacggtgctgactgtgtcatgttgtccggtgaaaccgctaagggtaactacccaattaacgctgttaccactatggctgaaactgctttgatcgctgaacaagctattgcttacttgccaaactacgatgacatcagaaactgcactccaaagccaacttctaccactgaaactgttgctgcttccgccgtcgctgctgtcttcgaacaaaaggctaaggctatcatcgttttgtctacctctggtaccaccgctagattggtttccaagtacagaccaaactgcccaatcatcttggtcaccagaaacgccagaactgctagattctctcacttgtacagaggtgttttcccattcgtttacgagaaggaatctgtctctgactggactgaagatgttgaagctagattgaacttcggtatcgaacaagctatcgaattcggtatcttgaagaagggtgacacttacgtttccatccaaggtttcaaggctggtgtcggtcactccaacactttgcaagtctccactgcttaa

SEQ ID NO: 7401 - protein, 501 aa, Candida glabrata
MDSRLARLTTLQTSAGEELRRTSIIGTIGPKTNNPETLVALRKAGLNIVRMNFSHGSYEYHKSVIDNARKSEELYPGRPLAIALDTKGPEIRTGTTTNEVDYPIPPNHEMIFTTDDKYAKACDDKIMYLDYKNITKVISAGRIIYVDDGVLSFEVLQVVDDKTLKVKSLNAGKICSHKGVNLPGTDVDLPALSEKDKADLRFGVENGVHMIFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAVLDGADCVMLSGETAKGNYPINAVTTMAETALIAEQAIAYLPNYDDIRNCTPKPTSTTETVAASAVAAVFEQKAKAIIVLSTSGTTARLVSKYRPNCPIILVTRNARTARFSHLYRGVFPFVYEKESVSDWTEDVEARLNFGIEQAIEFGILKKGDTYVSIQGFKAGVGHSNTLQVSTA

SEQ ID NO: 7402 - DNA, 1527 bp, Candida glabrata
  CDS (1)..(1527)
atggactccaggttgcatagattgattaacttagaagtcactccaggtaaggatgtcagaaagactgccattattggtaccattggtcccaagactaacaatgttgacacattagttgctttgagaaaggctggtttgaatattgtccgtatgaacttctctcatggttcttacgaataccaccaatctgtgattgataacgccagaaagtcagaacaggtttatcctggtagaccattggccattgccttggacaccaagggtccagagattagaacaggtaccaatgttgacgatgttgactacccaattccaccaaatcatgagatgatcttcactactgatgataaatatgccaaggcatgtgatgacaagatcatgtatgttgattataagaacatcaccaaagtgattcaaccaggtaaagtcatctatgttgatgacggtgttttgtcttttgaagtcttagaagtcgtcgacgataagaccttgaaggtcaaatccttaaatgcaggtaaaatttcttctcataaaggtgttaacttgccaggaactgatgtcgacttaccagctttatctgaaaaggacaaagaagatttgagattcggtgtcaaaaatggtgttcatatgatctttgcctcttttatcagaactgcacaagatgtcttgactatcagagaagtactgggcgaggaaggtaaagacataaaagtcattgttaagatagaaaaccagcaaggtgtcaataactttgatgagattttggaagtggcccatggtgttatggttgccagaggtgacttgggtatcgaaattccggcaccacaggtcttggccgttcaaaagaaacttatagctaaatgtaacttggctggtaagccagtcatttgtgctactcaaatgctagagtccatgacattcaacccaagaccaaccagagctgaagtttctgatgttggtaacgctatattggatggtgctgattgtgtcatgttgtctggagaaactgctaaaggtaattaccccatcaatgctgtcacaacaatggcagaaactgccattatcgctgaacgagccattgcttatatgccattgtatgatgatttgagaaattgtactccaaaaccaacatcgacaacagagactgttgctgcctcggcagttgcagctgttcaagagcaaggtgccaaacttattttggtactatctacttctggtaacactgcaagattagtctccaagtatagacctcaatgcccaatcgttttggttacaagaaacccaagaactgctagattttctcatttattcagaggtgtgttcccatttgtttatgaaaaagaaccactagatgactggagtgaggatacccacgctcgtttgagatttggtgtcgatatggccaaagaatatggctttgttaagaatggtgatgcagttatttccattcaaggtttcaagggtggtgttggtcactctaatactatgcgtgtttccattgtaggtggagaaaaggaggatatctga

SEQ ID NO: 7403 - protein, 508 aa, Candida glabrata
MDSRLHRLINLEVTPGKDVRKTAIIGTIGPKTNNVDTLVALRKAGLNIVRMNFSHGSYEYHQSVIDNARKSEQVYPGRPLAIALDTKGPEIRTGTNVDDVDYPIPPNHEMIFTTDDKYAKACDDKIMYVDYKNITKVIQPGKVIYVDDGVLSFEVLEVVDDKTLKVKSLNAGKISSHKGVNLPGTDVDLPALSEKDKEDLRFGVKNGVHMIFASFIRTAQDVLTIREVLGEEGKDIKVIVKIENQQGVNNFDEILEVAHGVMVARGDLGIEIPAPQVLAVQKKLIAKCNLAGKPVICATQMLESMTFNPRPTRAEVSDVGNAILDGADCVMLSGETAKGNYPINAVTTMAETAIIAERAIAYMPLYDDLRNCTPKPTSTTETVAASAVAAVQEQGAKLILVLSTSGNTARLVSKYRPQCPIVLVTRNPRTARFSHLFRGVFPFVYEKEPLDDWSEDTHARLRFGVDMAKEYGFVKNGDAVISIQGFKGGVGHSNTMRVSIVGGEKEDI

SEQ ID NO: 7404 - DNA, 1071 bp, Bacillus thuringiensis serovar konkukian str
  CDS (1)..(1071)
atggtgataaaagtgacaatcgatcgagtttgtacaattggcccagcaagtaataataaagaaacgttagcacagttaataaacaatggtatgaaaattgttcggctaaatttatcacatggcacgcatgaaagtcataaagatattattcgtttagtgaaatcgttagatgattctattaaaattttaggcgatgtacaaggtcctaaaataaggttaggtgaaataaaaggagaacaaattacacttcaggcgggagattcttttctgttgcatacgcaaccagttacagggagtagtacggaagcaagtgttgattatgaaggaatcgcgaatgatgtgaaagttggaagtagaattttaatgaatgatggtgaagttgagttaatcgttgagaaggtaagtacggataaaatagaaacaaaggtcaaaacaggtggtaatatctcatctcataaaggggtgaacttaccaggcgcaatcgttagtttaccagctattacagagaaagataaaaaagatattcagtttctcttagaagagggtgttgattttattgcgtgttctttcgtaaggaaacctagtcatataaaagaaatacgagatttcatacaacagtatagagaaacgtcacctaatttaattgcaaaaatagaaacgatggaagcaatcgagaattttcaagatatatgtaaagaagcagacggaattatgattgcaaggggcgatttaggagtagagttgccgttccaatttattccgctcttgcaaaaaatgatgattcaggaatgtaatcgaacgaatacatatgttattacagcgacacaaatgcttcaatctatggtagatcattcgattccaacaagggctgaggtaactgatgtgtttcaagctgtactggatggaacgaatgctgttatgctttctgctgaaagtgcttcaggagagcatccggttgaaagtgtgagtacactacgtctcgtttctgaatttgctgagcatgtgaaacaagacggtccttttgtgatgaaagatgtactggaattgctgcataaatctttgggtgagtga

SEQ ID NO: 7405 - protein, 356 aa, Bacillus thuringiensis serovar konkukian str
MVIKVTIDRVCTIGPASNNKETLAQLINNGMKIVRLNLSHGTHESHKDIIRLVKSLDDSIKILGDVQGPKIRLGEIKGEQITLQAGDSFLLHTQPVTGSSTEASVDYEGIANDVKVGSRILMNDGEVELIVEKVSTDKIETKVKTGGNISSHKGVNLPGAIVSLPAITEKDKKDIQFLLEEGVDFIACSFVRKPSHIKEIRDFIQQYRETSPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPVESVSTLRLVSEFAEHVKQDGPFVMKDVLELLHKSLGE

SEQ ID NO: 7406 - DNA, 1960 bp, Zea mays
  CDS (144)..(1673)
gcacgagcgcacgagcgacgccgcccccattcattcttggagggcaagaagaacgcgcagtccaaaagcgaaacaaggggaaggggcgaggcagccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaagccaggcagtgtcatattgtgtgctgatggtaccatcactcttactgttcttcactgtgataaagaacaaggcttggttcgctgccgctgtgagaacactttcaagcttggcgagaggaagaatgttaatcttccaggagttattgttgatctccccacactcacagacaaggacaaggaggacatccttaaatggggtgttccaaacaagattgacatgattgccttgtcatttgttcggaagggttcggatcttgtggaggttaggaaggtacttggtgagcatgccaagtccataatgctgatgtcaaaggttgagaatcaagagggagtagctaactttgatgatatcctggcaaactctgatgcttttatggtggcaagaggtgatttaggaatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaacggatgttgcaaacgcagttcttgatggcacagactgtgttatgctcagtggtgagactgctgctggggcctatccagagttggcggtgcagactatggctaagatctgcctgcaagcagagtcttgcgtagaccatgctgctatttttaaatcaatcatggcttcagctccaattccaatgagtccattggagagccttggatcatcagctgttcgcacagcaaactctgccagggcagcacttatcttggtcctgaccaggggaggaactactgctaggcttgtagccaagtataggccatccatgccgattctgtccgttgtggttcctgagctgaagacagactcgttcgactgggcctgcagtgacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccggtcaatccgttgtggccctgcaccgcatcgggatttcatccgtcatcaagcttcttactgtgaagtaggggtccaagggtgagggacaccattttgcttggtgaatttttgtgaggctgcttacgcacatcagcgtatccacagcttttctgttgccaaagatacagactttgcgttctggtacaccttggtgttacaaggttgtgggaatttgtcgtttagatattagcgatttaaacagtttatcaactgctatagctaattaatttgcagctgtgctgcaactttatcgcacaaaaaaaaaaaaaaaaaaaaaaaaaaaaaaaaaaaaaaaaaaaaaaaaaaaaaaaaaaaa

SEQ ID NO: 7407 - protein, 509 aa, Zea mays
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLGSSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 7408 - DNA, 1452 bp, Mycoplasma mobile
  CDS (1)..(1452)
atgaatgtattagaaaaagaaaaaggtgttaatcttactgataaaagatcaaaaatgatcgctacaattggtccatcttcacaaaataaagaaattttaaaacaaatgatgttgaaaggtatgactacagttagagccaattttagccatggagatcatgcagaacaactaaataaatttgttttagcaaaagaagtagcaaaagaactaaatttaccaatgtctcttatgttagacactaaaggtcctgaaattagagttggaaaaatgaaagatggatctcaaaaaattgaagtagggaaaattattaccgttttaacagatgaagtttcatacaaaacttttgaaggaattccaactaaatttacagtttcacatagaatggataaagatgttaaagttggaagctacattttatttgatgatggaaaattaactactattgttacaggtgtaaaatcaggaattgtcgaagtaaaaacaattaattcacatgttttaaaatcaaataaaagaattaatattccaggagctcaattatcattagaatttttaagtaaaaaagataaagaagatattatctttggaattaaaaatgatgtaaattatattgctgcttcatttgttaattcgaaacaagatgttcttgatttaagaaaattattaaaagataataatggagaacatattcaaattatttcaaaaattgaatctgtatttggaattgaaaatattgatgaaattattgaagctagtgatggaatcatgatcgcaagaggagatttaggattagaaattccttattttgaagttcctttttatgaaaaacaaattattagaaaatgtcgtaatgttggtaaaccagttattgttgcaactcaaatgcttgattcaatggaaaaactacctcaaccaactagagcagaagttagtgatgtttactgggcaacagaattaggagcagatgcaactatgctttcaggagaaagtgcaaatggagatttccctgttgaatcagttgaagttatgtcaacaattaatcgtcgtgcagaaaaagaattttacaataaattatactatcctgcacatttagaaactttaattcaaaatccggttggagttcactcgaaattagcttctgaagttgcacttaaagtaatgaatggagattataaattttcagttattctttcagaaacaggaagattattaaaagaaattgcacgttttagacctaatacagttattatcggagttattaacaatgataaattaattcatggatttggaattacacacagtgtgtttatgagtgtagattcaaaagcagtaaaaagtgaaattgaaaaaaatcttactaaagcaagggaagttttaaaaccatttttccctaaaaaaggtgacaaatatttagttgttgaaaataataaaatttcagaatatatttattaa

SEQ ID NO: 7409 - protein, 483 aa, Mycoplasma mobile
MNVLEKEKGVNLTDKRSKMIATIGPSSQNKEILKQMMLKGMTTVRANFSHGDHAEQLNKFVLAKEVAKELNLPMSLMLDTKGPEIRVGKMKDGSQKIEVGKIITVLTDEVSYKTFEGIPTKFTVSHRMDKDVKVGSYILFDDGKLTTIVTGVKSGIVEVKTINSHVLKSNKRINIPGAQLSLEFLSKKDKEDIIFGIKNDVNYIAASFVNSKQDVLDLRKLLKDNNGEHIQIISKIESVFGIENIDEIIEASDGIMIARGDLGLEIPYFEVPFYEKQIIRKCRNVGKPVIVATQMLDSMEKLPQPTRAEVSDVYWATELGADATMLSGESANGDFPVESVEVMSTINRRAEKEFYNKLYYPAHLETLIQNPVGVHSKLASEVALKVMNGDYKFSVILSETGRLLKEIARFRPNTVIIGVINNDKLIHGFGITHSVFMSVDSKAVKSEIEKNLTKAREVLKPFFPKKGDKYLVVENNKISEYIY

SEQ ID NO: 7410 - DNA, 1668 bp, Picrophilus torridus
  CDS (1)..(1668)
atgtcaaggacaaagttaatagcaacaataggccctgcaagtgaatcaatggaaattataaaaaaaatggcaaatcttgggctttcatgcataaggataaatacagcacatattgaaaatggatacataacaaaagtagcaaaaatggttgatgatgttaataaatcagagggcacatatataggattaatggtggatttaaaggggccagagttaagaactggtaaattcaaggacggctcatttaaaatagattataataaaaagtataaaatatcatacaataaaaatgacaaccctgacatattaataaattataatatatcggatttcatagacgataaaacattaatagcaatgagcgatggaaagttaagattttccgttgattctgtaaacggcgatataataaacgttacatcccttgattcaggctctttaagggacaactcaagagtcaatgttccagggaagttgttaaggctcggaagcctgacggaccgagacaggatgttcatagaggagggcataaaaaacaatgtaaacttctatgcattatcatttgttcaatcaagggagaacataaacgagctccaggattatctctttgaaaggaactgcgatgcacagttaatatcaaagatagagacaaagagcggctatgataacatcgatgagatagcaagggcctctgattttataatggttgcccggggcgatcttggcgttgagatgccgttgaaggaggttacaatagcacagaagaaaattatagatgaatcaagaaagtatgcaacaccgacaatagttgcaacgcagatgcttgaatccatggttaacaacgattcaccaacaagggccgaggtctctgatataacaaatgcaataattgacggaactgacgcattgatgctatccgaggaaaccgccataggaaggtatcctgtcgaggccataggctatttaagcagcatatcagactatgtcgattccatggagataaaatacaaggaacctgaaagctttgcctttgacaaggtggcatttgccatatccaagggattaaagatgatatctgactacacaaacgttgattctattgttgcattcacaaggtctggattcaccgcaaggctggtatcatcaatgaggccagggaagatgatatactccgttgtttcaagcgatttccttgcaaggtcattaaaccttttaaaaagcgttgttcctgtaaaaatcgatgaatcaatgaagtcaaaggaaatatacgatatactcgttgatataaacaggagcaataagataagaccgggcaaaaaggtgcttgttgtttcaggctctccatactttgtcttcggcggcacaaacgagataaggcttgtaaccatgggaaaattcataggccgtggatatcctgttggtaacagcttctcaggttactatgagcccgatggctctggggatataataatacttgataaatatataaaaaactttgattacaaaaaatacaaatgcgttataataaaaggcaatgtaagcgatacaataaaaaacctattctatgaaaataagatacttttattgtacaacactgaattcgacgctgaattaaatgagaaaacatttctaaacatagacggtgatacaggaataataacagcataa

SEQ ID NO: 7411 - protein, 555 aa, Picrophilus torridus
MSRTKLIATIGPASESMEIIKKMANLGLSCIRINTAHIENGYITKVAKMVDDVNKSEGTYIGLMVDLKGPELRTGKFKDGSFKIDYNKKYKISYNKNDNPDILINYNISDFIDDKTLIAMSDGKLRFSVDSVNGDIINVTSLDSGSLRDNSRVNVPGKLLRLGSLTDRDRMFIEEGIKNNVNFYALSFVQSRENINELQDYLFERNCDAQLISKIETKSGYDNIDEIARASDFIMVARGDLGVEMPLKEVTIAQKKIIDESRKYATPTIVATQMLESMVNNDSPTRAEVSDITNAIIDGTDALMLSEETAIGRYPVEAIGYLSSISDYVDSMEIKYKEPESFAFDKVAFAISKGLKMISDYTNVDSIVAFTRSGFTARLVSSMRPGKMIYSVVSSDFLARSLNLLKSVVPVKIDESMKSKEIYDILVDINRSNKIRPGKKVLVVSGSPYFVFGGTNEIRLVTMGKFIGRGYPVGNSFSGYYEPDGSGDIIILDKYIKNFDYKKYKCVIIKGNVSDTIKNLFYENKILLLYNTEFDAELNEKTFLNIDGDTGIITA

SEQ ID NO: 7412 - DNA, 1536 bp, Plasmodium falciparum
  CDS (1)..(1536)
atgagttcatttaagtacaaaaactccgccgcaggtgccagtatgcaaagtgctgctaacataaccttgagacaaattttagaacccaataatgtgaatttacgttctaagaaaacacacattgtatgtaccttaggtccagcatgtaaatctgttgaaacacttgttaaattgattgatgcaggtatggatatttgccgttttaacttttctcacggtagccatgaagatcacaaggaaatgtttaacaacgtgttaaaagcccaagaattgaggccaaattgcttattaggaatgttgttagatactaaagggccagaaatcaggacagggtttttaaaaaataaagaagttcacttaaaagaaggtagtaaattaaaattagtaaccgattatgaatttttaggtgatgaaacttgtatagcatgttcatataagaaattaccacaaagtgtgaagccaggaaatattatattaatagctgatggatcagtaagttgtaaagttttagaaacacatgaagatcatgttattacagaagtattaaattcagctgttattggtgaaaggaaaaatatgaatttaccaaacgttaaggttgatttaccaattattagcgaaaaggataaaaatgatatactaaattttgctataccaatgggttgtaattttattgctgcctcatttattcaatcagccgatgatgtccgtttaattagaaacttattaggaccaagaggaagacatattaaaattattcccaaaatcgaaaacattgaaggtattattcatttcgataaaattttagctgaatctgatggtatcatgattgcaagaggagatttaggaatggaaatttctccagaaaaagttttcttggcacaaaaattgatgatatcaaaatgcaatttacaaggtaaaccaattatcactgccactcaaatgttagaatccatgaccaagaacccaagaccaacaagagcagaagttacagatgtagctaatgctgttttagatggtactgattgtgttatgctttcaggagaaactgcaggtggtaaatttccagtggaagctgttaccattatgtccaaaatctgtttagaagcagaagcatgcattgattataaattattatatcaatcattagtaaatgcaattgaaacaccaattagtgttcaagaagctgtggctagatcagctgtagaaacagcagaatctattcaagcttctttaattatagctttaacagaaacaggttatacggctagattaattgccaaatataaaccaagttgtaccatcttagcccttagtgcttctgattcaactgttaaatgtttgaacgtacacagaggtgttacatgcattaaagtaggttcattccaaggaacagatattgttattagaaatgctattgaaatcgcaaaacaaagaaatatggcaaaagttggtgatagcgttattgctattcacggaattaaagaagaagtatctggaggtaccaacttaatgaaagttgtacaaattgaataa

SEQ ID NO: 7413 - protein, 511 aa, Plasmodium falciparum
MSSFKYKNSAAGASMQSAANITLRQILEPNNVNLRSKKTHIVCTLGPACKSVETLVKLIDAGMDICRFNFSHGSHEDHKEMFNNVLKAQELRPNCLLGMLLDTKGPEIRTGFLKNKEVHLKEGSKLKLVTDYEFLGDETCIACSYKKLPQSVKPGNIILIADGSVSCKVLETHEDHVITEVLNSAVIGERKNMNLPNVKVDLPIISEKDKNDILNFAIPMGCNFIAASFIQSADDVRLIRNLLGPRGRHIKIIPKIENIEGIIHFDKILAESDGIMIARGDLGMEISPEKVFLAQKLMISKCNLQGKPIITATQMLESMTKNPRPTRAEVTDVANAVLDGTDCVMLSGETAGGKFPVEAVTIMSKICLEAEACIDYKLLYQSLVNAIETPISVQEAVARSAVETAESIQASLIIALTETGYTARLIAKYKPSCTILALSASDSTVKCLNVHRGVTCIKVGSFQGTDIVIRNAIEIAKQRNMAKVGDSVIAIHGIKEEVSGGTNLMKVVQIE

SEQ ID NO: 7414 - DNA, 1458 bp, Photobacterium profundum
  CDS (1)..(1458)
atggagtttcaaatgtctgaacaactaagacgtaccaaaatcgtaactacacttggtcctgctactgaccgcgataacaaccttgaaaaaattatcgccgctggagctaacgtagttcgaatgaacttctctcacggtagccctgaagatcatattcaacgtacaaaaatggtacgtgaaattgcagcaaagctaggtaagcatattgctattcttggcgaccttcaaggtccgaaaattcgagtttctacttttaaagacggtaaaatacaattggctatcggtgataagttcacgctagatagtgaccttccaaaaggtgaaggccatcaagatgctgtcggtcttgactataaagagctacccaatgatgttgtgactggcgatcttttacttctagatgatggtcgagttcagttaaaagtaacagcagtgagtggtaataaagtacataccgaagtcaccgttggtggtccgttatctaataacaaaggcatcaataaaaaaggcggtgggctttcagctgaagcactaacagagaaagacaaagccgacattattactgcagcccaaatgggtgtggactaccttgcagtgtcattcccacgtaacggcgaagacatgaagtatgctcgaagcttggcattagatgctggtcttgaagctaagttagtcgctaaagttgagcgtgcagaagccgtagcaacaacagaagcaatggatgacatcatcatggcatctgatgtggtaatggttgctcgtggtgaccttggggttgaaattggtgaccctgagctggttggtgttcagaagaaattaattcgtcgtgctcgtagccttaaccgtaccgtcattactgcaactcaaatgatggagtcaatgattactagcccaatgccaacacgtgcagaagtcatggacgttgctaacgccgtattggatggtacagatgctgtaatgctttcagcagaaacagcagctggtgatttcccagttgaaaccgttcaagcaatgtcgagtgtttgtgtgggtgctgaaaaagagcctagcatcaatgtatccaatcaccgcttaactcgcacatttgcttcgcctgaagaaactatcgcaatgtctaccatgtatgctgcaaaccatatggaaggcgtaaaagcgatggtagcaatgaccgaatctggtcgtacagcattaatgatgtctcgtatctcatctggtttacctattttcgctatgtcacgtaacgaaagtacattgaatcgttcttcactataccgcggtgtaacacctgtctatttcgaccgtgatagcgacgcaggtcttgaagcggctaaacacgcactggttgtgcttaaagagcatggttacttagcaacgggtgatcttgtcattatcacccaaggtgacgtaatggatacgattggttctaccaacaatatgcgtattcttactgttgaataa

SEQ ID NO: 7415 - protein, 485 aa, Photobacterium profundum
MEFQMSEQLRRTKIVTTLGPATDRDNNLEKIIAAGANVVRMNFSHGSPEDHIQRTKMVREIAAKLGKHIAILGDLQGPKIRVSTFKDGKIQLAIGDKFTLDSDLPKGEGHQDAVGLDYKELPNDVVTGDLLLLDDGRVQLKVTAVSGNKVHTEVTVGGPLSNNKGINKKGGGLSAEALTEKDKADIITAAQMGVDYLAVSFPRNGEDMKYARSLALDAGLEAKLVAKVERAEAVATTEAMDDIIMASDVVMVARGDLGVEIGDPELVGVQKKLIRRARSLNRTVITATQMMESMITSPMPTRAEVMDVANAVLDGTDAVMLSAETAAGDFPVETVQAMSSVCVGAEKEPSINVSNHRLTRTFASPEETIAMSTMYAANHMEGVKAMVAMTESGRTALMMSRISSGLPIFAMSRNESTLNRSSLYRGVTPVYFDRDSDAGLEAAKHALVVLKEHGYLATGDLVIITQGDVMDTIGSTNNMRILTVE

SEQ ID NO: 7416 - DNA, 1413 bp, Photobacterium profundum
  CDS (1)..(1413)
atgaaaaagaccaagatcgtatgtacgattggaccaaaaactgaatctgtagaaatgctgactaaactagctaacgctggtatgaacgtaatgcgtttaaacttctctcacggtaacttcgaagaacacggtcaacgtatcgtaaacctacgtgaagtaatggctacatctgctcagcctctagctatcttgctagatactaaaggtcctgaaattcgtactatcaaactagaaaatggcgaagatttcgctctagttgctggtcaagaattcacattcacaactgatattacagttgttggcaaccaagaccgcgttgcagtaacttacccaggtttcgctaaagaccttactaaaggtaacatcatccttgttgatgatggtcttatcgaaatggaagtactagaaacaactgaaactgaagttaagtgtaaagtacttaacaacggtgaccttggtgaaaacaaaggtgttaacctacctggtgtttctgtaaagcttcctgctctttctgaaaaagataaagcagacctagtattcggttgtgagcaaggcgttgatttcgttgctgcatctttcattcgtaaagaagatgatgttaaagaaatccgtgctctacttgctgctaacggtggcgagaagattcaaatcatctctaaaatcgaaaaccaggaaggcgttgataactttgactctatcctagaagcttctgacggtatcatggttgctcgtggcgaccttggtgttgaaatcccagtagaagaagttatctttgctcagaagatgatgatcgagaaatgtaatcgcgcacgtaaagttgttatcactgcaactcaaatgcttgattctatgattaagaacccacgtccgactcgcgcagaagcgggtgacgttgcaaacgcaatcatggatggtactgatgcagtcatgctatctggtgaatcagctaagggtaaatacccaattgaagctgtaactatcatggctcaaatctgtaaccgtacagattcagcgttaaaagcagaattaggttctcgcctagacagctctcgtctacgtattactgaagctgtatgtaaaggcgcagtagacacttcagagaagctaaatgctcctctaattgttgttgctactgaagcgggtaaatctgctcgctctatccgtaagtacttcccaacagcgaaaattattgctgtaactacaaaccagaaaacagctgctcagctttgtctaacgaaaggtgttacacctatcgttgttgatgctatcgacaacactgatgcattctacagtcgcggtaaagaaatcgcgctagaaactggtcttggcgctaaaggcgatatcgttgttatggtatctggcgcactagttccttctggtacaactaacacagcttctgtacacgtactttaa

SEQ ID NO: 7417 - protein, 470 aa, Photobacterium profundum
MKKTKIVCTIGPKTESVEMLTKLANAGMNVMRLNFSHGNFEEHGQRIVNLREVMATSAQPLAILLDTKGPEIRTIKLENGEDFALVAGQEFTFTTDITVVGNQDRVAVTYPGFAKDLTKGNIILVDDGLIEMEVLETTETEVKCKVLNNGDLGENKGVNLPGVSVKLPALSEKDKADLVFGCEQGVDFVAASFIRKEDDVKEIRALLAANGGEKIQIISKIENQEGVDNFDSILEASDGIMVARGDLGVEIPVEEVIFAQKMMIEKCNRARKVVITATQMLDSMIKNPRPTRAEAGDVANAIMDGTDAVMLSGESAKGKYPIEAVTIMAQICNRTDSALKAELGSRLDSSRLRITEAVCKGAVDTSEKLNAPLIVVATEAGKSARSIRKYFPTAKIIAVTTNQKTAAQLCLTKGVTPIVVDAIDNTDAFYSRGKEIALETGLGAKGDIVVMVSGALVPSGTTNTASVHVL

SEQ ID NO: 7418 - DNA, 1344 bp, Methanococcus maripaludis
  CDS (1)..(1344)
atggttgaaaaatcgacggaatataggaaaaccaaaattctggttactatggggccatctcttgacggaacttttgaaaaaagtcttgaatttattgatggaattcgctttaacatgtctcacacaaatacaaaacatattgaaaaatatctcgatattttaaataaaaaaaatattgcaaaactcatggatttaaagggaaacaagattaggataaaaaaatcaaatttttcagaactcattgaaaatcaggttgtaaaacttggaaaagatattctaatttcatatattccagaatgtattaaaaagggccaaaatatcctgattaatgatggaaaaataaaattaatcgttgaaagtgttgaaaaagatataactgcacgtgttttagttggaggacacataaaagaaaaaatgggagtaaactttcctgaaggatgctttccaaacgatttaacagatgaagatataaaaaacgtgaaatttgcagttgaaaatgaatttgaatacattgcactatctttcgttagaagtgaaacggatattttgaatttaaaaaatttaattaaagaatattctggaaattgctcagttattgcaaaaatcgagaccaaagaaggattgaaaaacattgatgagattttaaatcattcggatggcgtaatgattgcgagaggcgatcttggagttgaagttgccattgaatatctgccgataattcaaaaaaatattataaaacttgcaaatgagaagggaaaactcataattactgcaacccagatgctcgactcaatggtaaataatccgtatcccacaagagcagaagttacggatgttgcaaatgcaatatttgatggaaccgactgtttaatgctttcaaatgaaaccacaattggaaaatatccaatcgaatcaataaaaactctcgataatattgcaagagtttcagaaaatgatatttcaaaatacaaacaggaaatagaatttgaagaacattcaatctattcaggaattgcctatgcagttgaagctctttcaaaaaaattaaatcctaagatagtaattactccaacaacttcgggaaaaactccgctcagaatttcaaaattccggtttaattcaccaattattgcccttgctcctgaaaatatagtttttagaaaattaagattggtttggggagtaattccaataaaaattgatgaaataggagatgttgatgaagtacttgaaatatctaaaaaaattgcgaaaaatataattgacagcggtatttacgttgtaacgctcgggcacccaaaaggcgagaaaaaaacaaacgttataaaagttgagagcatataa

SEQ ID NO: 7419 - protein, 447 aa, Methanococcus maripaludis
MVEKSTEYRKTKILVTMGPSLDGTFEKSLEFIDGIRFNMSHTNTKHIEKYLDILNKKNIAKLMDLKGNKIRIKKSNFSELIENQVVKLGKDILISYIPECIKKGQNILINDGKIKLIVESVEKDITARVLVGGHIKEKMGVNFPEGCFPNDLTDEDIKNVKFAVENEFEYIALSFVRSETDILNLKNLIKEYSGNCSVIAKIETKEGLKNIDEILNHSDGVMIARGDLGVEVAIEYLPIIQKNIIKLANEKGKLIITATQMLDSMVNNPYPTRAEVTDVANAIFDGTDCLMLSNETTIGKYPIESIKTLDNIARVSENDISKYKQEIEFEEHSIYSGIAYAVEALSKKLNPKIVITPTTSGKTPLRISKFRFNSPIIALAPENIVFRKLRLVWGVIPIKIDEIGDVDEVLEISKKIAKNIIDSGIYVVTLGHPKGEKKTNVIKVESI

SEQ ID NO: 7420 - DNA, 1797 bp, Parachlamydia sp
  CDS (1)..(1797)
atggcattaattagaacaaaaattgtttgtacaataggacctgcttgcaattccttagagaaaattattgagttaataaacgtaggaatgaacgttgcaaggttgaattttagtcatggaactcaagaagaacatttaaggacaattaatcttttaaaagaagcgagatgtcaacttaacttacctttagccatcatgttagatacaaaagggccagaaatacggctaggaaaaattcgagatggacaaatttttttaacggtaggtcaaaaatggcggttagtgaaaaaggaggttttaggagatgaaagtcaggtttctatttttcctctcaatattttagatcaacttcctgttgggacaacaattttatttgatgatgggtatattgcctcacgcgtgattgaaaattcatccgaaggtgtgcttgttgaaattaataacagcgggatgattcgttcaagtaaaggagttaatattcccaatacaagcctaaatttgcctgctgtcaccgaaaaagacattgacgatattcgttttggatgtagccaggatattgacttgattgctgcttcctttgttcgttctgcagaacatgtcttggagattaagcgtttattagctgatgaaaaaaaaactgatattctagttattgcaaaaattgaaaatagtgaaggggtgcaaaattttgatagcattgtccaagcagcagacggaatcatgatagcaagaggagatttaggggttgaagttcctttaagccatgttcctagattgcagaaaatgatgatccgtaaaagttatttggcaggcaagccagttgtgacagcaacgcagatgttagaatcaatgatcaataatcctagaccaactcgtgcagaaacatctgatgtagcaaatgcgatttatgatagtacatctgctatcatgctttcaggagaaacagcaattggtcgttatcctgttgagacggttaatgtgatgcgaagtatcgtagaagaggctgaagctgatttcaactacagtactttttttgatcaacatgcccctttagtttatcatgatgttccctctgctgtgactttagctactgtaaaaacagcttacagttctagcgctaaagctatttttgcttttactaaagcaggaacaacggcacgacttttatcaagacttaggcctaaaatgcctattattgcgatgacagcaaaagaaaaaatttttcatcagttggcatttaattggggagttattccttttttaagtgaaccttgtaactctttagataaaagtttaaaaaaaatcagtgatttcgcccttggaagtcaacacgtcagctatggagatttggttgtgattactgcaggaactccttttggattttcaggaacgaccaatatgatgatcgttgaaaatattggagatgttttggtaagagggcactctggatatggtatacgtgtgcatgggaacgtagtaatagttcttgctcctcagtctaaagctccttatgcggtcaaagatcaggtacttgtgattgccaaatgcgatgagagttatttatctttaatgaaggaagcttctgctattattttacagaaccatatcaatgattttgcgtctgaaaaatacgcgaagaagattgctctgagtttaggtaagcctattcttcttcgagctgatgcggcatgtcaaattttaaaagaaggacagcttgttactctcgatcctgaaaaagcccttgtttacaaaggagttgttttggaccaattgttggcgagtggagaattttcatga

SEQ ID NO: 7421 - protein, 598 aa, Parachlamydia sp
MALIRTKIVCTIGPACNSLEKIIELINVGMNVARLNFSHGTQEEHLRTINLLKEARCQLNLPLAIMLDTKGPEIRLGKIRDGQIFLTVGQKWRLVKKEVLGDESQVSIFPLNILDQLPVGTTILFDDGYIASRVIENSSEGVLVEINNSGMIRSSKGVNIPNTSLNLPAVTEKDIDDIRFGCSQDIDLIAASFVRSAEHVLEIKRLLADEKKTDILVIAKIENSEGVQNFDSIVQAADGIMIARGDLGVEVPLSHVPRLQKMMIRKSYLAGKPVVTATQMLESMINNPRPTRAETSDVANAIYDSTSAIMLSGETAIGRYPVETVNVMRSIVEEAEADFNYSTFFDQHAPLVYHDVPSAVTLATVKTAYSSSAKAIFAFTKAGTTARLLSRLRPKMPIIAMTAKEKIFHQLAFNWGVIPFLSEPCNSLDKSLKKISDFALGSQHVSYGDLVVITAGTPFGFSGTTNMMIVENIGDVLVRGHSGYGIRVHGNVVIVLAPQSKAPYAVKDQVLVIAKCDESYLSLMKEASAIILQNHINDFASEKYAKKIALSLGKPILLRADAACQILKEGQLVTLDPEKALVYKGVVLDQLLASGEFS

SEQ ID NO: 7422 - DNA, 1488 bp, Bdellovibrio bacteriovorus
  CDS (1)..(1488)
atgttagcagatcgtcgagcgaagattgtggccactattgggccagcgacacgtgatgagaaaaatctggaaaaagcaataaaggcgggcatgaacgtggctcgccttaacttttcgcacggaagtcatgaagaccacctgaaggtggttcattccctgcgcaagctctctaaagagcttcaggctccggtggcgattcttcaagatcttcaggggccgaagatccgcgttggtaagtttgaaaatggctccatcgaaattaaacctggcgaaaaactggtggtaacgacggcaaaagttctggggaaaccaggattggttccgtccgacttccaagagctgcctttggcctgcgtgccgggcacgcgcatccttctggatgacggcctgatggaagtgaaggttttgcaggttcgcggtgaggaaatcgacgtggaagttgtctatggcggtattctgaaagaccgcaaaggcatgaatcttccgggtgtaaatctgcctgtggactgcatgactccaaaagatctggaggatttgcagttcggtattgccaataaagttgattatattgctttgagttttgttcgtcatgcccgtgatatccgcaagctgcgtgaattgatcgaggccgggaactccaatgcgaagatcgtagccaaaatcgagatggtggaagcgatcgaaaatctggaagaaatctgccgcctgagtgacgctgtcatggtggcgcgcggggatttggcagtggaagtcggtcaaagccgtctgccgggctatcagaagcgtattatttctgtatgcaatcaactgggtaagccggtgatcacggcgactcagatgctggacagcatggttgaaaaccctcgtccgacccgagctgagatcacggatgtggccaatgccgttttggatggaactgatgctttgatgctgtcggcggaatctgccagcggcaaatatccgttcaagtgtatccgcactatgcacgagatcatcactgaggtggaacgcaacgaagaagagtattataaaatctctcttgaaaacgagtttctgagcacgccggcgtctatcgccgccagtgcttcactgagtgcgctgaagctgaatgcaaccgcgatcatctgtctgacgacttccggtaaaacggcaaatatcatttcggccttccgtccgaaggcgcgcattatttccgtgactcagcatctggatgttttgaatggcatggaattgggctggggtattcagacccacgcgatcaagccatataagacgatggaagatatcctgcgtgaagtggatctgttgttggtgtcccatggcttgggtaaaaccggggaccgtgtgattctgacattgggtcagccgattgcttgtggtgcaaaaaccaattcgatctatgtgcacacagtgggcggggaaaacgtggcgaagcttcctaatgacaagttgcctctgcgttgtcaggaagagccggttgttgaataa

SEQ ID NO: 7423 - protein, 495 aa, Bdellovibrio bacteriovorus
MLADRRAKIVATIGPATRDEKNLEKAIKAGMNVARLNFSHGSHEDHLKVVHSLRKLSKELQAPVAILQDLQGPKIRVGKFENGSIEIKPGEKLVVTTAKVLGKPGLVPSDFQELPLACVPGTRILLDDGLMEVKVLQVRGEEIDVEVVYGGILKDRKGMNLPGVNLPVDCMTPKDLEDLQFGIANKVDYIALSFVRHARDIRKLRELIEAGNSNAKIVAKIEMVEAIENLEEICRLSDAVMVARGDLAVEVGQSRLPGYQKRIISVCNQLGKPVITATQMLDSMVENPRPTRAEITDVANAVLDGTDALMLSAESASGKYPFKCIRTMHEIITEVERNEEEYYKISLENEFLSTPASIAASASLSALKLNATAIICLTTSGKTANIISAFRPKARIISVTQHLDVLNGMELGWGIQTHAIKPYKTMEDILREVDLLLVSHGLGKTGDRVILTLGQPIACGAKTNSIYVHTVGGENVAKLPNDKLPLRCQEEPVVE

SEQ ID NO: 7424 - DNA, 1437 bp, Mycoplasma mycoides
  CDS (1)..(1437): transl_table=4
atgactaaagaaaaattacaaaagagaatgaagcgaaccaaagtaattacaacaattggtccttcaactcactctgcagaagctattaaagaattatttaacaatggaatgacaactattcgtttaaatttttcacatggtagttatgaagaacacggttatagaattaaagctgcaaaaaaaatctctaaagctttaaataagccaatctcaataatgttagacactaaaggtcctgaaataagattaggaaaatttaaagataataaacaagaagtagtaaaaggtcaagcaattactatttatacagataattattcttatttaaacaaagaatgtgttcaaggtgaaatgactgttgcttatgatatgtcagttgatttaaaacctgaagatatgattttaattgatgatggtaaattagaattaacagttgattcagttgaacctcaaattattaaagcaactgcatttaatcatcacattgtaaaaactaataaacgtgttaacttacctggaattgatttttcattaccatttttatctgaaaaagatgaaaaagatattttatttggatgtgaacaagatgttgattatatagctgcatcatttgtaaatacagctgaaaatgtaagacaaattaaagaaatcttaactaaagctaatgcaaatcatattcaaattatttcaaaaatagaatcacaagttggattagataatattgatgaaattattgaagaatctgatggaattatgattgcgcgtggtgatttaggattagaaattccatattatgatgtaccttattgagaaaaaattatcatcagaaaatgtagagaaaaaggaaaaatcgttattgttgctactcaaatgttagaaacaatgacagaaaatccatcaccaactagagctgaagtaactgatgtttattatgcaactgaacttggtgctgatgctacaatgttatctggtgaatcagctgctggagattatccatttttaacagttcatacaatgtcaacaattaataaaagagcagaagttgaattctacaacaaaatttactaccaagtacaattagataatgcaagaaactcaacatcaggacctagagctgaaatcgcagacttattagctacaaaaacaaaagatggtgaatataagtatgcaattgttttatcaaaaacaggtgaattattaaaaaccatttctaaatttagaccaaatgtaacaattttaggagttagtccagataagaaattgtgaacttcatttggtgtatgacattcaatttttatgaataaagttgatactttagataatttagataataatgttgaaaaactatcagaaattgctaagtcttgaggagctaagtttggtgaaaaagttttagttgtaagaagtacagctataaaagaaatagaagttatttaa

SEQ ID NO: 7425 - protein, 478 aa, Mycoplasma mycoides
MTKEKLQKRMKRTKVITTIGPSTHSAEAIKELFNNGMTTIRLNFSHGSYEEHGYRIKAAKKISKALNKPISIMLDTKGPEIRLGKFKDNKQEVVKGQAITIYTDNYSYLNKECVQGEMTVAYDMSVDLKPEDMILIDDGKLELTVDSVEPQIIKATAFNHHIVKTNKRVNLPGIDFSLPFLSEKDEKDILFGCEQDVDYIAASFVNTAENVRQIKEILTKANANHIQIISKIESQVGLDNIDEIIEESDGIMIARGDLGLEIPYYDVPYWEKIIIRKCREKGKIVIVATQMLETMTENPSPTRAEVTDVYYATELGADATMLSGESAAGDYPFLTVHTMSTINKRAEVEFYNKIYYQVQLDNARNSTSGPRAEIADLLATKTKDGEYKYAIVLSKTGELLKTISKFRPNVTILGVSPDKKLWTSFGVWHSIFMNKVDTLDNLDNNVEKLSEIAKSWGAKFGEKVLVVRSTAIKEIEVI

SEQ ID NO: 7426 - DNA, 1434 bp, Rhodopseudomonas palustris
  CDS (1)..(1434)
atgagacgcctgcgcaggatcaagatcctcgccacgctcggccccgcctcctccgacagcgcaatgatccgcaagctgttcgaggccggcgccgacgtgttccggatcaacatgagccacaccccgcacgacaagatgcgggagctggtgaagaccatccgtaacgtcgaaagcagctacggtcgcccgatcggcatcctggtcgatctgcagggaccgaagctgcggctgggctcgttcgccaatggaccgatccagctcaacaacggctcgaacttcgtcctcgactcgatcaaggagccgggcgacgagacgcgggtgtatctgccgcatccggagatcctcgcggcgctcaaggtcggagacgcgctgctgctcgacgacggcaaggtgcgcttgatctgcgaagagacccaaggcgatcgcgcggtgacccgcgtggtgatcggcggcaagatgagcgaccgcaagggcgtcagcctgcccgataccgatctgccgatgtcggcgatgaccaacaaggaccgcgccgacctggaagctgcgtgcgagaccggcatcgactgggtggcgctgagcttcgtgcagcgcgccgaagacgtcgtcgaagccaagcggatgatccgcggccgtgccgccgtgatggccaagatcgagaagccgcaagcgatcgaccggctcgaggacattctcgacgtctccgacgcgttgatggtggcgcgcggcgacctcggcgtcgagatgccgctggagcgggtgccgagcctgcagaagcagatgacccgcatggcgcggcgcgccggcaagccggtggtggtcgcgacccagatgctggaatcgatgatctccagcccggtgccgacccgtgccgaagtctccgacgtcgcaaccgccgtgtacgaaggcgccgacgcgatcatgctgtcggccgaatccgccgccggcaaatatccggtcgaagcggtgtcgacgatgaaccgcatcggcgaggaagttgagcgcgacgtcacctatcgcaccgtggtgacggcgcagcgccccgatccggaagcgaccgccggcgatgccatcgcgggcgcggcaaggcagatcgcagagacgctcgatctgtcggcgatcatctgctggacctcgtcgggctcgaccgcactgcgggtcgcgcgtgaacggccgaaggtgccggtggtggcgatcactccgagccttcacaccggacgcaagctgtcggcggtgtggggcgtccactgcgtggtagcggaagacgccaaggatcaggacgacatggtcgagcgcgccggccgcatcgcattccgcgacggcttcgccaaatccggccagcgcgtcatcatcgtcgccggcgtcccactcggcacccccggcgccaccaacatggtccgcatcgcctatgtcggaccgagcgatgcggacgtgtga

SEQ ID NO: 7427 - protein, 477 aa, Rhodopseudomonas palustris
MRRLRRIKILATLGPASSDSAMIRKLFEAGADVFRINMSHTPHDKMRELVKTIRNVESSYGRPIGILVDLQGPKLRLGSFANGPIQLNNGSNFVLDSIKEPGDETRVYLPHPEILAALKVGDALLLDDGKVRLICEETQGDRAVTRVVIGGKMSDRKGVSLPDTDLPMSAMTNKDRADLEAACETGIDWVALSFVQRAEDVVEAKRMIRGRAAVMAKIEKPQAIDRLEDILDVSDALMVARGDLGVEMPLERVPSLQKQMTRMARRAGKPVVVATQMLESMISSPVPTRAEVSDVATAVYEGADAIMLSAESAAGKYPVEAVSTMNRIGEEVERDVTYRTVVTAQRPDPEATAGDAIAGAARQIAETLDLSAIICWTSSGSTALRVARERPKVPVVAITPSLHTGRKLSAVWGVHCVVAEDAKDQDDMVERAGRIAFRDGFAKSGQRVIIVAGVPLGTPGATNMVRIAYVGPSDADV

SEQ ID NO: 7428 - DNA, 1422 bp, Corynebacterium diphtheriae
  CDS (1)..(1422)
atggaacgtcgaactaagattgtttgtacattagggccggcagtcgcttcccgtgagggaattcttggactggttaaagccggcatgaatgtcgcacgtatgaatatgtcacacggcgaccacgcagatcatgagaagaattaccagtgggtccgcgaagctacggatgaaaccggacgcgctgttggtattcttgccgatctgcaggggccaaagattcgtctcggtcgctttatcgatggcgcaacggtgtgggagaacggtgaaatcgttcgtatcactgttgatgacattgaaggtacacacgaccgtgtgtctaccacctacaagaacctcgctaaagatgcgaagcctggcgatcgtcttttggtcgacgacggcaaggttgcattgcgctgtgttgaagtagatggaaacgatgttgtttgtgaggttgtagaaggcggcccagtctctaacaacaagggtgtttcccttcctggaatggatatttccgttccagctttgtctgaaaaagacattgctgatttgcgcttcgctctcaatctcggtgttgacattattgcgttgtccttcgtccgctccccagcagacgtggaacttgttcatgccatcatggatgaagaaggtcgccgttgcccagtgatcgcaaagcttgagaagccagaagccatggacgctttggagtccatcgtattggctttcgacggcatcatgattgctcgtggtgacttgggtgttgagtgcccgttggagcaggtgccgctgttccagaagcgtgccatccagattgctcgtgaaaacgctaagcctgtgattgtggcaacccagatgctcgattccatgatcgagaacctacgcccaacccgtgctgaggcttctgacgtagctaacgctgttcttgacggtgcagatgccgttatgctgtccggtgagacttcggtcggtatcgatccagctaacgttgtccgtactatgtcacgtatcgtttcctacgctgagattgatggccgggtaccaaacttggctcatattccacgcaccaagcgtggcgtgatttcctactctgcacgcgacattgcagagcgtttgaatgcaaaggcacttgtagcattcacctcttcaggtgataccgcaaagcgtgttgctcgtttgcactcgcagctgccgctattggtctttacccctcaccaagaagtccgctctcagttggctttgacttggggtgtagaaaccttccttaccgacgaggttaaggacacagacgagatgatgcgtacgatcgatgagcagttgcttgctctcgatacctacagcgaagatgacatgatcgtgctcgtagccggaacccctccaggagtccaaggcaataccaacatgatccatgtacaccacctaggtgaggacctcaacggtctataa

SEQ ID NO: 7429 - protein, 473 aa, Corynebacterium diphtheriae
MERRTKIVCTLGPAVASREGILGLVKAGMNVARMNMSHGDHADHEKNYQWVREATDETGRAVGILADLQGPKIRLGRFIDGATVWENGEIVRITVDDIEGTHDRVSTTYKNLAKDAKPGDRLLVDDGKVALRCVEVDGNDVVCEVVEGGPVSNNKGVSLPGMDISVPALSEKDIADLRFALNLGVDIIALSFVRSPADVELVHAIMDEEGRRCPVIAKLEKPEAMDALESIVLAFDGIMIARGDLGVECPLEQVPLFQKRAIQIARENAKPVIVATQMLDSMIENLRPTRAEASDVANAVLDGADAVMLSGETSVGIDPANVVRTMSRIVSYAEIDGRVPNLAHIPRTKRGVISYSARDIAERLNAKALVAFTSSGDTAKRVARLHSQLPLLVFTPHQEVRSQLALTWGVETFLTDEVKDTDEMMRTIDEQLLALDTYSEDDMIVLVAGTPPGVQGNTNMIHVHHLGEDLNGL

SEQ ID NO: 7430 - DNA, 3179 bp, Lactobacillus casei
  CDS (1307)..(3070)
aaaaaattgcaaactgcccatggaccaattccagttatcactgtcgacacgaccagcaaggagagtgttttgttagataagcgatactgggtcactgctgacaccagcttgatggctgatcttgaatcgcggtttggtgcggctaatgtggtgttgcgaaaacgacaagaagaatagagaaaattgtaaaatgttctcattttcagggactttgtttctgaaaagtggtaaactcaatgagtatttgtgatgggacaaatcgcaaaagaatatgcatgaggtgaaataatgaaacgcattggtattttgaccagtggcggggatgcgcctggcatgaacgccgcggtccgcgctgttgctcgcaaggcgatgcacgaaggccttgaagtatatggcatcaattatggatttgctgggttagttgccggcgacattttcaaaatgaatgaatcaactgtcggtgataagattcaacgcggcgggaccatgttatattccgcacgttatccacaatttgcgcaagaagaaggccagttgcgcggggtcgaacaattaaacaagtttggcatcgaggcgttggtcgtcatcggcggagacggctcttatcacggtgcactagctttgacgcgtcacggtttcaacaccattggcctgccaggaacgatcgacaacgatattccttacacggacttcacgattggctttgatactgccgttaatacagttgtggaagctgttgaccgtcttcgcgataccgcggcttcgcatgaacgaacctttgtcattgaagtcatgggtcgtgaagctggggacattgccctttggtcgggcgtcgccggtggtgccgaggatgtcatcattccagaacacgactttgacgttaagaaaattgcgtcgaagttgcaaagttctcgtgaacgtggtcaaaagcatgcggtcattcttttggcagaaggcgtgatgcacgctgatcaatttgccaaggaattagccgcacatggcgatttccaattacgttcgacagttctgggacacattgttcgtggcggtgcaccgtccgcacgtgatcgcgttttggcttcacaaatgggttcatacgcggttgaacttttgttgcaaggcaaaggcgctttggctgtcggcattgaaaacaacaagatcacggcacatgatgttcggaccttgtttgatgccaagcatcacgcagaactttcgctctacaccttagcggaagagttaacattttaatctcgtaaacaaacgacattaacgtctgtttaaataatttcaaggagcgatttcacttatgaaaaaaaccaagatcgtcagcacgcttggacctgcaagtaacaccactgatatcatcgttaagttgattgaagcgggtgccaacgttttccgtttcaatttctcacatggtgatcatgaagagcatttggcacggatgaacatggttcacgaagctgaaaagatcacgggtaagaccgttggtatcatgctggatacgaagggtgccgaaattcggacaactcttgaagataccccgaatggtaagatcgattttcacaccggtgacaaagttcgcatctccatggatgcaagtctgaaaggcaccaaggaaaaagttgctgttacctatcctggcctttatgatgacactcacgttggcggccatgttttgtttgatgatggcttgattgacatgaagatcaccgaaaaggacgaaaagaaccgtgaactcgttaccgttgttcaaaacgacggtgtccttggtggtaagaaaggtgtcaacgctcctggtgttgccatcaacttgcctgggattacggaaaaagactccgatgacattcgtttcggcttggacaacgggatcaacttcattgctgcttcctttgttcgtaagcctcaagacgttttagacattcgtgaactccttgaagaaaagaacgcacttaatgttcagatcttccctaagatcgaatcacaagaaggcatcgacaacattgatgacatcttgaaggtttccgatggcttaatggttgctcgtggcgacatgggtgttgaaattccatttgaacatgttccgatcgttcagaagcgcttgatcaagaagtgcaactctttgggtaagccggttatcacggctacacaaatgttggattccatgcaagaaaacccacgtcctacccgtgccgaagtaaacgacgttgccaatgccgtgtttgatggcaccgatgcaacgatgctttctggcgaatctgctaatggtgactatccggttgaatccgttgctgcaatggctcggattgacgaatacaccgaagcagcgatgatggatcaggatgccttcgcattgaaggaatacagtaacaagaacgtcaccgaagctgttggccaaagtgttgcacacacggctcgcaacttaggggttaagaccattgttgctgcgaccgaatccggctacactgcccgcatgatttccaagtatcgtccgaaggctgacattcttgccattaccttcagcgaaaagacccaacgcggcctgatggtcaactggggtgtttacccaatcattgctgaaaagcctgctaacaccgatgctatgttcgacttggcaaccaagaaggcccaagaccttggctttgctaaggaaggcgatctgatcttgatcactgccggtgttcctgttggtgaatctggcacaaccaacgtaatgaaggttcactcatggctccagctggttcaaggctcaggtgtcggcgacgaatccacgattggtaaggcagtcatcgcaagcaacgctcaagaagctgctgctaagatgcaaaagggtgacattctggttgttaagacgactgacaaagattacttgccagcaatcgaaaaagcagctgccttggttgttgaaaccggtggcttgaccagtcacgcagctgttgttggtattgctatgggtatcccagttgttgttggtgctgaaaatgctaccagcgtcatctccgatggccagatcattactgttgactcccgtcgtgggatcatctacaaaggtgctaccaacgccctttaatcttcaaaatgacctgttaaaggttaggaaaaactctcaaggaaacttgggagtttttttcttcccaaaaaacagtagcgttacctgttttgagcaacttactgataaa

SEQ ID NO: 7431 - protein, 587 aa, Lactobacillus casei
MKKTKIVSTLGPASNTTDIIVKLIEAGANVFRFNFSHGDHEEHLARMNMVHEAEKITGKTVGIMLDTKGAEIRTTLEDTPNGKIDFHTGDKVRISMDASLKGTKEKVAVTYPGLYDDTHVGGHVLFDDGLIDMKITEKDEKNRELVTVVQNDGVLGGKKGVNAPGVAINLPGITEKDSDDIRFGLDNGINFIAASFVRKPQDVLDIRELLEEKNALNVQIFPKIESQEGIDNIDDILKVSDGLMVARGDMGVEIPFEHVPIVQKRLIKKCNSLGKPVITATQMLDSMQENPRPTRAEVNDVANAVFDGTDATMLSGESANGDYPVESVAAMARIDEYTEAAMMDQDAFALKEYSNKNVTEAVGQSVAHTARNLGVKTIVAATESGYTARMISKYRPKADILAITFSEKTQRGLMVNWGVYPIIAEKPANTDAMFDLATKKAQDLGFAKEGDLILITAGVPVGESGTTNVMKVHSWLQLVQGSGVGDESTIGKAVIASNAQEAAAKMQKGDILVVKTTDKDYLPAIEKAAALVVETGGLTSHAAVVGIAMGIPVVVGAENATSVISDGQIITVDSRRGIIYKGATNAL

SEQ ID NO: 7432 - DNA, 1341 bp, Onion yellows phytoplasma
  CDS (1)..(1341)
atgaacaaaactaaaataatttgtaccttaggacctgcttcttatgataaaaacattttacaagccttaattcaaacaggtttgaatgtagcaagatttaatttttctcacgctcaatacgaacaaactaaacttttaatgaaaaccattaaaactattagcgataaattagacaaaaacacaggacttatgttagatactaaaggacctgaaattagaactcacgaatttgatggtgtagtaacaattcaaaaagattctgaagtaaaaatatctatgacagaagttttaggtaatgctaaacttttttcagttagttattctaatttatacaatgaattaaaagttggcgatatggttaatattgatgatggatacttatctttggaagttgtaggcaaagacgaagccaaacaacaattagttactaaagccaaaaatactcactccatcaaatctcgtagaggtgtaaatgttcctaaagttaatttagaaatggattttatttctcctaaagattatcaagatattgtttttgctgcccaacaagattttgattatattgctgcttcatttgttagaagagctcaagatgtcaaagatattagaaaaattttacaagaacaaggaaattccaacatccaaattatttctaaaatagaaaatcaagaaggtgttgataatttagaagaaatcattcaagaatcagacggtattatggttgcaagaggtgatttaggaatagaagttgatggtgaattagtaccactttaccaaacgcgtatgattactaaatgtttagaatacggcaaaccagttgtagtagctactcaaatgttagaatctatgcaaagaaatccgcgcccaaccaaagctgaaacttctgatgtctttaatgcagttagagaaggcaccacctttactatgctatcgggcgaaagtgcttcaggtgaatatcctgtagaagctgtaacttatatgaaaaaaattaattatcaagctgaaaaagtagttaattatcaagctttatcacaagtataccaacctaaaaactccaaagaaaaccttttattaagtgctgtggaattggctttacgcaccgatgttaaagcaattgttgtctatgacttaaaagatgcttataatgtttctaaatttcatccatccgttcctgttttggctttagttaaaactgaacaagaagctcgtcgtttagtactaaattttggggtttgtccttttgtttctgaaaccaaattacaaactaaattggaagaacttacccaaaatcaaagtagtaattgtcttgttgttaaagatgggatgctttattttaaataa

SEQ ID NO: 7433 - protein, 446 aa, Onion yellows phytoplasma
MNKTKIICTLGPASYDKNILQALIQTGLNVARFNFSHAQYEQTKLLMKTIKTISDKLDKNTGLMLDTKGPEIRTHEFDGVVTIQKDSEVKISMTEVLGNAKLFSVSYSNLYNELKVGDMVNIDDGYLSLEVVGKDEAKQQLVTKAKNTHSIKSRRGVNVPKVNLEMDFISPKDYQDIVFAAQQDFDYIAASFVRRAQDVKDIRKILQEQGNSNIQIISKIENQEGVDNLEEIIQESDGIMVARGDLGIEVDGELVPLYQTRMITKCLEYGKPVVVATQMLESMQRNPRPTKAETSDVFNAVREGTTFTMLSGESASGEYPVEAVTYMKKINYQAEKVVNYQALSQVYQPKNSKENLLLSAVELALRTDVKAIVVYDLKDAYNVSKFHPSVPVLALVKTEQEARRLVLNFGVCPFVSETKLQTKLEELTQNQSSNCLVVKDGMLYFK

SEQ ID NO: 7434 - DNA, 2023 bp, Oryza sativa
  CDS (324)..(1688)
gaacgcctcgtctgaacacaaaaccccgtaaaaatctccgcctccgccaccgccaccgccgccgacgccgccatggccgccaccgccgccgcggcccacaccctcctccacctcgcggccccgaggaagccctccgcggggcccccactcccgcccgccacccaaccccaacgggatcctcgtcgcatatcgatgttgacgtggcgacggaggccgacctgagggagaacgggttccggagcacgcggcgcaccaagctcgtctgcaccgtggggcccgcctcctgcggcgccgacgagctggaggcgctcgccgtcggcgggatgaacgtcgcgcgcgtcaacatgtgccacggggaccgggagtggcaccggggcgtcatccgcgcggtgcggaggctcaacgaggagaaggggttcgccgtcgccgtcatgatggacaccgaggggagcgagatccacatgggggacctcggcggcgccgccgccgccaaggcggaggatggagaaatatggacatttagcgtaagatcctttgaggcacctcccccagaacgaactattcatgtgaactacgaaggcttcgctgaagatgtgagagttggtgatgagcttcttgttgatggtggcatggctcggtttgaggtggttgagaaattaggaccagatgtcaagtgccgttgcacagatcctggtttgttgctgccacgtgccaatcttacattttggcgggatggtagtattgtccgtgagaggaacgctatgctacctaccatttcatcaaaggattggcttgacatagactttggaatttctgaaggcgtagattttattgcagtttcgtttgtcaaatctgcagaagtaattaaccatctgaaaagctatatagctgcaaggagccgtggcagcgatatagcagtcattgccaagatcgagagcattgactctttgaagaacttggaggagataatccgtgcttcagatggtgccatggtagcccgaggggatatgggtgcacaaattcccttggagcaagtcccctcagtacaacaaaagatagttaaactgtgcaggcagctcaacaagccagtcattgttgcgtcgcagcttcttgaatcgatgattgagtatcctacgcccaccagggccgaggttgctgatgtttctgaagcagttcgtcagcgtgcagatgcgcttatgctttcaggtgagtcagcaatggggagatatccagagaaagctcttagtgtcctccggagtgttagcctaaggattgagaagtggtggagagaggagaagcgccatgaggaactggaacttaaagatgtttcatcttccttctctgacaaaatatcagaagaaatctgcatttcggccgctaaaatggccaacaaattggaggtagatgccgttttcgtctacacaaacactggccacatggcctcactgctctcgcggtgccgtcctgactgcccgatcttcgccttcacgacctcgacatctgtgaggagacgattgaacctccaatggggcctcatccccttccgcctcagcttctcggacgacatggagagcaacctgaaccgtaccttctcgctgctcaaggccaggggcatgatccagtccggcgaccttgtcatcgcgctctccgacatgctgcagtccatccaggtcatgaacgtaccttgagaatcatcatgctcccctctcgtgtttgtttgttctgcccaaaacggaacacggctttagttgacatcatcttaggggcggttttctggtttgaaatttattcgtttgttctccattgtgttagacgacagaaccagagaatgttacaacaataatgctgcaacttccagcgcgttgtaaactctatgctatttagcctgatgtataaggccatgaactgttttgtcgcttactatgataggctatgtatttaccaataaacccttctatttaagctatgtaagaattttcctcatcagaaattactccttgctagagcccagtaaagattcttt

SEQ ID NO: 7435 - protein, 454 aa, Oryza sativa
MNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 7436 - DNA, 1410 bp, Desulfovibrio vulgaris
  CDS (1)..(1410)
atgcgcacaaagattatcgccaccatcggccccgcctcccgttcgcacgaagtcctttcacgcctcgtcaatgcaggcgtgggcatcttccgcctcaacttctcgcatggcgacgcatccatgttcgtggagctcatcgggcttctgcgcgaactggagcgtgagagcgggcgcccgctcaccatcctgcaagacctttcgggcccgaagatacggataggcgaaatcgccaagggcgcgctctccgtctccaagggtgacaggctcctgctggggcccgcccctgcccccgccgacaaccgccccttcattcccttcgaccatcccgccgtactcgccgagttcgagatcggcgacagggtggtgctctccgacggcgggctgcagttccgtgtcgtggacaaggggccgaacggcaccttcgagctcgaggccaacaacaacggcatgatcacctcgcgcaagggcctcgccctgccgggcaagtcggtcaagctcgccgcgctcacggccaaggaccgcaaagaccttgccgacggcctcgccctcggggtcgacgccgtggcgctctcctacgtgcagacccccgacgacatccgcgacgccaaggagatcatccgcgcagcgggccgcaacatccccgtcatcgccaagcttgaaaggcagaacgccgtggacaggctcgacgagatactcgccgagaccgacatcgtcatggtcgcccgcggcgacctcggcgtggagtgcccgctgcccgaactgcccgccatgcagaagcgcatcatccgagcctgcaaccgtgcggcaaagcccgtcatcgtggcgacgcagatgctcctctccatggtcaacagcccctcgcccacacgcgccgagaccacagacgtggccaacgcagtgctggacggtgccgactgcgtgatgctctccgaagagacggccatgggcagcttcccggtggagaccgtcaatttcatgaaggaaatcgccatgaaggccgaagagctgcacttcgaattgcagcgtcttcgtgagcctgacgtgggacgcggttcggccgacttcctcgcctactccgcctgcctgctggctgagaaggccaacgccgatgccatcgtctcgcacagcctgagcggcagttcggcgcggctcatctcctcgcgcaggccgcagcagccggtctatgccatcacgcctgacccggcagcccagcgctggctcaacttctcgtggggcgtgttccccgaggggggcgacgaaggcataagcggacaccttgagcgtgcagaggcgttcatcgaacgctgcccggacatccccgatggggccgacgtggtcatcaccgccggacagccgaagccgggcgacaccccgcgcggcaccaatctggtcaagatttacaggaaatag

SEQ ID NO: 7437 - protein, 469 aa, Desulfovibrio vulgaris
MRTKIIATIGPASRSHEVLSRLVNAGVGIFRLNFSHGDASMFVELIGLLRELERESGRPLTILQDLSGPKIRIGEIAKGALSVSKGDRLLLGPAPAPADNRPFIPFDHPAVLAEFEIGDRVVLSDGGLQFRVVDKGPNGTFELEANNNGMITSRKGLALPGKSVKLAALTAKDRKDLADGLALGVDAVALSYVQTPDDIRDAKEIIRAAGRNIPVIAKLERQNAVDRLDEILAETDIVMVARGDLGVECPLPELPAMQKRIIRACNRAAKPVIVATQMLLSMVNSPSPTRAETTDVANAVLDGADCVMLSEETAMGSFPVETVNFMKEIAMKAEELHFELQRLREPDVGRGSADFLAYSACLLAEKANADAIVSHSLSGSSARLISSRRPQQPVYAITPDPAAQRWLNFSWGVFPEGGDEGISGHLERAEAFIERCPDIPDGADVVITAGQPKPGDTPRGTNLVKIYRK

SEQ ID NO: 7438 - DNA, 1425 bp, Thermus thermophilus
  CDS (1)..(1425)
atgccgccttttaagcgcaccaagatcgtggccaccctggggccggccacggacgacaaggaggtgatccgcgccctggcggaggccggggccgacgtcttccgcctgaacttcagccacggcgcccccgaggaccacaggcgccgggtgggctgggtgcgggaggtggcggaggagctcggccgaaccctggccgtcctccaggacctccagggcccgaagatccgtgtgggccgtttccgggagggccaggtcctcctccgcccggggcagaggttcgtcctcaccgccgagcccgtggagggggacgagcaccgcgtttccgtgagctacaaggggcttcccgaggacgtttccccggggcagatcctccttctggacgacggccgcatccggctcaaggtcctggaggtccggagcccggagatcctcacggaggtggaggtgggcggggtcctctccaacaacaaggggatcaacatccccggggcggacctctccatccccgccctctcggagaaggatatccaggacctggccctgggggcggagctcggggtggactgggtggcggtctccttcgtccgcacgcgggacgacctcctcctcgcccggcactacctctcccgctacggctccaaggccaggctcatggccaagatcgagaagccctcggccgtggcccggtttgaggagatcctggaggaggcggacgggatcatggtggcccggggggacctcggggtggagatgcccctggaggaggtgcccatcgtccagaagcgcctcatcctccggtgcatcgccgccgggaagccggtgatcaccgccacccagatgctggagtccatggtgcagaacccgagccccacccgggccgaggcctcggacgtggccaacgccatctttgacgggaccgacgcggtgatgctctccgcggagacggcggccggggcctacccggtggaggcggtggccatgatgagcaggatcgccaaggcggtggaatcctccccggagttcttgcagaagctcaacgtcctccgccccgcccccacccccaccacccaggacgccatcgcccaggcggcggacgacgtggtggaggcggtgggggcacgggccatcgtggtcttcacggccacgggcggctcggcgcggaggatcgcccgcacccggccccaggtgcccatcctggccctcaccccgaaccccgaggtgcggaaccagctggccttggtctggggggtctacccccatctcgcccccgacccccaggacaccgacgacatggtccgcatcgccctcagggaggtgaaagccctggggctcgcccaggtgggggaccgggtggtcatcgccgccggggttcccttcggggtccgggggacaacgaacctcatccgcgtggagcgggtggggtag

SEQ ID NO: 7439 - protein, 474 aa, Thermus thermophilus
MPPFKRTKIVATLGPATDDKEVIRALAEAGADVFRLNFSHGAPEDHRRRVGWVREVAEELGRTLAVLQDLQGPKIRVGRFREGQVLLRPGQRFVLTAEPVEGDEHRVSVSYKGLPEDVSPGQILLLDDGRIRLKVLEVRSPEILTEVEVGGVLSNNKGINIPGADLSIPALSEKDIQDLALGAELGVDWVAVSFVRTRDDLLLARHYLSRYGSKARLMAKIEKPSAVARFEEILEEADGIMVARGDLGVEMPLEEVPIVQKRLILRCIAAGKPVITATQMLESMVQNPSPTRAEASDVANAIFDGTDAVMLSAETAAGAYPVEAVAMMSRIAKAVESSPEFLQKLNVLRPAPTPTTQDAIAQAADDVVEAVGARAIVVFTATGGSARRIARTRPQVPILALTPNPEVRNQLALVWGVYPHLAPDPQDTDDMVRIALREVKALGLAQVGDRVVIAAGVPFGVRGTTNLIRVERVG

SEQ ID NO: 7440 - DNA, 1317 bp, Leptospira interrogans
  CDS (1)..(1317)
atgaatttttcacacggcacacatgattctcataaaagagtctacgacacgttacgcaagtgcgaacaaattttcggatttcctttagggatcatggcagacctacaaggccctaaaattcgaaccggaaaattaaaactcaactccattctacttcataaaaatcaggagattgaaatcgtcccagattctgatattttgggagatgaacacaaaatcggttgtacatatccaaatctaattagagatatacaagaagaagacaagattctaattgatgacggtaagttaattttaaaagttatttctaaaaaatcgaactccgccattttaaaagtaatcgtaggtggaatcttatggagcaacaaaggaatcaatcttccaggaactcctatctctgctcctgcactttccgaaaaagacatagaagatcttaagttcgcactctctctaggtgtagattacgcggctcttagttttgttcgtactggggcagacttagaattagcaaggtcttatttagaaggtacatatacagggctgatcgcaaagatagaaagaccggaagcaattggaaacatagaagaaatcatagaacgagcagatggcatcatgattgcaagaggagatttaggagtagaaattgatacggaaaaggttcccattctacaaaaagaacttatctataaactcaatcaagcgggtaaaccggtcattactgcaacccaaatgctggaatctatgattgaaaacccaagaccaacacgtgcagaagcgagcgacgtagcaaatgcggttatggacggaacggatgcagttatgctttctgcagaatcggctaacggccattatccggtcgaatccgttgaaatcatgtctaaaatcattcaagaaactgaaaccattgatcatatctatgagattcactggaacattaaaaaaactttcttagaatcagaaagaactgcactgggaaatgccgcaagggagattgcccacggaatccacgcaaaggcaatcgtcaattttacgagaagcggttattccgcattgattacctccgaaatgagacccaaggttccgatctactcttttactccgtttgcaaccaccgccagaaagatgaaactctatcgaggtgtggtgccatttgtaatgcctttctttacaagattggaagatatgattgcttatatgaatcaaaaactcaaagaagatgaatttctttttccaggagataaggtggtaattctttccggagccccaggaaccacagtcagaagtgtagactttttacaggtttataaaatacattga

SEQ ID NO: 7441 - protein, 438 aa, Leptospira interrogans
MNFSHGTHDSHKRVYDTLRKCEQIFGFPLGIMADLQGPKIRTGKLKLNSILLHKNQEIEIVPDSDILGDEHKIGCTYPNLIRDIQEEDKILIDDGKLILKVISKKSNSAILKVIVGGILWSNKGINLPGTPISAPALSEKDIEDLKFALSLGVDYAALSFVRTGADLELARSYLEGTYTGLIAKIERPEAIGNIEEIIERADGIMIARGDLGVEIDTEKVPILQKELIYKLNQAGKPVITATQMLESMIENPRPTRAEASDVANAVMDGTDAVMLSAESANGHYPVESVEIMSKIIQETETIDHIYEIHWNIKKTFLESERTALGNAAREIAHGIHAKAIVNFTRSGYSALITSEMRPKVPIYSFTPFATTARKMKLYRGVVPFVMPFFTRLEDMIAYMNQKLKEDEFLFPGDKVVILSGAPGTTVRSVDFLQVYKIH

SEQ ID NO: 7442 - DNA, 1758 bp, Bacillus cereus
  CDS (1)..(1758)
atgcgtaaaactaaaattgtatgtactataggtcctgctagtgaaagtattgaaaaattagagcaattaatcgaagcaggtatgaacgttgctcgtttaaacttctctcatggtagccatgaagaacacggcgctcgtattaaaaacattcgtgaagcttcaaagaaaactggtaaaacagttggtatcttacttgatacaaaaggtccagaaatccgtactcacgacttcgtagacggacaagctgagcttgtaacaggtgcagaagttgttatttctactgagcaagtattaggtactgcagagaagttctctgtatcttatgctggtctttatgacgatgtaaacccaggttctcgcattctaatcgatgatggtcttatcgagctagaagtaatcgaaaaagctgacggaaacatccgtacaaaagttcttaacagcggaactgtaaaaaataaaaaaggtgttaacgtaccaaacgtaagcattaagcttcctggtatcactgaaaaagacgtaaaagatatcatcttcggtatcgagcaaaaagttgatttcatcgcagcttcattcgtacgtaaagcagctgacgtattagaaatccgtgaattactagaagagcataacgctcaatacatccaaatcgtaccaaaaatcgaaaaccaagagggtatcgacaatatcgattcaatcttagaagtttctgacggtttaatggtagctcgtggtgacatgggtgtagaaattccaccagaagaagtaccattagtacaaaaacgtctaatcaaaaaatgtaacgtgttaggtaaaccagttattactgcaacacaaatgttagattctatgcaacgtaacccacgtccaactcgtgcggaagcaagtgacgtagctaacgcaatcttcgatggtacagacgcaatcatgctttcaggtgaaacagctgctggacaatacccagtagaagcagtaacaatgatggctaacattgcagtacgtgttgaaaaatcattacaatatgaagatatgttcaaaaaacgtattaaagagttcactccaacaattacagatgcaattagccaatctgttgcgcatacagcacttgctcttgatgtagctgcaatcgtagctccaacagaaagtggatatactgcgaaaatgatctctaaataccgtccaaaatctccaatcgtagctgtaacatctgacgagcaagtaggacgtcgtcttgcgcttgtttggggtgtacaagcatttatggctgagaagcgcgcagcttctactgacgaaatgttagatacagcgattcaaacaggtatggatgcaggtctaatcggacttggagacactgtagtaatcactgctggtgttccagttgctgaaactggtacaacaaacttaatgaaaatccacgttgttggtgaagaagttgctaaaggacaaggaatcggtcgtaaagctgcaaaaggtaaagtagttgtagcgaaaacagctgctgaagctgtagcgaacgtaaacgaaggtgatatccttgttacaacaagcactgataaagatatgatccctgcaatcgaaaaagctgctgctctagttgtagaagaaggcggtctaacaagccatgcggctgttgtaggtgtatcaatcggtattcctgttatcgttggtgtaaacggcgtaacagcaactttaaaaaatggccaagaagtaacagttgatgcagcacgcggaattgtttataatggacatgcggaagtgctataa

SEQ ID NO: 7443 - protein, 585 aa, Bacillus cereus
MRKTKIVCTIGPASESIEKLEQLIEAGMNVARLNFSHGSHEEHGARIKNIREASKKTGKTVGILLDTKGPEIRTHDFVDGQAELVTGAEVVISTEQVLGTAEKFSVSYAGLYDDVNPGSRILIDDGLIELEVIEKADGNIRTKVLNSGTVKNKKGVNVPNVSIKLPGITEKDVKDIIFGIEQKVDFIAASFVRKAADVLEIRELLEEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEVAKGQGIGRKAAKGKVVVAKTAAEAVANVNEGDILVTTSTDKDMIPAIEKAAALVVEEGGLTSHAAVVGVSIGIPVIVGVNGVTATLKNGQEVTVDAARGIVYNGHAEVL

SEQ ID NO: 7444 - DNA, 1059 bp, Bacillus cereus
  CDS (1)..(1059): n means a or g or c or t/u, w means a or t/u
atgacaatcgatcgaatttgtacaattgggccagcaagtaataataaagaaacgttagcgcagttaataagcaatggtatgaaaattgttcggctaaatttatcacatggcacacatgaaagtcataaagatattattcgtttagtgaaatcgttagacgattctattaaaattttaggcgatgtacaaggtcctaaaataaggttaggtgaagtaaaaggagaacaaattacacttcaggcgggagattcttttattttacatacacaaccagttacagggagtagtacggaagcaagtgttgattatgaagggatcgcgaatgatgtgaaagtcggaagtagaattttaatgaatgatggtgaagttgagttaatcgtagggaaggtaggtaaggataaaatagaaacaaaggtcaaagcaggtggtaatatctcatctcataaaggggtgaacttaccaggcgcaatcgttcgtttaccggctattacagagaaagataaacaagatattcagtttcttttagaagagggtgttgattttatcgcatgttctttcgtaagaaaacctagccatataaaagaaatacgagattttatacaacagtataaagaaacctcacctaatttaattgcaaaaatagaaacgatggaagcgatcaagaattttcwagatatatgtaaagaagcagatggaattatgattgcaaggggcgatttaggagttgagttgccgttccaatttgttccgctcttgcagaaaatgatgattcaggaatgtaatcgaacgaatacatatgttattacagcgacacaaatgcttcaatctatggtagagcattctattccaacgagggctgaggtaactgatgtgtttcaagctgtactggacggaacgaacgctgttatgctttctgccgaaagtgcatcaggcgagcatccgattgaaagtgtaaaaacattacgtctagtttcagaattcgctgagcatgtgaaaaaagacggtccttttgtgatgaaagatgtactggaattgctgcataagtctttgaatgcgtga

SEQ ID NO: 7445 - protein, 352 aa, Bacillus cereus
  Xaa in position 224 is unknown
MTIDRICTIGPASNNKETLAQLISNGMKIVRLNLSHGTHESHKDIIRLVKSLDDSIKILGDVQGPKIRLGEVKGEQITLQAGDSFILHTQPVTGSSTEASVDYEGIANDVKVGSRILMNDGEVELIVGKVGKDKIETKVKAGGNISSHKGVNLPGAIVRLPAITEKDKQDIQFLLEEGVDFIACSFVRKPSHIKEIRDFIQQYKETSPNLIAKIETMEAIKNFXDICKEADGIMIARGDLGVELPFQFVPLLQKMMIQECNRTNTYVITATQMLQSMVEHSIPTRAEVTDVFQAVLDGTNAVMLSAESASGEHPIESVKTLRLVSEFAEHVKKDGPFVMKDVLELLHKSLNA

SEQ ID NO: 7446 - DNA, 1416 bp, Treponema denticola
  CDS (1)..(1416)
atgaaaaaaacaaaaatagtatgcacaatagggcccgcttccgactcggaaagggtcttggcagaaatgtttaaagccggtttaaatgtctgccgccttaatttttcgcatggaagccatgaagaacacaaggttaaaatagatcgaataaaaaaaataagagaagagttaaaaatgcctattgcacttttactggatactaagggacccgaaatccgtttgggcctttttgaaaagcctgtagaaattgtacaaggtcaggaatttataattacaaccagagatgtaatcggaacaaatcaaatatgcagcatctcatataagaatattgccgccgaaattaaacctaaaagcagaatccttataaatgacggattattggagttacaggttatcgatattttaaacgatacggacatagaatgtgtcgcagtaaattccggaaccctaagcagccgaaaaggtgtaaacattccgggcttgagggtaaaccttccttacatgagtgaaaaggatatctccgatatcgaattcggaattgaaaatgatgtggattttattgccgcctcctttacacaaagagccgacgatattatccaaataagaaaacttttggaaaaacacaaaagtacaatcgccgttatagcaaaaatagaaaatcaagaaggcttggacaacatagatgaaattttagcggaagccgacggaataatggtagcccggggagatatgggtgtagaaatagagcccgaaaaaatccctcatcttcaaaagcagctgataaaaaaagcaaaccttgcaggaaagccggttatcaccgcaactcagatgctcgaatctatgacccacaacctgcgtcccaccagagccgaagttaccgacgttgcaaacgctattctcgacggaacatcagctgtaatgctttctggagaaaccgcagcaggcgaataccctgtcgaaaccgtggccatgatgacctcaattgcgaactctatagaagaaacattagattatgaaaaactatttgctgaaaatgcttctcttcatgagaccacaatcacaaatgcaattgcaagagccacctgctccactgccctagccctcgatgcaaatgcaatcataacggcatccgcttcgggaataacgcccagagctctttcaaaatttaaaccaagggtaccgattattgcaataacggaatcgcctcaggttatgagaaagatggccctcgactgggacgtatatccggttttagccgatcctataaaatcgaccgataacatgttcgatgtgtgttcgcaaattgcaaaggatacaggccatgtaaaaaaaggagacatagcaatccttacggccgggattcctataggcaaagcaggatctacaaaccttctaaaggtagaaataatagaataa

SEQ ID NO: 7447 - protein, 471 aa, Treponema denticola
MKKTKIVCTIGPASDSERVLAEMFKAGLNVCRLNFSHGSHEEHKVKIDRIKKIREELKMPIALLLDTKGPEIRLGLFEKPVEIVQGQEFIITTRDVIGTNQICSISYKNIAAEIKPKSRILINDGLLELQVIDILNDTDIECVAVNSGTLSSRKGVNIPGLRVNLPYMSEKDISDIEFGIENDVDFIAASFTQRADDIIQIRKLLEKHKSTIAVIAKIENQEGLDNIDEILAEADGIMVARGDMGVEIEPEKIPHLQKQLIKKANLAGKPVITATQMLESMTHNLRPTRAEVTDVANAILDGTSAVMLSGETAAGEYPVETVAMMTSIANSIEETLDYEKLFAENASLHETTITNAIARATCSTALALDANAIITASASGITPRALSKFKPRVPIIAITESPQVMRKMALDWDVYPVLADPIKSTDNMFDVCSQIAKDTGHVKKGDIAILTAGIPIGKAGSTNLLKVEIIE

SEQ ID NO: 7448 - DNA, 1419 bp, Mycobacterium paratuberculosis
  CDS (1)..(1419)
atgagtagacgcgggaagatcgtctgcacccttggcccggcgaccaattcggacgagttgattttggcgctggtcgaggccggaatggacgtcgcccgactgaacttcagccacggcgactacgccgaccacaaagccgcctacgaacgggtgcgggtggcctccgacgccaccggccgcgccgtcggcgtgctcgccgatctgcagggccccaagatccgcctggggcgctttgccaccgggcccacctactgggccgacggcgaaacggtccgcatcaccgtcgccgactgcgaaggcagccacgaccgggtgtcgaccacctacaaacaactggcccaggacgccgcggtcggggaccgggtcctggtcgacgacggcaaggtcggcctggtggtcgacggcatcgagggcgacgacgtcatctgcaccgtggtcgagggcggcccggtcagcaacaacaagggcatctcgctgccgggcatgaacgtctccgcaccggccttgtccgacaaggacatcgaggacctcaccttcgcgctcgagctgggcgtcgacctggtcgcgctgtccttcgtgcgttcgccctccgacgtcgagctggtgcacgaggtgatggaccgcgtcggccggcgggtgcccgtgatcgccaaactggaaaagccggaggccgtcgacaacctggaagccatcgtgctggccttcgacgccatcatggtggcccgcggcgacctcggtgtcgaacttcccctggaagaggttccgctggtgcagaagcgggccatccagatggcccgggagaacgccaaacccgtcatcgtggcaacccagatgctcgattcgatgatcgagaactcacggccgacccgggccgaggcctccgacgtcgccaacgccgtgctggacggcgccgacgccgtgatgctgtccggggagacctcggtgggcaagtacccgctggcggccgtgcggaccatggcgcgcatcatctgcgcggtcgaggacaactccacggccgccccgccgctcacccacgtgccccgcaccaaacgcggggtgatctcgtatgcggcccgcgacatcggcgaacgcctggacgccaaggcgctggtcgcgttcacccagtccggcgacaccgtcaagcggctggcgcggttgcacaccccgctgccgctgctggccttcacggcatggccggaggtgcgcagccagctggccatgacctggggcaccgagacgttcatcgtgccgatgatgacctccaccgacggcatgatccgccaggtggacaagtcgctgctggaactcggtcggtaccggcgtggtgacctggtggtgatcgtcgccggcgcgccacctggcacagtagggtcaaccaacctgatccacgtgcaccggatcggggaggacgacgtctag

SEQ ID NO: 7449 - protein, 472 aa, Mycobacterium paratuberculosis
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKQLAQDAAVGDRVLVDDGKVGLVVDGIEGDDVICTVVEGGPVSNNKGISLPGMNVSAPALSDKDIEDLTFALELGVDLVALSFVRSPSDVELVHEVMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADAVMLSGETSVGKYPLAAVRTMARIICAVEDNSTAAPPLTHVPRTKRGVISYAARDIGERLDAKALVAFTQSGDTVKRLARLHTPLPLLAFTAWPEVRSQLAMTWGTETFIVPMMTSTDGMIRQVDKSLLELGRYRRGDLVVIVAGAPPGTVGSTNLIHVHRIGEDDV

SEQ ID NO: 7450 - DNA, 1443 bp, Geobacter sulfurreducens
  CDS (1)..(1443)
atggatacactgtcacgcaaaaccaagatcatcgccactctggggcccgtcagctcctcgcccgacatgatccggcagctgatggacgcaggagtcgatgtcttccggctcaacttttcccacggctccaacgaccagcggcgggaggtaatcgccgccatccggcgtctttccgccgaacggggcaaggagataggcattctggccgatctccaggggcccaagatcaggaccggcaggatggagaacggtgccattccgctggtgcggggcgactcgctcgacattaccaccgatgaggtcctggggcgccccggtctcatttccaccatctaccagtctctcccccacgacgtgaagcccggctcacgcatcctgctggacgacggccttatcgagttgcgggtccagtccgtgtccggcgccacggtccgttgcaccgtggtccaggggggcatgctcaaggatctgaaagggatcaacctccccggcgtcaaggtttctgcgccgtcgctgtcggagaaggacctccgcgatctggatttctgcctggaggtgggggtcgactacattgccctgtcctttgtccgcactgccgccgacgtggaggggctgaagcggatcctcttcgaacgggacgtccaggtgccggtggtggccaagatcgagaagcccgaggccctgcgcaacttcaaaagcatcctcaaggttgccgatgcggtcatggtggcccggggcgatctgggggtggaaatcagcccggaaaaggtccccctgttccagaaaaagatcatccgggcctgcaacgaggccggcaaaccggtgatcaccgccacccagatgcttgaatccatgattagccatccgcgccccacccgggccgagacctcggacgtggccaacgccatcctcgacggaaccgatgcggtcatgctctcgggtgagaccgcctcggggcagtttcccctggaagcggtgcgtaccatggacaaggtggccctcgacgttgagcgcttcgctcaggtggaggacggctcggggccacgccgccacagcgtcagcatcgccgaggcggtggccgaggccgcctgccacgctgccgtcattctgaaggcgaaggccgtggcctgcatgacccagtcggggagcacggctgcccgcatctcacgctaccggcctccgctgccgatcctcgccttcaccggttcggtggacaccatgcgacggctgtcgctctactggggagtcaaggcataccccatcggcaccatggccggcaccgacgagcagatagtggccgtggagtcgacgctcctgtccggtggctaccgcaagggcgacgtggtggtcatcaccatgggtgtgccggtggaggcccgggggtccaccaacctcatgaaggtccacaagctgggaaccggccagttcttcgagatattttga

SEQ ID NO: 7451 - protein, 480 aa, Geobacter sulfurreducens
MDTLSRKTKIIATLGPVSSSPDMIRQLMDAGVDVFRLNFSHGSNDQRREVIAAIRRLSAERGKEIGILADLQGPKIRTGRMENGAIPLVRGDSLDITTDEVLGRPGLISTIYQSLPHDVKPGSRILLDDGLIELRVQSVSGATVRCTVVQGGMLKDLKGINLPGVKVSAPSLSEKDLRDLDFCLEVGVDYIALSFVRTAADVEGLKRILFERDVQVPVVAKIEKPEALRNFKSILKVADAVMVARGDLGVEISPEKVPLFQKKIIRACNEAGKPVITATQMLESMISHPRPTRAETSDVANAILDGTDAVMLSGETASGQFPLEAVRTMDKVALDVERFAQVEDGSGPRRHSVSIAEAVAEAACHAAVILKAKAVACMTQSGSTAARISRYRPPLPILAFTGSVDTMRRLSLYWGVKAYPIGTMAGTDEQIVAVESTLLSGGYRKGDVVVITMGVPVEARGSTNLMKVHKLGTGQFFEIF

SEQ ID NO: 7452 - DNA, 1770 bp, Lactobacillus johnsonii
  CDS (1)..(1770)
atgaagaaaactaaaattgttagtactttagggccagcctcaaacgatgttgagactattactaaattagctgaagcaggtgcaaacgtattccgtttcaacttctcacacggtgaccacgaagaacaccgtgcacgtatgaacatggttcgtgaggttgaaaagaagactggtaaacttcttggcattgctcttgatactaagggtgccgaaattagaactactgaacaagaaggcggcaagttcactattaacactggtgacactatccgtatttctatggacgacactaagaagggtaacaaggacatgatccacgttacctacgatggtctttacgacgatactcacgttggtggtcacgtattaatcgatgatggtttagttgaccttttgattaaggacaaagatgacgctaagagagaattagtttgtgaagctcaaaacactggtgtaatcggttctaagaagggtgttaacgctcctggcgttgaaatccgcctcccaggtattactgaaaaagatactaacgatattaagttcggtttgaaggaaggtatcaacttcatctttgcttcattcgttcgtaaagcacaagatgttcttgacattcgtcaattgcttgaagaagcacattgtgaatacgtaaagatcttccctaagattgaatcacaagaaggtattgacaacatcgacgaaatcttaaaggtttctgatggtttaatggttgctcgtggtgacatgggtgttgaaattccatttatcaatgttccatttgtacaaaaagaattgatcaagagatgtaacgctttaggtaagccagttattactgctactcaaatgcttgactcaatgcaagaaaacccacgtcctactcgtgccgaagttactgacgttgccaacgctgttcttgatggtactgacgcaactatgctttcaggtgaatctgcaaacggtctttacccagttaaagctgttaaggctatggctgaaatcgacatgcgtactgaaaagcaacttgctaagcgtaacaagttagctcttcaaagattcgaagaatacaagggttcaaacgttactgaagctatcggtgaatcagttgttagaactgctgaagaattgggcgttaagactattattgctgcaactgaatctggttacactgcacgtatgatttctaagtaccgtccaaacgcagacattattgctatgactttcaacgacaagattcaacactcattaggtgttgtttggggtgtaaagccaatgttgactgaaaagcctaagtctactgaagaaatgtttgaaaaggcagctgaacttgctaaagaaactggtcttgcaaaagacggtgacttagtaattatcgttgctggtgttcctttgggcgaaactggtactactaacttgatgaagttacaattaatcggtacccaacttgttaaaggtttaggtgttggtgaacaatcagttattggtaaagctgtagttgcaacttctgctgaagaagctaacagcaaagttcaagatggtgacatcttagttgctaagactactgataaggattacttaccagcaatcaagaaggcttcaggtatggtagttgaagcttctggtttaactagccatgcagctgttgttggtctttcacttggtatcccagttatcgttggtgctactgatgcagtagaaaagatcaaggatggttctaagattactgttgatgctcgtcgcggtgctgtttaccaaggcgaagcaactaacctttaa

SEQ ID NO: 7453 - protein, 589 aa, Lactobacillus johnsonii
MKKTKIVSTLGPASNDVETITKLAEAGANVFRFNFSHGDHEEHRARMNMVREVEKKTGKLLGIALDTKGAEIRTTEQEGGKFTINTGDTIRISMDDTKKGNKDMIHVTYDGLYDDTHVGGHVLIDDGLVDLLIKDKDDAKRELVCEAQNTGVIGSKKGVNAPGVEIRLPGITEKDTNDIKFGLKEGINFIFASFVRKAQDVLDIRQLLEEAHCEYVKIFPKIESQEGIDNIDEILKVSDGLMVARGDMGVEIPFINVPFVQKELIKRCNALGKPVITATQMLDSMQENPRPTRAEVTDVANAVLDGTDATMLSGESANGLYPVKAVKAMAEIDMRTEKQLAKRNKLALQRFEEYKGSNVTEAIGESVVRTAEELGVKTIIAATESGYTARMISKYRPNADIIAMTFNDKIQHSLGVVWGVKPMLTEKPKSTEEMFEKAAELAKETGLAKDGDLVIIVAGVPLGETGTTNLMKLQLIGTQLVKGLGVGEQSVIGKAVVATSAEEANSKVQDGDILVAKTTDKDYLPAIKKASGMVVEASGLTSHAAVVGLSLGIPVIVGATDAVEKIKDGSKITVDARRGAVYQGEATNL

SEQ ID NO: 7454 - DNA, 1506 bp, Ashbya gossypii
  CDS (1)..(1506)
atggaatctagattgggatggctaactcgtttgaactacgacactggttctgcattgagaagaacgtcgatcatcgggacgattggtcctaagaccaacaacccagagacgttggtggagcttagaaaggcgggcttgaacatcgtgagaatgaacttctcgcacggctcgtacgagtaccaccagtcggtgatcgacaacgccagaaagtcggaggagttgtaccctggtagaccattggccattgcgttggacaccaagggtcctgagatcagaactggtaccactgtcgacaacgtcgactacccaatcccacctaaccacgagatgatcttcaccaccgacgaccagtacgccaagtcctgcgacgacaaagtcatgtttgtcgactacaagaacatcacgaaggtgattgagaagggcagagtgatttacgttgacgacggtgttctatcgttcgaggtgttggaggtcgtggacgacaagaccttgaaggtcaagtctttgaacgcagggaagatctgctcccacaagggtgtgaacttgccgggtaccgatgtcgacttgccagctctgtctgagaaggacaagtctgacttgcgcttcggtgtcaagaacggtgtgcacatggtcttcgcttccttcatcagaactgctggagacatcctaactatcagagagatcttgggcgaggatggcaaggacatcaagatcatcgccaagattgagaaccagcagggtgtgaacaacttcgacgagattttgaaggtcaccgacggtgttatggtcgccagaggtgacttgggtatcgagatcccagcgcctcaggtatttgctgtgcaaaagatgttgatcgccaagtgtaacttggctggtaagccagttatctgtgccacccagatgttggagtctatgacctataacccaagaccaaccagagctgaggtttctgacgttggtaacgctgtcctggacggtgctgactgtgttatgttgtctggtgagaccgccaagggtatctacccaatcaacgctgttaagaccatggctgagactgctttgattgctgagcaggccattccatacgttccaacttacgatgacctcagaaacttgactccaaagccaactccaacctccgagaccatcgctgctgctgctgtcgcggctactttcgagcagaaggccaaggccattgtcgtgctatccacctccggtgacaccaccagattggtctccaagtacaagccaaacgttccaatcgttatggtgaccagaaacccaagagcggccagatactgccacttgcacagaggtgtcttcccattcgtctacgaacaggaggcagctgatgagtggaccgatgacgtcgaggccagattgaacttcggtgtggagaagtccaaggagcttggtatcctgagcgagggtgacactattgtcactattcagggtttcgcgtctggtgttggccactctaacaccttgagggtgttgaccgtctaa

SEQ ID NO: 7455 - protein, 501 aa, Ashbya gossypii
MESRLGWLTRLNYDTGSALRRTSIIGTIGPKTNNPETLVELRKAGLNIVRMNFSHGSYEYHQSVIDNARKSEELYPGRPLAIALDTKGPEIRTGTTVDNVDYPIPPNHEMIFTTDDQYAKSCDDKVMFVDYKNITKVIEKGRVIYVDDGVLSFEVLEVVDDKTLKVKSLNAGKICSHKGVNLPGTDVDLPALSEKDKSDLRFGVKNGVHMVFASFIRTAGDILTIREILGEDGKDIKIIAKIENQQGVNNFDEILKVTDGVMVARGDLGIEIPAPQVFAVQKMLIAKCNLAGKPVICATQMLESMTYNPRPTRAEVSDVGNAVLDGADCVMLSGETAKGIYPINAVKTMAETALIAEQAIPYVPTYDDLRNLTPKPTPTSETIAAAAVAATFEQKAKAIVVLSTSGDTTRLVSKYKPNVPIVMVTRNPRAARYCHLHRGVFPFVYEQEAADEWTDDVEARLNFGVEKSKELGILSEGDTIVTIQGFASGVGHSNTLRVLTV

SEQ ID NO: 7456 - DNA, 1461 bp, Leptospira interrogans
  CDS (1)..(1461)
atgaagagcgaatcctccgtttttagaaaaaccaaaatcatctgtacgattggtcctgcgacctcagataaaaaaatgattcaggctcttgccgaagccggaatgaacgtggcacgattaaacatgtctcacggaaaccacgattttcatagaagtatcattcgtaatattaagtccctcaataaggacgtgttgaaaaatccgattgcgattttactcgatacacaaggaccggaaattcgaactggagatcttcaagtagatcatctggatttaaaagtaggtgagacctttacctttcatatcattccgggggaagaatctgaagaacaatccgtatttgtaaactataaggatatagttaaagatttaaaagtaggcgatccggtaaccgtagataacggtttaatcaatcttgtagtagaggaaatcaatgattctgctcttaagtgtaaggtgttagacggtggaagactaggttctagaaaacacattaatcttccaggaattcgggttaatcttccctcgatcactccaaaggatcataaggatattctattcggattagaagaagatgtagattttatcgcactttcttttgttcgttctgtggaagacattaatcaattaaaacaaattatagaagagaacgatggacacgcgcagatcatcgctaagatagaagatcaagaagcggtgcgtaatatgaaagaaatcgtggaagccgcagacggtgtgatggttgcgagaggggatttgggggttgaagttccaattgaagaattgccgatcttgcaaagagctatcattaaagaatgtgctctcaaaggaaaaagggtgatcgtagcaacccatcttttagaatctatgattcataatccttcgcctacgagggcggaggtgaccgacgtcgctaacgcgatttatgaagaagcggacgcgattatgctttctggagaaaccgcggccggtaaatttccgattcgttgtgtggaaatgatggataagatcgcacaacgtgtagaaaagactggcggtgtagattacgttaaggataaaattccacaggataaaaaagagcagatggcaagggcggctgcaaaacttgcagattctttaaagtgtccggcgattatagtaattacaagaagagggaccaccgcgttgaacgtggcgggttttcatcctcattatcctttgatttatgcgtttacgaatatgacaactgttaggcgaaagctctggttgactcgaggagtgattccgcatagaatcgatttttccaaagatccggaaaagacgattcgactcgcgatcgaaactttgaagaaaacgggaaggatcgaggatggggatcaagttgtgattctgtcagacatcatcgcgggcgaagatcgtgtggaaacgattcagattcgagaagtaaaaacgtattttaatgtggaagtggaaaaactttga

SEQ ID NO: 7457 - protein, 486 aa, Leptospira interrogans
MKSESSVFRKTKIICTIGPATSDKKMIQALAEAGMNVARLNMSHGNHDFHRSIIRNIKSLNKDVLKNPIAILLDTQGPEIRTGDLQVDHLDLKVGETFTFHIIPGEESEEQSVFVNYKDIVKDLKVGDPVTVDNGLINLVVEEINDSALKCKVLDGGRLGSRKHINLPGIRVNLPSITPKDHKDILFGLEEDVDFIALSFVRSVEDINQLKQIIEENDGHAQIIAKIEDQEAVRNMKEIVEAADGVMVARGDLGVEVPIEELPILQRAIIKECALKGKRVIVATHLLESMIHNPSPTRAEVTDVANAIYEEADAIMLSGETAAGKFPIRCVEMMDKIAQRVEKTGGVDYVKDKIPQDKKEQMARAAAKLADSLKCPAIIVITRRGTTALNVAGFHPHYPLIYAFTNMTTVRRKLWLTRGVIPHRIDFSKDPEKTIRLAIETLKKTGRIEDGDQVVILSDIIAGEDRVETIQIREVKTYFNVEVEKL

SEQ ID NO: 7458 - DNA, 1519 bp, Bombyx mori
  CDS (130)..(1341)
ggacggttcgcgctctcccgacgtggaattcaatttttcactcggaagggcagttcaagatcacgtaaaccgcccgtcagtcgtaaccgagagctcacagacaaatatcttcactataatccattaaaaatggtttaccctactattcacgatggcgaaatcgaggcgggtgcagttgaaaagcccacagtcgccaacgtcggctcccagctccagcatatgtgcggtctcgacattgactccaagtcttcgtacatccgtctctccggaataatctgtactattggaccggcatcccgtaatgtagctgtgctagagaagatgatggagacgggaatgaacgtggcaaggatgaacttctcgcacggttcccatgagtaccacgcagagaccattcgcaattgtcgcgaggccgagaagagttacagcgctaaactaggttcacccttctctttggccatcgcattggacactaaaggacctgagatcagaactggactcttggaaggcggcggctcagctgaagtcgaactgaagaagggagagaccataaagttgacgacaaatccggattatcaagagaaaggcaatgctgatacaatttacgtggactacaagaacataacgaatgtcgtgaagccaggaaaccgaatctttatcgacgatggcctcatctctatcatctgtcagtcggtcagcgctgacactcttacgtgtaccattgaaaacggaggtatgctcggatcccggaaaggcgtcaacctgcccggcatacccgtggacctacccgcagtctccgagaaggacaagtcggacctgctcttcggcgtcgaacaaggcgttgatatgattttcgcgtcattcatccgcaacggcgccgcgctgcacgagattcgcggcatcttcggcgaaaaggggaagaacatcaagatcatctccaagattgaaaatcaccagggaatggtcaatttagacgagattatagctgaatccgatggtatcatggttgctcgtggagatctgggtatcgagatccctccagaaaaggtattcctcgcccagaagaccatgatcgccagatgcaatcgggttggaaaaccagtgatctgcgcgactcaaatgctggaatccatggttaagaagcctcgtcccactagagccgagatctctgacgtggccaacgccatcctcgacggagctgactgcgtgatgctctccggggatactgccaagggcgactaccctgtcgagtgcgtccacaccatggccaacatttgcaaggaggctgaagctgtaatctggcacaggcaactcttcaacgaccttgtgtccgaggtttgaagttattttctcttcttataggtagttataagttaccgggatagactaatggtaccctggtgtcgttttttgtattatgctattcaaaagtgattcaagatcatgacacataactataagacaatagcaggaagaataaaccaaagaggaaaattaaaaaaaaaaaaaaaaaaaaaaa

SEQ ID NO: 7459 - protein, 403 aa, Bombyx mori
MVYPTIHDGEIEAGAVEKPTVANVGSQLQHMCGLDIDSKSSYIRLSGIICTIGPASRNVAVLEKMMETGMNVARMNFSHGSHEYHAETIRNCREAEKSYSAKLGSPFSLAIALDTKGPEIRTGLLEGGGSAEVELKKGETIKLTTNPDYQEKGNADTIYVDYKNITNVVKPGNRIFIDDGLISIICQSVSADTLTCTIENGGMLGSRKGVNLPGIPVDLPAVSEKDKSDLLFGVEQGVDMIFASFIRNGAALHEIRGIFGEKGKNIKIISKIENHQGMVNLDEIIAESDGIMVARGDLGIEIPPEKVFLAQKTMIARCNRVGKPVICATQMLESMVKKPRPTRAEISDVANAILDGADCVMLSGDTAKGDYPVECVHTMANICKEAEAVIWHRQLFNDLVSEV
